United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 5

SEQ ID NO: 16663 - DNA, 717 bp, Glycine max
  Peptide Sequence Number=SeqID_133441
atggtagctgctaaaaagattatgggcatagagatcaagagggatcgagtccaaaagaagctttttctatgccagaaggaatatattcatctcatgtatgctatagtatgcaccatatcgaaccgagcacaagcagtcaatgttgagagtaggtatatgggaaatcctaggaagaaacattggcaagctatgaaacgtatatttaggtaccataagggtaaaattgatattggactcgtctaccatggagacatgtcctgtgctcttgttggttactcagattctgactatgctacaaatttggatgcaaagagatatgtgattaggtatgcattcatgattcacaactctctttccagttggaaggcaacacttcaacccacaatggttttatgcactatagaggtagagtacatagctttggtagaagcaacaaaggaaggaatatggttgaagggtctgattagcaatcttgggtttccacatgaaaagactatcattttatgcgacaatcggagtgcaaaatatttagccaacgatcaattacatcatgagacaactaagcacattgacatcaaataccacttcatccattctgagaagaggttcaaagtccagaaagttgatttgatggagaatccagctgatatgttcacgaagcctattccaagaagcaagttcatgcattgtctggatctacttaacatagattgctag

SEQ ID NO: 16664 - DNA, 420 bp, Glycine max
  Peptide Sequence Number=SeqID_133442
atggcgccgcatcatcaatatttccacggcctggcaagattcacgctgcctggatacagcgcttacgcagccatgaaaggcggtattgaagtattgacgcgttatatggccaaagagctgggcgcacgccaaattgtggtgaacacggtagcacctggtgcgattgaaacggactttggtcagggccttgtgcgcgataacaaagaagtgaatgcctatattgcttcgcaaaccgcacttggtcgtgtcggtgtaccaaatgatattggcccaatgattgccagcctgttgtctgaacataaccgttgggtgaatgcacagcgcattgaagcttcaggcggcagctttgaagctgcctgtttttttactgcgcttgctgatcgagaaggggtgtcgccagaccagacttttgagaagtaa

SEQ ID NO: 16665 - DNA, 372 bp, Glycine max
  Peptide Sequence Number=SeqID_133443
atggaaagaggaatggtggcaggaatcgatagccgagcagcgggaggtcaggctattgccagaagtgacattgatcccgccatcatctatgccgaaattttgcggcgcgatgaagatacgctgtctatcctcaatgcattacgcaatccagcctcgtcaaacgaagagaaatcgcaactggtgcgcgcaggctttgaacgtatgcaaaacagcccgaatccggcttaccaggcttatatcgataaattaacgcagcaaacctgcgaaaccatcgcaaacctgcaagccagtacaactgtaaaacaacgcttgcatgcgcaacaatgggtagaagattacaagacgcaattcacccagctacagagcaaatga

SEQ ID NO: 16666 - DNA, 825 bp, Glycine max
  Peptide Sequence Number=SeqID_133444
atgacagccacgtgcggacctatattcaagttgcttcgaaaagatcaaggggttatttggaccgaagattgtcaaaaggcttttgatagtatcaagaattatctgctagaacctccaattcttatacctccagttgaaggaaggcctttgattatgtacttgactgtgttagaagattctatgggctgtgtactcggacaacaggatgagaccggaaggaaagagcatgccatctactacttgagcaagaagtttacagattgtgagtccaggtactccctacttgagaaaacttgttgtgcactagcctgggctgctaagcgtcttcgtcactacatgattaaccacaccacctggctaatatccaagatggacccgatcaagtatatctttgagaagcccgctctgacaggaagaattgctcgttggcagatgttgttatccgagtatgatatcgaataccgcacccagaaggcaattaaggggagtgttcttgctgatcatttggctcaccaaccaattgaggactatcaacccatcaagtttgactttccggatgaagagattatgtacttgaagatgaaggattgtgatgaaccattacttggagaaggtccagatcccgagtccagatggggtttgatttttgatggagccgtgaatgtctttggcaatggaattggggcagttattatcactcctgaaggtaatcatctccctttcgctgcaaggttacagttcgattgcaccaacaatatggcagaatatgaagcatgtgtcctgggcattgaaaaagccatcgacttgagaatcaagaacctttga

SEQ ID NO: 16667 - DNA, 186 bp, Glycine max
  Peptide Sequence Number=SeqID_133445
atggagcagccaagtgcgcttgttctgtcaggatgggagtttctatgccttaacagcagtgtacagctattcactaggtttggacccttatccttggaagttggaaccacagtcccatttcccaccttacactctcatctacggttggtattcattgtttctgcacgtgtcctgttgaagtactaa

SEQ ID NO: 16668 - DNA, 108 bp, Glycine max
  Peptide Sequence Number=SeqID_133446
atgacttatgcaaatgcaagaatgacatgttcattatgttggcatgaagagatgcatgatgtgatcaaggaacaagccagagtgtcatgtatgaacggagcaacctaa

SEQ ID NO: 16669 - DNA, 477 bp, Glycine max
  Peptide Sequence Number=SeqID_133447
atgcctgttagttcttcatttaaattgaactattctgccaagaccaagaaaaaggatgatgatatagtggatctttcctcctcccaaactccttctcaaatcggtgataatgagatttggacatactcgtttcgacaatggatgccagcaacaccagagcaaaagagggtcaagacgaaaaagatgatactcaaagccataatgaatcctctccatcaaagcaaatttatcattgaagaacctcctattgtggatgcaagagatattcaaagagaaacaaatccactagatgttgatctattcactttcatcaacatttggtcctatgattccatgcccttgaaagcttttgaatctagtcataacagaccattcactcattttgacgaagttgtggctaagtttcaaaggctagcgtttgatcaacctcttgaagactctctttctaatccagattacaagcctcaacttcagtag

SEQ ID NO: 16670 - DNA, 228 bp, Glycine max
  Peptide Sequence Number=SeqID_133448
atgctagctgcctacccccttcaacctcctctatgcacccgcactatccacaagatggagaagacactcgtcgagctccgtcttttctataattaccagcttcgccacctcggccccgctgccaagatctttgcccttgacctctcgttcaggaagaatctatgcgttaacctgtgggttctcgccgctgagaattgtgactcagtggacgccgatgccggaagctga

SEQ ID NO: 16671 - DNA, 306 bp, Glycine max
  Peptide Sequence Number=SeqID_133449
atgaagggacttgttgatgtagctccatgtggagcttgtaggccttggatcttcttcatcaatggagtcctttacttcttgaaaatcaatggcagcggaatggagaaggaggaaagcccactaatccaagatcaagtccaagattctccactaagtgtgtctcggtgtcatggggcatcccatgggtccaaaatctaccctaaggctcatgagaatcctagggcattttcctgcatctctggcccaatcttcttggattctcctagccatggctctggtgatgggtcccttccttggaaggattga

SEQ ID NO: 16672 - DNA, 969 bp, Glycine max
  Peptide Sequence Number=SeqID_133450
atggggaaggagctaagcattgcaatttcacttgatgaaaacttcaaagaaaagccgacagcaactgctcgtagacaatgggcagttacaactgttgctgaggatgttgatcatactgctaacgaggttcatgaggagcctcaagagccagttattgatgatgaacgtactgagttaaagttggcctctcatgagaggaaggtagagaaatttggaaggtctacacttgagattgaaggcataaggtggcacaaggaaactagtagtttccatctaccagtaggagaggtcactataatcctcgatgatatggcatccttgttacatctgcccgttataggcgccttctataccttcgatgctcttgatgtagatcaagttgtggacttgattatcatgaaaggaaaccacgtgcttgttgatggaagtctagaaaggcattaccagtgtcgatgtatcaccattcctccacacattgttgctccatccttgtctatagaagagattgatgatagatggcttcagttttcagaataccttgcaccggttggacagatttgtagtgctcatggacagtgttcaccagactacatggaacggttctataggatatctcaccccttcatgagtttgacacaacctagggagcctcctggaaattcacccgtggtgcatgatgatacatttattgtaccagatcctcctcagcaagtcatcgatgcagcagctacaccagaaccacctgcacctacacttgcagctgctgatgtagatatgcctcgacgtgtagtggacgcttgccaaaggatagcaaaaagtttggaacacatgatcaacatgagaattgttactgttggaactgaagcatacactctgacccaacattgtctaagattggccaggggtgccattgagcaacataatgtttatgttcggtcaagacgaaggagggatacacaggacacatga

SEQ ID NO: 16673 - DNA, 756 bp, Glycine max
  Peptide Sequence Number=SeqID_133451
atgcctgaagtcactcatgaagacatagtgaatgtgaaaagagcaagaaagcacactcttgtatccaaatatgaagcgtttcaaatgaaaaatggagaaaccatttcaaaacttcaaacaagattcactcatattgtgaaccatctccttggtctaggaaaaacgtttgaagataaagagctgaacatcaacatcctcaattgtcttacaagaacttgggaacattacaaggatagttcctgcagtgaggaagatgcaaataatttcaatttgatggtaagaaaatttggaaaatttctcaagaagtccaaagatagaaaattccctaaatcctccaagaagattgagaacaacaacaacttcacatgcttcgaatgcgataatgcgtcaacaacctctaactcatcagtcattgaagaaactaaggtaaatcctgaatttgaagaagttttggaagcatttaatgaaattgatgcaatcctccctaggaagggactagttaccagagccatgagcaagaggctccaagaggattgggctagagctcttgaagaaggcccgagggttctcatgaacctcagggctcatcttctacttgaagtggcgtctccattcatctttctccttctccattctgctgcaatcagacctcaagaagcaaaggaatccattgatgaagaagatccaaggcctagaagctccacatggagctacatcagaaatgcatcaagaagctctatgtcttgcctattttga

SEQ ID NO: 16674 - DNA, 399 bp, Glycine max
  Peptide Sequence Number=SeqID_133452
atgctatctttcaatgttgttaatggtggatggcgattcatagcggaaagtaaaaaatccgtcataaaaatatggcagatacagggattgggatctcttaagctacactttccagatgtacctgtcatggcattgactgccactgcaacgcatgcagttcgtgaggacatcttgaaggctttaagaattccccatgcacttgttcttgaaagaagctttgaccgaccaaatttgaaatatgaagtgattgctaagacaaaggagccaataaagcagcttggacagctgaatgccggagacaaactttactcaaacattttggagaatcttttgatagaagagactgcaagtatggatctagcccctgtgataactgtctcaagactgtattgtgagtag

SEQ ID NO: 16675 - DNA, 678 bp, Glycine max
  Peptide Sequence Number=SeqID_133453
atggcacggtctggtttccagcaaggtaagctaaacacaatctgtttggcgcccttgaaagtttgcaagcccgatccgaggttgttgaaggaattcgtagttgttaaaggactctacagttccagagaactggacaacgggatttgcggtgcggtggggattattggggaccgaattggtgctgctcgttacagaagaagggttgggaataatatcagagttgttggttgtgctgcttcgtacgcttgccattgcttccattttccatgttgcttaattaatttcttggttcatattcaacttgtagggatttggctttttgatttttcctttcttgttatggatccaagagaaaccagactatgtatgagtgaatgtctcgaggtaaaagcacgaagcggacatgcgatggttaagggaggagaatgtgaacctcaaagcaaggctttgttatccatcatccacctccaccaccaccaaccccaccacactatccatcctttcaagcacctacacatgcggaaaccaggaaccaaaaaaatcatacttagttgtcctcctacggtaatcaggaggaaacctcaatccactccagacttaagtccctcaatatccacaatgatgtcattcacttgtacccgtttgttgatggcatcatggacatacctctacccataa

SEQ ID NO: 16676 - DNA, 246 bp, Glycine max
  Peptide Sequence Number=SeqID_133454
atgcaacacataaaaaatgaagacagaatcacaattgtctcttttttcacagaaacttccccccttagcaactacacgctgaatagcaaagggagcaaaacttatccaaagtatagtgacaataaaacttcaagggagcacagagaaagtgaaacagaaaagagtaaggaacggagattgagaaagaaaggggaagtgaagagaaatgggtaccgggaagatgcagaggcagaagaagcagagtga

SEQ ID NO: 16677 - DNA, 1263 bp, Glycine max
  Peptide Sequence Number=SeqID_133455
atggatcctgctctcaagctctgcgtcttgttactcattcttctcggattagtgaatggttcttttgcggaaaatgattatggacgctgcgaaagcgttgttaagagttgggcgcgttcttcgctcgatgaggaaatgacaaaagatgataagcacacattaagagatttgctgttttttctgcatgttcctagaacgggagggagaacctattttcactgttttttgaagaaattgtatcccagctatctggagtgtcctcgctcgtatgataagttgcgctttgatccaagtaaaccaaaatgcaggctgttagttacacatgatgactatagtataacgtccaaacttccaagggagagaacttctgttgttaccatacttagggatccagttgaccgtgtttttagtacttatgaattctcaatagaggttgcagctagatttttggtgcatccaaacttgacgtccgcaacaaagatggctttacgcctaagctctaagactaaaggagtaagcacactggatatctggccttggaagtatctggttccatggatgagggaagacctatttgctaggagagaagctaggtacagtaggggactgaatatcattgaaagcaatgattcttatgacatggaagattttgcaatgccattacaagaatacatcaatgatcctgtggctgtggatgttgtacataatggagccacattccaggttgcaggtttgacaaacaattcttatatagcagaagcacatgaagtgcgccattgtgtacagaaatataagactcttggtaaatatgtgctacaagttgcaaagcatgtgcttcagtgcttgtacatcttgcagaagagactggatgagatgttatatgttggtcttactgaggagcacagaaaatctgccacaatgtttgcaaatgtggttggtgctcaagtgatatcacaacttaatgcaccaaacactagcctggaaactactgataagacagaaaggagttcatttacggataatgatcccgatagcagtgaacatcagaatagtaccttggacagaggagaaagtgcggttacttcaagtgaagggggagaagcaacagaatttaatatgactgttggagaactaatggatgcttatgaagtctgcatttccaatttacgtaaggcccagtcacgccgacgcatctcttctttgaagaggatttctccagtgaactttacaaaggaggtggtgcctgtatttcaagctatttag

SEQ ID NO: 16678 - DNA, 2805 bp, Glycine max
  Peptide Sequence Number=SeqID_133456
atgggattcggtcgaaattcgacctcaagaagcggagattacttggaaggaatgcttaacgactatgttggaggaaggaacaaactgaaggctcagaagagcgccgccacaacaacgaagtttgtggcagtgctcacgtgccttcagtttttctttgcagtctatgcaacattcctattgtattacatgggcccttccattgatttaagaaccaagccagagttcacatgggcaacaaaaattgcccaacaatggaagcaactcatcatcacgccccatgttgttggccactaccaagaagctgcttcctctctcatcaaggaggatcttcttcccacaactccttcccaagtgtgtgagaatgagaagatagacttcatgcaaaagaagtccaatgatgtccaaatgatcaagataaagagagagctctatgatgaggtgctgagcttccaaagcaaaacctttggctccgagactctccaagagctaatttcaatgaaatccaaatgggacttgaaaggtccaaacaggccaaagatcacggttttgctaaaccacttcaagagaaagacactttgtgctcagctcgattctttgctccaacaaaccctcccttttcatcatgtttgggtgctttcatttgggagccccaatgaggcctcattgaagagaattgttgacacctataacgactcaagaatcagcttcataagctcaagctacgatttcaagtactatggaaggtttcaaatggctcttcagactgaatctgatcttgtgtacgttgttgatgatgacatgattccgggaaggaagatgttgcagattttggcacatgttgctgggacagacaagtacaagaattctgtcttggggagtattggaaggatattgccctttagacagaaagatttcacctttccaagttacagaaaatttcggtctaaggaggcagggttgtatttgcctgatcctgcttatgatatcactgttgataaaattgtgcaggtggattttctatcaagttcatggttcctctctgctgatcttgtcaagacactcttcactgagacaccttttaccttctcaactggtgaagatcttcaccttagctatcagcttcagaaatacaaaaatgctggttcatttgttcttccagtggatcctaaggacaaggaaacatggggtgatagtgagcacaggcttgcatatgtgtctgaaaccacagtgattttcaaggatgtagttcaagtcagagatgatcaatggtggaaagcactttccacaggctatgtgactcaatgggctgcaatgtaccctcaaaaaattgatgcactcttttatgctcactcagttgatgaagtaaaaatgcttgcaccacttcttgaaaagttcaggtccacagttggcaagaaggcctacattgttgtctctggaggcaattactgcccttgtgaagatgctgcaagagctctcaaatggcctgcattggtctgcaaagaacgccggtttaagatttttgacttggccattgaagcactttctggggtgtcagattctgaggcaccagtgatacatgcagtgtacaccagcttgaagggtttgatcaaaattcacaatcccagtgtagtgatcagtctggctgacattgaccctcatgtgagaaaagctctcaagatggcctcagaaaccaactcaaatgacaccacattggttcttttaccaaggtcttcagtttctcaagttctttggatggctgatctgcgttcaacagcattgccaaactggaatcggatgagggtttctgtgaacatcatcacccaaaatagagccaattcactagcaaggcttctcaaatctctcagcaatgcctactatctcggagatgaaattcccattaccttcaacatggatagcaaggtagatgaggcaactataagactagtaggttcatttgagtggcctcatggacccaaaaccctgagaaggagaatcgtccaaggaggtctaatccgcgctgtgagtgagagttggtatccatcttctgatgatgactttggactcctactagaagatgacattgaagtttcaccttactactacctatggatcaaatatgcactcatggcttaccactatgaccctcaagtctctctacctgagctctcatccatttcactctacactccaaaacttgttgaagttgtcaaagagaggccaaaatggaatgccacagaattcttcaaacacatccaccccaacacaccttaccttcaccaactaccttgcagctggggagcagtgttcttcccaaagcattggagagagttctatgtgtacatgaacatgaggttcactgaggatgccaagtccaacccagttcaaattccaaagtctagaacaaatggatggcaagcttcatggaagaagttcctcatagacatgatgtaccttagagggtatgttagtctctacccaaatttcccacaacaagcaagcttttcaaccaaccatatggaaccaggggcacatattagtgctaaagacaatttggttaagcataacaaacaggactttgaggtgccactaatgaaagaagactttagaaactttttgccagcaatgaaaatgccttcagcatcaaggcttccatctcttaacctcttcaatcaaccagtttctctaaagggtctcaaagctgctggagctaagttgggacaggatgtgcttagatgtgacaatgccactgaggttgttgctgttgacaaagatactggtctaccttacacttgctccaaattctga

SEQ ID NO: 16679 - DNA, 312 bp, Glycine max
  Peptide Sequence Number=SeqID_133457
atgagcagagtgagagccgagaaaccttcatctgaaatgtggaagatgcagtataactggcatctgcggcgtctgaatgatgtttactcctcgcttttactcattttgtattattttgtgggttcatcaataccttcagcattggtactgtgggtaatgagagaattaccacctgaagaagctgctagcatatctgaagaatcaagtacaatagcttttgttgctgatagttcaattgcaatccatcatcctcaacgctggactacagcaacaagcatgcagaatcagacatcaagagcgagtcctatatga

SEQ ID NO: 16680 - DNA, 303 bp, Glycine max
  Peptide Sequence Number=SeqID_133458
atggaacttttttatgcattgacaaatcgtttcaaggcacgtcttcaggttcctgaagagattctccacaagatacggtctcttaatgaccttgacttacagctctatgaatatgcaaaagccattttcaataaacaacataaaacctcattgctgattactgaggagagttgggacaacatatcaggcagtgcatatggcctctggagggtcgttacgctagcaattacttgtgtcttcttcattttcttattcttactaattgtaaatgtgagaagaagaacgtccaaagttaagaagtga

SEQ ID NO: 16681 - DNA, 420 bp, Glycine max
  Peptide Sequence Number=SeqID_133459
atggctggtgaaataggtgctacagctaacgtggagcatgtttcgccattagcactggcgaaacatcatgcaggggtagcaagcaacttttcagaaggtgtcgccattaacagtggcgaaataccttttcagaagggtatcgccattaggagtggcgaaataagcttcgtgattatgcttgtgttgtgtggtagtttcagttgtgctgttcttcagtccatatttggttgtctcaaacttgcaacaaagcatcaatttgcaacacaggagtttcatattctcccgtcaagtgttgaaactcaaggcataggcagacgaagggaggttgttgaagcggaaccatatttctacccacagatggaagagcgtggtcgtggaatgtattacacaccaccaacattttctcagtatccgacatag

SEQ ID NO: 16682 - DNA, 1785 bp, Glycine max
  Peptide Sequence Number=SeqID_133460
atgttgtacccttcagtcatttcaagtttttcgttgggtggtggtggtggtggctgtagtagttattatgtgccatgtgaattccttgtgcttttggatgtgtcatctgataataaggtactgcctacaacatatggtgaattgagacctccgcttggcaagcatcgattaaagatcgtggaatttattgcagtacttctaaaaactggaaatgaagtggcagaaaaagaattggccaactcaggaaccattcgacgagtcattgatcttttctttgagtatccatacaacaactcattacaccatcatgtagaaagcatcatatcatcatgcctggagagcaaatctaatgccatcattgatcatcttcttcgagattgtgatttagttggaaggtttctccaggcagataaacattgtattctttcagtggaaagcagtcagcacacagtacctgctgctggaaaacggggaacacgtgtaggaaacattggacatattactcgaattttcaataaacttgtccacttggctcgtaaccaaagccacattctggcatgtctccaggagaatagcgagtggaatgagtggcaagctacagttcttcagcagcgtaatgtggtcgagaatgttcaccgttgggcttgtggacgtccaacttcattacaagataggatgagggatagtgatgatgaagaccttcatgacagagactatgatgttgcagctttagcaaataatttgagccaggcttttagatacaaaatttatggaaatgacgataatgaagaggaacatggtggtcttgatcgagatgatgaggaaactaggtattttatgacagaaattagggagaaacccttgttacaaagatcagaatcacaggatgtctactttgacgatgattctgctgaagtagtcatatcttccctgagacttggtgatgatcaagggagtaatctgtttacaaactccaactggtttgcattccaagacaacagaattggtgatgcacctgggggtacatcatcctctgagatgatggatgagataaaattgaatgcagctgcaaatggtggtagcaacagtagtgatgatgaggtagtggtcggagaggatgaagaattggtggacagcaaaaatactgtgaatggtacatctagctcaagcacagacttctttagtggattaactggcagtgattccttgaatgggggcactctaaacattgaaagtgagaagacaagtccttcacatgatatgggatttttcaggtttgaggcaccagacaatgaggacttgtttggagatagacctttacctgattgggttggatggggtgaaccatccgaaatgcaagatgctggttcaagtatgaacccctttctggataatgacgagtctggtagtaatttgcctattaagcctcaagaaggtagtcctaatctgagttctccttcaaatggggaatccataccttcaaatgggtcaccaactactagcgattcaatcaatgggagcagtgactccagtccaacatctgtagcggtaccctcactatttgaagaggatgtggaatttgtaggtgtagaattagaaggtactgagaaggcaatggaccaggctctcaaagaaggggtagttggggaagcaggaccactgaaaagaaacgtagtctcaaaagttccagaaaaggaaaattctgaagaaggcagtcctggtgtgaaggagttcaacgatgcaaattactggagggttgacaacgaggttgctgttctagagtga

SEQ ID NO: 16683 - DNA, 2382 bp, Glycine max
  Peptide Sequence Number=SeqID_133461
atggatttgagcgaggaagttagggcagctcacaagcgagaattctccgatttcttagatcaagatgttggaaagggcatatacatggacgaaatcaaaaccctaatcaaccacaagcgtcaccgcctcatcgtcaacatctccgatctccacaacttccgcgacttgggtaacaggattctgaggagtccaagtgagtacatgcagccgttctgtgacgcggtcacggaggctactcgtgctatcgatcccaagtatttgaaggaaggggaacaagtgcttgttggatttgaaggcccttttgtttctcgccgtgtcacgcccagggaacttctctctgaattcataggttccatggtctgtattgagggcattgtcactaaatgttctcttgtaaggccgaaggttgttaaaagtgttcatttttgccccaccacgggaagcttcacttctcgcgaatatcgtgatattacatctaatttgggattgcccacaggatctgtttaccctacaagggatgaaaatggcaacttactcgtgactgagtttggattgtgcaaatacaaagatcatcaaactttgtccattcaagaagttcctgagaattctgctcctggtcaactcccaagaacagtggatgtcattgcagaagacgatcttgttgattcttgcaagcctggagatcgagtggcaattgtggggatatataaggctcttgcagggaaaagcaaaggcagtgtgaatggagtattcaggactgttctcatagccaacaatgtttctcttctcaacaaagaggctaatgcaccaatctacagtgctgaagatgtcaaaaacattaaagagatagctgcaagagatgatgcatttgatctgctaagtaattcacttgcaccttctatatatgggcattcttggataaagaaagcagtggttttgttgatgcttagtggggtggagaagaacttaaagaatggcactcacttgcgaggtgacatcaacatgatgatggttggcgatccctctgttgccaagtctcaactcttgagagcaattatgaacattgctcccttggccatatcaactacaggccggggttcttctggggttggtttgacagccgcagttacttcagatcaagaaacaggggaaagaaggcttgaagctggggcaatggtgcttgctgacagaggtgttgtctgcattgatgaatttgacaagatgaatgatcaagatcgtgttgctatacatgaagttatggagcagcagaccgtgactattgccaaagctggtatccatgcttcactgaatgcccgatgcagtgtggttgcagctgcaaatcccatatatggaacttatgatcgttcattgactccaaccaaaaatatcggactcccagactccttgctttctcgatttgatctactttttattgtgttggatcaaatggatcctgatattgatcgtcgaatatcagagcatgtccttcgtatgcatcgatttcgttctgctgttgatggaggtgaggcagcacttgatgggagctcaagatatggaagagaagatgaagctgatatggactcatctgtctttgtcaaatataacagaatgttacatgggaagaaaactggaagaggtcaaaaacgtgatacgcttacaattaagtttcttaaaaaatttatccactatgctaagcataggattcaacctgaactgactgatgaggcatctgagaacattgccacggcctatgctgagctcagaaattcaagttcaaatgcaaagactggaggaacacttcccataactgccagaactttagaaaccataatacgtctctcaacagctcatgccaaattgaagttgagcagagagactttccaattgagccagtacttgtcttgtcaggtttctaagtctgatgttgaagcagctttgaaggttctaaattttgcaatatatcacaaagaactgacagaaatggaggagcgtgagcaagagagggagagagagctggacaggaagcgcaaggctgatcatgatgaaaatgatggtcctgatcgtggtcctaaagatagaagaggtcctaaagataaaagagggccaacatcaacggatgccatggaagtagatgataactcagcaactcatgctgctgtcggacccacccctgaaagaattgaagaatttaattctctatttaatcagcatatgcatgccaaccgcctggaacaaataactattgcaaacttagggaatgttatcaacagagggcaagatccaccaccttacagtgctgcagatatactactcctattagagaggttgcaagacgacaatagagtcatgataactgatggagtggtgcatatgatatcataa

SEQ ID NO: 16684 - DNA, 210 bp, Glycine max
  Peptide Sequence Number=SeqID_133462
atgagtattccgcccgtcaaactggcgatacaggcagtcacgtggagagggtttcgccattgtcattggcgaaacacctcaggtagtacaggtaggctcctaggtgcagcaggcatagcagggagggcgcagtgttgcatgcacatttcgccattaccatgggcaaaacaggtatatgatgaattcggttattttgatgctttgttctga

SEQ ID NO: 16685 - DNA, 942 bp, Glycine max
  Peptide Sequence Number=SeqID_133463
atggctgcgactctcactgctgtaagaattcccactttccaccaacgccatctcagaaaacatttcactgcaccttcttcttccttacgcctcctcaatctcgcaaagatggaaggaagtgagatcagtgagcaagtgggagaggatttgggagcaaagaagaaagtttttgtagctggagccactggtagcaccggcaaaagaatcgttgagcagttactcgcaaagggctttgctgttaaggctggggttagagacgtcgacaaggccaagacaaccctttcatctgccaacccttctcttcaaattgtgaaagctgatgtcacagagggttctgataagctagctgaggccattggtgatgattcagaagcagtagtgtgtgccacaggctttcgcccggggtgggatttgcttgctccatggaagatttgcaaatttttgtgttgccatgtgctttcagttgcggaattttcaagactttcacttgtgatttttgaaggggttgacaattttggcacagtaaacctcgttgaagcatgcaggaaacgtaatgttaacagattcattcttatcagttccattttagttaatggagctgctatgggacaattattcaatccggcttacatctttcttaatgtttttggactcaccttagtagcaaaactacaggcagagaaatatatcaggaaatccggtataaactacacaataataagacctggtgggttgagaaacgatcctcctactggaaatatagttatggagcctgaggacaccctttatgaaggttccatatccagatctttagttgctgaagtggctgtggaggcattggcttatcctgaggcatcttataaagttgtggaaatagtgtctcgccctgatgctcctaaacgcccgtaccatgacctttttggatccataaggcaacaataa

SEQ ID NO: 16686 - DNA, 2094 bp, Glycine max
  Peptide Sequence Number=SeqID_133464
atgaaggaaggtgagaaggtattggatccgcagctatggcacgcgtgtgcaggtggcatggttcagatgccacaagtgcactcaaaagtcttctacttcccacagggtcacgccgaacacgctcacacaaccattgatctgagagttccaccgttcatcttatgcaacgtcgaagccgttaagttcatggcggacccagaaaccgaccaagtgttcgccaagctgagtttggttcctctaagaaactcggaactcggtcctgactcggactctgctgctggtgatgacgcggcggaaccttcttcttgtgaaaagcctgcgtctttcgccaagactctgactcagagcgacgccaataatggtggggggttttcggttccgcggtactgcgcggagacgattttcccgaggctcgactgcacggcggagccgccggtgcagacggttgtggcgaaggacgttcacggcgagacgtggcggttccggcacatttaccgggggacgccacgtagacacttgctgacaacagggtggagcagtttcgtgaaccagaagaaactcgttgctggggattccgttgtgttcctaagggcagagaatggtgatttgtgtgttgggattcgaagggcaaaaaagggaattgatgagggttcaggtttagcttcatcttctgtgtggagttcagcttcagggtctggaattgggcctttttcttttttcttgaaagaagaaaacaagatgttaaggaatggttgtggtgttggtgggaatttgagtggaagagtaaaagtgagggctgaggatgttgttgaagctgtgactcttgctgctagtaacaaggcttttgaggttgtgtattacccaagagccagtactcctgagttttgtgttaaggcttcttctgtgggggctgctatgaggattcagtggtgttccgggatgaggttcaagatggcctttgagactgaggatgctacaaggataagttggttcatgggaaccattgcttctgttcaggttgttgaccccatctgctggcctaattccccatggaggcttcttcaggttacttgggatgagccagatttactacaaaatgtgaagcgtgttagcccgtggctggttgaattggtatcaaacattccactcatcaattttacacccttctctccaccaagaaagaagcttcggccacaacacccagacttcccccttgatgttcaatttccaataccaatgctttcaggcaaccagcatgggcctaacagccccttgtgtggtttttcggataatgctcctgcagggatacagggagccaggcatgctcaatttggaaaatctctatcagatctccaccttaacaataataaactgcagttggggatgcttccaactaatatccatcaacttggaggagtgtatactgggatttcaagtggtaacatgatgaccaaacatgataagagcaaagaaagcttatcgtgctttctgaccatggggaaatctagtaagagtttggagaaatctgatgatgttaagaaacaccaatttttgcttttcggtcaaccaattctcactgagcaacaaatttctagctgttctagagatgtgttgtctcgcggaaaaagatcgctaggtgatgagaaggacaaagcgaaatgcgttttggatgactcgcaatctactctctcacagcagttttcaccaggaaaagcttcttctgctgagttcttttggcaacttggcttggatactggtcattgcaaagttttcttggaatcagaagatgtaggaaggaccctagacctatcgcagtttggttcttatgaagagctctataggagacttggcaacatgtttgggattgaaaggtctgagattttgaaccatgtgctctattatgatgcagctggtgctgttaagcaaactggagaagaacctttcagtgacttcatgaagacagcaaaaagattgacaattctgacagattcaggcagcaaaaatatcaaaagggcctttattacaggaactggtaatggtgaacaaggactagatccatcaaacaaaacaggccctctgagcatatttgcttaa

SEQ ID NO: 16687 - DNA, 287 bp, Glycine max
  Peptide Sequence Number=SeqID_133465
ataacctggctgccaatttcagcagggaattggctgactatattatttacataatagacgtgtctggcggtgataaaattcctcggaaaggtggtcctggaatcacgcaagctgatctccttgtgataaacaagactgaccttgctcctgcaattggggctgatttggcagtcatgcagcgggatgctctgcggatgagagatggagggccatttgtctttgcacagctgatgatcaccaggaatatgccgattcagaaagtacattacgtgaaaggggctgtttga

SEQ ID NO: 16688 - DNA, 946 bp, Glycine max
  Peptide Sequence Number=SeqID_133466
tctgagggatagagctcaggttgagcaattgctacgctacatcatagaagaaccactggaggatgatgaaaacaaacgggtcttcaagtttcccttcatttcctgtgagatctttacatgtgaaattgatgtaattttgaagaccttggtggatgaagaagagctcatgaacttattattctcctttttggagcctgatcgttctcatagtaccttactggctgggtactttagtaaggttgtcatttgcctaatgatacgaaagacagtaccacttatgaattatgttcaagcccatcagcatgtttttcgtcaactggtagatttgataggcattacatccattatggaggttttggttcgattagtaggtgctgatgaccatgtatatcccaattttatagatgtgatgcaatggttggctgagagcaacctgcttgagatgattgtcgataaattaagtccatctatgatccatgggatattctttgacctacctcacatagccattctacacttgcccggtgttaaaagtcctcctgaagttcatgccaatgtagctgaaactttgtgtaccataactcgagttgcatcatctactctagctattaagctttcaagtccaagttttgttgcaaaaattttgggttatgcattggaagattcacaatcaatgtctagccttgtcaactctctttcagtgtgtatttctttgttggatcccaaaaaatcagctatttcatctccactttttcattcattccgaagtcaaaacatgtatgagccaccaattcctgtaaaccccgatactattggtgcaatgttacctaaacttgattttaaagaaaactaccaaaaggtgaaccctagtctacaggagggagttgggagcatgcttttaagcagtatcaggatattctggagcttggtggagccttgccaataa

SEQ ID NO: 16689 - DNA, 690 bp, Glycine max
  Peptide Sequence Number=SeqID_133467
atggtttgggttgcatggtggtttggtgaaggtcatatgggtaacgcaaggagttttaatgatgcatcgggtgaaggttgtttaggtgatggactaatgccaagagggaaaagagaggattcgatggaaattgagtttggatttgggaagagtgccaatggagtcgtggaaggaaggggaggtgaggaagccactgagggtggtagaggaggaagaggtgtcgtcgtcgtcaatggtgtagttcatgtgtttggacatgatgaccaaggcaagcagatgatggtgaagaagaaatcaggtgaagaaagccagcatgagaattacaatgaatataaaagcgatgaagatgaaactttaatgctacttaacgctgcttgttggattttgggaactgtggcttctcacagggaaggtgttggtgatgaagagaaagatgcaactcatggtgtgagaggtgaagagatgaacgtgagccatgcttcggttcacccagttgaagaagctccaactactgaaggtggtggtgaccaaaacgtcaacgctcctagggtgaggatgaaggatgttcaaggcatgcctggcactgccggtggcctttctctgcgtgtttctcagtttgttttcgctgctgctgcactctccatcatggcatccactagcgatttcccttctgtcactgctttttggtaa

SEQ ID NO: 16690 - DNA, 412 bp, Glycine max
  Peptide Sequence Number=SeqID_133468
cgaaaaggaagagaatgaagcggagtatgaattgagaataagagaactcacgggagaggaggaagagatagaggcgagcttccagaacatgagggagaagaaggcgcggaacatcgaggaagctgaaaaccctaatttggagatcgaaaaggcattcgaaaccttgattgaatgtgattctgattctactatggcgcttcaattcattgcatctggtgtggttccaacacatccttattacttgattgttcaaaaaattcgatttgctcacacgttgctagaagctaatagttgtgcagactcccttgcaaagaaggacactaaatttctcatattgaaagatgctccgtccaacctcaatacttctctaatggcggatgctcttgctgttttcttcacccggaatagatag

SEQ ID NO: 16691 - DNA, 192 bp, Glycine max
  Peptide Sequence Number=SeqID_133469
atgactaaagacattgtcgtcttcaaaatgcatgcaatgcctgaagacatttttgtcttcaaaatgtgtgtggattaccgtatagggcgtcttcgcatgttacctgacttctcacagataacccttgggtatctctgcatgctacctgacttctcacaggtcggggtagcagaactgtgtgtgtacggataa

SEQ ID NO: 16692 - DNA, 372 bp, Glycine max
  Peptide Sequence Number=SeqID_133470
atgaggcttcactgtcatcaagcgagtcggagacccagcatgaccacagattcacctccactccttatggctcacatagatctgggcatagggcctaatatctcaatgagtacaaaaaaccaaagatataagggaagggagaacataaataaagaagatgtcatgatgagatgttgcacactgattgattggcctaactctctaaaaaagtctccagtggagtcgccaactgtcgcaacctacccttcggcgggagggcgacgcagggctcacgggtgcgtcatccaagggaagaaggcgcgtagagttgccaccaacgtttattcgaggaaaatgtcagaaaaaccggaacatgtggtctacgaactttaa

SEQ ID NO: 16693 - DNA, 438 bp, Glycine max
  Peptide Sequence Number=SeqID_133471
atgggggagacacatgaaatatcccatcgcaatctagccgacttcgagcctcgccttagctatgccattgaagggcaaacagttggcgatatacccatgcaaaacactttggagggccctcagtatcacccacaaccacatcccttgcattccacagtgggtaaaaaccctcctgctttggcagaaatgggaaagttggatcatctagaggaaaggctcaaggccattgaaggaggcagagattatgcctttgctaacctagaagagttgttcctagtacccaatatcgtcacccctcccaagttcaaggtgtcggactttgacaagtacaaggggactacttgccccaagaaccatctaaagatgtattgtcgaaagatgggggcaggtcaaaagttctcacccgtcgatgtttttaaacaaaaaaaaagggagtga

SEQ ID NO: 16694 - DNA, 435 bp, Glycine max
  Peptide Sequence Number=SeqID_133472
atgcataccggggcaagatttcgctcagaccacagcaaggagacgaggatcgtgcccacaagacacctaatggacccgaagaagtccaacagggtcctggggtttccagctctgattatgggcctctgtcagttctacggagtgctcgtcgcccccaacaaggtcattaagccccctattaacagggttttcatcaagaagtaccacgcccccagggaagcgcagggcgaggcaccacagcagcctggggatggccagcagcaggcaacagacgcaccaccaccacctcctgagtccacctcagctcatctacaaaggctggagcattgcctacgacatatggccgaccagcaggcgaccaaccatccgggcaggtacgagcaagtactagtcctgggaccgataagtcatcacgcgtctgactcaagaagttaa

SEQ ID NO: 16695 - DNA, 246 bp, Glycine max
  Peptide Sequence Number=SeqID_133473
atgggtgttaagtacctcgaggcggtcaagcgaaggttgcatgccaccaaacaatggtccccggacgaaattaggatgaactcgctaagcgcacctactgcgctaagcgagttcatcttttggggaagaacattcatctccctgatgagttgcctgtggctaagcagggctaatttgctaagcctaagtaacttagtcaattattttgttgaaagacgcacactaagcctagcctatctgggctaa

SEQ ID NO: 16696 - DNA, 213 bp, Glycine max
  Peptide Sequence Number=SeqID_133474
atgtgggacaccttaaccattacatacaaagggtcctctgaggtaaaacattacaagttgagccttttgacacattcatcatccaaggcccttgctattaatgatgctttagaagaagaatcaaatgatgatgactttgatgaagaagatgatgagctaagttctgtcaccagaaagatcagaaagatgcggaaaaaacaagaactcctctaa

SEQ ID NO: 16697 - DNA, 303 bp, Glycine max
  Peptide Sequence Number=SeqID_133475
atgtcgcaacctaccattcagcaggggtgcaaaaaggccattatggataggccaaagcgtttgtctccaagggagaaaacgagcggagtcgccaccaacgtttatttgaggaaaacgctagaaaaaccaaaaagacgaaggtctgcgaattttgaaaatgagggtttgggagttatttatgcacgggaaagattgattttaattgcgaacaaaagttgtttaaggcgttggaccttgaaacgatgttttactggaaaagtggagagaatcgttaaggcgttggaccttgaaatgatcttttga

SEQ ID NO: 16698 - DNA, 231 bp, Glycine max
  Peptide Sequence Number=SeqID_133476
atgaggagagtcgccaccaacatttatttgaggaaaaggcaagaaaaaccaaaaagacgaaggtttgcggattttgaaaatgagggttcaggagttgtttacacacggggaagattgattttaattgcgaacaaaagtcgtttaaggcgttggaccttgaaacaatgtttaactagaaaagcggagagaatcgttaaggtgttggaccttgaccttgaaacgatcttttga

SEQ ID NO: 16699 - DNA, 468 bp, Glycine max
  Peptide Sequence Number=SeqID_133477
atggagagtactacaaaagttatgatgaaactgaaaaacaccctagtccaattgctaaactccttcaaaaacatggaccttgtaaaatttccaaaaggttgcaagagagttggttgtaagtgggactttaagactaaacatgactgtcatggaaaccttgaacattacaagaccaaacttgttgctaaggtgtttactcagagaaatggtgttgattataaagagacattttcaccagtctcacgaaagctttcctttaggattatcatagcaccggtagcccattatgatgtagctccatgtggagcttgtaggccttggatcttcttcattaatggagtcttttgcttcttgaagatcacggcaacagaatggagaaggagaaaaggtgattggagatgtcacttcaaggagaagatgagtcaagaacaagctcatcaccataagaagttatggataagagcttga

SEQ ID NO: 16700 - DNA, 315 bp, Glycine max
  Peptide Sequence Number=SeqID_133478
atggaagagacgaacctggaaagcgataaatctacttgccgcaaaacacaactagctagggtccgaacccagcctatgaaccaagggagaaagtacaatatctcaaaccaccacacccaactcttcgttcaacgaggccgatgttacctctgtgaacaatgtcagtgcaacgaactttgggttctcagaaaggcaccgaaacgccacgcggagctcggggggagatttgcgttcagaggtgtgaaggtgctacgagatgtagcacgggaagttttcaaaggttcactcagaagctcactcacgaggaagacctag

SEQ ID NO: 16701 - DNA, 246 bp, Glycine max
  Peptide Sequence Number=SeqID_133479
atggcaagggctgagattgatattgcctccacagtccccgacctcgattccttgacatacacatctgtatccgcccgtacccgtcttcgatacttgatgggttcggcgcgtaccatcagtcaggccgggatcgattcttcaacatttggaacagcatgttctgataacaggttcggggaaagcaaacagaaagtggagagttttatggtgtgccattacatgggttacttggaattggaggaataa

SEQ ID NO: 16702 - DNA, 231 bp, Glycine max
  Peptide Sequence Number=SeqID_133480
atgactgactccgaaagagaatcagagtcagagggagagattagggcttccatcgaaccatccagccccgatagcagcggctatgccggcgaaggaagaggcagtaccagcgccaccagtggctcccagttcgaaatagaacaagaggatgacatgagaattgaaatcgatagaatctcaatttctgattcccacactactaggattcccgacaaacgccacttcaacgag

SEQ ID NO: 16703 - DNA, 444 bp, Glycine max
  Peptide Sequence Number=SeqID_133481
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtaatgacttgcaggccaaggtcagatcttttcatgaatcttccagctctgcacaaacttgacaatatgcttcttgaaattttagatggttgcaaggatatggagttttggtatgttgaccaagggattgtagcccaagatgcagatggatcagcttcattttgcaaaagaattcaacggcaagaggatggtaccgagctcgaattcgtaatcatggtcatagctgtttcctgtgtgaaattgttatccgctcacaattccacacaacatacgagccggaagcataaagtgtaa

SEQ ID NO: 16704 - DNA, 576 bp, Glycine max
  Peptide Sequence Number=SeqID_133482
atgcatcctacaaaagctctagggcctgatggtacaccggtcttgttctataagcacttctgggaggtggttggtgaggatatctcaagaattgtcgtagatattcttaatggtgcaacagacccaataggtattaatcaaactttcattgctctgagtcaaagtgcttttatgcctcatgtgcatattactgataatgctctcattgcttttgagtgtcttcattacacaaggacaaaaaatgatgggaagaaaggagacactgacacgaggaaaattcattggatgagcaggaagaaattggccaaaaacaagttagaaggttctataacagagttagatgatgatgctagggcacttttctttgcagtgctaacaacaatcaggccattattagtcctcatgaagttggtaaccatggatctaggcaaggatggaaagcccttcttagtgattttcaaggtaaattttgattttgctatagggatgggtaagggatctagacttgatttggtggctcgtgatgataaaggaattctggacctgagagaggttgaggcaaatgcatttgggtag

SEQ ID NO: 16705 - DNA, 226 bp, Glycine max
  Peptide Sequence Number=SeqID_133483
atggaggatttctccctcccccggattcatcttaaaccgaccgagatgacatccagcacgagagcaagaaaaggaaatggtctccgtgcagcttcaatccggttgacgccactcgataggaagaaaagagcatcaaggtttttcgaagggcttcaagccctgtttcagcggagagcatggattccccctggcacctctcttccacagcttggcacgtttaaagaag

SEQ ID NO: 16706 - DNA, 351 bp, Glycine max
  Peptide Sequence Number=SeqID_133484
atgaattgcgttttcgttcatgcgtcctccaccttagagtttggagccatgcgtagtgattgcttagggcaattttccattctcaacctttttcggagccccatgaatcgtattttcgttcatgtgtcctccaccctcgagtttggtgccatgcatagtgattgcttagtgcaattctccattctcaacctttttcggagccccatgaattgcgttttcgttcatgtgtcctccaccctcgagtttggagccatgcgtagtgattgcttagtgcaattctccattctcaaccatttttcggagatccatgaactgcgttttcgttcatgcgtcctccaccttcgtgtttag

SEQ ID NO: 16707 - DNA, 129 bp, Glycine max
  Peptide Sequence Number=SeqID_133485
atgaagactctcaataacgaatcactagccaaggtggacgctatgttccaacagttcttcctaatgtatgctaaattgatcatgggactgagcgactcgaatgccagggtatctgaggtgaccccctga

SEQ ID NO: 16708 - DNA, 408 bp, Glycine max
  Peptide Sequence Number=SeqID_133486
atgatcttaagaaacatcattaagacagcgcaattgaaagctcaggagcattgttccgataaatctgtcgcaggaaaacaaaacaaaaggaaaaggatgattagcattctcacccaggaacggcttctgggagcttcattgggagttgtattgacgggagttgttgtgtttgagcaacgcagatacatctacgcttctatttccgattcccaatctcagttggttatactgccacacttcactgcatgggaaggattcaaaatgagagatggaattgttcaccatgttcatgttaaagaacctatatttgggaagaagtcacgttctgaatttgcacatgtatggaacaaaactgtggatcagacatttggacctttgataaagtctctcagctcacgtggatggtag

SEQ ID NO: 16709 - DNA, 1776 bp, Glycine max
  Peptide Sequence Number=SeqID_133487
atgaaacaagagtcaccagcctcaccactgccatcgtcgcttccacaaccatcaccaacaatgacaacaacgaaaaatgtgatcaagcttcagaacagtttaactccatcacggttaaggcttccttccaagtacagagagccgccaaagactccaccagaggttgttgtcaacaatgtggtggtgtcaacaccatcaaggagagccaagtctgtgactccagagttgaagcacaattcaaggatcaaaaggggtcttgtgctgaacaaggccaaacccaatgaagaggttgtgggaacaactcaaaggggtagggaagctgaagagactaaggttgtcgctcgtttcgtgagacctcatgttgtggaacaatttgctaggccaaggaatggggctggggattttgctttcaagagggacaaggaggactctgatgagaagagtaagaaagaattgatggagaagctcgaggcgagtgagagtttgatcaagaatctgcagtctgaagtgcaggctttgaaggctgaattggagaaagttaagggcttgaaagtggagctggagtctcacaacaggaaactcactgaggatcttgctgctgctgaagtaaaggtggtgtctttgggtggcaatgagaagttttggagcggaggtagtagtatggagccaaatggagaacatcagagccccaagtttaaacacattcagaaactcattgctgacaaattagaaaggtccattgtgaaaaaggaagccattgcaaatggagggtttgttgaagcatcaattccaccaccaactgcaattcctgccattcctgatgccccaactgcaaggaaaggaagaaaacccactcccaactcgtgcctgccgccacctccaccacctatgccaccatcaatcccttcaaggcctatagcaaaagcgagtaacactcaaagggtccctgcatttgtgaaactatttcacacattaaagaatcaagaagggatgaaaagcacaacagggacagttaaacagcagaaaccggtatctgtcaatgtacacagcagcattgttggagaaattcaaaaccgttccgctcatcttttagcaataagggcagacattgaaacaaaaggagctttcattaatgacctgataaaaaaggtggtagaagcagcctacacggatattgaagatgtcttaaattttgtcaattggcttgatggtgaactctcgtcattggctgatgagcgtgcagtcttgaaacattttaattggcccgagaggaaagctgatgctatgcgtgaagccgcagttgaatatcgcgaacttaaattgttagaacaagagatttcgtccttcaaggatgacccagaaattccatgtggagcttccttgagaaagatggccagcctattagacaagtctgagagcagcatacagagactaatcaagttgcaaaattctgcaatgcgttcatatcaagagtacaaaattccaactgcttggatgcttgattcaggaatcatgaccaagataaagcaggcttctatgattctggtcaagatgtatatgaaaagagtgacaatggagcttggatctgctcggaactcagacaggtctagtcaagaatcccttctgcttcagggcatgcattttgcatatagagctcatcagtttgctggtggtctggatgcagaaactttgtgtgcttttgaagagataaggcaacatgtaccaggacacttggcaggttctcgagaacttttggctggcatagcatcatcatga

SEQ ID NO: 16710 - DNA, 576 bp, Glycine max
  Peptide Sequence Number=SeqID_133488
atgatgaagtatgaattgaaacacaagagtgaagaggttagtaagtccaaacagaaatcatggtatgaagtcaagaaaagaagaattcaagtgcttttaagggaaattaaggcaaaaagtagaagaaaaaaagccttgatgaattggacagctcgctcagtgcgtaagcctttgaagtgtaaagtctctcatggctatgagaggctaaacccctctgttggagcctatcagccaaagcccttttctttcttcttcctattctattctacaccctttcctattgcttacaaattgggtatttaccaacgcaagtacaaacaaagtctctgtggactcaacactcggtcttccattttaatctttattacttgtgataaaattggtacacttgtcaatcgattgacagagacctacatctgcactaagacctttagaactagggcgcgagagtgcaacgacaaggatcttttccagtcaaagacggtgtcgttgaagtcaccagatcagggttcagaaacggtgagggaaagcatgatagcaagggtgaaagtgaatattcaactacatcaagaatga

SEQ ID NO: 16711 - DNA, 1587 bp, Glycine max
  Peptide Sequence Number=SeqID_133489
atgactagtacagaggaaaagcctgtgactgtgagtgaggaacatgatgcaagttcttgcagaagaacagtttctcttccagttcaaaaggtgccactttctgttattcgttttgcatcttctttagcttcaatcttttggggcaatagggttgatgatccaatggcgataactgaagaaaccacacatgttcctcctcggaagcgacagaatcttcttctagaaataccctcaagaacagaagagagttctcaagaatttgttgcaatcaaaatgccaccgacacccagttccaatcccactcctactccaaagagagtgaattttcttgtgagttctcgctctgttgatcctccaacatatcattctcctggaccttcaacatcaagaggcaaatcatccataagaaacctgctcccaaaactgagtttcaggtatcggacaccggcagatattgaaaaaccaaatactgcagctccagaagtttcctctacaggcactggagaaaagccttcaatctcaagatcattgtctcttactaagatatttactcctaggattaagagagcgtcgtcattaccactagatgaaattagacaatcaaacaatgaatcttctcaaggtggaagtgttggtggtcccttaaataaaagagaagcacagcggaagatagctcgctctctttcagtacctgccaatgacaaagataaaagcctaaggaggatggattcatttttccgtgttgttccttccactcctcaattagtaacttgccttaaatacttccatggtgcagaaaatgaagatgctaatggtgaagatatagctgaagaagaggctgtttgtagaatctgtctggttgatttgtgtgaaggaggcgagaccttcaagttggaatgcagctgcaaaggtgaacttgctctggctcaccaagaatgtgctattaaatggtttagtataaagggtaacaagacctgcgatgtgtgcaaagaggaagttcgaaacttacctgtcactctattacggatccaaagtattcgaaatcggaataatggtggtaataggactcagctggaagatgaagtcccagtgcttgtcattgtcagcatgcttgcctatttctgttttcttgagcagctattggttggaaaaatgggaactggtgcaattgccatatctcttccattttcctgtgtattgggtctactctcctccatgacatcatcaacaatgggtaggttcatctggatatatgcatctgttcagtttgctctagtggttctctttgcgcacatattttactccgtggttcatgtgcaagcagttctgtcaatccttctggccacatttgctggctttggtgtggtgatgagtgggagttctattcttgtggagtattttagatggaggagaagagtgcaggctctatcagagcagcgacatggcccgcaactgatgccacaagcaggacaaaatcctcgaacatcaaacgtgcagcgtccaggtccaggttcaggttcaggtttggctccttccaaccacagtcaacctgtggtgcaaaatcaacagaactcaaatcagagctga

SEQ ID NO: 16712 - DNA, 2754 bp, Glycine max
  Peptide Sequence Number=SeqID_133490
atgacggaacctctctcaaacaccgaactctcttcttctaaaaccctagacccaaccaaccgccacgattccacttcggaaccgcatcaaacggctccggaagaggttgaactcaatcgagaagacgatgtcgttccgaccgcgaaacggaagaggaacgacggcgtcgtcgaagaccgtttgctgcatccactgtggaagaccagcctctgctcctacttccggagccacaacggatcgtgcagccacggcggtgcgtgtcgctacgcgcacggcgaggaggagctccgcctccgccccgacaacacgtgggacccgacctccgagcgcgcgaagaaggcgctgaagaccgaatcggacgacaagcgtgctgtgtcggaggaagtaatgatgacggaggcagtagtcgacgacggcgatgccgacggcgacgacggttgtggtgccaatcacgcgcttagcaaatgcttggtgcatttgccgcggaaatggagctctgagaattttaggacttttctcagcgaacagggtatagcttttaagcatgctaagaaaaagaaaggtatgatgattggttttgttacttttgaagatgaagaacagttgaagagttcaacaaaggaattagaaggaaaatcaattggcaacaaaacggtaaaggtggctgatgttcttcctcggtcatttgaaaagaaaagtaatgccagtgttgcatcccatcaagaattagatgagggggttgatgttgcttcaagtgggactttggatggtgaaacaaataatgataacttggcaaagacaagaaatgtgcgtgatgcagtgactcctctagctcatatggcctatgctgatcagttggagcagaaaaaaagcgctctcatgctgattctcaaaaaacttactcgaaatgctcgtaaagcttgtccaaatggtgtttctcttcctgaatggattctcaagtctagggaaataggtggtcttccgtgcaaactagagggtattattgcatctccaattgtaaatggataccgtaacaagtgtgaattttctgttggatattctctgggaggcaaagtgacagtaggcttcatgcttggaaacttcagggaaggtgtaacagcagttgaggaagcagtggactgcccaaacgtttcaacaattgcttgcaaatatgctacaatctttcaggaatttctgcaggacagtgatttaccagtttggaacagatttaaaaatactggattttggcgtcaattgacggttcgagaaggaagaacaaatgggaatgctgttgatgctgagacttttggtggtattgcagaggttaaaaaaaatgttggtagcactctatgggatgggcaggtgatgagtggtagtttcttgtttggagacaagacccctgattacttgaagcttatgatttgtatacctcctttctttttaaatgtcattcagaactctttgcctttgaggcttgctcaggcatttgttgtcggagctacttcgcattgttcgacattaccccttactgctctggttgttcaggatcaccaaggaatatccaatgtggcgccagctgatgcaccgctgcatttgcttcccattcctaaagcagctggtgattctgaggtggatgaaaataataatgccaaggatgtacgaatccatgattatgtcaacaatctccagttttctatatctccaacagcattttttcaggttaacactcttgctgctgagaagttgtactcacttgctggagattgggcatgcttaggtcctgacacactgctatttgatatatgctgtgggacagggacaattggcttgacgttagcacatcgagttggtatggtgattggaattgaaatgaatgcttctgctgtatctgatgcccataggaatgctgagattaatggcataaaaaacattaaatttatatgttcgaaggcagaggacgtaatgggatctctgttaagggaacacctgaatgtgactaaggaacaagttgatgatcctaatatctctggaaagggcaatgacagtcccgaggatagtgcatgcccagaacctgaaaatggtgaactagcatctcattgtccagaaaataacaatgcagaagttggaagtgaggttcagaagggtagcacttgtgaacaagctgatggtatctctgaacaggcagaggacgtgatgggatctctgttaagggatgatgcaaatatgcccaaggagcaaagtgattatccaaatatctctggaagtgggaatgacattcctgaggatagtaccttcccagtgcctgaaaatggtgaaactacatctcattcagaaagtaacaatgcagaagttggaggtgaggttcagaagggtagcacttctagaaatgggaagacttcactgcaacagttcaaaaatgttgttgctattgttgatcctccacgtgctggacttcatccaactgtgatcaaagctttgagaactcatcctggcctgcggaggcttgtttacatatcctgcaatcctgaaactttggtggcaaatgctattgagctttgtacgccatcccccttaaaaattgagaaaggaaataaagacaacagaggatggagaaacatgagcagtgctggtttagcacggcacagggccaaatctatgcccatctcagaggcattccatcctgtaaaggctatggctgttgatctttttccacatactccacactgtgaattggttatgcttcttgagaggtag

SEQ ID NO: 16713 - DNA, 2307 bp, Glycine max
  Peptide Sequence Number=SeqID_133491
atgtcggctgaaagtagcaactttgtgcagccagcaatacccaagtttgatggtcattatgaccattgggctatgctcatggagaattttcttcggttaaaagagtattggcatttggtggaaacaggcattcctacagtagctgaggggattcaatcaacagaggcccagaggaagtcaattgaagatcacaaactgaaagacctgaaggcgaaaaactatctcttccaggccatagatagaaacatcatggagactattcttgacaagggaagttcaaagagcatttgggactcaatgaaacagaaatatcaagggaccagcagagtgaagagagcacaactacaagcattgaggaaggaatttgaagtccttcaaatgaaaggaggagaaaaagtggaagagtactttgctcggacacttacaattgtgaacaagatgaagatttatggtgagaacataactcaagttatgattgtagaaaagatcttgagatctatgacctcaagatttgactatgttgtgtgctcagtagaggagtccaacaacttggattcactgacagtagatgagcttcaaagcagccttttggttcatgaacaaagaatgaattctcatggtggtgacacaagggatgagcaagcattgaaggtctcacatgaagaacagaatggaggtagaggcagaggtagaggctttggtcggggtcgaggcagaggcagaggaaggcagtctccaaacaaagccgcagtggagtgctttaagtgccacaaactaggacacttccaatacgaatgcccaagatggaaggagagtgcaaactatgctgagatttatgaagaagaagagatgttgctcatgtctcttgtcgaagctgacaacttgcaacaagaagagacttggtttctcgactccggttgtagcaatcacatgtgtggaaatagggagtggttctctaccattgatgaggctttcagacactcggtaaagcttggcaacgattcaaaaatggaagtactgggcaaagggaacatcagacttcagatcaatggtgcaattcatgtagtcactgatgtttactatgtcccagatttgaaaaataatttactgagtgtaggccaacttcaagaaagaggactagctttacttatacaagatgggaaatacaagttgtaccaccctagaagaggattgataatgcaaacagaaatgacagcaaatcggatgtttgtgctgctggctagtgtagtgcttgaagagacttcaacatttctacaactagctactgaagatagttcacaattgtggcaccgtagatttggacacttgagttacaaaggtttgaggactttgcaacacaaacagatggtgaaaggtcttccatttttcaaagattcaagtaaaagttgccctggatgctttgtaggaaagcaacatagagatgtcattccaaagaagagtcaatggagagcttcccataaattacagcttgtacatgctgacatttgtggacccattactcccaactccaatagcaacaaaaggcaactcacaacatcttacactccacaacaaaacggcgtagcggagcgtaaaaatcgaaccattatgaatatggttcggtgcatgctttgtgacaaacaagtaccaaaggctttttggccagaagctgcaaaatggacagttcatgttctcaacaggagtcctacattgacagtgaaagataaaactccagaagagatgtggagtggaatcaaacctaaagtagattactttaaagtatttgggtgcctaactcatgtccatgtacctgatcagaaaagaacaaagctggatgacaagagcctgcagtgtgtattgcttggggtaagtgatgaatctaaagcttatagattattcgatccagttgcaagaaaatttatagtcagcagagatgtgagttttgaagaggataagggctggaattgggggaggactgcagaagaagtgaagcatgacgtgttgatttgggaaggtagtaatgatagtgaggatgcctcctctgaaaatgaagaagaagctgttgtggaaggtactgaaacagcaggagttacagaccaagatgcagaagcaacaacctctacatcaagtgattcatctaatgaagatgcatctgtacatgctacagctgaaggaaggagtcgaagagcacccaactacttgcaagattatgaaactggtgaaggattatctgaagatgaagattattttgcaatgtttacctctcatgaagatccaagctcatttgaagaagctgaaagagattag

SEQ ID NO: 16714 - DNA, 510 bp, Glycine max
  Peptide Sequence Number=SeqID_133492
atgttgatcttgagtctaaatctgcatctcaacaaacgcaaggggactcttaaacctcaggcaccaccttctctaacccctcaaacccaacctaaacatgctttatctcccataagcaaaagggaagctacaactttttctaaggctaaaaagaagtttatggttgaagcatgcaagaaggaaaaattggatgagactctagaaagaaataagactttggagttggaagaagaactaaagagggttgagatgaacgaacttgaaagagttcaatctgcattagaacatgtagctgggatcatgtctctggatgttgctcaaagacaagtagagatggaagccaccattgttcctgaagacatggatcctgtagagaatgaaactcttgaggaggccatgcttcagtctattattgaagtatctcttgtaaaagcaaaagatgaaattattgaaatagataatggaattgcaccaattcgacaaaggccaatgtctgatgttgatgaatag

SEQ ID NO: 16715 - DNA, 774 bp, Glycine max
  Peptide Sequence Number=SeqID_133493
atgacgcaggggatgataatcgcagtacaaggatcaagaaacatgaatgcaagaaacagatttgagaacagggacatcataagcactatgccagatgatatcttagggaacattctttctcggttgacaatgaaagaagctgttaggtctagcgtgcttggaactaaatggagacataactggacctttttctctggggtcttggaatttgagcagtcacgtaggaattttcacttgcgccgagaacatgttggaatcttgactaaatgcaatgtttttgtaagtgagtgggaaaggttcatgacccatatgtcaaaagtgatgaaatcactgaaaagctcatccatgcaaggactgagaatctgcatggatttgggtgacccttggagggcagctgaatgggttaagtatgctgctgagaaggatgttcaaacgttggacttggatttctcatatcacttctcagtaccaatctataaaatgagtgagctcactattcacaatgtttttccatccaggggttatgaaatgaagtcactatgtaacctgcgtttgtcttctgtggacatcaatgttctgaaattggaattgtccatgccgtatccgggttttattgaaggcatgcctgtgtttgataatgtgaagcagctggaaattcgaattcctcacaggagtggagcgtcgcttgatcatcatgtttatttactaagttcattcccttcagtacgcgtgcttaagattaaggtcagtccaacaatagtgagtgacacttaa

SEQ ID NO: 16716 - DNA, 291 bp, Glycine max
  Peptide Sequence Number=SeqID_133494
atgcccttctttacttccttggatcttcaaaaattgataggtcccatctatgctctcaatgttgttcttccttgggatcacactatgtcggagatacttttcagacaaaggacatcaatttggaggcaccagaggacattccaaacatccaagattgggaataatcaaaatatggacaactactacaaatgcaaggagctgctaattaaagaagatgaagatgctccaacaaccaaatatgtcaaggcttgtcctagaagacttttcaaatatgagcttgaagctttgtag

SEQ ID NO: 16717 - DNA, 855 bp, Glycine max
  Peptide Sequence Number=SeqID_133495
atgatgaccaaagcgcttgattttacgtccggttacctttcacgccgcccaccgatgatgggccgtaacgcggtggcaacgtctcagccgctggcggcgcaggcggggatgaagatgctgcaactgggcgggaatgccgttgatgcggccattgccaccgcgatggccctgacggtggtcgagccgaccggcaacgggattggcagcgatgccttcgccattgtctgggacggtgaaaaattgcacggactgaacgcgtcgggtcgttcaccggcgagctggcatgcggatctgtttgccggaaaaactgcggtgccggaaatcggctgggacgcggtgaccgtaccgggggcggtatccggctgggtcgcgctggcggaacgcttcggcacgctgccgctgaccaccctggcgcagcctgcggttgactacgcgcgcaacggtttcccggtctcgccgctgattgggcatctctggcagcgcggctatctcaagctgaaagatcagccgggcttcagcgcctgcttcgcgccggaaggccgcgccccgcgcgtgggggagattttccgtaacccggcgcaggcgaactcgctggagctgattgcgagaaccaacggcgaggcgttttaccgtggcgagctggcgcagaaaattgccgcctttgccaaagaacacggcgcgcacctgacggcggaggatctggctaaccatcgcgtcgactgggtagagctgctgtcacgcgacttcgcgggcggttcggtgcaggagctgccgccgaatggccaggggattgccacgctgattgcgctgggcattcttgagcagtgtggtattgagaagcaccatccggattcc

SEQ ID NO: 16718 - DNA, 615 bp, Glycine max
  Peptide Sequence Number=SeqID_133496
atgaatactcatcctctggataagtacttgtggctaagcgaggctgattcgccaagcccaaggagagctaagcgcacatcattgcagcaagttttaggcttagcgggatctataggcgccaagcggatggccacaagaaagagagcaagagctgaagacatcccttcatcatccaacccacctcctccaacagcaaccatggaactagatggcctacaagcacaacctatagtttctatgttgcagagcctattccgggggcagctgattattgtctacaaccagcagcagttggctcataacaggccaatagtattcatggagaaatttttagataaagtggcctgtcctgaagctcaattgcggctaggaagatctcccgaggttatgccccccagtcccataccaacaaggacagagcctgcaccagctgagtcgcaaccaccagtagcagacccatcagcttccccgaaggttgagattctaccacctccatcagctccacctttgatactcattctcgatgactcagataacgaagttgcagctcctcctgactcaccagcctactactacctagaggatggttcagacttttctaactggatggactag

SEQ ID NO: 16719 - DNA, 330 bp, Glycine max
  Peptide Sequence Number=SeqID_133497
atgtggccacagccgaagcattggaacaggaaacaaagagggcctgaaaggaagcatggggccgaaacaagttccgaggggctttgtaggggcagcaacagtgagctcaagcttcgaagggtcgagagagaccagtcaagagtcgagggcatgatattaaaggacaagttgaaggcttgtcaaaggtcaaagaggagtttgtccgaacaattcagtaggacgaaaggaaacatgtgggccatcattgaccaatacaaagagaagctaaatctagcttcaacccatgaacaaaggctagaggatgagtgtgcaaaggtatcggtcctgtaa

SEQ ID NO: 16720 - DNA, 277 bp, Glycine max
  Peptide Sequence Number=SeqID_133498
atgcgtaacttagtgaaatatgcgggcatcggcctgctggtgttaggcctggcggcgtgtgatcagaagaaagacgacacggcggcaaacagcaacggcgccagcgccagtcagtcagcacagacagtaaacctgatggacggtaagctgagtttcagcctgccagcaggtatgtcggataagagcggcaagctgggttcggaatccaccaatatgcacgtgtatgccgatgaaaccggccagcgcgcgattatcgtgattgcgggcgatccgacca

SEQ ID NO: 16721 - DNA, 318 bp, Glycine max
  Peptide Sequence Number=SeqID_133499
atggcctatgcgctggggcagatccttgatgtgcacgtgtttaaccgcctgcgtaaactgccgcagtggtggattgcgcctgcctgtgccatgttcctcggcaatatcagcgatacgctggccttcttctttatcgccttttataagagtccggacccgttcatggccagccactgggtggagatcgcactggtggattacagcttcaaagtgctgatctgcatggttttcttcctgcctgcttacggtgttctgctcaatgcggcacttaagcgtctggcggaacgttcggctcagcgccagatgaatttcggctaa

SEQ ID NO: 16722 - DNA, 381 bp, Glycine max
  Peptide Sequence Number=SeqID_133500
atgggtaataaacttgggaggaggagacaagtggtagatgagaaatatacgaggccgcaagggttgtataatcacaaagatgtggatcacaagaagctgaggaagctaatactagaatcaaagttagcaccttgctatcccggagatgaagaaaccacctacgatcgtgaagagtgcccgatttgctttctgtattatccaagtctaaaccgatcaagatgttgcacaaagagcatttgtacagagtgctttttgcagatgaaagttccaaattcaactcggcctacacagtatcctgcattactagttgtttgtcttcaatatattgaatacatacctcgtagttgccagtctagcaacttcaatcttttgttgctttaa

SEQ ID NO: 16723 - DNA, 117 bp, Glycine max
  Peptide Sequence Number=SeqID_133501
atgggaggtgatgagtgtcatggtcatcatgacgagggttattatgatagtgacattggtggcaatccatggtggttgacgacaaactcttgctggttacgggaatacagaggatag

SEQ ID NO: 16724 - DNA, 1212 bp, Glycine max
  Peptide Sequence Number=SeqID_133502
atggcgaagatgggtggaagaaagtggagcatcttggtggccatcttcatcttacttcttgctatggaagctgtcattgctcaaggtcaaggaaatggtaatggcaacaatggaaatggcaatggtaatggtaacggtaatggcaagggtaatgataaggaagagaaggagagggagaagagggagaaggagaaggagaagagggagaagaaggagaaaaaggaaaaggaaaaggagaagaaggaaaaagagaaacaggcaaaaaagcagcagggtgaagccacaaattatgacaagctgtcacctttgccaacaggtcaagaacgaggcttctgcagaaaaaacactgcctgtgagtttaagaccattgtgtgtccatccgagtgcgcatacaggaaacccaagaagaacaagaagcagaaggcatgtttcattgactgcagcagcagtacatgtgaagccacttgcaaggttagaaaagccaactgtgatggatatggtgctttgtgttatgatcctcgctttgttggtggtgatggagtgatgttctacttccacggtgccaaaggaggaaactttgccattgtttcagatgatgagttccaaatcaatgctcacttcattggtactcgaccaaaaggaaggactcgagactacacatgggtgcaagcactctctgtcatgtttgacacacacactcttgccattgcagccaatagagtgtctcactgggatgacaatgtagattctctcatagtaaagtgggatgatgaactagtcaacattcccactgatggagaggctgaatggagggccaatggtgatgaaagagaagtggttgtggagagaactgacgataccaacagtgtgagagtgacagtttctggtttgattgagatggacattagcgtgaagccaatcagagagcaagaaaacaaggttcacaattaccagttgccatcagatgatgcttttgctcatttggagacacagttcaggtttaagaaaagtactgataactttgaaggagttttgggtcagacttataggccagggtatgttagtcctgtcaaaagaggagttcctatgccaatgatgggtggtgaggacaagtaccaaactctctctatgttttcaacatcatgtaacctatgcaagttccagaggccatctgagatagcaagcaccgaaggactagttgctcagtactga

SEQ ID NO: 16725 - DNA, 1245 bp, Glycine max
  Peptide Sequence Number=SeqID_133503
atggggtgctgtagttgcttcgggttcatcaggacacctaaccgtcaaagtcaaaggtctaagcctgccactaacaataataatctctgccaggagcctcttctagatgatgacattgaagatgaagagggtgagcatttgtacaatgatgaggttactaacactagtggagatgaaggcgaggaggaaactcgtcccaagcgatcggaagaaattttgaacttgagagtagaaaatgacatgatttgtacacggtttcctgttaaggagactcacaaacttgtgcgcaccgaggcaaacattgagactaggtgggctagtgtttcctttcaggatgaaaatgggaacaagatgataaatgagtatattcgtgagtgtaaaattggttctggtagctatgggaaagtggctctttatcaaagctctgtcgatggaaagaattatgcaattaaggcctttcataaatctcatttactgaagcttcgagtttcaccctcagaaactgccatgactgacgtactacgcgaggttctcattatgaaaatgctggaacatcctaatatagtcgatctcattgaggtgattgatgacccacagtcagataacttctacatggtacttgaatatgtggaaggaaaatggatatgcgagggttcaggtaccacttgtggcttaggtgaagagactgctaggagatacttgcgtgatatagtttctggattaacatatctccatgctcataatattgttcatctggatattaagccagataatctgttgattactcgtcatggtacagtaaagataggggatttcagtgtcagccaggcttttgaggatgataaagatgagcttcgtcgatcacctggcactcctgttttcactgcaccagagtgtattttaggtggtgtgaaatatggtggtaaagctgcagacacgtgggcagtaggagttactttatactgtatgatattgggtgaatacccttttcttggagacacacttcaagatacatatgacaaaatagtcaataatcctttagtactccccaacgatatgaatcccccattgaagaacttaatagaaggcctactttccaaagacccaagattaaggatgtctttaagtgatgttgcggaagatagctgggttattggagatgatgggccaattcctgattacctttgttggtgcaaaatgaagagcttgggaattgaggacaatgatgagagcaatactgactaa

SEQ ID NO: 16726 - DNA, 639 bp, Glycine max
  Peptide Sequence Number=SeqID_133504
atggtggatatactgccacagtaccagtgtgccacatacaaggagaatggcaggcagagaaatttatctttttccgatgctacttctggacactatgtagctgatggtcgctatgtttcatctgcctcatccatcacgggtccaccaacgggatcatcctcgtctccatctgggggtctcgcttgtgccattgcagctcttgctgagcgccagcaaatggctggagaatcatctatgagcatcactgatgaaaatatgccatcattcaacacactacctggttccagaaggttttataacagacttggtagggatatggcttattatccacctgctgaaaacctcaacgaggagccactggatgaagctgtggcgatgactaggagtcatggtgaatgggacacggaccatgggacaccgttgactgaaacagcaactagctatacaaactctgtcacagcagaagatcgtggtgaactatcttcattgctacggtctgatgacattgatggaagcctacaaagtgccccagaacccattgttcctgagagttttgaggagcaaatgatgctcgctatggctgtctctttggctgaagctcgagccatgtcaagtggacagagtgcttcttggcagtag

SEQ ID NO: 16727 - DNA, 303 bp, Glycine max
  Peptide Sequence Number=SeqID_133505
atgaatcatatacactttacctatgaactatgcaattcacacgactactcaattgttttcaaaatcattttaactcgtcgagttcccacagtggatcccatcacaatactcatcgcccttaaagggtcttacaattgtgtgattgcacagttcatagctcatgtcgtaacctacccttcggcgggagggcgacgcggggctcactggtgcgtcttccaagggaggaaaatgcacggagtcgccaccaacgtttattcgaggaacatgtcgaaaaaaccaaaacgtgtggtctacgaactttaa

SEQ ID NO: 16728 - DNA, 186 bp, Glycine max
  Peptide Sequence Number=SeqID_133506
atgaccaaggtaaacatatttttctcctttcccaacaagaatgtaggaggtttgatagtgacacctacttgtgcttgtatatcaattgttgcttgtagtttgtccatgattctcgaaattgctcgatcaacatctcttataggaactcatccagaaggaaaacattttttgcattcatatctttaa

SEQ ID NO: 16729 - DNA, 1152 bp, Glycine max
  Peptide Sequence Number=SeqID_133507
atgacaagctgtcacctctgccaacaggtcaagaaacgaggcttctgcagaaaaaacactgcctgtgagtttaagaccattgtgtgtccatccgagtgcgcattcaggaagcctaagaaaaacaagaagcagaaggcatgtttcattgactgcagcagcagcacatgtgaagccacttgcaagggtatgggggatggatgttgtacacagccttacccttgcatttgcaaagaggctgtttccggattcaaatccatgaccaacaagtcaccaaggcacaactttaccgctgcaccagggctcgccctcatgatttctgatgagagttgtaaagtgtctttacactctaaatttgttgccttttataaaacacattttaagatgatttctgattggttgagaagtgagactgttaggaaagccaattgtgatgggtatggatctctgtgttatgatcctcgctttgttggtggcgacggtgtgatgttctacttccacggtgccaaaggaggaaactttgccattgtttctgataacgagttccaaatcaatgctcacttcattggtactcgaccacaaggaaggactcgtgactacacatgggtgcaagcacttgctgtcatgtttgacacacacactcttgtcattgcagccaatagagtgtctcactgggatgacaaggttgactctctcatagtgaaatgggatgatgaaccagtcaacattcccactgatggagaggctgaatggagggccaatggtgatgaaagagaagtggttgtggagagaactgatgataccaacagcgtgagagtcacaatttcaggcttggttgagttggatattagtgtgaagccaattggagagcaagaaaacaagattcacaattaccagttgccatcagatgatgcttttgctcatttggagacacagttcaggtttaagaaaagtactgataactttgaaggagttttaggtcagacttataggccagggtatgttagccctgttaagagaggggttcctatgccaatgatgggtggggagaacaagtaccagactctttctctcttttctacatcatgcaacctatgcaggttccaaaggccatccgaaatagcaagcaccgaaggactagttgctcagtactga

SEQ ID NO: 16730 - DNA, 2163 bp, Glycine max
  Peptide Sequence Number=SeqID_133508
atggcctttaacttttctaaacagtggtttccctctttggctaattttattccgggtattcagttccgaactgacaacaaaccattcgaggcagaaatgaagcggttcactgttaagattgtggatatgatgaagcaagagagcctctatgcctcacaaggaggacccattattttgtctcaggttgaaaatgagtatgggaacattgatgcggcctatggtcctgctgctaaatcctacatcaaatgggcagcatcaatggcaacatctcttgacacaggggttccttgggtaatgtgccaacaggcagatgctcctgatccaattattaacacgtgcaatggattttactgcgatcaattcacaccaaattctaatgcaaaaccaaaaatgtggactgagaattggagtggatggtttctttcatttggtggtgctgtgccttacagaccagtagaagatcttgcttttgctgtggcacgcttttaccagcgaggtggaacttttcaaaattactatatgtaccacggaggcactaattttggccgaactactggtggacctttcatttctactagttatgattatgatgcaccaattgatcagtatggaattattagacagcctaaatggggccaccttaaagatgtgcataaggccataaagctttgtgaagaagccttgatagcaactgatccaacaattacatctcctggaccaaatatagaggctgcagtttacaagacaggatctatatgtgctgccttccttgccaacattgccacatctgatgcaacagtgacctttaatggaaattcatatcacttgcctgcatggtctgtgagcatcttaccagactgcaagaatgtagtgctaaatactgcaaagattaattctgcatctatgatttcaagcttcacaactgaatctttcaaagaagaggttggatctttggatgattctggctcgggatggagttggattagtgagcctattggtatttcaaagtctgattcattttcaaaatttggattactggagcaaataaatacaactgctgataaaagtgattacttatggtactcgataagcattgatgttgaaggtgattctggttctcaaactgtccttcacattgaatcccttggtcatgcccttcatgctttcataaatgggaagattgcagggagtggaactggcaacagtggcaaagctaaagtcaatgtggacatccccgtcacactagtggctgggaagaattcaattgatctcctgagtttaactgtgggacttcagaactatggagctttttttgacacatggggtgcagggatcactggtccagtgatactgaaaggtttgaagaatggaagcactgttgatctctcctcccagcagtggacatatcaggttggccttaaatatgaagatttaggtccatctaatggcagttctggacagtggaattcacaatctaccttacctacaaatcaatccttgatttggtacaagacaaactttgttgctccctctggaagtaatccagttgcaattgacttcacggggatgggaaaaggtgaggcttgggtgaatggacagagcattggaaggtactggcctacatatgtttctccgaatggtggttgtaccgactcatgcaattatagaggggcctatagttcatccaaatgtctcaagaactgcggaaaaccatcacagacattataccacataccacgatcatggttacaaccagatagcaacacacttgtattgtttgaggagagtggaggcgaccctacacaaatatctttcgctacaaaacagataggaagcatgtgttcacatgtatctgaatctcaccctccacctgttgacttgtggaattcagataaaggaagaaaagtagggcctgtattgtcactggagtgcccttatcctaatcagttgatctcttccattaaatttgcaagttttggaacgccttatgggacttgtgggaacttcaaacatgggcggtgcagaagtaataaggctctatccattgtgcagaaggcctgcattggatcaagtagttgtagaattggaatatcaattaatacattcggagatccatgtaaaggagtaacaaaaagtttagctgttgaagcttcttgtgcatag

SEQ ID NO: 16731 - DNA, 540 bp, Glycine max
  Peptide Sequence Number=SeqID_133509
atgtggaaagagttgcagattaaggtggctgaattacctaaggccaaacctcaaaagaggaaactacaccaaggaagaggaggaaactattatcaagctgcaccgacatctaggtatgcaacggagcatagatgtggagtagttgttaaaggaccaaatctgagtggaaatatatcaggaacagagccattgaaggacaaccacatacttttgaaagcagaagctttagatgattcccatgaaccaagtaatattgctgttgttgttaatgagttgtccaaggaaataacaaaaaatttggtttctcatcctgtgaatgctaaatgtactgcagaagggaagagcatagcaaatgtagtccttttaagaggttgtggcattcaaattgagagaatcactgagggacagaataaagtgataattactgatagaatgtgggctaggcttctatcttcaacaaatcagcccagctttaccattgctaagactgtctctgaagaaaagagggaagaagaagcaaacggtcatatctctgaataa

SEQ ID NO: 16732 - DNA, 591 bp, Glycine max
  Peptide Sequence Number=SeqID_133510
atgatgcttagactaggatcaagagaccatgtacgcgacaaagatagattatgcatgtataaggtgatggtggatgaaaaggttaatatgaatgaagtcatctttttctacttgcttcaagcattcaaggacagatttcatgccaaaggcaagaagaaccttgttccttataggatattgttgactaagatcacaaggaacaagagggtagatgtgtctatgttggaaccatctgtaggtgccacacaactcaaaggtgtgacctttgtcaaaatgggaatagttgacaaattccttgaatatgctcaaaagcatatcaaaagaaagagctcaagagcagccaatagatcaagagtctggagtagcgtctcagtaaactcagggggagaaaagttctttgaagaaattcaagaagatgttattttggaatctctaaagatcctatttgttgaggaggtgcagatgaaaatagttgaagaggcaaccatggttgatattgatggtgagccattgcctgaggaagtaattgtagagtccaaccaggcacagtctaaacttaaagccaagcaagctgaaatggaagggctttag

SEQ ID NO: 16733 - DNA, 2574 bp, Glycine max
  Peptide Sequence Number=SeqID_133511
atgacggagagagttgacgtgttggaggcaagaatgaattcgctggagaactccttgacgcagtccatggaagagttttgtcgctccttgatgacggagttcgccaaattgcaagactgttgtgtcaatgatgagacccgctcaccatcgttcagtacagaatcggtgttagaatacaaaatgccggcgaagaaggtggagcttccaccatttgacaaggaggacctggtgggatggattacccatgctgagacctattttgaggtgcatggttcatcggaggagatgaaagtgaggttagcgaagctcagtatggagggttcggctattcactggttcaacttgttatgtgagactgaggatgcactcacatggtctaaacagaagaagtcgttgattgaacgatatggaggaagagtgggtcatcttctcgcagaacaatatttgaggatagcgcaagatgttgaggcaaagttgcgtggctctttgatgccacatatcagtgggagtgtgatacaatggaggggaggtcgagaattggatcctggatcgggtggaaaaagaggtgttaggtcaaattttccttctggtgcaagaagcgacagtgggtcacattataactcaggcccatataaaggaactttcaggtcagggcctttaagtagtgacccaactcagacaatgcaatctggatccaatgtgaaccctaattcaagctccaattcggtgcaaaaagaaagagatgaaggaggaaggggcaacaaccctcgaaacagagatattaaacatttaccatactcggaattgatggatggtaaggtttgcggtttgtgttttcaatgtggagagcgatttcacccactgcaccaatgcacagagaaacagtttcacttagttatcctggggaacaacgaagtggttatcgcagaaggggaggtgatagccatagaagtaagagacgacgaagatgaagcaaccctagattgtaatattatgggagtgtttgggctgaccgaaggtatgaagacgatgaaacgacccacaacaatcactgggtttgacaataccgatatccctaccatcacaaaggggagattgagaaacaaagatgcattgtggcgtatgcgtgtggactatagggagctgaataaggtaacgatacctgacaaataccccattccggtggtagaggaacttttggatgaactacatggtgctacatatttccctaatttggatttgaagtcaaggtatcatcaaatccgggtgaaggaggaggacatgcataaaactgcctttcgcacacatgaagggcattatgaatttatggttatgccgtttgggttgaccaatgcccccccagctaccttccaatctaccatgaaccaagtgttcaaacctttcctaaggaaaactgcattggtgttttttgatgatattctagtgtttagcaaaggatggaaggaacatatggagcatctaacacaagttctgaaggcgcttcaagaaaacaaattagtggagctaaaaggggtgatgactcaagcacctgtgttgacacttccagattttaatcaaccatttgaaattgaatgcgatgcttccggaagaggggtaggagctgtgttgatgcaaaacaggaaaccaatagcatatttcagcaaggccttgtccgagaataatttaagcaagtcagcatatgagaaggaattgatggtgttggtgttggcagtgcagcactggattactacagctgaccaacaaaattggatagctaaactcttgggttaccaatttgaggtcatttacaaacctgggccggacaataaagcagctgattcattatctcgcatatatgaagaaggtgatttgaaaagcatcacttcatttccaatttggatgcaagagcagcaagtacagcatgaagttcttcgagaccctttcttaaaacaggtgatagctgacttgcatgagaatccagcttcacagccgatgtttagcttgcaacaaggagactttgtgaagagttgtgacgtttgccaaggacaaaagtattcagcatcatcaccggcttgtctgctgcagccactcccaattccagctcaaatttgggaggatatatctttagactttgtcatgggactccctaagtctaaaggatttgaagcagtatttgtagtggttgacaggttatccaaatatgctcatttcatacccttgcgccatccctatacagatagaaaggtggctgaagtgtttacaaaggagataggtactgtcctaaaaatgagctcttcgtatcatcccgagacggatggacagacagaggaagtaaataggtgtttagagtcttatttgcgatgttttgcatctgaacagcccaagaattggtcattctgggtgttgtgggcagaattgtggtactatactaccttccatgtgtctactggagtgactccttttgagtctgtgtatgggagaaaacctcctacattggttcgagttttgcaaggagaaaccagggtggaagcagtggaagtagaattgatggatagagatgaggcactgcaatag

SEQ ID NO: 16734 - DNA, 318 bp, Glycine max
  Peptide Sequence Number=SeqID_133512
atgggaatggaaaagggtgaacgaagtgagaatgaggatggaatggcaatgggaaaagaagagatgggaaaacccgggcaggacacatggagggaggggcaaaataatgggaagaggaaaagaaataaaagcaaacacgggcataacacttggattgaagcgggaaaaatcataaaacccaaaaaaagacaaaagccaaaactttttgatgaatatgaaattttaatcatgaaccaaaaaatcaaacctggactcgtggagtttccagataaaaactgcacatgtagtgtgttattctaccagatgtgcatgcaatag

SEQ ID NO: 16735 - DNA, 1026 bp, Glycine max
  Peptide Sequence Number=SeqID_133513
atggcaacgcgaaagctgattcgtgatttgttactctccaaacgatcccttcttcaccaccagggttggagtaggagtagaaggttacctttggtttgggaagataggcgtagatacagtgtcttcaatgagttctctaagaacattaaaggccaagctgttagaaaccaagaattccaacagtctgtcaaggagctgaaagaaaaagcagatgaacttaaaggggtaaaagaagagctgaaagaaagaacaaagcaaaaaactgagaagctgtacaaacaagtggatgaagcgtggacagaagctgaagctgctgcaaggaaggtttcttacaatgttaaagagaagatttcagctgcatcagaggaggtgaaggaaacttttgggataggaaagcaggattcttcaggatcaactgattcttcaacaaaacagggtgctgatgcaaatggaggaaatcagacatcacgtgaggaagagaaaaatcagcaatctgggtctagtaaggatgctgattcgttgtttggcaaatttaaatcaactatttcctctccaaatgtttctgctgccttccaaaaattaaaggatgcaaagttagttgacataaccaaaaaaggttatgacatagtaaaagaggagttaagtagtaccccgactaagagaaagcgagttccttttgcatcaagtggtgaaacaagtacaagaacagatcttgttgttatgccatctaaacaatcttggtggagtaagaagtttgatgagttcagggagaaggtgaaaggccatccagtatccaagcgattccttaagtatagtgacccagtgaagacaaagggccaggagatagtagaggacttgcgggaaagatatgagaccagtgacagccccattattcacaaaatacaggacatagttgtcaataccggcgtaacggagtggagtggccgaccccaaaagtgggatagcaggatagcggatggcgggatgaccgcttttctaatgtgtttttttatacatgttaaataa

SEQ ID NO: 16736 - DNA, 300 bp, Glycine max
  Peptide Sequence Number=SeqID_133514
atgcatggcgccattggtgatggcgccttcgacagggacgagccacgtggctgtgtcgccactgcgactggcgacaaaggactgcatatcgcagctcctattggcgcgtccaagggtgcatgggagcgctggtttgaccagcgacttcagcacctgcaagctgcaggcatagtctgcagcagcacctgcagctactcagatcgtagctggaaggcgccactggaggtgattgcttgtgttgagaaaggtagctggtggtgctgtttagtttgtgttcttccattttccaaaagcttgtag

SEQ ID NO: 16737 - DNA, 615 bp, Glycine max
  Peptide Sequence Number=SeqID_133515
atggagatgttgaacttgttagatttgttagagcttgacttgaccatctgctcaaacatgagcttgaaactctcaaacacaagtttgagatcacaaatctggatgtatatgccatgggaagtttccacaggctacaagaatgttgttctggtttgggaggaaaagctagctgtagatgcctatcaccatgaagttgggcaatattatcagactctgaaccacacttgctttactcaagaaactcccttcaacatgctttacacatggaagagggaattttatgaagttaaatctggtgttgaagttgcttttgactccatggttgttccagtatatgatcctccaccctttcgttcctgtgtttgtctacttgaagtggaactagtcagagcgagggaagcctttgctcaagtcttgaaggatcgcgctcatgttgagaaggaagtccataaatggtctctgattggtgactacttctacaagaaagccattggatggaaacctcattgtcctccaacaccacctggtagccctattctttcttatgataatgaggactcaggtgatgagtttcttaacgaagaagttgccaaacaaaagggggcgaaaaagtaa

SEQ ID NO: 16738 - DNA, 365 bp, Glycine max
  Peptide Sequence Number=SeqID_133516
atgactatcttgtacaggatgaattcggttataacagtgttgtatttcaatggaaggatatatgaagataatgatggtgtaatatttgaaggaagtaaaaaagcgattcagattaaacgtggaattagtttcaatgctttgaagaaaaaaattggagataaggatgtcgctggtggttcaatgtttcattctgcaaattcgcttacatcatgtggaaattatttatctaatgatgagacacaaccggcaacaaatatgagcaatttacacattgacgaagacgatgatgatcatgatgatgatgattatcttgtgtctaactcatacgttgaagagtctgtagacgaagatgacagtgttgaacg

SEQ ID NO: 16739 - DNA, 792 bp, Glycine max
  Peptide Sequence Number=SeqID_133517
atgatgctattgcgccgcatttcagtgccacccggatgtgatataagtccttccttgattaagatctgcttggatagagagcatgaagttctggttgcagatgctgtgaatctcccttacaggactggtttcggcgatgtggcaatatctatagctgtgttacatcatttaagcactgaaaatagaaggagaaaggcaatagaagaattggtcagagttgttaaaaagggtggccttgttctgattacagtttgggctgtagagcaagaggatagtaagctgattaccaaatggacaccactgaatgagaagtatgttgatgagtgggtaggaccaggaagtcctcgtactcgggcgccttcatcctcatcattggaaagtatccccgaaagtgaggtgagtcgctctggtgagcacatggaagtttgcaatgagccacatgtatcaagagatttggaggaagaaaaaaatataaagaatcaacaggaatactttgttccctggcatttaccttatcatcgtgctgaaatcagtggtgcttctgctgaagctcttgctgctggtctggcaacgaaagatgacaaaaaaggtgctgtggtgtataatcgatattatcatgtttttagtgaaggcgagcttgaaagtttgacaactggaataaacaatgccagaattgttgatcagttttttgataaatccaactggtgtattattcttgagaagacactgcagaagttggacagaatgattatctggccatttcatcatccagaccaggctgcattcttctag

SEQ ID NO: 16740 - DNA, 432 bp, Glycine max
  Peptide Sequence Number=SeqID_133518
atgataagttgtacaaatgatgttaagcatgtggatcatgcagttgacgagatccataaacagcctaaagagatagttgttgatgatgtagttgctgatgctgagggtttttcaggcggaccccacgatacattagttttgatggactatgttcatcatgtggcagcaacagtttggaatggagaggaacgtgctgagttgaagttatccttccatggaagaaaggtaaagaaatttggtaggcctgcttcagagattgaaggcttagtggctgcatgttacttggacattggtgattggggacttatatatgcttttgcgaagagcgccttccatagttttgaggctattcaagtggacgaagtcgtggacctattagttgacttgcttgaagttagtttagaagaagcaagggctgagacattacaatga

SEQ ID NO: 16741 - DNA, 333 bp, Glycine max
  Peptide Sequence Number=SeqID_133519
atgttggcgaaattgttgatttcgccatcgcgattgagctcattgttgcagggaagtggagtttggactacacgagcatgtgggagatctgggagaaggagtgaagctggggttctaaccaagggtggtgtggtgaaggttaaggctaggctttggggtttgcaaaggggctttgaacctcgtgagggacaatggcttcagggagtggatgcgagagaggatgatgtcagggagaagggggacaaaggagaggactaccaagtggacgtgggggtcagaggagaggaaggtgtcgtagagccactggcggaggtggtacatagtcgtaattga

SEQ ID NO: 16742 - DNA, 5019 bp, Glycine max
  Peptide Sequence Number=SeqID_133520
atggagaatcatgttcattcaagagtgaaattgaaaagagaatctaaagatctcccccgtatttcttcacttgaaggagaatcaggggtaaatgaagattatgctgactcagctgctggctttgatggctcgtctagtacttctgaaagcatatatacagagaagcatgatatctccagtacacatgaagtggacagtcttaaaagcacaatctctggtgatttaggtggactatccctcagtcaaagtcctcagccagagaaaggagaggcacctgataatcagtttccagcacagggtagtgagcgggttcatgattggagcatagactattcagctgccaatagtttggctgctgcttctgaagataggagcagtaacagacttatgggaaatttggatgcagttgagtcgtctattcttgatctaaaactgaaggtaagttctttgcaaaaccatgctgatgaaataggtgttgaaacacacaagttttctgagcaacttgctgctgagatttcatcaggagaagagttagtaaaggaggttgcagtactaaaatcagagtgttcaaagtttagagatgagtttgagcaacttaaaagttctaagttgagcttagcattacctcacaaagaacctactggtacagatcgggacaaattatttcaaaatttacagcataaatggcataaggggcttttgctcatggaagggaagataagagatattcagaaagtgtctttgggatttcctgaaagggattttaggttccttaacttggagttagaagcactggctgagattttgcagaatctcaaacaagaatctggagagccaatttcaggggccaaagttgtcaacgaaagagagaacaagaaaatggatatgcataaaagtgaacaatttttaacagatattgggtctgatacaggtttatttcaacctgaaagcatgactcattatcttaccatacctggccttgtgtctcatgagtttgattctgttgatcctgcccttgctatgaaagaaaaagtttttgaacttctaagagagttagatgagtccaaaactgaaagggaaagccttgtacggaaaatggaccagatggagtgctactatgaagctttgattcaggaacttgagcagaatcaaaggcagatgatggctgagttgcagaacctcaggaatgaacattctacttgtatgtacacaatttctgctggtaagtctgagatggagaaaatgcaccagaatatgaatgagcagataatgaaatttgctgaagacaagcacattttggaatctctgaacagtgactttgaaagaagggctatttcagctgaagcagcccttaaaagggccagattgaactattctattgctgttggtcaattgcaaaaagatcttgaactgctttcttgccaggttctttctatgcatgagacaaatgaaaatctcataaagcaaaccctttctgattcttcacttccaaacgctgatggtagcccagaaccagtgacatatcctaaaatttcagaaggtcgtactttcaatcgatcgctatgtcaaaatcacagttcttccttacaaagacaacatttgggtgaagacattttacttagcgatttgaaaagatcacttcagttgcaagaggggttatacagacaggttgaagaagaaatcagtcaaatgcattttgtaaatatatactcagatgtgttttctaaggctctgcaagaaacattgcttgaagcaagtcttgacattcaactcatgaaagagaaaattgttcaactctctcagcagctggagcttacaaatgaatccaacgagttactggtgttgaggttgcagaatgctatgaatgatatcctctcgctaaatgagtacaaggagatttgcactgcaaagagcaatgatattgctctccagaaccaaattttagaggcaaatttaaaagatcttgctcatgaaaacaatctccttactgagaaaattaatgagttggaagttcttctgacagagtatagaagttatgagggcaagtacatggcatgcagtacagaaaactcagagttgagaagtttattgaaaaaagagagcctaggaaagaaacatcttcatgatgaaatatccattttgcaggaagagttaaaatctatcagaactaaatttgacgagcaagtttcaatgaaggataatctgcagaataatgccatctttttatctaaaaagttgcagaaattgcttgcatcatatgaagaaagacacagtgaactttctctttgtagtagatctgcttgtttggattcagaatgtgaagatgtagaaggtctcttattgcaactagaagagctgcaacaaagtgcatttcatagaatcctactactcattgaagagaaggagattttagtgcatgaaaaacttatggctcaagtatctttaaataccgcagaatcagatgttctagtcatgaaacagaaggttgagcatgatttgcaagagatggtacagaagataactgtgtcaggtgccctgttgcagaaacttcagttaaattttgaggtgatcattaacaggattaatgctggttttgaagctgaagaattatattctcagcatcacaaagagtttttgtctggtctggaccatttggaagctgagctacaacaacttaattccagaaatcaggaccttgctcaagaaataataaagctagatacttcatcaagtgaccttgaaatgtgtaagctgaccttagcaacaatcaaagaggaaaagaaagatttagagtcgtctttacaggaaaaaacagaagaatctactaagatttcatctgagcttgattttttgaagaagaacttggattctctacataatgagttgcatgctgagaaaactgtaagagaaaaattagagaaaacagtttccgatcttaccacagaattgaatgagaagcaacgtcagctgcagggaaagaaagatttggagtcatctttacatgaaagagcagaagaagctgctaagatttcatctgaggttgattttttgaagaagaacttgcattctctgcattctgagttgcatgctgagaaaactgtcagagaaaagttggagaaaacaatttccgatcttaccacagaattgaacgagaagcaaacccagctgcagggaaagaaagatttggaatcatctttacaggaaagagctgaagaatccgccaagatttcatctgagcttaattttttggagaagaacttgtattctctgcatactgagttgcatgctgagaaaattgtcagagaaaagttggagaaaacagtttcagatcttaccacagaattgaatgagaagcaatgccagcttcaggattctgatctgaaaagacaagaacttgtccatctcaagcaaatggtgacagacttagaatttgaaaattcaagaatatcagatttgctacagaaatctgagaaacatcttacagatgctttaaaagaatcttcttctattagttgtctggaaactcagttatctgaaatgcatgaattttgcatagctacagatgttgtcatgactttcaccagagctcagtttgaggatcatatggaggagcttgctcagaagcttcattccacttgctggcaacttgatgtggtccacaagaagaatcttgatgtagaatctgaattggatggctatctttcaagagaacggacttgcattgaagaaaatacaagattgttgacgagtcttgactttgtgaaatctgagatagatgtcttgaccactcagaatagagcactaattgatcaaaacagtgcaaatatgttggagcttaaggagcataagagtaggacagagaagatcagtgatacttatgtgcgtgaaagacagagtgtccctgaggttgcaaggctggagcaattgctggcaagttgttgcagaaatgctgaagaactctttttgtccaaggaagcagcagaattcaagtgtatagttctcctgggcaaattggatgaactggaaactgcattcacttcattaaaacaatctgataatgagctgataaggctgcagaaccaatgcaatgaacttaccaagaggcttgctgaacaagttttgaaaacagaggagtttaagaatttgtctattcatttgaaggaactgaaagacaaagcagaggctgagtgtgctaatgctcatgacagaagaggacctgaaggaccaccggttgctatgcaggagtccttgagaattgcatttatcaaggagcaatatgaatcaaagttgcaagaactaagacaacagctgtctttgtcaaaaaagcatagtgaggaaatgctgtggaaactacaagatgcagttgatgaaactgagaaaagaaaaaagtctgaagcttctcaaataaaaattaatgaagagttggggatgaagatcttggaattggaggctgagttacaggctgtactttctgataaacgcaatttgttaaatgcttatgacctgctaaaggctgaaaaggagtgttcagtgataagccttgaatgttgtaaacaagaaaagcaagagcttgaagcttctcttgtaaaatgcaatgaggagaagtccaaaatcgaagtagagcttaccttggcgaaggaattggttgagacttcgggatctcatgtgaattctctgaatgagggcaatggtacattctcttcattgaatcctcaagaaaattctactcatgctgcttgcagtcatgagccagagagtgcaagcatcaatatgcaatccaaggatcctcttgcatttagtgttatgaatggatgccaaactcttggaactgaaaaggacttgcaactagaagaagtaatgaagcatgtggcatcaactcaaagtttgaaatctagcattgatcacttgaataaggagttggaaaggatgaaaaacgagaatatgcttccttcagtagacggtcaaagccacgagtcaagttttccaggtctacaaagagaactgatgcaattacacgag

SEQ ID NO: 16743 - DNA, 489 bp, Glycine max
  Peptide Sequence Number=SeqID_133521
atggcaccagaggatatggcaaagacaaccttcatcaccctatggggaactttctgctacaaggtgatgtcctttgggctcaagaacgctggggctacttaccagcaggctatggtggcattattccatgacatgatgcataaagagattgaagtctacgtgaatgacatgattgctaaatcaaagaccgaggagctgaatcccacaaagtgtactttcggggtcaaatccaaaaagtttcacggttttatcatgagtcagaaagaaatagaggtagaccgagataagctaaccgccacttgtgagccttttttcaagttattgcgtaagaatcagtccatccaatgggatgatgattgtcaagtagcgtttgaaaggatcaaacggtgcttcatgaatccttctgcgctcgtttccctggtgcccggaaggccccttgtcttgtatatgactgtgttagatgagtcaatggggtgtgtactgggatag

SEQ ID NO: 16744 - DNA, 741 bp, Glycine max
  Peptide Sequence Number=SeqID_133522
ctttatgttgttggaggggttagtcaaggtcaagctggattggttcctctccaatctgctgaagtttttgacccctctacagatacatggtcacatgtacctagtatgccattctctggagctccagtcttgcccagtgcttttttggctgacatgccaaagcctgttgccacagggttaagctcatacatgggaaggttgtgtgttccgcagagtctgttttcatggatttttgttaatgttgggggacaaatctacgatcctgaaactaactcgtggatagaaatgccggctggaatgggtgagggatggcatgtgcggcaggcaggtaccaaattgagtgttgtggtggatggtgaattatatgcttttgacccttctaattttgtggatggtggaagaatcaaggtatatgatcaaggtgaagatgcttggaaagtagttattggaaaagtccccatatatgattcttctgattctgagtctccatatctacttgctggtttccatggaaagcttcatgtcattaccaaagatgccaatcatgatattgcggttctgcaggctggcctgcgcgataatttggattcttcaccatcactctcaactctgtcaccaagtacatcgcaagaatctccagaagtggctgccgaatcagaagcagcaactgtttggaggatagttgccaacagggattttgggcaagccgaactagtcagttgtcaagttattgatatctag

SEQ ID NO: 16745 - DNA, 372 bp, Glycine max
  Peptide Sequence Number=SeqID_133523
atgtcagtgaaaaatcttgtcggtcacctaggagtatatgaaaagacagaccacacactgaatgttacaagtttcattttcggtctcgatctcgatctcgtggcgagggtttttagaagacatgttgttgatttagagctcttcagagggagcgatgacgagaggttgctagaggttatcgagctcgtcaatgagggtgaggacggagaatttggagcgaagaacctcttcctgctccttgttcaagggcttgccctgggtgacgacctcttccatggcgaggggcgaggatgcggttcagcttcttccctgggcgatagggtttatgttggctcaaaaatgagaacgattgaagaatgtgatagggcgtga

SEQ ID NO: 16746 - DNA, 747 bp, Glycine max
  Peptide Sequence Number=SeqID_133524
atggaggaggaaaccacggaatcagaaccatcaccgccaccgctatcatggctacggtcaccgtcctcgccggcgttccaaaccaccatgctgggtgacgtgatcggaacggagagcggggactgcatgataaccgacgtggaggaattgagaacggaatctgagcctcggaagacgataataaagcgcagagagaggggaaggaagagggagtttccgccaccgataacgctgctgagagaaacgggagaaatgccttggagtttggaaagggaatatagcggcgacggaaggttaatcataacggcggtgccggagacagtagtgaagcgtggtcacgagtattgcagcattatggaagctcgtcgagaagacgggagactcacgatgagattcgccccagaagaagacggtgattactgcgaagaatgtggttacgccatcgattatgaagaagatctggaatttaaccaaggatttgacagtgttgatgatgaggatgagtgtggttttgagtttgaggaagagtcggcgaaggaagcttcgaacgagagtgagcgatgtgggaaattagatttacgtgagtgtgttacatatgatgggcctgggcttgggcctgtggagatgcttcagcttccccattcggattcggaccctttcttgaaaggtactggatttggagatcttaatacctgtttgggccggcctgcttctgcacctctaaggcccatgactcctgtcatgtga

SEQ ID NO: 16747 - DNA, 432 bp, Glycine max
  Peptide Sequence Number=SeqID_133525
atgggtgcattttttagtgtggcgagtacaaaacctgaacaaagggaatggaatgaaatctctccaaatgagacatgtaaaaggcaaagaatgtcacctactgttgatgaagagagtccaacgctaattcctaatctccctgatgagttatcactccagattattgctagacttcctagaatttgttacttcaatgtaaggctggtatcaaagaggtggaagtcaactatcatgagttcggaattgtataaattaagaaaggaacttgggacaactgaagagtggctatatctgttgattaaggttggagaaaataatcttctgtggcatgctctagatcctcattctaagacatggcagagagtgcctaatgcatttgatgaaatgcccttttgcggttgtgcaattggagctgttgatggatgtctttat

SEQ ID NO: 16748 - DNA, 1671 bp, Glycine max
  Peptide Sequence Number=SeqID_133526
atggtccagtcaccctctacagatacctctgattcttcccctgatgacatcatcagaatattaaggaaggccaaatcgttcaacgtcctaattcgccttctgaaaaccacccaattgatcaaccaaatcaatgctcagctaataaccataagatcaggtggcttaaccatctttgcaccagatgatggaagcttttcacaactcaaagcagggttcctcaactctctggccgacaatcaaaagatcgaacttcttcagttccatgttcttcccacttatgtttcaagctcaaacttcgattcactgagcaaccccgtgagaactctggccggggataatcccaccaggttgcaatttaatgtgacagcatatggcagcaatgtgaatatctcaacaggagtggttaatgccacggtcacgggagttgtgtactcagataaggtgcttgcagtctatcatgtggacaaggtgcttctccctttggatttcttcaggcctaagccaccagctcctgcaccctctcccgcaatggcgccaaaagctgataatgataactcatctgctgatgctcgccttggaacatccaaggacagcgctgatgcaagcagtttgataagtactcgaggaatgacattgctgtcctttggagttgctttagttgcattgaacttattccacctattggattgcgctcggttgaagctgctctgtgggagggaggattcaaagacaatgtctaagaatgagtatgacagccgaataaagcaagcaacccttttctccttctcactctttctactcttttccgccaccacctttgccatttcacctgcacctgcagcagccccaaaagccccagcaaaaccaccccctacccccaaggccacagcaccatcaccaaaaccattagtccccactttacctcagtctccaaactcccctgactcagtccccgacgacatcaccagaatcctcaaaaaggccaaaatgttctcagtcctaatccgcctcttgaaaaccaccgaaatcatgaacaacataaactcacagctcataacagccaagagtggtggcataaccatccttgcaccagatgattctgctttttccaacctcaaagcaggtttcctcaactctctaaacgaaggccagaaaatcgaacttgtgcagttccacatattgccagagtttgtgtcgagctcaaacttcgattctctgagcaaccctgtgcagacagtggctggaaaagacccagcaaggcttccactgaacgtgaatgcattaggtaacagtgtcaacatttcaactggggtcgtcaacgccaccgttctcggggtagtatactcagataacaagcttgggatttatcacgtggacaaggtgcttcttcctctagatttctttgtaaccaacaaggctccagctttggctccaacaactcttgcaaaagctcccaaatctgcaaaggataactcttcagaggacgatcaagaaggaacaaaccagcatcagaacaaatctggggcagtgagtgtggttagcattggccgaacaacgttgatgttgcttgggatagctttggtggcagtggcaaccatgggccttatttccaacatggagttgatccatttggcagctgcattttcaattttcttcgccaaacactgttaa

SEQ ID NO: 16749 - DNA, 153 bp, Glycine max
  Peptide Sequence Number=SeqID_133527
atggccattgggggctttacaatgagaaggggtgaaagaaagggagcgagctcagcgcgacaccccctcgctcagcgcgtgcttctgttagatcgcgggcttagcgcgtgtgttgcaggcttagcgcgcgcttctgttggatcatgggcttag

SEQ ID NO: 16750 - DNA, 717 bp, Glycine max
  Peptide Sequence Number=SeqID_133528
atggagaatctcatgctagaggacgttggaacacaatgctatgataggatggatagatggtgtcacaaaacctttctgcattggcatcattgtcacaatcgttgtggggtctgttcttggcttggcattgtggttgcttctattgttgttgtgtctccggtggtggaaaagatagcccgcgaaggcggtgacattgttgtcgaaggaggatatcaccaatggtttggcggaggtggagaggaacaagcttgtgatttgttgaaggctttagtggaggtgttggggaagggtagcgtggggatttcctataagttggtgatggaagaaggaaccaccatggaggtgaagaggtttaaggacattgtggagacaaagaaagagtttgagatgcaaatggaggtcctaattgctcccataaaacttgttgttgacaagttccagcttcttctcgagttcctcaagattggtatgggtgtggaacaagaggtaggaagtcaagctggaatattcagctctcgctttaggcattgttgggtatatttgcttagccttattgctttttccaatcgcaagagggtcttcaatttttggggaaagacacatcaaatcttagaggtccagtctaagcatgttattgatatgcatatctatagcctttgtagcaacatatgctttcttatggaacaagaaacagaacaaagatttggggcagattaa

SEQ ID NO: 16751 - DNA, 141 bp, Glycine max
  Peptide Sequence Number=SeqID_133529
atggagagcgttgagcccgatgctgcggattgcttggatggttgcactactggttgtgttcaaagcgatttgaggcttcaagcacggtgtgatcgcaagtgcaacattagatgtggtccaggaaaaataatcttaagttaa

SEQ ID NO: 16752 - DNA, 219 bp, Glycine max
  Peptide Sequence Number=SeqID_133530
atgaccattgagggctttacaatgagaaggggtgaaagaaagggagtaagtgaaacccctaggagagagctgctgaagtgggctttgggccttcgtaggcgagctcggcgcgacaccccctcgctcagcccgacaccccctcgctcagcacgtgtagatcgcgcgcttagcgcacatgttgcaggcttagcgtgtgcttctgttagatcgcgagcttag

SEQ ID NO: 16753 - DNA, 849 bp, Glycine max
  Peptide Sequence Number=SeqID_133531
atgaagcaagcaatccttttgtccttctcactgttgctactccttgcctccaccaccttggccatttcaccggcacctgcagcagcaccaaaagccgcagcaaaaactcctcctaccccaaaggccgcagcaccatcaccaaaacaattagtcccaactttacctcagtctccagactcccctgactcggtccccgacgacatcaccagaattctcaaaaaggccaaaatgttctcagtcctaatccgcctcctgaaaaccacagaaatcatgaacaacatcaactcacagctcataacagccaagagtggtggcataaccatccttgcaccagatgattctgccttttccaacctcaaagctggcttcctcaactccttaaacgaaggccagaaaatcgaacttgtgcagttccacttattgcccgagtttgtgtcgagctcaaactttgattctctaagcaaccctgtgcagacagtggctggaaaagaccctgcaaggcttccactaaacgtgaatgcattaggtaacagtgtcaacatttcaactggcgtcgtcaacgccaccgttctcggggtagtatactcggataacaagcttgggatttaccatgtggacaaggttcttcttcctctagatttctttgtaaccaataaggctccagctttggctccaacagctcctacaaaggttcccaaagatgctaaggataactcttcagaggacgatcaagaagaaacaaaccgggatcacaataaatccggggcagtgagtttggttagccttggtggaacaaagttgatgtcgcttggaatagctttggtcgcagtagcaaccatgtggagttga

SEQ ID NO: 16754 - DNA, 171 bp, Glycine max
  Peptide Sequence Number=SeqID_133532
atgttggtgtcggctgagaatggcattgggggtgttacttcggtggcgacagcgagggtgacaagctcgggagcaatgatgatgaacgaggttggatcagggacagggtcgaagaaatgggggaggccaggaagtatccattgtcgtcatgagaaagggatatatggttaa

SEQ ID NO: 16755 - DNA, 288 bp, Glycine max
  Peptide Sequence Number=SeqID_133533
atgaaccatttgatgaggggcaccactattgatactaccaaatatcaaatcatgggaaattcgtcttttggagttgttgccgttggtgatgagattggggtgaatcttgtcaaatttgggtgtggtccaagtgggatggtgtgcacacaatggtggggtgaaacagaggtgttgcgagcacaaatttattggtgtcgaggtgttgtttgggttgctaagcagaggtgttgttcaagtgatatttggctatgcgatattgttgttgatatggtggtgatggcggtgtga

SEQ ID NO: 16756 - DNA, 240 bp, Glycine max
  Peptide Sequence Number=SeqID_133534
atgtcaatgaaggagagttgccatggaggccaaggcggaaaaagaggttttaaggataacccttttcttgtcttggcggaaggcttgggtaacctgggtgcaattcatgtttttagggacctcattcagagtcagataccagatgttatgttcttgtcagaaacactagtacatgcgagtaaagtggaggaaataaaaaggacaatcgacttttataattgctttgcagttgatagatag

SEQ ID NO: 16757 - DNA, 999 bp, Glycine max
  Peptide Sequence Number=SeqID_133535
gttgatcgtgtagatgctcttccaatcaagacattggatggaaaaatccattacgggacagctacaaagacagtattggaaaatgatccaagtgaagagggaactggagaggatgtcaataaggacaaaggtatggtcaagctaactaaggctgaaaagagagccaagcttaagaaaatgagaaaagaggcgaaacaacaagggaaagaggtggctaaagcagaagtggaagagacaccacaagcagcagtactggctgaggtaaaggaagatcttacagctgaggaggcatttgaaagtaagaagcataaacttgcagagttggggaatgccttgcttacagatccagagcttcctactgaaaaggaactagaaatgaaggtttcaaagactgttagaaagatgcgttattatgagtcatctcttctttctgcatacaaggaaatatggagaagtctggaacacgaaggtgcatttagcgcaagtcacgcgctaagcacaagaaaactgccatactcgctaagtgtggtaattgcgcttagtgcaaaggttgaagctgattataaggctgcatccttagccccggatgttatggagaagaagcatatgcaagctgaaacagtctctgctgtctttgagacatactttcgcattttgaagcatacaatgcagtccataaatgccaggcctgaagcaaacactggggcattatctgctgcagtgggacccctccctttgcttgctccatgtctgaaaggactagcaaaattttcacatctcattgaccttgatttcatgggtgatccaatgaaccatctgagattatttgcttttggaggtagcacctcaggcaacacttctgacaaatgttctaaatatttgattgtatcggaacatttccaacagacccaaggcgtctcctcgcttagcggtcaacccaagcttagcatgaagaagctcaaaggcacacttagtgcgaatctagcaccaagcatgtga

SEQ ID NO: 16758 - DNA, 222 bp, Glycine max
  Peptide Sequence Number=SeqID_133536
atgaagatccctgttgctcctttagcactagatgctaccaaaaatggttcaaataacaacactcccaacattcttagtgagtcaactgacaaacaaagaacccctgaaaaaagaaagtcacatggatctaacatagacaaacgtaaaacaaaggaggttgtcttcatcgggggcaagcatcttgcatctagggatgactttatggatcttcgcccaacttga

SEQ ID NO: 16759 - DNA, 1518 bp, Glycine max
  Peptide Sequence Number=SeqID_133537
atggttggaagcaatgggaatgcacattcaaatggctctcttttgaatgttaatgggggtagtttagaagagaaggttgatgagattcgtgggcttcttgggaaagtggagggtgatccattgagaatagttggtgtaggagctggtgcttggggtagtgtgtttattgctatgctgcaggaggcttatggtagtttaagagaaaaagttctgataaggatatggagaaggccgggaagaatggttgacagggccacggctgagcacttgttcgaggtgatcaattcaagggaggatgtactgaggagacttattaggaggtgtgcatatttaaaatatgtcgaggctagattaggtgatagaacactttatgcagatgagattttgaaagatgggttttgcctgaatatgattgatacccctctgtgccctctgaaggttgtgacaaacctgcaggaggctgtgtgggatgctgatatcgtgattaatggcttgccatcaacggaaactcgtgaggtgtttgaggaaattagtaagtactggaaagagagaatcactgtccctgtcattgtatccttggcaaaaggtgtagaggctgaattgggcactgagccacggataataacaccaactctaatgatcaatcaagcaactggcgttcccttggacagcatcctttatcttggaggaccgaacattgcctcagaaatttacaacaaggaatatgcaaatgctcggatatgtggggcagaaaaatggaggaaaacattggcaaagtttttgaggcaacctcactttatagtgtgggataatggtgatcttgttactcatgaaatcatgggtggattaaagaatgtatatgctattggagcaggaatggtagctgctttaacaaatgaaagtgccaccagcaaatctgtatactttgctcactgtacttcagagatgatttttatcactcatctattggcagaagaaccagaaaaacttgctgggccacttttggctgatacttatgtaaccttgttgaaaggtcgtaatgcgtggtatggacagaagttggccaaaggggaattgagccttgaaatgggtgacagtatcaagggcaaggggatgattcaggttttaaaagcggtccgcgattgcgatttcagcttcaacgaggttttttgggtcattgtggctgcatttgtctgcaatgtctcgcaataccaaggatcgcaacagaaccgcaactgtcaccatgaatccggagtctctgctgttagggccttttatgagctacttagccagtccagcttaaatgtcctaaatcctgaagagaacaagcatgtagccccagtggagctctgtcccatcttgaagatgttatacagaatattgataataagggaatatccagcccaggccattcttgaagcattaagggatgagacaatgaatgatccccgtgaccgcattgagattgcccaaagccatgtgttttataggccatctcttcttggtcacaagccttag

SEQ ID NO: 16760 - DNA, 273 bp, Glycine max
  Peptide Sequence Number=SeqID_133538
atggagcttcatgtactcattctggggattgacaaggctggcaaaacgactttgctggagaagatgaagtcggtgtactcaaatatagaaggcattcctcctgatcgaattattccaacagtgggattgaatattggtcgcattgaagtggcaaatagtaaacttgtgttctgggacctaggaggtcagcttatgtgctgcttgtttaaactcttccattctagaagctcagtagctaaagcaatcatcatctacatagttgctgaagtgtaa

SEQ ID NO: 16761 - DNA, 773 bp, Glycine max
  Peptide Sequence Number=SeqID_133539
atgacggcaacgaagtgcgatagacggtggccgcagaaagatccgatgacggtcgaaagggatcaagagtgggcgatttcgcttctcaaagttgtttctcgcatgagaagagaactaaagaacttaaggataaaaataatttgctataaaaaagaaagaaagagaatagagaaggcgttgaaaggtgttgaggcttggctcaactcaatttcccacacaacacgcatccgattcggagcaatctctgtttcatcttctttctttctgattctgattctgatgggtatctcgtggagtggcaacagcagaagaagaaacaattacctccaaaaccgaccaccacccccttcttactactaccctcctgaatcccaccctcctcctccgccaccgccaccaccaccaccgcagtctcaaggctactttctcccttcaacaaccccctacgcccctccccctcccttgcctccaccaccaggtcctccccaaagccactcaatttcgttctattacaactccaaccccaattcctacggcactcccactctcgcccctcgatttcactaccagcattactaccagccccatccctccgcgtgtcccgcccctcgtcccgcctccaccactcctccgccctacgtcgaccaccagaccgccaagaagataaggaactatgtcaatgtccacaaagacaccctgcgcctcgaggtcgacgaccacaaccccgatcaccatcttctttccttcgttttcgatgctgtctacgatggcag

SEQ ID NO: 16762 - DNA, 621 bp, Glycine max
  Peptide Sequence Number=SeqID_133540
atgagctcaacattatcaacaacctcaagcaggatgagggatcccataatgactctgccctgcatattacagtttattgcagcatttcacaatgagaagtgggcaccatgttatccagaattcgcccggtttaactatgatggagcctcataccaaatatgcctcagacaatatcaacgaaaattgttctttgctgatggcctcaaacagttgaggaagcatttaaatatctacgagccaattactatcaactttatggcctgtgaacacagatggaattttgatcttcatttcagtccttcgctcgaacaacaggcatgtggcagacccctaccagcatttagaatgcatatgcttccacctattgcagcaatacaccttccttcttgtggtttccatatgaccattttaagaaagttcgggcctccattacaatggtctgtcgtcccgattggccctagctttcatggcaagtatgttgcagagccatggtaccggtttcttgctgaaggtgattttgttcatggagacgaacttttattctattacagaagtcatgaggatatttgggaaacggttattagaaaacagaggaattggggtgacaatgatgattggtga

SEQ ID NO: 16763 - DNA, 666 bp, Glycine max
  Peptide Sequence Number=SeqID_133541
atgtcaagtgccaatgaaataccaatgagaaaccacagcattactatcttatactttgccaaggaagaagaaaaatgtaggtttgttccattatatcctgatgcatttcagccggtcagaatcccctttcagaaaggagttggccagaaatttgctcagccttctggaacaggaattgacctaggcttctttgagttggatgatctttcaaagccctcacccggagaagatgtctttcctcttgtaatatgtgctgaaacaagtttgaaaactacctcagaagatgaaactcctggtgattccttgctagatgcatcccctcacatgcaaataactcaaggtatcttagagaaaagtaatggtgctggtccattcctaataaaagtagttaagcagattttgtggattgatggtgttcgttatgagttgagagagttatatggaataggaaactcatccacagatgattttgatgacaatgatcctgggaaggagtgtgtcatatgcatgactgaaccaaaggatactgctgtcttaccttgtcgacatatgtgtatgtgcagtgagtgtgcaaatgctcttcgacaacaatccaataaatgccctatatgccggcagcctattgaggaacttatagagatcaaggtgaacaatggtgatcaatga

SEQ ID NO: 16764 - DNA, 303 bp, Glycine max
  Peptide Sequence Number=SeqID_133542
atggtcattttgcaccctttatcattaaggaacaacaagtcgagtgatacacgcgcagagactaattatggtcattctgcgccctttgtcattcacggacagttccgctggcagggagattcactggccgaatggtgtttcgctcgaacgaaattagtgtcttatctttacttcccttttatctccaataaaagacaagtaaagaggggcaactgtcatacccaaatttcatccggggaccatctgtttgttgggatgcgaccctcgtttgaccacttcgaggtacttggcacccatcgttag

SEQ ID NO: 16765 - DNA, 2126 bp, Glycine max
  Peptide Sequence Number=SeqID_133543
atggcgggatctccatctgcttcggccaaaaaagccattgttgaaaccagtacaaagtcgtgcaaaaaagtcattgatgaaatccatataaagttcggaggagtcattgatgacctttgtacaaatatacatggtcagatccgagaagccgaagccgaagccaaagccaacgagatagccctagctattttggaggaacggcttaaaaaagtggtcatcccaaaagaagttcccaccaaattgatgaccagcgaagtcttggagaaacttgaaagcgttgcaaaggacgcaaaaaatttgaataagatggtggtggccatggatcaatctaaggaagtctgggatattgtggcttatttttccttgtttcctcaacatggcgagcttgatgctgagagattaattgatctctggatggcggaaaaattttgcaattctccaaaaggcggtcgtaggtgtttgagccagctggatgggaactctatgttccaagacgtgaagaaagacgagtttggccaagtcagaagcttcaaattgcatctgctaatgcatgaaatagcagaactcgtggaaaaacatcaccattccattagggagaacatcaccattccaaacgaaaaccaggttcactccaaagtccagcgagcctcaattgatttgagtgacagtcgtctagatcctaaacagctttatcaccaggcaaaacaacttcgaagcatttttttcttcaaggaaggtacgccgcaggtggatatagacaaaattcttgaaaaaatcttcaagaacttgaagctgcgggtgttggatctccgtaatttggggatcgaggttgtgccgagctctattggggacctgaaggaattagagtatctggacctgtcccagaataaaatgaagaagctccctagttccatcgccaagctttccaagttgcatactttgaaactgtttagctgtttcgatctcacccgcatgccttgtgaaatgagcaagctgagttctctaaagacattgtccacttttgtggctagcaagaaggaaaccatgggtggccttggggaactcgcaaagctcaacgatttgagaggaaacttggaaatcttgcatctggacagggtgcgatgttcctcctctacaaatggggaaagaaagttattgttggcaaaagaacaccttcagcgcctgacactaagttggactcccaaaggtgacaaagaggggggccatctttcacaactactggagtctcttaaaccccattctaatctgggatcactaatccttgtgggttttccaggttccagccttcctggttggctcaattccttaacaaaacttgttaagttaagcttgcaggacttccagaagcctcacggatgcaaattaaaatatctctcagagcaggataatcaacttcccccaaaactcaagattctcgaacttgaaaatttggaaaatctggaatacattacagaaaagtgtatcgacggggaaaatttctataaatccctggaggagatgacaatcaagaattgccgtaaactcgaaagttggcggggaacggagacagaagctgggccgttatttgagaagatttcaaaactacacctccacaattgcaccttaaaactgctgcggctgaatactacgtccattccccttaaggatcttcacattcaatattgccgtgatttagaaaacctgtccggtgttttccagcacctgagctcactccagcgtcttacgattgagaactgtgacatgagtagtcttgacggggaaagcaaagcatgggagggtctgaaaagtctgtcttgtctcacgttaagggatattaaacatctcagttccctttcatttggtgacggcgttaccactctccaacaactcacccttgagaagtgtcatctattaccttccatttcgataggcaaactcacctcactgcaagaactcacccttcgcaactgtgataagttaacttctatttgcatagacaaggtcgcctcacttcggagcctgaagatttctggatgcaacaaattggagtcgctgcccaaaacgagtgaagctcttaattctctaaaaaccttgcatattttggactgcgccttgttacagccaag

SEQ ID NO: 16766 - DNA, 224 bp, Glycine max
  Peptide Sequence Number=SeqID_133544
tggtggatcaatcttctcctcagcagctagcagaccctcctacgccagtgcatgagatgccagcagacccttctactccattactggagattctagaggaccctgccacaccagtcctaggactgactaccactccttcaaccactcatgtgctacattttacagataaggagggcactcaggatcaggatacccagcaggatgaccagtcacatgagttttaa

SEQ ID NO: 16767 - DNA, 330 bp, Glycine max
  Peptide Sequence Number=SeqID_133545
tggtgcctctgcagaaccagggcagcgcgctggccacctacacagcgtttatggatatgtcgctcggcatcaccggtccgatcgcgagttttatcatgagcttcgccggtgtacagctggtctatctgctgactgcgctgctggtgggatttgcgctgctttgtaccctgcggatgatcaagcgtcaggctgggatgccagccggggacgcggcgtccaggtgaaaaaaaggcctccgaccgaggccaacactaacaaaagcgtctacgctccggcgctgaccctctcgctgactgatcgtcctgccaatctccctgctgctgattacgg

SEQ ID NO: 16768 - DNA, 396 bp, Glycine max
  Peptide Sequence Number=SeqID_133546
atggttaagtttgaccctgaggtagtcctggagttttatgctaatgcttggcccacagaggagggagtgcgagacatgcgttcatgggtgaggggtcagtggattccctttgacgtagatgaccttagccagttcctgggtgacccgccagtgttggaggaaggccaggagtgcgagtttagccagaggaggaatagggccgacgggttcgaggaggaggccattgcccagctgttatgcacaccggggcaggatttcactcggaccgctgtagggaggcgggtgcggatcatgcgtaccagcatgaccaccttgacccaaacgtggatgacattactgctcagcaatgccttgcctagcgatcataactccgatctccctctgccaaagtgttag

SEQ ID NO: 16769 - DNA, 255 bp, Glycine max
  Peptide Sequence Number=SeqID_133547
atggagtgttatgttaacttttggtttagggaaagaaagaaaggaaaaaagtctcagagaatctcaagggttttagtgagattgtctgatggtttttcaataaaaacaagtcattctggtaggagctcactcaagcgcccagaagctcgctcaagcgtcagcaaacagagaacaaaagtcaaaattcaagttggctcgcttaagcgagcaatctcctgtttaagcactatagttattgaggcccaatatcaatag

SEQ ID NO: 16770 - DNA, 267 bp, Glycine max
  Peptide Sequence Number=SeqID_133548
atgatcgacttcagccacgccaacagcagcaagcagttccagcgtcagatggtggtggccgcagacgtggcgcagcagattgccggcggcgagcaggcgattaccggcgtgatgattgagagccacctggtggaaggcaaccagagcctcgacagcggtaaaccgctggtgtacggccagagcgtcaccgacgcctgtattggctgggacgacacggaaaaagcgctgcgtcagctggcgcaggcgatcaaaacccgtcgcggctaa

SEQ ID NO: 16771 - DNA, 144 bp, Glycine max
  Peptide Sequence Number=SeqID_133549
atgtcggcaaggacaccctcatcgcgtgcctccgccactcctgttgcgccctccacttcgttgtcaccgccaccccgccgagctgaaggagacgacgttggagttctcatggccaatcacaagaataacatcagtatttcctga

SEQ ID NO: 16772 - DNA, 306 bp, Glycine max
  Peptide Sequence Number=SeqID_133550
atggagaacttccctgtgatcaacttggagaatatcaatggtgaggagagaaagactatcttggaccaaattcaacatgcttgtcagaactggggattttttgagatttccaatcttcaccactcctccccaatgacaggacactttaaacctcaaccaaatttggttaggctcggcacctccttctactggtcaagcatgtactttgacactaaagcttttgttcgcaactgcactacttgtcagcaaaaccaatacctgccacaccagaagccaggttacttcaccaaagcttttgttttctga

SEQ ID NO: 16773 - DNA, 672 bp, Glycine max
  Peptide Sequence Number=SeqID_133551
atgcagattgttgaaccattcatagcacactatatttttgctcttggagttgcaaggttcttgagttgtgcacaatgggtcctccaggtgttttcttttgatgttgtggattttgatggtggagaaatttgggcaacttgcttcaatgttgtggctgatcagttctacaatgttattgaagctggtaagaacatcaatcatgagaaaaatggcactgaagttcagaagagaactctccagttgaaagacatgtctggccgaagtgttgagttaactctatggggaaatttttgcattgtagaaggacaaaggttgcaaactatttgtcatgttggggaatttctagttttggctacaaaagttgtcatattaaatgatttcaatgggaagtctgtcgggactataaccactagtcagctatatgtggaggctgattttcccgaggcttgtacactgaaaagatggtttgaaaatgaagggaagagtgtcccaactctctctatttctagagaaatgtctaatttgggtaagactgatgtgtggaagactatatctcaaattaaagatgagaagttagggactttagagaagcctgattggatatttgtctttgtagttgtttcacacattaaggttgataacttctgttacccagggtgccctctcagatag

SEQ ID NO: 16774 - DNA, 900 bp, Glycine max
  Peptide Sequence Number=SeqID_133552
atggctccttatcgttttatcaaagagccaggcaagccttattcctccactggtggcagcagtagtcaagtcataagcattatcgaagaattcccaataacaaccctgactgtctattacacaaccaggggaagtcaagacgatacatttgacatggatcttggggtgacaccatcgacaaaggccaaacaccaatcaaagagctcatcaactgatatgccaggcatctatcctagcatcatatgccacaaattggttgttttccctcaacctaaaccagtctcacaaaagaagagaaagataggagaagaattacataaggtggttagggaaaagcttgacaagcttctcaaggcccaatttatcagagatgtcagacactcaacctggctggccaacgttgtcatggtgaagaaggctaatgggaaatggcgtaagtgcactgactacaacaacctcaacaaggtgtgcccctgggatggatatctcctgcctagcatcgacaagctcgtggatggcgtgtctggattccagttgctaagcttcctggacgcttattcaggatacaagcaaattaaaatgcatcctccagatgatgaaaaaacctccttcataacgaaagatgcccatttctattattgggtcatgccttttggactcaagaacgttggagctacataccaaatgctcatagaccgagtcttcaaatggaatataggacaaaattttgagttgtatatggatgatatggttgtcaattctcatagcatagcccaacatgtagcagacttagaggaaatgttgggagagattcgcaagtacgacatgtacctcaatcctgaaaagtgcacctttggggttggcaacaaaaaaattttgggcttcatgatcacccaatag

SEQ ID NO: 16775 - DNA, 396 bp, Glycine max
  Peptide Sequence Number=SeqID_133553
atggatggaggcataggttccatactagacctcactctcaaagaagtgaaaaggatagaaggtctcaagaggaaaagaaggattcatggggatcctctagtagagtattggaatgatcttaagagtgctcttgggaagaggcacattccctcctactatgaaagggagattatggacaagctccaaaggcttagacaagggagtatgagtgtcaaacaatatagacaacaaatagaacgactcattttaagagttgaacttagtgatgtaagctccattagagcttgtaggcctaggatcttcttcatcaatggattcctttgcttcgtggaagatgaatggcagcggaatggagaaggaagagagagaggagacgccacttttaggagaagatga

SEQ ID NO: 16776 - DNA, 800 bp, Glycine max
  Peptide Sequence Number=SeqID_133554
atgcaatctcagggacttgcattgcctccagagcctatggttggtccctcaagtccttgtgtcagcataaaggagagttttgttgatccctcagggaacgatcctgagacgggtgactcagacaagtgcgggttgtacatcgaagcaaatcctccccgcctggttgccctaggaagagtttatgagggatcaatagttcacaacgttcctttgttgtctggccaagtgaaggttggtgttgaggaggctaaagatgcacaggctcccgttcctgtacccactgatgaggcagctgtttctccagcaaaacctccacaaaggtcggatcttgaggtcgatgatccactatatctaatgacattaaccatccgagagcttttcttgaagcctttccaggttaactgggatgctaccatgtttggagtgtttaatccagacttcctgctgtacataaagcatgatgctctctccgaaatcgcacacgatggtcaatgtctcagcatatatgtcatacaattgtggattctgaatttgactgagacaagtatgcgagcgaggaattccgatgtgtatggattcctcgagccacagtctattcagagatctgggcaatcacagtttgaattggaaagctacatgaagagttggatgcagagttcacaacgcaatgtctaccttggagcctacctgaatggcgggcactggcaaatggtcatcattctacctaaggaaaacgttattgtctggttttgttccttgcataatagaccagacaactaccttaagggaataattaacag

SEQ ID NO: 16777 - DNA, 396 bp, Glycine max
  Peptide Sequence Number=SeqID_133555
atggttgacaaggccaaaagatataactggcaagccctagatcttgatgccaaaattcttatgcaacaactctccttaggaaccatcagaaccctatcgtcgtgtgataataaagaaaagctgagggagaacagaaacagcttcaagataaacacaaaatgcccagagaatcctattaagtggatgatgccgggttattggatgaatttacaaggacagcacaacacaagaaaatacatccatttgagagataaagttggttacttgggtttgaaactaagacatttccattccaaaatttcacaggtaatcaagccaaacaagcttgcaggaatgatagagcacacaatcaaacaatgcgtttcccttctccttttctggaaaattgtacgatga

SEQ ID NO: 16778 - DNA, 254 bp, Glycine max
  Peptide Sequence Number=SeqID_133556
atgtctaatttgggtaagactgatgtgtggaagactatatctcaaattaaagatgagaagttagggactttagagaagcctgattggatatttgtctttgtagttgtttcacacattaaggttgataacttctgttacccagggtgccctctcaagataggggatagacaatgtaacaaaaaggtgactaataatgcagatgggacatggcattgtgaaagatgtaatcagtttattgacgcatgtgactttag

SEQ ID NO: 16779 - DNA, 1281 bp, Glycine max
  Peptide Sequence Number=SeqID_133557
atgacacaacaaccggacttcagttggatggttcccattgaagtgatgctgggtgccctctaccacggacaagtccaagcctgcagcatctcaagcgtcacggacgagcttcgaagcccgaacgaggcggctttcaagccaaaggaggtctccataggacccttgcacagaggaaccacgaggcacgtgcagctaatggaagagacaaaatggcattacatgcgcgaatttctcgacagaagaggcacgcaggagcagaacagaagatcggagcggaggctcagagagtgtggcaccgatatcctcaagctggataagataatcatggcatgctatggaggtaacatcagatcagaaccgcaagagttggctaaaataatgattgtagatggttgttttctgttggaactccttatcaggcttggtgattttatatgtaacaatagtagtagttatgcaaatgaccctatactgaaaaatgaggagaagatggtgtctgttctgaatgatatcacattgcttgagaaccaaattccattcattgttctcaagaagttgtataggaaggtctttcccgatggcagtgacatcaacaacgataaccgggttgctgatatcgtttgcaaagcttttggttacactgaggtgaaagccccggtccacatacttcacttgatgcatttgtccacagttgaacagactcagcaagagggtaaacgcgtggagcaagaactattgcgctgcgccacgagacttcaagctgcaggagtagaaattaaagctgcaaacaccattgctcgccataagttggtggattggttcaattttgagataagtttcagtgacagcgtgttgcggattccaccgctgtatgttaaggacactacagaagtgaggtggaggaatttgatcgcgtgggagcagagcagaatttggatcagatgtaaatacacttcgtatgcattgttctttcaaggtttggtttgttgtaagcatgacattgagctgcttgagaagaatggggtgatagtgaacaaggccgggaagagcactgatgaactgctggatctgtttcgaacgattgcgaagggagcagagtacatggattcgagctatagcgaaattggtgcgaggttgaacatgtacaacaggggaaaaatcacaactgcatttcaaggattgcctgtagtcacttggcacaagtgcagacatgttttgcagatcattgtttactattggggaaactggtacagaattttgatacgcgatcatattcccacg

SEQ ID NO: 16780 - DNA, 468 bp, Glycine max
  Peptide Sequence Number=SeqID_133558
atgaaacagcctcaatctctctctttgttggagcttgggtttggtggtggaaaggcttgtgtgtcgtctccttcgccgtgtcggagttctcagctagtgcgtaaccacctctttcatcaaccctgtcattggcgcataccaccaacaaccccaatgcccctttgtgcaactccacaaacaccaccgatcgcggtgcccaccatcccctcttctatcgcaattgcaaccccaccacgtcggggagggttgacgggtgttagaatcaagggtttaagagggaacaaggtgggtgccaaagtgcaggggattagacatcaaccacatggtggggttgttgggattgtgggaaatgagggtttggtgagacaaggtcaaggtggtgctggtggtgggggaggaggagggaatgttattaatagggttggtggaaatggtgttggaaacaatgtgagtgttgttagtagctag

SEQ ID NO: 16781 - DNA, 330 bp, Glycine max
  Peptide Sequence Number=SeqID_133559
atgttagtttgtttgacaggttgtaggagagtattgtggttcaaggcaaatttgtcccaaatttgggggaatgtattgggtgattttgattgtggtaagaaaagcaatagccatagaaaattgtataaagaagcagccaaagaagagaaggttgaagtagctgatgactcgctcagtgagtggcatctgcttagcgaggcatacaactcgcttaccaagtcgggaaaccctagaagagaaagattcagagatgtgctcgcccagcgcgtagccagccagcccagtgaggatgttgtctcttctcgcactcagtgcgcccagtcttgctaa

SEQ ID NO: 16782 - DNA, 315 bp, Glycine max
  Peptide Sequence Number=SeqID_133560
atggtgttggggagtgaggatggtgtcactagtaatgaagatttcttgcttgatgatcgtgagcttgagagtgattactacttgagtatatccgactcccttactttcgagtctctgagccccgccattaatttggcatacatcaggaagaactgctggaacctggataatcccacgatcacttttccagggacccgcaagactagggctcggggaccctctaatgcttccacttctgcccctgcttctacttctacaccagctcctgctcctgcaccttcgcagatcacagcaccatccaacacctccgtttag

SEQ ID NO: 16783 - DNA, 801 bp, Glycine max
  Peptide Sequence Number=SeqID_133561
atgttgctcaagtactatcacatagtgatgtctctcatcgacaatttcaaatgtttcgaaatgtattacatccctagagaaagcaacacccgagtggacctactctctaagctggccagcaccaagaagggggtcctaccatcaatcgaggatgaaactcaatgccttaaaaggaaggtcaattactatgtcatcctcaatggtgagttatttaaaagagggttgacaacacccttactcaagtgcctaaatagtcaacatgaagacaacatcatgagagaacttcacgaagggatctacggtctccacaccggaggacgatccctagccaccaaagaaatgtgctatgcacccctcctaacaaccttcatagtctcagctccccatgccccttttccatgtggggaatggacatactgggaccactaccaaaggccccgggagctatcaactcagacttacaaagacttcctgacaagattaggtatcatgtacctagtcacctctgttgaacatcctcagactaacagacaagcagaggcagctaatggagtcatccctagggccctacgtactagactcaacaagtctaagggcttaggaaagaagaactctacagtatactctgggcgtaccactgaaccatcgataaagagactactgtttcagcaacaacaaaatgaagaaaatatgagagtggaacttgataccactgaagaagttcgtgaaatggcgatgattaaggaagaagctgccaaacttcaggcagctagaagatacaatacaaagattaaaccatga

SEQ ID NO: 16784 - DNA, 1539 bp, Glycine max
  Peptide Sequence Number=SeqID_133562
atgaagctagccgaggacaacaagaacctggaggaccaggtgcttgccctgacaatcgaggccaaggggttggggatgcgtgctattaatgcagaggccttggttaggtcttgggatgctaaaattgctaggatttggttggccttggctgctactgacaaggagaaggaggaggtcattagtgataagaagatgattcaacagaaggatttcaatgacctgatgatgattgatgacatctcagaggacacaactcttacaccagaaaggcagatgaccctgacggaggccttacatgttgaaggtgtcagggagaggaatgttaataaatcatcaagttcaaccttggtcgaggagggtactcgggagggaactgttagtgaaccttcgagttcaaccttagtcgaggaggatagtcaggagggaactgttagtgaatcattgagttcaaccttagctgaagagggtacttgggagggaattgttagtgaatcttcaagttcaaacttagctgaggagggtactcgggagggaaatgttattgaattgtcgagttcaaccttggtcaagggaggtactcgggagggacttgttagcaaatctccgagctcaaccttagctgaggggggtactcgggatggaactgttagtgaatcgtcaaattcaaccttggtcgaggagggtaatcggaagggaattgttagtgaatcttcggtgcgtacgagtccaatagaggggggagggagggcacctgcaaaagacactctgtcactcaaattagtagaaatctccaatccaacatgtgactgctctattgacgaacctgatcaaccttcaaaagagttttgttctcttcttgaaggtaccttctcttggaaggacgcaacttggaaaaagcctatatccttagagaattttgaaggaaaaggaattgttcttcataagaagactcccacccctgaggaagcagaaaaacaaatggcaatggatgcacttattgccaaagagcttgtagaagaagaagtgaagggtgcaacccaaagcaagggcaataagaaaggaaaagggaagaagaataaaaagaatgccttacatattgaggagcaagttgccttggaagaggctatcagaaacaatttgaaggactcaactgttgtttcaaacagtcaaactcgaactccattgaacattcgtccaaacagactgagatttaagccacttagactctttacaagaggctttcatccacacccgaatgacatcatctttgcaaaaaggatcatggtgtgtccaaggatgcctacactagaccctaagaagagaaagaagccaaagccttgtgctccaactctacctatatggcaagcaataaagtcgcaaagattctcattcctcattgctaagaagttgaagcaactatttgtagagagaagaaagttctttgaagatgacgctggacgcataggaggagagattcttccttgtagagtctacaactttgatggtgtcattccatgcttcctagtggatgatccctaa

SEQ ID NO: 16785 - DNA, 459 bp, Glycine max
  Peptide Sequence Number=SeqID_133563
atggaaaaatctgagaggaaaaccttcaatgataagaaagcaaagaaagcttacatcacttgggaagataacaatatgaattcatccagagactcaaaaaatgaagtcgtgaattttatagaagaaatcaaggatctgaaaaattctcttgccaaattcactattggcaaaaataatttagatattatactaggaaagcaaagatgtgtgtttgataagactggattaggatatagacctgataaacaacaaaaattatataaaaatttctttgcatctactcaaaagaatagttctcctttcttaatatgtttttactgtggaaagaaagggcataatgcatctacatgctattttaggaaaaatagtaataatattaaaatgatatgggttccaaaagaatcttttatcaaaactgacattcaaggaccccagaaagtttgggtacctaagtcataa

SEQ ID NO: 16786 - DNA, 1194 bp, Glycine max
  Peptide Sequence Number=SeqID_133564
atgaatgtccaggacatcagcgacctggatgcgcaggtgcccaacctgaccatctacgctgcccgcggcgccagcagcacggtcaccgcctacatccgtggcatcggccagtccgatcccacctggggcgccgatccgggcgtgggcatctacctggacgacgtctatatcgcgcgtccgcagggtgcgctgctggatgtgttcgatgtctcgcgcatcgaggtgctgcgcggcccgcagggcacgctgtatggcaagaacaccatcggcggcgcgatcaagtacatctcgcgcggcctgcccacccagaccgagggcttcgcccagatcaccgtgggcaactacagccagctggatgcgaaggcggccatcggtggcccgatcggcggtgccgacagcggcctgcgcgcccgtgtggcggtggccagcatgaaccacgacgggtttggcgagaacaccttcaacggccagccggtcagcgacaagcagatcaacgcggcacgcctgaacctgggcgcgtatgcgggcgatgacttcgacgtgcagttcgcactggactggatcgacgatcagtccggcatgcgcggctcgaagatgctggcgcccaatccgttcctgcgcgcctacccgccgatggacagccgctatgacatccgctcgggcatgcgcaacctcaacaacgtggagagcaagggcgcctcggccacggtgaactggcggccgaacgaagacatcgcactgaagtacgtgatcgccaagcgtgaatcggacagcgaggccaacatcgacttcgataccgctccggtcaagctcgccgacgtgggtggcacctaccacgacgaccaggtcagcaacgaagtgcaggtgaactacgatgccggcggccggatgcgcggcgtggtcggcctgtaccagttcagcggcgaagctggcgggcagatccagaacaactacttcagtgcgcagttcgccgacaaccagggcaaggtgctgaccgacagcatcgcgctgtacgcggactggaccttcgacctgaccagcagactgaagctcgatgtcggcgcccgctacaccgacgaggacaagcgcgcgatcgtgctgaaccgcctctacgccgacccgggcttcagccggccggtggcggtgaccgccgatttcgccaagaagaccaacttcaagaacgtctcgcccaaa

SEQ ID NO: 16787 - DNA, 542 bp, Glycine max
  Peptide Sequence Number=SeqID_133565
gtcatttggtgaagattgatgctgaccgtctcaacacattcttggagacacccgtggtattaactgagggggagaccttacccgcttactccagatactacaggttgcctacaaactatagagagatagaggctgtcttatgcatacttggccgagggttcatcttgaacttaaagggccatcctgggaagattctcaagaaggatttgactagactagctcaggtatggagtgtcctctcatactccaacttggcccccacatcacatacttctaacttgatagtggatagagctaggctgatctttggcctagtctctcacttggatatgaacataggagcgctgatctctggccagatgacctctatagcccagtctaacacttctagacttgggttccctgctctaatcaacgcattatgtagagccagaggggttgtctttgatagcctcacttttgagcacctgagcccgatcattaacttggcctacatcaggaagaactgttggaaccttgaggatctaacagtttctatctga

SEQ ID NO: 16788 - DNA, 246 bp, Glycine max
  Peptide Sequence Number=SeqID_133566
atggatgctggagtacgagctgtagaagtagaaggaagctcagctagccttgccctcgccctcttagcccctcagatagaaactgttagatcctcaaggtgctcaaaagtgaggctatcaaagacaacccctctggctctacataatgcgttgattagagcagggaacccaagtctagaagtgttagactgggctatagaggtcatctggccagagatcagcgctcctatgttcatatccaagtga

SEQ ID NO: 16789 - DNA, 477 bp, Glycine max
  Peptide Sequence Number=SeqID_133567
atgaccaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgttagtgagtcattactaaaatctgctgtaaagcttctatataagctgaaccattttatcaataaacacaagttgagttttattcagaaaattagagtttatctcttttatcttaatgagagtgattctcctaaattcttgagtgattcaagaacaccctggctgtatcaaaagactttcacaaccttgtgtgttgccctcgttggaaagagtgattcttccttcctttcatcttcacccttgttcttcaaaccacaattccagaaaatccacctctgcccagaattatctcgtggccataacttccattttacgcattcaaattaa

SEQ ID NO: 16790 - DNA, 225 bp, Glycine max
  Peptide Sequence Number=SeqID_133568
atgaagaataagaaggcttgtatgcttagcgagaatcatccgctaagcaaggcacttagcccgcttagtgagttgggagaatctggaggagaatcggccaagcttctgcacgctcagcacgtcattagcttgctcagcgagtcatttgtcttctctcacgctaagcgctcccagctcgctcaatggaaaatcacttactcgcgcttagcgcaaaaatggcgctaa

SEQ ID NO: 16791 - DNA, 577 bp, Glycine max
  Peptide Sequence Number=SeqID_133569
tgttcctcttggtgtgggggttcaacaaaaagcaacgacagctcgcggtggccaccggtggtcgtgggtggtggagaagaagcttgggggtgttgggaagggtttaggggaagagaagaaggaagaagtggccactagccaaggtcatgcgataagacctactagtggcgtattgcgcactgaatcgttcaataagggtgtcgaagctttctatggacataggaaggcatctatatgctcatctagatctgttgtcccatcgtaccactcgaggttgagtggtttccacctcaaggatatgtctacctccatattgcgaaaaggtgtgggtggattgctcattgccctggggacatctggtcatggccagcctttagctttgtcaactattccttgtggcgtctctccatctccacgatgcgattttggagttgctatagagattaacgagaggtcgtgggatatgttttaccgcggccctatggtggcgtcaaatgttcttactaaaatccggaaccttgacacatcagggtggacgtggttgaatgggatctcgaacttcacaggtcagcattga

SEQ ID NO: 16792 - DNA, 108 bp, Glycine max
  Peptide Sequence Number=SeqID_133570
atgacttgcttgggggtagggcttgtttctggaagagccaaaagtggcagtgaagaatacttgaaactttttaaagttagtggaacttggtgggttgtcaagaactag

SEQ ID NO: 16793 - DNA, 759 bp, Glycine max
  Peptide Sequence Number=SeqID_133571
atgttgtctcagaagcaagcagaggaagctatagtcacaaacgagacagaacatgaagttagcagcacaagggaagaggagaaggagcaagaccaatcaatgttcagccttaagagcatcctttggcatggtggttctgtttgggatgcatggttcagctgtgcctcaaatcaagtggctcaagtgcttttgacactgccatactcattctctcaacttggcatgctatcaggaatcatttttcaggtgttctatggaattgttggaagctggactgcttatctaatcagtgtcctctacatagagtaccgcaccagaaaggaaaaggaaaacgtcagcttcaaaaaccatgtcattcagtggttcgaagtccttgatgggttacttggtccatattggaaagccctggggctagccttcaactgtactttccttctctttggatctgtgatacagcttatagcatgtgcaagtaacatatactacataaatgacaaattggataaacggacttggacttatatttttggagcttgctgtgccaccactgtgttcataccttccttccacaattaccgaatctggtcttttttgggtcttggaatgaccacttacacggcttggtaccttgctattgcagccatccttcatggccaggtggaaaatgtcacgcacacgggtccatcaaagctagtgctatacttcactggagccactaacatactctacacgtttggaggacatgctgtgactgtgtga

SEQ ID NO: 16794 - DNA, 213 bp, Glycine max
  Peptide Sequence Number=SeqID_133572
atgtcattgcctaacgctgttcatgtgtctccattatcaagtgcgaagcttctggtgactgggaagcacgttattctgttgttttccagatcggttccttcgccaaaagaaaaaaagaaggaatggagacgagagtcgtcatcacagaaaagggcaggacggacgaaatcagtgtcctatctttgctttcctcttatctccgatgagaggtaa

SEQ ID NO: 16795 - DNA, 186 bp, Glycine max
  Peptide Sequence Number=SeqID_133573
atggcgtttttccaaagctacttggactacaaggctcaaaacgcacaagtgagcaatgctctcagaaacggaaacgtcgcgcacactccagacatcttctcaaagatcccaatgggtgttacaactctcccaccctttttgaaatttcgtcctcaaaatttacctgactcaaacaaggatggatga

SEQ ID NO: 16796 - DNA, 285 bp, Glycine max
  Peptide Sequence Number=SeqID_133574
atgaaaggagagaattttctacaattgggttggatggacatagactatgctatatggaaaaatgaaccacccacaatcattgatgaaagtagcccagctgttgttgtgctatatgagcagtgggagcgatccaaccagcttagcctgatgttcattaagaccaaaatctcagccaagatacatggttctgtcgaccagcatgaaaaggtccgagacttgctgaaggccattgatgaccagttcatcacttcagataaggctttagcaagcaccctaatcatttag

SEQ ID NO: 16797 - DNA, 258 bp, Glycine max
  Peptide Sequence Number=SeqID_133575
atgagtacaaagaagagcaaagagtgcctaaaaaacaaagccgataagtcctcgagaaagatgctttggtaccaggggaaggcgcaactatcaacggatattatggaagcagtgcaaaaaatgacttcacctcgtagaccttcacttgcggttgaacttcattcaacacgacttacccaggacacagcggtgagcgtgacgatggacatggggtcagagatgatgacagtgacgacaccgaggaagtcagagtcgtga

SEQ ID NO: 16798 - DNA, 384 bp, Glycine max
  Peptide Sequence Number=SeqID_133576
atgacactaacatactcatgccttcccttagaatcaagctcaacatataggatgacactcatcaccccttggaaaaggaagggatctgatcaggcatatatacttctcagggatgataggagtctccacgtactattcgacctcacggggtcgacctacccattgggacgtcagacacttgatgtcttccaccgcttagacctcttgcttaggccacacatatcaactctcggtgtaccaaaccgtagcttctcacactacatccaaaaccttccacctaacttagctaatccaagtcttttaggctctaaggttcatattcacgaattaaccgtcgagatcaacacacaagggttgttctcaccctttaacaataatatgtaa

SEQ ID NO: 16799 - DNA, 792 bp, Glycine max
  Peptide Sequence Number=SeqID_133577
gctcttcattctctctcataccctatctttgattatgaaaaccatgagagcaaggctccgcaatgtcatcagatatacctttgcgccggaggtaattgcacgaacgaggatctgaatccacggcagcgaagtgaacattgcggcggcaaggacctgtggtacaagggcgaaggccatgaggatcacaaagacgatgacgacagtgacggcggggagcttccagttgctgccgccatggagggcagagggattttcctgggcgacaaaggaggtggcatggactgcggagatggcggcggcaagggagaggtgggaagagaggagggcgaagatggcgcgcatgcagaggagcgagacagtggcgtcataggactcatgccaaacgtgacgtgcctcgatgcgcatggcagtgatgcgcacgacggcctcaaggtggaggacatgggatcggagggggaaggtggagattgcgagggtcccaggatgctcttcattgcgcagaaatctattgcatcttgcaccaagattggcaaatcttccaaagatgaggatcttgaagatcctcatagtagtcatgggaaagagaaacttgaatctgggaagccagtcacaaagataattggttcaattgctaacaagttctctactttgtgttcggatgcatcagttctaagataccttagagtgcgaaactacaatactaagaaggctgcaaagatgttgaaaggatccataaagtttttggtgagatgttccttggagttggatcctgtcacgaaagcaactagttga

SEQ ID NO: 16800 - DNA, 276 bp, Glycine max
  Peptide Sequence Number=SeqID_133578
atggatttcatgaaaacaaaaccttcagcaaaaaaaggtttccaagaaggaaatactcacacaaaccctcgaccagcaaagatgctagtactccaaaacctagatgaccaaccatcgtctaaggataataaagatatccaagaaatcaatactctaacaagagaacaagatcttgtgtttgaggcaatcaattccatacctgaccctcaggaaaagaagacacaacgaccctatttgacaccggggctgattcaaattgtattttggaaggattag

SEQ ID NO: 16801 - DNA, 438 bp, Glycine max
  Peptide Sequence Number=SeqID_133579
gccaatgcattcccactgacgataacactcaagaaattcatttcatggggaatcagtagaggcaagggtatactcaaggaggattttcaggcttccagcaaggtccttataatcagcaaggtcagtggaggacacaccctggcaaccagttcaataaagaccaaggtaacgatgtcgaatcataagagtactaagtcaatactaaagaaccttgaagtatatatgggacaactggccaagcagatagctgacaagtcatcaaacaactttggagcaaatacagaaaataatcctaaggaggaatgcaaggctatgatgactaggagtaaaaggtttgtggaagttgaggatgaagaaaatatggtggacaaggaacaactaagtgaaaagacaggtgctgagattatgaaaaatgatgtgaagggtaaagagaaatag

SEQ ID NO: 16802 - DNA, 270 bp, Glycine max
  Peptide Sequence Number=SeqID_133580
atggaaaattcctggaaatgcacagccctaccgatactggaaatgcacagccctaccgatgtcatagaagttcagaaattgaacggtagactgacgtctttgtccagggaaagcaacactagtgtagactttctctccaagctagcaagcactaagaagattggacaccccaagaacatcatccaggagacactccaatcaccaatgacaaacaccaaggaggtcatgaagggagaaaaaggaggaaccgaactggatgaccccctataa

SEQ ID NO: 16803 - DNA, 336 bp, Glycine max
  Peptide Sequence Number=SeqID_133581
atggccagttactatgtcatccttgacaaggaactattcaaaagagggtcaacaacaccattactcaaatgtctcaacaaccagcaagcaggctatgtcacgcgagaaatacatggaggaatctacaagcaggctatgtcacgcgagaaatacatggaggaatctatggtcttaatacatggggatgctctctggaaaccaagaaatggtctcccatatgccatcgtcactaacaacgacacccaattcaaagctctagcctacgaggaattattgtcaaggctaggtgttaaacacctcgtgacttatgtcaagcatcctcagacaaacaactag

SEQ ID NO: 16804 - DNA, 474 bp, Glycine max
  Peptide Sequence Number=SeqID_133582
ggaatcgggttaaaattcctgaaccgggacgtggcggctgacggcaacgttagggagtccggagaccctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 16805 - DNA, 605 bp, Glycine max
  Peptide Sequence Number=SeqID_133583
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggagggacggaggaggctaggttagccgaaagatggttatcggttcaaggacgcaaggtgcccctgctttttcagggtaataagggcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 16806 - DNA, 1476 bp, Glycine max
  Peptide Sequence Number=SeqID_133584
atggcgggatccttgttcccgcagttgtcaatggcggtacaagctttcccgccggcaacaatggcggcatgcacgtccataacagatcccgtctgttataagtttgaaaagaaaccctctttgaaaatccgaggttatagcattcgacgagtcgaaaaccagcgtcaaaggtgtcctcgattcgcgggggtcacaaaaatccctcccatgttccacgtcaacgtggacctcaccgacacctcacccaacaacgacttcaccatcccaatcgtggaccttcgagacaaggttcggcgcgtggaggtagttgacaaggttcgtggaattcgtgggtttcatgaaaaaaatggtgaacagaggaaaaggttttattcacgcgataatgagaagcgagtgaggtatttttccaacgggaagctcttcagatacatggctgctaattggagagacaacattgtgtttgttgcgaattctgagcctcccaactctgctgaaatgccacctctatgcagagatattgtggctgaatataccaaaaaagtaagggtgttgggcattacaatctttgagctattgtcagaggctcttggccttaaaccttcttacttcaaagaaatggactgcgctgaggcactttatattttgggtcaatactatccacaatggcctgaacctgaactcaccatgggcattacaaagcacactgactgtgacttcatgacaatacttctgcaagacatgatagttggccttcaaattctgcatgagaatcaatggattaacgttcctccggtgcgtggagctcttgttgtaaccattggagatattctacagcttgtgacgaatgacaggttcatcagtgtttatccccaggtcttgtcgaagaatataggccctcgaatttctgtagcaaccttcttcatgaactatacaatatctgaatgtacatcgaagatttatggtccaataaaggaattgttatcagaagaaaaccctccagtctatagggacattactatgaaagaaatcttgacaaattattatgcaaaaggccttgatgggaactcttactcgcagcccttaagtatcttgttaaatttctataaacagcattctttaagttctagaggcaaaagggctattcaggagatatttttcagggggtgctctttttgcacgtaccctgcatgggaagcgccagtagaactggcgacttcatgcatgtgcgacaagtgtcaagtgctggaggaaagtgcaatccttattggcgatttgaccattgaattgcaacacgccattcccgttagcgctttgactggtgttgtcctgtcaagcagcagcagcagaagtgcagggctaggcctaggtgcagggaaacgccattcccattggcgcttcctgcctcctgaaggcgctggtgccattggcgcctcgtgcttcttcgtttataaaatccgtttggccttcaaattttag

SEQ ID NO: 16807 - DNA, 867 bp, Glycine max
  Peptide Sequence Number=SeqID_133585
atgatagatttaagcaataacaatttgagcgatcaattgccaagagcactgctgaaagttgttgctctaagtgataatcatttgtatggatctatacggtgtcctacaacttgtacatttcccaaactgcacatcatagatctttctcacaatcagttctctggaagtttgccttcaaaaacaatccagaattggaaatccatgaaagtttcccgcaagagtcaattacagtatgagtattatatggcgtataagttgttggggaggttcagttggcaggatgatcaatatagctattcatttacaatgtgtaacaaagggatggtaatggtttatgaaaagctccaacagttttacaatctgatagcgattgatctttcaagtaataaattctgtggggagattccagatgttatgggagacttaacaggccttgttttgctcaacctgtcaaataacatgcttggtggcagcattccttcttccttggggaagctttcaaaccttcaagcattggacctatctctcaacagtttatcagggaagattcctcaacaattggaagaactaacctttctttcttactttaatgtgtcctttaacaatctctcaggtccaataccacaaaataagcagtttgctacatttgagggcagttcatttgagggtaatcaagggttatgtgggaatcaattattgaagaaatgtgaggatgatggagggtcaccatttgctccaccttctgcctctgataataatgatcaagactcaggatttttggctgattttgactggaaagtggttctgattgggtttgggggtggacttcttgcgggagtggcattggaaagctatttcagtcattag

SEQ ID NO: 16808 - DNA, 366 bp, Glycine max
  Peptide Sequence Number=SeqID_133586
atggaatatgtccacttaaattgctgtgagatagggataatacagataggaatagaccctgaaaaattgcatcgtgaaattgataaccaattcaaagacttgagatttcctatggatgcaggttttggttatgccccaaatttagatatctcaagtttggaaggtggaatatttcagatggaaattccccatatagttcacaatggtaaagagagagttgttgcaaagatcaagatcaaggctttgaaggtgtttgaggtgaaagaggctgctattagcatccaatataccaaagatttgactgctactaagatcaatggtaatgacatgacctgtgtgctcatcacattgaatgccatcccatga

SEQ ID NO: 16809 - DNA, 345 bp, Glycine max
  Peptide Sequence Number=SeqID_133587
atggtgaacgagagcaccaaaatgatagacacgagctgggttcgaggcccagaacctccaaagaagaagaaagaaacgcagagaacaaaaggaagggaaaagattacaagcataacggaaatggtattgctgccccttgaggctcgacaacaatctcagcagattctttgtgattctgttgaaggaaaagattacaagcataacggaaatggtatgcaggcctgtgaatggccctcttcggttttcctccttgcacccccttattgctatctgaactctgagttacttcctgcacctctctttcactttccatatcaagttcaaatgtcaagtgtggacttctga

SEQ ID NO: 16810 - DNA, 3324 bp, Glycine max
  Peptide Sequence Number=SeqID_133588
atgacccttgtgcaagccgcgggtctggctcgactccaggaagacaagctcctagatacgcactcctctttccgccaccgtgcaccgccggcgttgacgatacctatctcacgtcctacccccacttcggccctcttaccttccccaccccctcgctcacccaccccacgaccccaacccactctgaaacgtctctcaccggaggagattatctcccgcagggaacgcgggttgtgctttaattgtgacgagaagtaccatagaggtcacagatgtgcctctagggttttcttcttggtcgccgaagaggacccagctgctgttgaggttaatatagaagagctggacccaagacccgacccaaccgagacccacgacctgctagcggctcaaatcagtttcaactctttggcgggtcatttagccccagaaacgctccgactgttatggacgatttccagccaccaggtcatcatcctcgtggatgggggcaacacccataacttcgtccaggaggaattggtggttcgtttgggattgacaacacaggaaacgcgtcctctcagggtaatggttggtaatggccaacacttagcttgtaatcaatggtgtgaggttgtcgcggtcaatattcagggcatctccttcaccattgatatgtatgtcttgcccattgccggcgcgaacctcgtcttgggggtgcagtggctcaagtctctcgggcctgtccttacggactacaattccatgttaataaagtttttccatgaaggtcaactagtggagctgcacggggacactgagctcaccctgaatttactatctgtaccccaattccggcgactcctacgcaaaccacatacgagggtctatttccacatcacagtgctcgaagacgcaccccagattgcccccttcttcactgccaccggcccgcgaaacagaccaccacatccacctcctgccgcaagctgcgccagtcaacttcgcaagcaggatggttcatggcacttttgcatggactacagagctttaaatgcaatcacggtgcgtgatcggtttccgatacccaccattgacgagctcttagacgaattaggcaaagcttattggttctccaagctcgacttgcttcaagggtatcaccagatcagaatgcattcagacgacattgccaagaccgcattctgtactcaccacgggcattatgaattcaaggtcatgccctttggcctctgcaatgcgccttcgtcatttcaggtcttagctgagaatcagttcgtcctcaaattgaccaaatgctcctttggtcaacctcaggtggagtatcttgggcatctggtttcttcgaggggcatagagcctgtggcttccaaagtcagtgcaatacaccattggcccgttccaaagtcaactcgtgctctaaggagtttcctcggacttgcgggattttataaacgcttcatcagaggctatgcttccatagcagcacctctggtgcgagtcaccatggtggaaccctttcagtggaccactgaagctcaggacacatttgtaatgttgaagaaagctttgtcagaggccccagtcctcgcgttacctgatttccaaattcctttcactgtggaaacggatgcttccggggtagggatgggtgccattctatctcagcgtggacatcctatagcttatttcaacaaaccattccctctgaaacttcaccatgcttctacttatgtcagggaattatttgcagtgaccaccgcagtccgaaaatggagacaatatctcctcgggcaccattttacaataatcaccgatcatcggagtttgaaggaactcctcactcaagtcatccaaacccccgaacaacacatgtacttggcaaggctgatggggtttgattatcagatacaattccgttccggcgcgagcaaccaggcagcaaatgccttatccaggctaccagagcacaccacttccttgttcttgaccctctcagtaccttgtttgacattcaaggacgaattacgagctcagttgaccgagagttctgaattccaggacatggtcaaagccattcaaacatcaccctcagcatatactgattacatgattgtcaatgacttagtgctcagaaaggggcgaatttggctccctcccaaacttgctctcattcctacattgctgaccgaattccacgcgacacccactggtggacacttgggtaccaccaaaaacgtggcacgaatcatggagaactttcactggaatggcttaaggaaggacattgttgactttgtagctcaatgcattgattgtcaatgtgcaaaatacgagacaaaacgcgtggcgggattgctctgtcccttgccagttcctcaccggccatgggaggacctctcccttgacttcattgttggccttcccccgtatcatggctataccgttattctcgttatagtggatcgattttccaaaggaatccacttaggcatgttgcccacatcccacacggcccattctgtagcttgtctgttcatggatatcgctggaaagatccacggtatgcctcggagtctggtaccggaccgtgaccctctcttcgttagccatttttggcaggaattgttccggttgagtggtactcagctacgcatgagctctgcataccatccacagagtgatggtcaaacaaaggtgttgaacagagttattgagcagtacctccgttccttcatgcatcgccggccgagctcatgggtaaatttctcctctgggttgaatggtcacacaatacgtcgtggaatgcggccactgggtccacgccatatgagatcaccttcggtcggaaacctttcaactttccggaatacattaccggcacgtccaaagtggatgcggtggaagaaatgctggtcaattaaactccttaaggcaaaggctctgatgaaacattatgcggataccaagaggagagacgtggaatttcaccccggagattgggtcatgctcaaattgcgaccacaccgtcaatcttcagctaaacacttgcaggcaacatcgggcaagctatctaaacggtattatggaccgtttcagttacctgagggtgctagaattcacccggtgttccactcctctgctttgaagccttttaagggttcaccggagaagacagaaccagtggccctgccttcccgctttgatcagaatcagcccatcattgcacccttaacgattctggactatcgccagcgtactgataaacagtgggaagatttggttcaatgggagggcttatctcccgatgagactacatag

SEQ ID NO: 16811 - DNA, 654 bp, Glycine max
  Peptide Sequence Number=SeqID_133589
atggaggcacaaccctctaaaaccaagatcaagaagaccattgagggaattaaagatatcaaacaaatgcaagacagtgctttaggaaaagttcttgaagtttctgcctatgggagaattgaacccaccagggaggaggagcttggtgttgaagacaaagacgaatgttgctcaagatgcgaccaaaaaattgtgtggtacaagagattgggtcacataagtgagaaagatgtttgctcaatgtctgaaaagtcccttagtggtgcccaatactttgttaccttcattgatgatcgctccataaaggagactagaagaaagcttaaatgcttgagatcagacaatgggggagaatacagaggctcattcgaggcatactacgagactcatgggatacgacatgagaaggatgaatacaacaattgcagagaaagtcatatgtatgctttcacattcaaaactccccaagacattctcggagtcttcgggtgcaaggcttttgtctacatttcgaaagatgaaagatcaaatcttgctaaggcaaaggagtgcacataccttggttcaccaagagatgaacttggatttagactatgtgatcctaataacaagaagattatccaaagtagagatatggtgttcttcgaagattag

SEQ ID NO: 16812 - DNA, 285 bp, Glycine max
  Peptide Sequence Number=SeqID_133590
atgagtaagagctggatttccatcgagtcccttattataaaagtgacattaaagtcctacaataatgtttccctatacattgaggacaataattccttgacggggccatacattcctattgatgggcaagggaggtcggtaaaatggatccgtaacctcgagaaaaggattggctctgagggctgggcacggggtcccagtcccgaacccgtcggctgtcggtggactactcgagctgcttccgtggcgagcaggtcgtcgcgtgccagtcgggggacggattga

SEQ ID NO: 16813 - DNA, 237 bp, Glycine max
  Peptide Sequence Number=SeqID_133591
atgggatgttacaacgcgaccattaatgatgaagccttggttaagtctccggatggcgagatttccaggcttcggtcagccttaaccattgccaagaaggagaaggaggaggctactactgaagacattctagaggatgcagcccctaatcctgtgagggcgatgaccccggtggaggactttcatgctgacaatgttggggccgaggatgaagacaatgtaggacccatggactaa

SEQ ID NO: 16814 - DNA, 432 bp, Glycine max
  Peptide Sequence Number=SeqID_133592
atggcaacttgggcaactgattccaggctacaaaaccaacttattcaatgcaacatcatctacaattttgtgggatggaggagagcgactaagtgcatgcagatggaggagttggccgaatataggaaccgggtgttaatggatgccgtgtcggccaaaaaagataatgataagcccaactctaacaaatcttgcaatgacgggatgagggaacgaccaccccgagaacaacgatatgctcattacactctttttaccaccagtagatctcatatcatggatcagtccttttaccgccaaaaagagccaacacaccgccaaaagttgactactcaaaacattgacagtatcactgcaatcgcgatcactcgacgaaggaatgattggccatctaaaggagttcgtccacaagccacagtcatacaggcctaa

SEQ ID NO: 16815 - DNA, 309 bp, Glycine max
  Peptide Sequence Number=SeqID_133593
atggaacacccccagaccaatgggcaagccaaaacaactaacaagataatcccgggtgagctaaggaagcagttggatgaagcaagagaaagatgggttgaagagcttgcggaggtcctatgggtatatatatgcaccccacattctacaacccaagagactcctttttggctaacctataggacagacgtcatgttgttggtcgagttcgaacaaggggacctagtatggagagcatgcggagaagcccgaaaggtcctgacagatggaaatttggcaaccatatgggaaggggccttcagagtttag

SEQ ID NO: 16816 - DNA, 255 bp, Glycine max
  Peptide Sequence Number=SeqID_133594
cctgtctcgccaatggagaaggcaagatcctacgtggctgtctcgccaatgcagaaggcaagaccttctcgtctctcctacgtggttgtctcgccaatgcagaaggcgagaccttctcgtctctcctacatggcctgtgtcgccagtgcagaaggcgagaccttcttgtcacttgtctcgcccatggagaaggcgagaccttctcctacgtggcccgtgtcaggtcctgtaacgccaatgccagtgacaggttaa

SEQ ID NO: 16817 - DNA, 1755 bp, Glycine max
  Peptide Sequence Number=SeqID_133595
atgtctgaagtgaagaacaaagtggatttcatccagttgcttggacctgacatgtcaatcaagattctcacccatttggatgacccttgtgatcttattcgggtttcggctgtttccagttcttggcaccgatttgttattgaacaaggcctctgcaagcaactttgcttgaaaatgtttcctgaaatatctggtgttgctcatatcgttgaacttgacaacattattgaaccactaatcaacactcttggcagttatgtaaattgggagtctcttaagagaattcatagagtctatgcattcttggcttctggtcttactcctatgaggaaaaattgcatctcaaaatctattagtgcatctagcactgataactacccagaagaaagcattctacatacattggagcctggggatagaactcaatatagagcatcatactggtcaagcaaaggggaaagtcatccttctgttcctgagactttagtttataagcttgcttcaaaattatgtcttgttacggaaatctatgtccatcctttccaagcatattttcagcatggcttccctatatactcggctaaggctgtccgattcagaatgggccatccgagacacccaatggaattagagagtgctgtggataaaatggctactaatgacgtcttgggcgataatcaatttatatggacatatacttcacctgaatttccaatgtttcaaatggcatcaacctctgatgtggtggattgcttggatgaagaagcttttcaaaatgttgttggtgcaaatgtctggacacatggtggtgctagcaatattatgaaagccctaaatccggcctttgatagcaaagaggaattgcttgtaccctcttgggacctcagtcctatgctctggggcacacttcagttatcatccagatggagtatttatgccaggaacaggaaaaaaagtgtgcaaaagggaagtagagctacaatgtgctccaccactaagcccagtggtcatagggcatacacacaacaaagcggcgagctaggcagctgtcatatcatgaatttggcagaagggaaaagggggagattgttatttgttaaaaatggtaatcctaggaggaaggacagtgggaaggatatggctactatcagatcttggttccccaatttcaccattgtggacaaggttgaaggaacggtattgatagagcctgatgagttatcagagactgctgtcaaaggagaaactcttgaaactcagaagcaggattctctcccatttctgttgagattcaacaatccttcacagttttgttctctttctctctctttagctttctcagttctttctattgaaaaccgcttgcaaaaattcaagctacctgaacctgttctgtgcattggaggtgtactgctagttgagctgttgggtagagttcaaaaacaagaaatggatgaattattctacatatgcatctcccatgttcaagccatgggacgatcaatttcgccagaatttgacgtcaaaattcatcatccgtcagggaagtgtaccttgaaatactgccctcaaatagattgttatgtgtcttcttcaacatcatcacagagaagtgactcaagcaatccgtcgcgcttgcgaacaataacctcaaacataatgcagaggggtgtgagacgttgggagcaatttctcttgagtgcgctgcttggtactgctactgatcctgttgtagttgataatgatgatcaatga

SEQ ID NO: 16818 - DNA, 786 bp, Glycine max
  Peptide Sequence Number=SeqID_133596
atgcaattgaggcagcaattacaacaacaagtgatgcagccctcttctgctggcaagcgtccatatgacagtggtgttagtggggtatgtgcccgtcgattgatgcagtatctctatcatcaaaggcaaaggccaaatgataatagtattgcctattggataaaatttgtggctgaatattactctcctcgtgcaaagaaacggtggtgcttgtcattatatagcaatgttgggcatcatgcacttggtgttttcccccaagcagctatggatgcatggcagtgtgacatatgtggttctaaatctggaaggggatttgaggcaacttatgaagtgttacctaggcttaatgaaataaaatttggcagtggagtaattgatgaacttttgtttctggacttgccacgtgaaacaagatttccttctggtgcgatgatgttggaatatgcaaaagcagttcaagagagtgtatatgagtcgcttcgtgttgttcgtgaaggtcaacttcgcatcatattcactcaagacttgaagatcttatcatgggagttctgtgcaagacgccatgaagaacttcttcctcgaaggttggttgcaccacaggtcaaccaattaattcaggtagctcaaaaatgtcagagtacaattgctgaaagtggggcggattgggtttctcagcaagatttgcaaacaaacagcaacatggaggttgcaaaagctgttagtgataagacaaattttgacaaggaggttattcaagactatgagcgtctcaggtcatcttaa

SEQ ID NO: 16819 - DNA, 582 bp, Glycine max
  Peptide Sequence Number=SeqID_133597
atggcattcttgggagagacaagcagtaagacagttgtgaactccacattaggttttatttttccaaatggatccattgttcacaacgacagtggtgtttccttccaagcttccacttcaattcccattcgagtacctaacgggtgtgattttcaaacgttaaaaaccagaatacacaatacccttaagttaaccgacaagcaacttttggatgaaatttactaccggcagcgtttcacgtatgcaggaaaaaatcccaaaaactttgacattcccaccggatgtaccatggatgaactgaaggatttgatcaaacaagttgcgcctcgtgggattcccccatatggtgttgatgaaacacaaatggtgattcgtacgttgattcgtaagacacttacggatcaacttgatccagaagttacggatcaagttgatccgggaagtctcttacggattaaggtgatccgtaagaagaaaaacaagcagggacaattttgccattttgttagcatgctgggtgcacctagcaacactccaaagatttttggcatggatagttttattaaaggcctatggttttga

SEQ ID NO: 16820 - DNA, 528 bp, Glycine max
  Peptide Sequence Number=SeqID_133598
atgccttccaaagattattttgatgatgccaaagaatcaagagttaagcaaattccaaagattcaagaatcaaatttcaagaaacaagattcaagattcaagaatcatgtttcaagaatcaagatcaagattcaagaatcaagagaagactcaatcaagataagtactaaaaaaagtttttcgataacattgagtagcacaagaagttttcacaaaatcattaccaaagagttttactgtctagtaatcgattaccagaagagggtacatctacttggggattgttatactgagaacaagagatgctacatctcttgtggatcagttcaagtggagggtacatccacttggttattcaaagagaacaagggagggtacatcccttgtggatctttgcttgaaaaggattttacaaggttattggaaatctcaagaaccggtggttgcttggggactggatgtaggcacggtttgtggccgaaccaatataaatcttgtgtttgtcttcctcttccctacactctttaa

SEQ ID NO: 16821 - DNA, 402 bp, Glycine max
  Peptide Sequence Number=SeqID_133599
tgtttaaggaagataaggtggttccataagtggggtttaaaatccaaagacgagcttcgggaaaattacattggaaggtggttgaaggaagcaggaaaagaaatttacatagcaccttatttaaaccaggcccattggcagctcgttgtattgtgcccaggcgacaatgtagtggtttggctttgttctttgaagaagaagccggatgctgccatcaagggtgcagtaaacagtgcaatgaaatcagtcaccaaaactgcagagggaaagccacctcagcatgggcctcagtggattgaagcaaagagtcatgttcaaacaggaaattacgagtgtggatgctatgttatgcaatggatatggtgcatcgtaagtggtggattgaaggatgactggattcac

SEQ ID NO: 16822 - DNA, 300 bp, Glycine max
  Peptide Sequence Number=SeqID_133600
agggaggatgagtcatctgatacttccactccagagcccctgatcagatggaaaaggatagttgaaacacaagaagttgcagccacttctgagaaatctcttgaggccacttctgagccttcagaacgagtggtagatacaacttcaattcagcaggcagtagacccctccactcttgaggatcaaaatacaccggtcctgtctccgaacacctctcctctagctacccccgtgcttcacttaacagatgaggaggatgttcaaacactagatactcaggacagatcacaggatttttaa

SEQ ID NO: 16823 - DNA, 468 bp, Glycine max
  Peptide Sequence Number=SeqID_133601
atgcagccctcttctgctggcaagcgtccatatgacagtggtgttagtggggataatagtattgcctattggagaaaatttgtggctgaatattactctcctcgtgcaaagaaacggtggtgcttgtcattatatagcaatgttgggcatcatgcacttggtgttttcccccaagcagctatggatgcatggcagtgtgacatatgtggttctaaatctggaaggggatttgaggcaacttatgaagtgttacctaggcttaatgaaataaaacttggcagtggagtaattgatgaacttttgtttctggacttgccacgtgaaacaagatttccttctggtgcgatgatgttggaatatgcaaaagcagttcaagagagtgtatatgagccacttcgtgttgttcgtgaaggtcaacttcgcatcatattcactcaagacttgaaggttacaaaattgttattatag

SEQ ID NO: 16824 - DNA, 378 bp, Glycine max
  Peptide Sequence Number=SeqID_133602
atggcattttcaagatgttcaactttaacaactatcataacaccgttagagcaagtcaaagatttgagtgttgctagcttcttacctccattttcaaaaagttttgcttctcattttcgtgcggcattgtctctggttcgtgggggtagcagcgttgagcgcagcggtgaaggtgaaggttccggcgtcgagctttgcggtggtcggtggcggcaaacgaggtacgcagatggtggtttgttcgtcgcggacatggataaagatgagtggatgtataaaataatgtctgaacgaggggatatggattatgaaaatgcagaatcatgtggtgcgaatgaaccacgtgttgattgttcggatgcgttcaagacttctcag

SEQ ID NO: 16825 - DNA, 177 bp, Glycine max
  Peptide Sequence Number=SeqID_133603
atggagatggcagtagtgtggttgtctttccttgtacaaaagcaaaatcttgggggtgtgagggaatgtatggctctacaaattaagacgaattggattccactagcagtgattttcgccagtgttgatcccgcggtcattgctgtttccaaaagtgctcctgcgctcattatataa

SEQ ID NO: 16826 - DNA, 186 bp, Glycine max
  Peptide Sequence Number=SeqID_133604
atgggttggttgtgtagagacggatttagggtgggaaagctcatcaaatctcccatcgtgagaaataactatgtggaggaggacggcaaggacaagcaattcttaggtggcaatggtggttggagaaagggtcgacgagttaagacttggaagggaagggttaggaatgatgaaggagaagactga

SEQ ID NO: 16827 - DNA, 213 bp, Glycine max
  Peptide Sequence Number=SeqID_133605
atggcgatgggatctttttcacaagcacgaggagccttgggcaaaattgctagattccaaacaaccatttcgtgcatgggaaccaacaacagcactggatgggaatggaatctcacttggagaagggatctttttgaatcagagttactgttggcagatacttttattggggatttagctcagcagcaagttcagcctcatagggaagattaa

SEQ ID NO: 16828 - DNA, 269 bp, Glycine max
  Peptide Sequence Number=SeqID_133606
ggatacttgggttggatgaatcttacttgcccagatggattggttatggctttggttcacttctgctcttgaatcactttcttgggtctgattcagccactgttacaccggctcaacttagtacagaggttttgggtctgtctttggcttcgttctcgattgtgctgccttaccttggtaaatttctcaagaccaatgcggccaatgtatgtagctgcaattgtggttgtagaggtgtgaaaaaccttgattttgttgccgctatttag

SEQ ID NO: 16829 - DNA, 468 bp, Glycine max
  Peptide Sequence Number=SeqID_133607
atgagggaacttgctaggtgtttccctactgctatagtgaccggcagatgcaaagacaagctatattatgtaggaagccatggcatggatattaaaggaccaacaacaacctccaaatacaacaaagatagcaaagctgagccaatcctttgtcaacctgccagtgattttcttcccttgatagatgaggtgtatcaacaattagttgaaaagacaaaatcaactcctggagctctggttgagaacaacaagttatgtctttcagtccattttcgttgcgttgatgaaaagaaatggagtgaactggcacgccaagtgaaatcagttttaaaggagtacccgaagcttcgacttacccaaggaagaaaggtgctagagattcgtcccactattaaatgggacaaagggaaagccttggaatttttattagagtcactagataatgcacatgagtgtggaagtgcataa

SEQ ID NO: 16830 - DNA, 1060 bp, Glycine max
  Peptide Sequence Number=SeqID_133608
aacaccggatgctatactcaacctgcttcaatcaaccatcactcctactcatgatgcaattatgtattacaacgggaagtggaacataccacgtcaaggcgagtttttgggttactcctttgctggaactaatctaataataagatttggcattcctccaggatgtggcatgaagaaactcaaggatttaatcaagcaagtcgcacctataggggtttcccctaatggaattcacggatcacaattggttaggcgattgttctttcgacaatcaggtcattctaagtattccgaaaatttgattgaatatgagataacagaattgaaaaatgatgaagacgtgctaaaggaccttgccgccggcgacccagtttccgccgaacctgctgatgcccagttcacaatcctcgcaattgacctcaacggtcttgccgtcgaccgctacggcattgtggccggagtacggcgggcggcggagacagtggggttcttccaggcggtgaatcacgaaattccggtgaaggttttggaggaggcaatggcggcggtgcgtgagttccacgagctgccacaagagttgaagggtgaatattataacagggagctgatgaagaaggtgaagtttgggagcaactttgatttgtatcagtcaaaggatgtagcaatggaatactgtaggcaagttcaggtgttggggagagttttgtttgggttattatcagaagcacttggactcaaccctgcgcatcttcaacgcatggattgtgcaaagggccattcaattttgtttcactattatccaacatgtcctgagcctgaactcactatgggtactaccaggcactctgatcctgatttccttacaattctgcttcaagatcacattggagggctccaagttttgagccacaatggatgggttgatgttcctccggttcctagagctctagtagtaaacattggagatctgctacagatcccttccttctccgccactaacggcaccgtcaacttcaccttctcccagtacgccttcgttaggaaccctaaccgagagtga

SEQ ID NO: 16831 - DNA, 1275 bp, Glycine max
  Peptide Sequence Number=SeqID_133609
atggctacaccacccagctctcctccttctcctactgttgcagaatcacagtcgccatctaccttgaagcggacaagaaaagccacacaactaagatcattggcgactagactagttggggcagagagaccgatggtccatgtcgatcctgggaccgggaaggccaacaatccccatagaaagaagttaagaacatatttgggaatcgtcgctcgtgataaggctaaatttgatatccctgaagcatctggtctaaggacaaaaaagaaaatacttcagactgtgggggagcagtggagacaattcaagtacgatttgacgtcaaaatgtgcacttgcagtcgacaaggaaagtgtcaccaacactatatgcgaaaagatgtgcgaaaaaatgcacaggtcacccagaagcaaaacactgcccctcacgtgttgtctcatgggggaagttgctcaatccgaaagcactgacaccgtgaatgatcctccatctcctatcagacgacacgtgaaatggaagattgcccgcaccaagaaaactaggcaaatgacgtctgagccaacaaaggaaattgctgacaagattgattcgttggaggaccaggcctcacaggaacaccctagtcgtgtgcatgctactggagccggtgtcacgatcaagcaatactttggaccggctctaaggacctcccccacatcttcctccatggctcccgaagacctagagcagctgatgcaacaaattaaggaccagctggaggagtcgatcccagaaaaaggactcgcactgcctcctgagcctaaggttggtccttcaactgctcatgtcagcacaaatgagagttgtgttgatcccttagggaacgatccagacacggaaagagtttttgagggatccacaactgttcgcaacattcctttgttgcatgatcaagtcaaggttggtgttgaagaggttagagatgtagatgctcccattcatgtacccactgcagaggttaagttagtggggcatgcacttaacaccttccttgcttggctgacacatctttttaagcgtttatcagaacaagttttgtgcgatgctaccgtgttcaggctgtttaatgaagactttcccttgtacataaagcatgaagatctatttgaaataccacacgatggtcaatgtctcaacatctttgttatacagttgcggattctgccagacaattacctcaaaggaataattaacagtattccaattatgctagaccattggaaccagagagattga

SEQ ID NO: 16832 - DNA, 791 bp, Glycine max
  Peptide Sequence Number=SeqID_133610
gttgaataaggacaattccgtggctatcaatcaaattcttcctttcggcaccgtgcccggcgccaacgtgctcgatcccgccgactaccaggccctggcggcccggctgggcggcttctcggccggcacggccaaatccaaggaactcaacaccgtctggcgccaggcgtccttcgtggccgccatgatcggccagtacatcgtcgacaaggcgggccaggacgtgctggacgacggcgacctggcggcgctgcaggccaagttcgtggccgcgctggcggcgtcgccggcactgaccgggacgccgaccgcgccgacgccggcggcgggggacaagagcacccgtatcgcgacgaccgcgttcgtggcggggaatttccccaggatctactcgatcaatgcgctgccgacgcaggatgtgggccccatcatcgtcatggagcgctctgaaatctggggctggttcgccaatcagtacttctccggttaccggtctcctatgtgtggcatgagtgcatcctggccgatggcgacaccgccaacgggctggctggtggaggacggcgccgcgatatcagtggcagcctatggcgctctggctgccgccatctactgcggcgacgcaaacaattcaaccgcggagtgggggtatcgctgtgccagtgcgagcagtcccgcctcatcgcgcagcaccactggcggatacatcgtcttgcgggaccgtcgcggattgttcgagcgaggcctggacggcggccgcggtgtcgacgccggccgttcgctttggaccc

SEQ ID NO: 16833 - DNA, 261 bp, Glycine max
  Peptide Sequence Number=SeqID_133611
atgtcacttgaggacaagccaaaagaagagaaggttcaagtagctgatgactcgctcagcgaggctgatccgctcagcgagtggcatctgctaaacgaggcatatagctcgcttagcggcgcacagccagcccgcccaacgaggtcgttgtctcttctcgcacttagcacgcccaatcacgctaagccaaaattcacttactctcgcttagcaagttcgctaagcgagccttcggaagttgaaaggtccaagagcctttaa

SEQ ID NO: 16834 - DNA, 204 bp, Glycine max
  Peptide Sequence Number=SeqID_133612
atgagttctggatgtttgctagtagatcccaacggtcacaatcttgggaggattgatggggacccggtgttgagagaaacgaggatatgggctacgtgggagtacgtgagctcagatggaggtgggcaacaggggatggtgggtttatgcgcgcattgtggatgtggaaaacttgttgtgcaccatcgcccgaccgccacctag

SEQ ID NO: 16835 - DNA, 252 bp, Glycine max
  Peptide Sequence Number=SeqID_133613
ggccatttgatccaacaagtggtatcagagcagatatcttgtagaaagtttaacaacttcaagattcatagcctctttagattctttgtttttcaaaaaggatataaagtatcttttgattttgaaaaatgtgttatcaagcatgagcatgactgtcgcaacctacccttcggtgggaaggcgacgcgagactcgcgggatgcgttttccacgaaaggaatacgcgcggagtcgccaccaacgtttatttga

SEQ ID NO: 16836 - DNA, 707 bp, Glycine max
  Peptide Sequence Number=SeqID_133614
gtaatgtttcaaaaagagatgtggtcgttaagcacagttaccaaaattttaaggctaaactggccagtcttcctgatggaaagaacagggtcttcattataggtacgccgctttatgaggcaggggtaacgtctgttgatgatattgacttgacgctaagaatgataaatgacttaaagtcaaatcagatgggtgccgagcttgtttatattcctcaccgccgcgagcgtgaagagaaaatagatgaaatcagaaagtctgtagaggtccgtcggttggattttccctttgaggtttatcccattgtggctggtgagaacattgctttaattaacacactttatgctccttataaaatcggtggtgctgaagtatcagttcagttgttggctgaaagcctgcaacgagccgggcatgaagttggtgtgttttgtcttcatgaatttgatgagataaaatatgacactcttaatggcgttcatattgcttatttacctctcaaaaatatgtactggccatttcaggcttcttcggcaagcaaattaaagaaagcggtgtggcatctgcttgattcttataatccatttatggctcgtgccatgcgtaaggagctgcgcaaattttctccggatgtggtgcataccaacaacctcagcggtttttccgtcgcagcgtggcgagtggccaagaagctgggggcgcgcgtg

SEQ ID NO: 16837 - DNA, 944 bp, Glycine max
  Peptide Sequence Number=SeqID_133615
ccgacattgaccttccacgcttcggtcaccactctgcgcagacgctgggattccacttgatgaaggacgacaccatgacccagctcacactgcccgaactggccaagaagatggccgacatcgatttcaccatgctgcagacccgcgccggcggagaaattgccggtcgtccgatgagcaacaacggtgacgtggactacgacggtgacagctggttcttcaccacagaagacaccgacatggtgcacgagattgaggctgaccccgccgttgcgctgggtttttccggcagcaggtcactgctgggcaagccgccgttgttcgtgcacgtgcagggaagggcggcgctggtgcgcgatcgcgctgtgatgcgcgagcactgggtgaaggatcttgagcgctggttcgagcagggcgtggatacaccggggctgcgtggaatcccgatgcgtcctgcgttcttctggctggctttggccctgctgcccaccctggcggtggcgcaacccgcgcgtacgcccaaggccaaggccccggcgcaggatcccttcagcgagctgttcgacaccgcctgcatgcagcacatcggggcgccggcgcggttgcagtcgctgatggaatccaatgggctgtcgccgctgcagcccgccgaagccgcgacgctgttgcaggggcaatcgggcatggcctggatggtgcctctggccagtggccgctatgcggtgagctgggctgacgatggcacgtgtacggtctacgccgaaaaggccgacgcggcggtcgtgcagaagggattcgcccgggcgtgggccactgtcggccgatcaggtggccatccagtacggctgggccacgccggggcagggcaagctgcaggtgcgcttccgcctggtcacgcggcagccgccgatgcgggcgtgcaggcgatggcctcggccacgccc

SEQ ID NO: 16838 - DNA, 297 bp, Glycine max
  Peptide Sequence Number=SeqID_133616
atgatgaatggcactcttgaggtattaaatctgaagaacaacaatctctcgggtcctattcctgatacagttccagtttcctgtggtttgtggactttaaatcttaatggaaatcaattagatgggccaattccaaagtctcttgcttattgctcaaagttagaggtattgaaccttggatcaaatcaaatcacagatggctttccatgcttcttgaaagaaatatccacgtttcgtgtcttggtttttgaggaacaacaaatttcaaggttccctaaaatgtttgaaagccaataa

SEQ ID NO: 16839 - DNA, 1278 bp, Glycine max
  Peptide Sequence Number=SeqID_133617
atgaattttccatgttgcaaacgacagtcatgcggcttaaaggagcatcgttttatcgtggccgaacaactgcgccaaatcacgcgtttatcgcataatattattctggagccggtagggcgtaatacggcgccggcgattgcgcttgccgctttgcaggcggtttccagcggtgacgatccgctcatgttggtattggccgcggatcacgtcattcaggacgaagcgattttccgcgatgcggtcaatcaggcaattccctatgctgaagcgggaaaactggctactttcggcatcgttccgacgggcccggaaacgggctatgggtatattcaaaaaggtgccagcgtcgacggttccagtatctgcggcgtttcgcgctttgtcgaaaagcctaatcttgaaacggcgcagcagtatctggccagcggcgactatctctggaatagcggtatgtttttgttcaaagccagccgttacctggaagaattaggccgtttccgcccagatattctggacgcgtgtaagcagtcgcttgcgcatttgacccccgatatggactttatccgcgttgaccgagatgcattcattgcctgcccggatgagtctgtcgattatgccgtgatggaacaaactgctgatgctgtcgtcgtacccctggatgcgggatggaatgacgtgggatcatggtctgcgttgtgggaaatcagtgaaaaagacacaaaagggaactctactttcggtgatgttcttgagcataactgttcaaataactatattcgcgcggagcataaattggtggccgctgtcggggtgaccaatttggttgtggttgaaaccaaagatgccgtgttgattgccgataaagataacgtccaagacgtaaaagaaatcgtcaaccaactgaagcgacaaaagcgttccgaaagcaaacagcaccgtgaagtttatcgtccgtggggaaaacatgatgcgattgcgcagggcgatcgcttccaggtgcgccgcattactgtaaagccaggcgagaaattgtccttgcagatgcaccatcatcgttcggaacactgggtagtggtgtcaggcactgccaaagtgcataccaatggtaaaatgcaactgatcagtgaaaacgaatccgtttatatccctcttggggtcgaacattctctcgaaaacccgggaaaaatcccgcttgatttgattgagattcagtcgggtgcctatttgggagaagacgatatcgtgcgaatcggcgactccgctcagcataattaa

SEQ ID NO: 16840 - DNA, 426 bp, Glycine max
  Peptide Sequence Number=SeqID_133618
atggttatgggggatcccatcagcagactctccttccctgcatgtttgcattttagtggagaaaacaccgagactttttcaagtctcacaagttatccagaactacgtaggtctgagttcctcattggaggatacgtaggagcaagagcctcgcttttgtcgaccacaccgccttttgtcgccatgactcaagagctggtagcccgcggagacaccttacggttatccgcacctcgtcattcagtgaccccaagtgtgattcacgagcagagaccaatatggtcatttgcgccctttccggagatgtcagcattttccgatggagactttccaagtctcacaagttatccagaactacgtaggtctgagttcctcattggaggatacgtaggagcaagagctttgcttttgtcggccgccccataa

SEQ ID NO: 16841 - DNA, 1302 bp, Glycine max
  Peptide Sequence Number=SeqID_133619
atgcctgccctgaaggcaacggatacgacagcggtgacagccgaaacaccagcggccgaacaagatgtcggtgtggatttgtttgctgtactggaaatgcctgcgatggcgaccgcagagtcggaagttcccgcggcggtgaatccttatacctatgccgggcgcttgcaggaagcggggcgctggaccgtgtttttgaccgatggacaacaacaatatgtcgtgcatgagggcgaccactttgccgaaggctggcgggtggcgaaagtgaatcataaaaattgggtatgggcctgtgcattgccctggctggtcagttgcagtagcttcaaccccaccggtttaggccctgagaaccctgctggagatgccacgctggagcaagccaggatttatgccgcgcgtgggcaggatgaggaagcgatccggctattgcagcctttggtagaagcgaatccccggcagccgcaatacaaaaactggctcagcctgttgcaggaaaaaaagctgcaaaagcagttacaacaggcggacagtttgctggccgggcaacagttcgatgcggccagtgctatgtacctgcaggtattacaggaggcgccgaataaccgtgccgccagtgatggcgtgcaaaaggtacagtcagcccgccagcatgctgcgcaaattgaacaggtgaaaatcgccattgcggcagaggactgggcgggtgcggaattcggcttgcgcagtatcttggccgaacaacctgcgcatgtcgaggcgcgacaattgttcgagcaactggaacaaaaaaagaacgaaaaaagcagtgtggtgcgtcccctgcaatcgtcactcaggaagaaagtgacgctggagctgaaaaatacgccggtcaagcaagcctttgaatatataggcaaggcgggcaacctgaatttctcgtttgaccaggagctcaatgagggcatacgcgtcaatgtgttgttgcgtgagacgccgatagagcaggcgctcgaggtgattttgaccagtcaccaactgggcaagaaggtgctcaatagcaatacgctgctgatttacccgcaagcccgtgccgcacaatatgaggagttgtttgtgcgcagtttttacctgacgcatatggatgccaaacgtgcgctcaatatgatgaaaaccgtgttgcgtgccagtgatgtttatattgatgagaagctgaatacgctggtgattcgtgacaccttggaccggattaaagtggcggaaaagctgattgcctcgcaagacctcaatgagccagaagtcatgctcgaggtggag

SEQ ID NO: 16842 - DNA, 408 bp, Glycine max
  Peptide Sequence Number=SeqID_133620
atgggtaaagtagaggaggtgcaagagcagatgaaggccgacatggaggccatgaaagagcaaatggccacaatgatggaggccatgatgagcatgaaaaagataatggaagctaatgcggttgcagttgccgttaccagggctgttgctaaggtgaactcgatgcccccatctgatctcaaccaaatgaatcatccaaccttagctatggtaggcaaagatttgggaagtacgggcggcccctattatgtgcaaattcaaaacaagcacgccttcccgccatatggcttggctcccaactatacaccacccaatgtggcgtacactcccagtgagaatatcaataactccactcccatactcattgagagccgacaaccccaaactgatcatgcgcatgtctcttga

SEQ ID NO: 16843 - DNA, 552 bp, Glycine max
  Peptide Sequence Number=SeqID_133621
atgactattacccttcacgatgtagctctaatcttgggcttgtcgatagctggacttgagctcccttcaagtcatgccactgtagtacccatatcggtcacgacagttgaacaccatgcccttgattcgattcttagcgaggcattacgtatcaaatccaccaccaataaatctgcaagatcaattcttgaatcgatttttgccattgtggatgattcgatattgaagcttaatgggattcttaggggtagtgctctgttggatcttggactcttcaacttccgaagactcgctcagcgagcatgtctcactgagtgcaagttagtgaattttcacttagcgagcatgggcgcgttaagcgtgagaaaagacaacatcctcgctgggtgggctggctgcacgctgggcgtgcagatctctggcttgtcctcttttagggtctcccatccgctaagcaagctggatgcttcactaagcagatgcatctcgctgagtggatctgcctcgctaagcgaggcatcaacagctttaaccttctcttctttggcctga

SEQ ID NO: 16844 - DNA, 348 bp, Glycine max
  Peptide Sequence Number=SeqID_133622
atgctgctacctagaggctatttcccacaagtgaacatttcccacatagatcaagaagggagaggcagcaacagcagtggtggttgtgcagcattgcatcagaatgagggccccaagaagaccctacatggccaatcaatagcacaaatggaacgaaacttcacgtgtcacatggaccaacatagaccccaccaatgtcatatctctctcttgaatgtattcatacaaccctgcaagtccttctcattcaatttaatggcaggaatactcgatgtttacactccgacagtaatggattcaccaccaccacgacatagtgaggtagacaggagcattggcatatcataa

SEQ ID NO: 16845 - DNA, 408 bp, Glycine max
  Peptide Sequence Number=SeqID_133623
atgagatatccgtcattcagcctccttagagaacacaacattctgttcataaggggcttcatgatcttgttcctcagctgcataaccattcagcttaatttctgtatttccagcaccccttcttctctcaaagcacttcccttggagggacacttcagttttgaagaagctgaccttaaacatgcagccagtgactttggcaacaggtaccaatctcaccccatggcagtgctgcatccaaaatcagtttctgacattgcaaacaccataaagcatatctggaacttggggccaagttctcagctcagtgttgcagctagaggccatggccactcactccaggggcaagcacaggcccatggaggagttgttatcaacatggaatcactcagtgtcccagaaatgcag

SEQ ID NO: 16846 - DNA, 228 bp, Glycine max
  Peptide Sequence Number=SeqID_133624
atggcacaaattatttctaactatgaaggtaatagatacaaagatacacaccaagagaaaaaggcatttggggcaagggaagctagcccaggcgagctggagctctcccaggtgagccagttgcttaggcttaaaggtaagcttgcccaggtgagctggttgcttaaggatgaaggcattccatggcccaagcgagctagatgttggcctgagcgaactcaagcttag

SEQ ID NO: 16847 - DNA, 477 bp, Glycine max
  Peptide Sequence Number=SeqID_133625
atggatgatgtagctgaagaggtctttcaacatgttgaagaagttggtgttgatgcgcagggttttccaggtgggtcgcatgacacatcaatgttggttgcctatgttgatcatgttgcagtcattatttggaatggagaggaacgtcctgaattgaagctatcctcccatggaagaaaggttcagaaatttgggaggcctactattgagattgaagggttagtcgctatcacaggaataagtcttttgatcgcatgttcattggacactggcgatcggagacttatatcgacttttgtggagaggtggcataaggaaacgagcagtttccatcttccaataggagagctcaccatcaccctcgatgatatggcctctttgcttcagttgcccatcatatgtgcattccacagcttcaacacttttcatggcgacaaagcagtgttgatgttagtggattttcttgaattcacttga

SEQ ID NO: 16848 - DNA, 381 bp, Glycine max
  Peptide Sequence Number=SeqID_133626
atgcggtggtaccgtatggttatccgcatcttttgtcaaccaggggcgaacgagcccgttgacgtgcagagactaacgtcgtctcttacatctttcgtcaaccaagggcaaacgagcccgttgacgcacaaagacttacgtcgtcttctgcaccttttgtcatcccgaggcgacgagcccgatgacatgcgggggtaccgtatggttatccgcaccttttgtcatcccgagacggcaagtccgatgacatgcgggggggcaaacaagcctgttaacgcgcaaggactaacgtcatcctctacacctttcatcaaccttgggggaagcgagcctgttgacgtgcagagactaacgccatcttctgcacctttggtcatctag

SEQ ID NO: 16849 - DNA, 150 bp, Glycine max
  Peptide Sequence Number=SeqID_133627
atgggggtggaagcacaaaacaaatacaagtcaaaaaggaaaagaaaagaaaagaaaaacaataggtatacgaacaaagagataacatttcaacgaatgagtagcaagatcaggaattcgtactctaccgaccttcggaatgcaaactaa

SEQ ID NO: 16850 - DNA, 291 bp, Glycine max
  Peptide Sequence Number=SeqID_133628
atggctcgtggccttttggaccgacccaatccactactgtttaagactgctgagatgactaacaaacaaaaaggcactagcagacaaacgtgggagatggagaaagattggtggttttggtggaagtccagaattccaaataagatattgtgggctgtcaaagctgaatcttatgaaacaaaggaagatcgaaaccataccaaaaactgctttaagaataccactttgtgtcggggaggttggaggaaaacagccgcggttttctcacaccaccatccacagccacataag

SEQ ID NO: 16851 - DNA, 549 bp, Glycine max
  Peptide Sequence Number=SeqID_133629
atgagtgttgaccatggtgttccgcatcgcatgcccaaggtcatgcggattgttgagaaccacgttaatgggataaacaaacacatgcctgaaacacacatctttcacttgccatggggacagtgcaccatcattgttggtcgtgttgtggctggacctagctccttacattgggatgagttatgcgacgagttactaggggaagtccctcccgaaagtgcacataaaggagctacactgaagttgacatggttgctaagcatcttgcgcacaccattgcctgaagaaccaacaacgcaccaactacaatgcagctgtagagcttacataattcatgggcttggtacctcatgccttttattgcaccaagagtcccatgacccgaaacaacttatccactggctaaaagggacaagtgttgaacaaacacattttgaaattccacatcctcagtcaatgtattgtactccttcacttgttcatcaaacttttggccagactggcgagtcagtcagcaagtgtcatgctagcaacattaaggtcacctga

SEQ ID NO: 16852 - DNA, 2139 bp, Glycine max
  Peptide Sequence Number=SeqID_133630
ttggtacagcaattgttagatttctcttctataacgccccaaccttcattgctgtggttacatttggtgcatgtgctcttatcggaatcccacttgaatcaggaaagatcttatcagcacttgcaacattcagaattcttcaaatgcccatatacagtcttcctgacaccatttcaatgattgcacaaactaaggtttcccttgaaaggattgtatcatttcttcgtctagatgagtggaagactgatgtagtagagaagcttccacgggatagttctgataaggcaattgaattagtagatggaaatttctcttgggatttatcttcccctaatccaacattgaaaaacgtaaatctcacagtttttcatggtatgagggttgctgtatgtggtaatgttggatcaggcaagtccagtttactttcttgtatagtaggggaagtaccaaagatatctgggaccctgaagatatgtggtacaaaggcttatgtttctcaatcaccatggatacagagtggcaagatagaagacaacatattatttggtaaagagatggatagggaaaagtatgataaggtgctagaagcatgttccttgacaaaagaccttgagtttctaccatttggtgatcagaccactatcggagagaacggaatcaatttgagtggtggacagaagcaaagagtgcaaatagcccgtgctctataccaagattctgatgtatatctgtttgatgatcccttcagtgcattggatgctcatacaggatcccatctctttaaggagtgcttgcttggccttttaaaatcaaaaactgtgatttatataactcatcaagtagagttcttatccgatgctgatctaatattggtcatgagagaaggaagaataactcaatcaggaaaatacaatgacattctcaggtcaggcactgattttatggaacttgtaggtgcacacaaagcagctttgtcttcaatcaagtccttggagagaaggccaacatttaaaacatcaactaccaccaaggaggacacaagttcagtaagttattttgaacttgacaaaaatgtggtatatgatcaaaatgatatgtcagatgacatagttgaacccaaaggacaactagttcaagaagaagaacgggaaaagggtagagtagggtttaatgtctactggaaatacatcacaacagcttatggaggagctcttgtacccttcatattactttcaacgatacttactgtggcttttcagattgctagcaattattggatgattttggctactcctatgtctgcaactgcagaacctgatattggaagctttaaacttatggttttctatgttgctttggcaattggaagttccattttcacctttgccagagcatttcttgctgtgatagctggatacaagacagccactgttcgatatgctcctcacttgcctcttgttttacgaggtcttacttgcacttttactgctggagcaaaaactggtattgtgggaagaacaggaagtggaaaatcaaccctagtgcaaacacttttccgacttattgaacctgttgctggacaaatattgatagatagaattaacatttctttgattgaaattcatgatttgcggtccagactaagcatcattcctcaagatccaacaatgtttgaagggactgtaagaaccaacctggacccactggaagagtacacagatgaacaaatttgggaggctctagatatgtgccaacttggagatgaagtaagaaaaaaagaagggaagcttgactccatagttactgagaatggagaaaactggagtatgggtcaaaggcaattgttctgccttggccgtgttctacttaagaaaagcaagatcttggtgcttgatgaagctactgcatcagttgatacggccacagataatactattcagcaaacagttaagcaaaaattttcagaatgcacagttattaccattgctcataggataacttcaatccttgacagtgacatggttctgtttttaaatcaaggtttgattgaggaatacgattcaccaaagaaactgcttaagaacaagtcttcatctctagctcaactagttgcagaatacacaaggcggtcaaactctg

SEQ ID NO: 16853 - DNA, 1830 bp, Glycine max
  Peptide Sequence Number=SeqID_133631
atgcaaagcagtgctaacaatggaattaaggtatcatctggtcataacttggtaccagctcatgagaccacaaatgacactgtcaacgaaattactggtctgtctgttcaaataacagatgacaaggactttcctatgagtaactccaaattatccaattcagacattgtttggtcaggagttgcatggagatgtggcaaacaacttaagcattatccagcttttttcaggaatggcatcaaaatagcgattcaatcctttgtttttgttatgggcaagggagagaaccattatattgcttatgtagaggatatgtatgaagacaggaggggacagaaaaaggtcaaagtgaggtggtttcaccataatcaggaagtcaagggtgtagttcctgtaagaaatcttcaccctcgggaagtttttatcacaccttattctcaagtcattagtgcagagtgcgtagatggttctgccacagtcttaactcgtgaacactatgaaaaatgcatgccttttttttcccccacttcaagggacagaatacatttgtgctttaggcagtttagaagcaacaaagtcaagccctttgacttcagtaaactgcgtggttactatactcaaccaattctttcttgcttgcaccatgattcaatccagaaccctgagagccttgtgggagaagatgaagagttgagtgcaggtgaggatgtgaaggtaggagccaagaggaggagaggtgataaggggtctcctcagtcttggataagtcgccagggagttaggaagttaattaagagtaagcaaatgatggtatacaaaaccttccaggttgcaaattatgcaagatcagaaaggagattgctttctcggaagcaggttgagtgtcaaccttggtctaaccacacatacaaggttgatgacaagatagagttactttgtcaagatagtggcatcagaggctgctggttcaggtgtacagttgttcaggtagcccggaagcagttgaaagtccaatatgatgatgtccaggatgaagatggaagtggaaatcttgaggaatggatccctgctttcaagttagccaggcctgataaacttgggatgaggcattctggccgccccaccatcaggccagctccaacttatgaggaacaggaactagctgttgaggttggaaatgcagttgatgcatggtggagtgatggctggtgggagggggttgtaactagaaatgacaactgtggtgatgatagtgctcaagtctactttcccggtgaatgcttgctgatgaaagtgtgcaagaaggatttaagaatatctagagattggttaggggacagttggattaacattatggcaaaacctgaaataactaaaactattatattcacagctaataatagttttaacacagagctttatgtgtccccatctatcgctaaagatgcggactctgttggttttgctaattcatgtcatggtgatcctgttagtaagaagtcaaatgaaccggttatcaaagaagtgaatcttgtgtcttgtgatggctctactaaagaagagaattttgtgtcttgtgatgactctgctgaagatagggactgtgttcaggataataaaccctcttcagaaaaatgtactcaagctgaaaatattgattcagatgtcaattgtgatcatgaagacaattgtgttgataatgataatgataagaatagcgatgatggtggtaacaagaatgatgatgataatggaaataaagatatggaggtatttgaaacttctgtactggatggagaaactgtagagctcatggaagtggctgtataa

SEQ ID NO: 16854 - DNA, 2111 bp, Glycine max
  Peptide Sequence Number=SeqID_133632
atggcttccataagaaaatcagtcctcttgttcctcacattcctcacagtgatcattatccctgccactccacaaccatgcaactcatacaagttccccaacaactttaactacgctgcatgcgaggacttgccggtacttgaatcctcactgcactggaagtaccacccatcttcaggtgcagtagatgttgcattcaacaaggccaacgtaaaaggttctagttgggttgcatgggccatcaaccctacctcaaagggcatgcttggttcacaagcattcgtggctgtttataaacaagatggtagtatcaaagcctatacatcaccaataacaagttatgcaacaatgttacaagagggtaatcttacttttccggtttatggtgtttctgcatcctacacaaacgggcacgtgatcatcttcgcgagttttcaacttcccgggaatacgactttggtgaatcacgcttggcaagaaggcttggtttccgatgatggcactctcagaccacactctttctcacgcgctaatcttcagtcttttggaaccttggatttcttatctggcaaggtttctgaactggtgggaattcggactcaagatcacgttgagaaacttttgaataccataagctggggagtactaatgccaattggggtaatattggctcgctacttgaaggcatttgatggtttaggacccacttggtttcagctgcatcgagcatgtcaatcactagcattcttgatgggcattgctggttttggtactggtttgtatattggaaatcattatgggattcataacgctcctcacagatgcgttggaatcactctattgtgtctcgcaattacacaagtctgtcttgctgtgtttttgaggcctaagaaggatcacaagtacagaatgttttggaacatttttcattatatagttggttattcaattattgccttggccgtatggaacgtcttcaagggttttgacattctcaacgctcagaatatctggaaaaaaacctatgtgggctcaatcatatccttggctataattgctgtggtattggaggtgataacttggatctgggtgtgcaaaaagaagagggtcaaggagcctgagaatcatgttgaaattgttattgacttcgtagcctatggaaagcatgttttcttgccagttatgtatgttatttctgatataggttcctctataactggtttatttctatgttatgtgggatgttgtcttaacaatatgcgtaagcttgcgcctctcgaagaggcccttttgaatgggcactctagtgtatgcaacaattctgattcccgtgagactagagtaaataaaaatttaacccgttattcaaatgctggatttttcagcattctcactttctcatggatcagtccattgataactctgggcaatgagaagactttagaccatgaggacctcccacttcttgctactgatgacagtgcctatggggtttttccaacttttagaaataaacttgagtcagagtgtggtagtcttaggaatgtcaccactcttaagctggcgaaggtgttattcttgtccacatggcaaggaatccttttatcaggtttatttgcattcctatacacatgtgcttcttatgttggaccctttcttattgacatttttgttcaatacctcaatggggaccacaagtttaaaaatgaaggctatgttttggctatggcatttgttgctgcaaagcttgtggagtgtctttcacagaggcactggatgtttaggttccagcaggttggggttaggatgcaatcaaagttggttgcaatgatctatgctaaaggtttgactctttcatgtcagtcaaaagaggttcacagcactggggaaatcatcaacttaatgtctgttgatgcagaaaggattggtgaattttgttggtacatgcatgatccatggatgtgtgttttgcaagttgctttggccttgttaattctgtatagaagtgtaggggttggttcgatagctgctcttgctgccactgtaattgtgatgttgctaaaccttcctgtggcatcattgcaagaaaaattccaaggcaagataatggg

SEQ ID NO: 16855 - DNA, 126 bp, Glycine max
  Peptide Sequence Number=SeqID_133633
atggctactcctgaggcaacaatctgccaaaaggccaaatggaggggctggagcaaaggctggggcggtgggaacactgaggaggaagaactgaagtgtgagagaagagagagaggtcagagatga

SEQ ID NO: 16856 - DNA, 1026 bp, Glycine max
  Peptide Sequence Number=SeqID_133634
atggcccagcaaaatcgattaagaaatttggctcaaagcctcaaagacaaagcctcagtaatcgctgcagcgctatccacgaagcgacacgtgtcctccgtccgcgtgcacgtgctccgcgccaccacgcacgccctcgccgcgccgccctccgaggaaacaatctccgccgtcctcgtggtcgggtcccaccagaagcgccaccctcgcgcttgcatcgacgcgctaatggaccgcctccacagcacgcgcagcgccaccgtggcactcaaatgcctctacacactccacaacgtcgtcgtaaagggacccttcattttgaaagaccaactctcctgttacccttcctacggtggccacaatttcttgaacctctccaccttccgagacggctcggacttggaatcgctcgaactcagttcgtgggttcgctggtacgcgggagtgttggaacagagcttaaccgtttcaaggatcttaggttattacttgaaccactcttgcgagtcccaagaaaagaaaaagactttggtttcgaaggcgtcgaatgcggatttgttgtataagttggaggctctcgtgggtttcgtcgaacaaacaagccacgttccagattcgttgcaccttcagaggaacgagttggtgtacgaggttgtgagattggtgggggagaattataggagcgtgcaaggtgagattttgatgcgtgttgaggagcttgggggaagaataatggaggacgtgggtgagttgaacgagttggtggggtatttggggagattggaggagactcgtgaaaagttggtgcttttgtttgtgaataggggaaagaacaatgagttctgggattcggttaagaagaccaaggagaagggtgtggcgaggaagaaggagattgaaaggaagtggctcgcggtggtggtggtggcagggaacgccgccgagtttactcggtccaccaacccgtttcttgacccggggcaactcagtccggtcccacggttaagttttgcaacggtaaggtga

SEQ ID NO: 16857 - DNA, 111 bp, Glycine max
  Peptide Sequence Number=SeqID_133635
atgcagatgttgtcgagtgtcttggcaagcactggcagcaaccgtggaactggaaatggggtgcagtgcaggaagaaatggaccattcagtgtaaacgtgcagcccagtaa

SEQ ID NO: 16858 - DNA, 1533 bp, Glycine max
  Peptide Sequence Number=SeqID_133636
atgaccactttcacacactccattttccaccatgaccttctttttcttttctatttctttctcctcacggaatttccgccgcaggccaccgcgcagcctccgaacacgctgacgccgccgccgcagcaggaccgctttacgaggctgaagttcgacaaatccatggccatcgttctgctgatcctggtggtggtgttcttcatcctagggttcctctccgtgtacacgcgccagtgcgcggagcgcaggatgggagggaggttcgacctctccatcttgatctcgcgccggcaacgcggcctcggccgcgaagtcatcgaaacgttcccgacgttcgtgtactccaccgtgaagagcctcaagatagggcgcgccacgctagaatgcgccgtgtgcctaaacgagttcgaggaggatgaaacgctacgtttcatccccaactgcagccacgtgttccactccgactgcatcgacgcgtggctcgcaaaccactccacttgccccgtctgtcgcgccaatcttacttccaaacccgatgaccggtgttctgctcctatccaaaacccggatccggagcagcccgttttaacctcatcaacccgacccgaaaccgtgggtgctgatttgcttagtcagaaccgtacaccgccgcgaccatggtcaacgggtcttagtatcgcgagttggtttccgcggtctcactcgacggggcactcgctggttcaacccggggagaattgtgaacggtttacgctgcgtttgcctgaggaagtgcggaacgagcttatgctgagtcgcaccaagagttgcggcgtgagcgtgacgttcacgcgcgagaatagtggaaggaggggttacagggcaaggagccttggtagcagcctcagccctcacgtgacaagaaacagcaccagtcctcacgtgaggtggtggttttctcggccacgctcgattaaggatgatgtcggggaacggtcttcggatcggttattctccacgacaagggatattagtgagcttcctcgttcgtgttcttccgcgctcccttcctcgttcgtgttcttccatgggcttcctcgcagcagtcttcttcctcctcgtagcagtgttccttgcagcagtcttcttctccattttggttgcgtcccttggagttcttcattgggttgtttaagcgtttcttccgccatcgagattgaacacgaagttcttccgcgggaagaagcttcttccgcgcgtgtgttaggggacggaaatggattcagcggaagaaggtgttcttctgcgagctcctgcggaagaaatgtgaaaagttcttccgctggcacccgcggaagaacctttttagtttcttccgcaggagcccgcggaagaacaccttattccgctgactccatttccgtgttgttacactcgcggaagaacaccttcttccgtagagtgcattttctgctcgcggaagaagctgtcaaacttcttccgcaagaagcattttgctgtatattggttatttttcttgaaaattatgtctga

SEQ ID NO: 16859 - DNA, 210 bp, Glycine max
  Peptide Sequence Number=SeqID_133637
atggtgatccgtaaacagcccaacaactttccgatagcggtttccgccatcgccggcaacaatggtggaagaagaagaaacgcgaaggagaaacgtacctcgaagaagaagcagaaacgcaaagaagaagctttccacttgatcccgacaacaatggcggcaacgaagatgaggaagaagcataaacgcgaagaagaagacttcacttag

SEQ ID NO: 16860 - DNA, 189 bp, Glycine max
  Peptide Sequence Number=SeqID_133638
atgtcacccataatagatgaactcaaatcagagttgcgaacaaagcatggtgatgcccctactaatgttcatgatcaatgtccttgtgacatacctgatggattaaataaaacaagtataataggagaagaccctacatggagtgggaaaaagatccagttatgtgcatggaacatggagtgtgaataa

SEQ ID NO: 16861 - DNA, 207 bp, Glycine max
  Peptide Sequence Number=SeqID_133639
atgaggattgcattgaaaggtttcaaccgggtcagaatgacctggctgaaggttgaaggagaatggaaccatgtgaggagttgccaatgtttgaaccctcactgcactggaactaccacccacatctgcaggtgcagttctatttgggttgcatgggctatcaaccctacctatgattggttcacaagcattcgtggcagttcataa

SEQ ID NO: 16862 - DNA, 300 bp, Glycine max
  Peptide Sequence Number=SeqID_133640
atggtaatcgattaccagcaacatataacattgtgtaatcgattacacacaaatggagctagcctgctgaggtacgccacaggttctcactggctgactatgcccgggttgggtcgggattggccaagcttggttttgggcaatagcaccccacctgacgtccccaagggcttattgggttatggggcacccgtcatatgtggtactaggtggcgatcaggtgatggcgcaaaacaaatatctcatttccacaagcccaggcataagcacaccatccccagttgcccacctttaaattaa

SEQ ID NO: 16863 - DNA, 198 bp, Glycine max
  Peptide Sequence Number=SeqID_133641
atgtacgatcttgactggacgtacaggggcaagagacatgacacatcattcaaagtgatggtcatctcttcaacaagcaggtggaaggacgaggttttctgttgccacctctccacaaggacattcatgaagcccttgtttgcaatagtgtaccgtgtcgtaattgcaacacataagccctcatcatcggctcaatag

SEQ ID NO: 16864 - DNA, 360 bp, Glycine max
  Peptide Sequence Number=SeqID_133642
atgcataagtatcctaaacttttcaacactcataatatagagggattcagtcctctcaaaattcttgccagtaggccctcggccttcaaaagtggaatcaatctcaagtggtgggaggcactcttgtaccattgtgtatctgcagaatctctagacgttgaaaaaacaaaggaatcgtacatgaaagatgaacctgcagaacacaacaaacattttggaataagattcgcatcaaggaaaacaaaaaagaagaaacagttaccagagaactacgacacatgtcgtcggctctattgtgcatttcgactttttgttctcgtgcccatatttctcatcgatagtataggatttggtatgtga

SEQ ID NO: 16865 - DNA, 126 bp, Glycine max
  Peptide Sequence Number=SeqID_133643
atgactcgattagtatcacgaggacatcttagagttggaccgttacgatttcttgaagcaagacttatgagtcaagtatacgaaagtgagaaagatcatgttgaaggaagaggcttagactcaagg

SEQ ID NO: 16866 - DNA, 204 bp, Glycine max
  Peptide Sequence Number=SeqID_133644
atgtgttggagtcaagtacctaggatatcagtttatgacatatgtcataaggttgttgaacccttgcaggagaagattgacttaaggatggtgattgagggaaccacgacatgggataatgttcaagcagcactttgttgttgtctaaaagtactcatggtggaaataatagtagaggatgaggcggtagaggagttagagtag

SEQ ID NO: 16867 - DNA, 228 bp, Glycine max
  Peptide Sequence Number=SeqID_133645
atggtcgtcataagtatcgccctcgtcgtctctgtcaccatagtacaagtaatcatatttgggcttcgaggagaacaaggttgtttcatgagagtttcgattttatcagtggtgttgaagttggcattggcaccactagaggtggaggcgaagaggacaagtttcccactggagttgtcggatcacataggtagtacaaaggattttcattattctcataccaagtag

SEQ ID NO: 16868 - DNA, 1188 bp, Glycine max
  Peptide Sequence Number=SeqID_133646
atgaacgaattaacaccaaacacagaaagctacctataccttcatccaagcgaaaacccagttgtagcccttgtctcgccagttttagattcaagcaactatcattcatggagcaggtccatggtaacaacattaagcgccaaaaataaagtggagtttataaatggaaatgcaccagaacccctgaaaaccgatagaacctatggtgtatggagccgctgcaacaacatggtggtatcgtggataatgcattcagtatcagttgcgattaggcagagcattttgtggatgaacaaagctgaggaaatatggaatgatctgaaatcccgatacacgcaaggagatctcttgagaatctctgatcttcaacaagaagcttcatcaatgaaacaaggtaccctctctgtcacagagtacttcacaaagctccgcatcatatgggatgaaattgaaaatttcagacccgatcccagatgttcttgcaccatcaaatgtacttgttcagtcctcactatcattgcccaacgaaagttagaagaccgagccatgcaatttttacgaggattgaacgagcaatacaacaatgtacgatctcacgtgttgctcatggaacccatgcccacaataccaaagattttctcctatgtagctcaacaagaacgtcagctatcaggtaataattttctcccaaacttcagtcttgaatcaaaagaaaacgcttcaatcaatgttgtcaagattacttgcgaattctgtggacgaattggccataccgagagcgtttgttacaagaaatatggtgtaccttcaagctatgaaggaagaagcaaaagctacaacacaagaaacggaaaagcctgtactcattgcgggaaaataggacataccattgatgtatgttttaagaagcacagatttcctccgggatacaagtttggcaatagcaaggtggtagcaaataatattgtggcagtagaaggaaaagccacgagtgaccaaatgcaacgccatgagtctcatgatttggttcgcttttcaccagagcaggatcaagctttgttcgctttaatacaacgaccatcttcaggaagctcagcccctacccaatcccaggttgcatccatatcttcatgttccactaacacctcaccaggataccaacaccaaagcgaagattggtacagttga

SEQ ID NO: 16869 - DNA, 309 bp, Glycine max
  Peptide Sequence Number=SeqID_133647
atgggaacaacaggatcaggtgttgcttacatggctccaattgacactttcagcattgatcctatcacccatggtgatggtggtgctagccaccgtggaggtggcggtggcggcggtggtggtggtcgtttcgctaacttccagtgtcagtattacaaaacatcctgcaactccatcattttgaaggtcctaatcagatcttcacaggcaatggtcaaggtctacaaattcactcctcaggttaccaatgaagtcttacttcaaggcaatgctggttttgatggcctttacaattttcctcacatttag

SEQ ID NO: 16870 - DNA, 492 bp, Glycine max
  Peptide Sequence Number=SeqID_133648
atgaagcaaaagcacatatggagtgctcaactcttgagggcatttatggaaaaaccctatctgtcatatacgggaggtccaccaccattgaacgagggtgttcaaacagattacagaaaagtaagtgttgacagcaaggagacagtgattttggttgcggcaagaaatggcatagttgaaatggtgaatgagattatatctaaaataccaagtgccatacatgaaactaactcagaaaagaaaaacgtgttgcttgtagcagtggagaacaggcaaacccttattgttgaggcattaaaaaattggtttgaacaggagaaaaaagagttaatcttttacaacctaaaattaggtgtggatgaccaagagaacaccgtgttacacttggcagcaacactacctaataagggttggatgatatctggccttgccttgcaaatgatgtggcatatcaaatggtttcaggtatacgtttatgatatccgtatgtaa

SEQ ID NO: 16871 - DNA, 906 bp, Glycine max
  Peptide Sequence Number=SeqID_133649
atggagaatgcttcgaatatttggaatactctcaagaaacgttattatcaaggtgatgtgtttcacattagtgacttacaagaagagttgtatttgcttaaacaaggtgatgctactatcacttcttactttacaaaattgaaaggtttaatccacaaattagataattttcgccctattccttcctacacatgtgctgttgctactcaatctgagttatcatctcttattaagactaacacttggcagcttactcatttacctcctgataaaaagctaattggttgtaagtgggttttcaaaaccaagttcaaagttgacggatccattgacaagcacaaggctatattagtagccaagggatttacccaaactgctggtttggactacattgaaacctttagtccaattgtaaaaatgaccatagttagacttgtattatccctagctacttctcagggttggcatcttcatcaacttgatgttaacactgcctttttacatggtgatttacatgaggaggccagcaggcgacttattaccaccttacttgattcaggtttccaacaatccaaggcagattattctcttttcactaaaaggtgtcctactagcctcactattgtgcttgtttatgttgatgatttggatcttggaatactcaagtacttccttggttttgaagtagctcgatccacctcagcttccacttctttaagaggattcagtgactcagattggggagcttgtcttgacactcgaaggtctatctcaggtttgattcaccttcttctcatttcctctcatgagcaatcggcagacattctcactaagccattacatgctggtccattcaatcataatcattccaagctaggaatgcttgacattcacattccagcttga

SEQ ID NO: 16872 - DNA, 621 bp, Glycine max
  Peptide Sequence Number=SeqID_133650
atggagcagtatataaaagacctagtgccggagcatttcactgttagaaccaataaagacgggaaaacggcaaggcaaatctttaaagaatcacataattgcctcgtaaaagatgctaatgaatggctcaagggcacatcagaatcttgctcagttgtggcagcttttcttgctggtgtttcctttgccacatccaccagtgtccctggtagttttgacagtgacactggtgaacctctgttagaaaccaataacgcattcgagtcatttgcaatgtgttcattaattggcctaagcttctccgtcaccgctctcgtattgttcctctctatactcacttctcgaaaagaactcaaagattttcgaagaagtttgccactgaaagtgcttttgggcttaagctctcttttcatatcgactgctgcgttgtttgctactttctgctccgcccatttctttattgttgatgaaaaatacaagcaagtcttaatcgttatttatgcagtcacttgctttcccgtgggtctctacgcaatagcacaatttccattatttattgatcttgtgagggccattgcaactaaagtgccacaggcaagtgataacgagaacgatatatag

SEQ ID NO: 16873 - DNA, 1068 bp, Glycine max
  Peptide Sequence Number=SeqID_133651
atgttcggtatcctctacactctgtcctctcttattcccggctctcaccttcacatcgccactgatggcactgttgaacgatacaaggcgcatctcgtagcaaaagggtatacacaattagaagggttggacttcctcgatacattttctcccgtggctaagctcactactgtaagattgcttcttgctcttgttgcccttcacaattggcacctaaggcaactcgacgtaaacaacgcatttcttcatagggatcttgacgaagaggtctacatgactcttcccccaggtcttgttgtgaatgatctcaacctcgtttgtcgtcttcaacgttcattatatggactcaaacaagctagccggcaatggttcactcggctctcttctttcctcatctcccacgacttccgccagtcttcagttgatcattccctttttctacacttccataataatgatatcactgctgttcttgtttatgttgatgacataatcttagcaggtaccaatctcgacactatcgcacatatcacaaagctccttgatcaagctttcagcatcaaagaccttggcacgttgaagttctttgtcgatcttgaggttgctcgcactagccatggtatccacttatctcaacacaagtacgttctggacatattatctgactcaggcatgcttgcatctcgactagcttccactcccatggactactccacacgattaacaacttcaatgggcactcctttatcagagacttcttcctcctcatatcgccgtttgattggacaactcatttacctcaccaatactcgtcccgacatcactcatgccattcaacaactcagccaatatatggctcacccaacttctgctcattcacaagcagcattttgtatcttgcggtacctcaagggatcacctggttctggtatatttctcgctgctcacggtcctctacaactcaaggcttttagtgactccgattgggcgggttgtcgcgatacacggcattccatcaccggattctcggtatatctcggtccatccctcatttcctggcgttcgtag

SEQ ID NO: 16874 - DNA, 147 bp, Glycine max
  Peptide Sequence Number=SeqID_133652
atgagggcagtgactgagaagcataggccaattaatgaacacattgcaaatgactcgaatgcagggacagtggtggatgtggcaaaggaattgaaacaccagcaagaagagctgccacaactgagcaagattctgatgagcccttga

SEQ ID NO: 16875 - DNA, 240 bp, Glycine max
  Peptide Sequence Number=SeqID_133653
atggtcttcatagaagacaatattacgggatgtggtgatgttatgggaatgaaggttatagacgagataccctttggtgtgtggtttgaaaccaatgaagatgcatgggtgggcacgagggtcaagcttttgtctgtgggatttgagagtactcatgtaacacaggcaaccatagactcgaagggagatttgttattcaagaagggagtaggaatgcaattgatcaaatatgctgcatga

SEQ ID NO: 16876 - DNA, 180 bp, Glycine max
  Peptide Sequence Number=SeqID_133654
atgaagttaaaaaggaaagcaagccaatactcaaacatcatggtgttaaaagaggacaataccaaaaccaagccagaagcgaaaaaacgtggaagaagcaaagcattcccactcaccacagacagcgacttcattggaggggaaggggttggtgcagggtgccattctagtcaggagtag

SEQ ID NO: 16877 - DNA, 1128 bp, Glycine max
  Peptide Sequence Number=SeqID_133655
atggcgaaaggcgtaatcggagaagaaacgcgactcaaattagcggagggtcttctcagccaatccgcagttccatccgaggcactaactcactccaatgtgggtcttctaatcggcaagttcagctcctccttgggccgggcctttctcttcgacctcattcccaccccacacaacgactccgccgagcccgcctgcgccctcaccgaccccgacaagaagaaggccaccaaatccaaccccgccgattcctcttccttgttcatcgacaaggattgggtcgccgaacatgcccgccaggtttctagaatgctcgtcggcggcatcaaggtcgtcggcctatacgtttgggttagcgatgccgcattcaaaaattcaaccataatgctttgccagaccgtgaagggtgttgctgaggcagctccggttttggagggtgattgggatgagaggctgcttcttcacatttcttatagcccgaggaggtggaattgtagaaactgctcactgtcttcgaatattacatcaagtagtttgcggccttgtgactttaagatggggaaggtcttaacttcccttcagacgttcaagtgcatgcacaactttaacctgaggttacctatattacgcgacagtgcatcaaagttccagacattgagtgatgttcttcgtcatacaatatctattcatgccaaagagcttgcaggtgcaaaggccttgattgatgtggttttttgcactgaatattacattgcccaagatagttttgtcattagggttgttgagagtgagtcatattcatcagatggtgtgcatgaagttgaattgcttctttcatttctgaacgatagttctattgaagcatgcagccaaggagatgttgttggtattctttcatttagtggcttgatatgttcttttgcatatctgaattcaaaagagcctaattcacaagccatcactgatataaagggagatatcattacgagtctgcaaagtagattggatataatctgtgatgaggtagatgttgactctggtaacaatcatgatgttggaagccaagtaagcaatgaaatatcggctgaaaagcctgttccccaactagtgttgcacttattgaggtag

SEQ ID NO: 16878 - DNA, 516 bp, Glycine max
  Peptide Sequence Number=SeqID_133656
atggtggtgaggaaagttgggaactgttgccactcacaagcgcttgtttctgttgtgaaacgttgttttcttcaggttcttgcaagccgtaccaagatttatatcatattggagttcatcacgggtggtgaattgtttgataaaattatacaccatggccgtcttagtgaaactgactctagaagatatttccagcagcttattgacggtgtagattattgccacagtaagggagtttatcacagagatttaaagcctgaaaatcttttactcgattcactgggaaatataaagatttccgattttggtttgagtgcatttcctgagcagggggtgagtatccttcggacaacttgtgggactccaaactatgtggctcctgaggtactcagtcataagggttacaacggtgctgtggcagatgtttggtcctgtggggttatcctctatgtcctactggctggatatcttccttttgatgagcttgatctaaccaccttatatagtaaggcatga

SEQ ID NO: 16879 - DNA, 642 bp, Glycine max
  Peptide Sequence Number=SeqID_133657
atgtgtcacatcatcataaacattaacggaggttgggaaaccgaaacaagtaacgagagaccaaagtggccaagaacgaagcttgacgttgtcttgaagtcattacaatttcatacccacattccgctttctttggaacactctcgctttcgccttcttccttcacactcagcaaatgagattagtcgctatccagaagttctgtgggcacaacgttctgataaggtttaccttactgttgctctacctgatgccaagaatgtttctgtgaagtgtgagcctcagggtttgtttactttctctgcttctggggttcaagaagaagcctacagctttagcttggagctgtacggatgcattgaacctgagggttgtaaaactaaatctggcttaagaaacatactatgctcaattcagaaaggagaaaaaggttggtggaagaggctattgaagtctgaagagaaacctgctccatacttgaaggttgattggaacagatggtgtgatgaggatgatgaagagtcaaccttacaatgtacatactggagggcgagccctggtgcagcggtaaagttgtgccttggtgacttgttggtcatgggttcgaatccggaaacagcctctttgcatatgcaagggtaa

SEQ ID NO: 16880 - DNA, 1531 bp, Glycine max
  Peptide Sequence Number=SeqID_133658
atggcctccatcgagatggagagtgcaaaagaagatgacatttcgccgatcgaggaggttcggctggtggtgtcgaacgaagacgatcccaggcagccggtgtggacgttccgcatgtggttcctgggaatcgtggcggtgatacttctctccttcctcaacactttcttcggctacaggaagcagccactcttggtcaccatgatttcggttcaggtggccacgcttcccattggccgcttcatggccagggttctcccgccaaccaagtttcggatccgagggagggacttctcgctcaaccctggtcccttcaacatcaaggagcacgtcctcatttccatattcgccaacgccggcgccgcgtttgggaatggcgccgcttatgccgtcgggattgtcgatataatccgcgccttctacggccggaagattaccttcctggccggtgttggggtatggatgggcggggataatgaagaagtacgtggtggagcccgcagagatgtggtggccctccactctagtgcagcacagcagattggatccggcgaaaagggacttggtttgggttccttttcccttgactggaccaccgttgctgcattccttggcaacccacttgtttctcctttctttgcaacagcaaacgtgttggtgggctacatcttattgatctacctcatcatacctgtctcatattggggacttaatatctacaatgccaagaacttcccgatatactcttctagtctattcgttgccaatggcacggaatacaatgtgaaggccattgtaaatgaaaagtttgagatagatatgctggcatacgagaaacaaggtcgagtcaacttgagtgcgttctttgctattagttatggcattggttttgctgccattgcctcttccctcactcatgtggccatattcaatgggagggagatatatgaacagttccgatcttcacgatctaaaaaagaagacattcacgcaagattgatgaagaagtacaagcgaatacctagttggtggtttcatgtgacgcttttggtttcttttgcacttgcacttttactgtgcattgtcatgaaagatcagatacaaatgccatggtggggtctcatctttgcatccgggattgcacttacttttactcttcccgttagcatcataacggccaccactaatcagactccaggtttgaatatcattactgagtacatcatgggtgtgattttacctggcaaaccaatagcaaacgtttgcttcaagacatatgggtacataagtatgtcacaggctgtttcctttctatctgatttcaagctaggacattacatgaagattccgccacggtccatgttcattgttcaggttgtagggacgctgatagcaggaaccatggacgttggtgtcgcatggtggttgctgggttccgttaagaacatatgcaaccaagatttactgcccgcagacagtccatggacttgcccgggtgacaaagttttctttgatgcatctgtgatctggg

SEQ ID NO: 16881 - DNA, 270 bp, Glycine max
  Peptide Sequence Number=SeqID_133659
atggattggggtaattttctccaccgaatccttgaggaggattctgagcattccactccaacgacaagcaacggcacctcgtggtggcctctggtggtcgtgggtggtggagaaggaggtattaggatcttgcttagcaagctcatctcgctaagcgggagtccacttttcacgcttagcgcgacaattggcactgagcgcaactccctctgcattaattctcgctcagcgcaattccctctcaggttgaaattgcacttagcgtgctaa

SEQ ID NO: 16882 - DNA, 1068 bp, Glycine max
  Peptide Sequence Number=SeqID_133660
atggataatcgagtccatgggtggatatctttcagtccgccagtgggattctggcagatcacacctagtgatgagtttcgttctggtggacccctcaaacagaatttgacctcgcatgtaggccctaccgcgcttgcaatgtttcttagtggtcactatgtgggacaagatttggtgcctaaatttagaggtggtgaatcatggaagaaggtttttggtcctgtatatatgtatcttaattctggagcagttggtgacgacccacttgggctatgggaggatgcaaaaatacagccatattctttcccagcttcagaggattttttaaaattggatcaatggggcaacgtcagtggcagattacttgtctttgacaggtacatctgcacagacttaatatcagcaaatggtgcttatgttggtttagccccacctggagatgcagggtcatggcaaagggaatgcaaggtgctcttcgctcacttaaggaaaagttcttacattgaattgggtgaacttgtatatgagcctctacgggatggtcccacattgtgggaaataggtattccggatagatctgctgcagaattttatgctcctgatcccaacccacaacatattaataaactttttatcaaccatctagacaggttcgggcagtatggattgtgggatgggtattcagaattgtatcctgatggagatttggtttacacaattggtgttagtgactatacgaaggattggttttatgcacaggctccaagattatcatgcaagcctgttatagttggatttcttgagttatacgttacatacaatattcgagtaaacgatgccaatgcaagacaacccgtatttaccagtggattaataggaagggacaactcaattgcaagacatggaattcaaggaatctattggctgtacaatgtgaatataccaggttctcttcttattgatggcacaaataccatatacttttcgcaaccaagatgcaccagttccttccaaggtatcatgtatgattatattcgtttggaaggcccaccttgtgaagaaatttaa

SEQ ID NO: 16883 - DNA, 1791 bp, Glycine max
  Peptide Sequence Number=SeqID_133661
atggatttagtggcaccagccgaacaggtttgctcatttcaccacttccacataaccagagctagggtttctgataactccatttctcgtcctttcgttctatatcctgatagtagtgttagtcatcatttttcaaaattgaaggcaactaggtctagaaagcgtttagaaaatcgcgtttctgctgtttccaagtccgaagcttctggtttgaacggtagattgcaacaaattgtgagcaccccaaacggggacttgaacgtcataggcatggaatcttcgcccattggggtgaacggttcccggagcttcgaggagtttgcgagtaacattcatctccggaagttggttagaaatggagagttagaggaagggcttaagtttctggagcgcatgatttaccaaggagatatccctgatgtcattgcatgcaccagtttgattcgcgggttttgcaggagtggaaagactaagaaggccacaagaatcatggagattctggagaattctggtgctgttcctgatgtgataacttacaatgttttgattggtggttattgcaaatctggggagatagacaaagccttggaggttttggagcgaatgagtgttgctccggatgttgttacttataacacaattctgcgtagtttgtgcgatagtgggaagctgaaggaggcaatggaggttcttgacaggcagctgcagagggagtgttatcccgatgtgattacttacacaattttaattgaagcaacttgtaatgatagtggcgttggtcaggcgatgaagctgttagatgagatgaggaagaaagggtgcaaacccgatgtggtcacttacaatgttcttatcaatggtatttgcaaggagggtcggttggatgaggcaattaagtttttgaataacatgccttcgtatggttgtaaaccgaatgtgattactcataatattattttgcgtagcatgtgtagcactgggagatggatggatgctgagaggctgttatcagatatgcttaggaagggttgttcccctagtgttgttactttcaatatcttgattaacttcttgtgccggaaacgattactgggtagagccattgatgtcttggagaaaatgccaaagcacggttgtgttccaaattccttgagttacaatccattgcttcatgggttttgtcaagagaaaaagatggatagggcaattgagtatttggaaataatggtgtctaggggttgttacccagatatagtgacctataacactttgcttacagcactatgcaaagacgggaaggtggatgctgcagttgaaatactgaatcaactaagtagcaagggatgctctcctgttttaattacttataatacagttattgatggtcttacaaaggtgggaaaaaccgagtatgctgtggaactgttagaagagatgcgcagaaagggtcttaaacctgatataattacatactctacactgcttcggggacttggtcgtgaaggaaaggttgatgaggctataaaaattttccatgacatggaaggattaagtattaagcccagtgctgtcacttacaatgcaatcatgttgggactttgtaaggctcagcagactagtcgtgcaattgattttctggcttatatggtagaaaaaggatgcaaacctaccgaagctacatataccattcttatagaaggcattgctgatgaaggattagccgaggaagctttggagttgttgaatgagttgtgctccagaggatttgtgaagaaaagttcggctgaacag

SEQ ID NO: 16884 - DNA, 429 bp, Glycine max
  Peptide Sequence Number=SeqID_133662
atgtctgttggatcccagagggtcgtgcggcaatttggatacacacagaccattcctgctccgcctgtcgattcatgggtgtcgtatgatgatatacacgacaagtggatgcactactcggatcatatcattccagcaggtgagccccgagtcgtccctcaggccccacagacagatatccctcacgtgctgaagccaggagcaccgtcgacatctgcgaggcccgctatggaggagcctagacatgcagtggtaatttgctatgagattgctgagaggttggagcgccatctgaacctaggggtggtcacgccaggctcatcgacacatgaggtgatcgaagaatgcctcaggatggccaggagtgtgacacaggaccagctagtatatgttaggtctcgacacaggcggcacacggattgggcatag

SEQ ID NO: 16885 - DNA, 387 bp, Glycine max
  Peptide Sequence Number=SeqID_133663
atggcaaattattttgtggtgatggataatggcatagtccaagttaccttaacaaatccagatggaattgtcactgggatacgatataatggtgttgacagtttgcttgaagttctcaacaaggagactaatagaggattcataatgctccgtggttcatcaggcttctacccttatggaatttatgagcacttaaatggatggccagattttgatattagtgaaacaaggatcactttcaagcttagaaaagaccagtttcaatacatggctatggcagacaataggcaaagggttatgccttttcctgaagatcggttaccaggaagatgccaaaccttgggttacccagaagctgtcctgctagtcaatcccaaggatccatga

SEQ ID NO: 16886 - DNA, 321 bp, Glycine max
  Peptide Sequence Number=SeqID_133664
atgacgaacacacaaacgggaccaccaatatttaaccttcacggaacaactacttcaaacacacaaacgggaccaccaaaacttcaaaagctttttacggaaaaggaatacgaagaacaccgggatgaaggtgaaaccaaaaagcatttccggaagaaagttcttccggaagaagaaggtggtcttccggaagaaccttcttccggaataagctctggaagacgtccttccggaacgtattacggaagttcttccggaagcccaccttcttcttccggaaaaaccttcttccgaaagttttctagaaggacctcttcctga

SEQ ID NO: 16887 - DNA, 432 bp, Glycine max
  Peptide Sequence Number=SeqID_133665
atgtccctggcttattttttccttataaaagcttttttttttcagaaatgcacacaacccccatttttgttcgctttttttcctccgtttttgtggtttttatgcggcattgtctcgggttcattggttcgttgtgaacaattaggtgcggtgaaggtgaaggtgcgttgcggtggtcggcggcggcaaacgagatacgtagaaggtggttcatttgtcgcggacatggacgaagatgagtggatgtatgaaataatgtatgaacaagcggatatggattatgaaaatgcagaagcatgtggtgcgaatgaaccacatgttgattgttcgaatgcgttcaacacctcaggttatgatgttaatgtgtttgagtgccgagaggatgctttgtactgctctcgatccctggctcaagaagacggatttgtggtg

SEQ ID NO: 16888 - DNA, 195 bp, Glycine max
  Peptide Sequence Number=SeqID_133666
atggacaacgatatattgtgcgtgattagcatctatatactgccaactaatattgatgtacctgtaaaaaatgagtcactcttgccttgtatgggagtatctgaccgttcgtcctcttcaatgaccgcggaggctggtacctgcaactatgctccaatgctctcaaatcatcaagggataattgtagggttttaa

SEQ ID NO: 16889 - DNA, 879 bp, Glycine max
  Peptide Sequence Number=SeqID_133667
atggagcttacatcacctgtggtattggcagagggtgagactttgcccacatactccagatactgcaggctgcccacagattatagagagattgaggttgccttatgcataccaggccgagggttcatcttgaacgctgggggccatcctgagaggattctcaagaaagatttgactactttagcccaggtgtggagtgttctgtcatactccaacctggcccctacatcacatacctctaatctgatagtggacagagctaggctgatctttggtctagtctctcgcatggacatgaatgtaggagctcttatttcttgccagataacttctatagcccagtctaacttttctagacttgggtttcctgctctaatcaccgccctatgtagagccagaggggttgtctctgacagccttacttttgagcacctgagcccagtcattaacttggcctacatcaggaggaactattggaatcctaatgatctgacaggacagatcattttattgcagagtttacaagtagtggcgcctccaggatccattcctttcgttgaacagtttctagagagggtagcctggcctggggcccaaccttctcttcacatggaagatgaaggtcccacagcccaggatagacaggtagttgctgctactcctgagaggtctcttgagggtactccagagcctcctgcattagtggtggacctatcctcgcctcagtatgcagcagacccctccactcctatcctagagataccagaggacccgaccacaccagtcctaactctaagcacttctcttccagctactctagtacttcatctgacagatgaggaggatgttcagacacaagatactcaggaccagtcatag

SEQ ID NO: 16890 - DNA, 609 bp, Glycine max
  Peptide Sequence Number=SeqID_133668
atggttgtcaatgttagcaccgaagaaaataagtggctttctcaaagttgggcagacacccttaaggatttaacaatgtttgataagtgcttctcagagttggtaaacagcgttggctacttggtagatctggatgtaagtatgagggacatgttgagactgaactatgcacgagttctgattaccactgtttctaatcaaactatttgtagctctcttagagtgaagattgatggtgccatatgtttagtaaggatggaagaggaaaacgtcttgttcattaaccactgtgggtgccgagatggagttgaatcctccccgctagttgacgttgaagtaaaaggaagcgaaatagagttggacatcggctctatgatgtcggaatgctctgacgatctggcaaaggaagatgaacaatcacaccagagtcctcgacaagcggtccatatggaggaaactacagtacaaaactcactgggtattgcccacttcataccacttatggagtctatgacacctatagcctctgtgaatgataggaacaatactagttgcattgaagggaatggagtaccaaatacagaagaggcatggagatttaaaaaataa

SEQ ID NO: 16891 - DNA, 882 bp, Glycine max
  Peptide Sequence Number=SeqID_133669
ctaaacctgtataggtacatcagtgatgcattcatcccagtcagcggtgcttatgtgggactagcagccataggagaggttggatcttggcagagagaatgtaagggttatcaattttggaccattactgatgataaaggctatttctcaattattaacatacgccctggaggctataatctctactcgtgggtcaatggattcattggtgattatcaattcgatagcgtcatctacgtaacttcaggttgtgaaactaatgtgggtgagcttgtttatgaggcaccaagagatggccctacgttgtgggaaataggcatccctgatcgttcagctgctgagttctatgttcctgacccaaaccccatgtgcattaacagactctatgtcaaccatccagacaggtttaggcaatatggcttgtgggagagatatgctgagttgtatccaaatgaagacctagtttacactgttggcattagtgactacagaaaggattggttctttgctcaggttaacaggaagaaagacaatggcacttacataggaaccacatggcaaattaatttcaagcttgatagtgtgaataccaacggaacctacacattgcaagtggctctggcatctgtgcattctgctgaattagagattcggataaacaatttagaagcaaatccacctttattttcaagtggagtgattggaaaagagaatactatagctagacatggaattcacggtctctactggctattcagcattcatatacaaggcacacttcttgtgcagggaaacaataccatctttctaacacaaacaagagacactagtccttttataggaattatgtatgactatattcgtctagaatacaaacggtga

SEQ ID NO: 16892 - DNA, 318 bp, Glycine max
  Peptide Sequence Number=SeqID_133670
atggagatgagcataataagagagactcacctacacctccaaggacttacacttccaacaatggaggaagagaagaaaaaaaaaacaaagaactccctcatttctccttggacaaccaacacgcaacaaggagggaagggagtttactctctcttttttagagggagagttaggtttagaggaggccccaaatgtaggacccctagatcaatggcagcgaaatggagatggaagaaagatgattggagatgccacttcaagaaaaagatcagtcaagaacaagctcaccaccataggaagccatggataagaccttaa

SEQ ID NO: 16893 - DNA, 516 bp, Glycine max
  Peptide Sequence Number=SeqID_133671
atgagttgttccggaaaattcttccggaataaccaaagggtcatccggaagaaccctcttccgaaaactttccggaagaagtgttccgtaaactttccaaaagaaggattcttccagatgaccctttggttcttccaaaagaacccttcttccggaaaccttccgaaacaacgtcttctagaacttccggaagaagtcttcttccagaaagtttctagaagagggttcttccggaagaagccatcgttactggtccgcgttttaaccattttttttggcgtcttctaccctaagtggaggggagttagggagaccaacctcgaaggcaaaacgcaccaacagcgtctgatcggagcagacgaagcagacggggctcgcggggaagaagaagcagcaggagaagaagaaaaggaacaaagaaggcgtggatcttccgggaagaggagcgcttatattttaaatttttacttaaagggcaaaatggtccattcactaaattgctgggtgcaccagtaa

SEQ ID NO: 16894 - DNA, 960 bp, Glycine max
  Peptide Sequence Number=SeqID_133672
atgctcatgccaccttcttccttcaccctcctcctcactctccttctattattccttacatatgaagcagagagcggagaaactccaccccctactcccccgccgccgttcagacccggcatagcggtgctggtgtgcgttttgacaaccataatctcccttacatcgctcctcctcctctacatcaaacactgcaacggcggcatcccagacggcggaggcggaaactcggctccgtggacggtggcgcccttctccggaaggaaaaactccggcattgaccggtccgtggtggaatcgttgccggtcttcagattcggagcgctgcgggggcaaaaggaaggactcgattgcgcggtgtgcctgaacaagttcgaggccgcggaggttctccggctgttgccgaaatgcaagcacgcgttccacgtggagtgcgtggacacgtggctggacgcgcattccacgtgtcctctctgccgctaccgcgtggatccggaggacattctcctggtggaggacgcaaagcctttccgccagagtcatcaacaacaacggaacaaggaagaggaacgcgtgcgtttgaatttggacctggagaagcaggagatagtggagtctcgacggaggcattcgtccgttggggtgggggaaggagaaacaacggaggagcagcagcagagtcggaggtggacgacgtcgtttagaaggtcattggatagcattagcgccacatcgagaaagaagaacgagagcgttgggacggagagggcaagcgtggaacggaggttggagcaccggattattgtctccccgggccagggcccgggcccaggcccaggcccaggtccgtgtgggctcgagcagcggtggagcgacttgcaggcttcggacctgctgtatctgacgtcggagatgataatgatgagggacagttggaatggcagagggagtggtgtctga

SEQ ID NO: 16895 - DNA, 648 bp, Glycine max
  Peptide Sequence Number=SeqID_133673
atggcttgtgggagtaagagcgggaaaagtgagatcagtgaaggaggtgcaaatgattcagtggctgtgggagatgtgatatttgtcaagcttcgcggtagctcatggtggcctgtacaggttgttgatgaaaatagtgttaataagagtgttaaaccgagcaaacggaccaaacgattgccgggagacatccttgttaggcattatggaagctatacatactcatatgctgatcctattaaatgtcgtgatgagtttaagaggatacttgagcgtaatgatggttctctcaagaaagtacttctacagactcttgaacagggtctttctgagcatctcactaagaaggtagaggatattgttgttattgagagagatgaatggaaacaggaatcatggagaagatgtgtggctgtggaaggggtgatagaggtaaccttcactacacttgttgttaagcaagatgggcacactcaagacaactactactctttgcatgggtttccatataaaattgctaaggtttctcaatctccaaatccggctattgagcagaagattaagtctgagggaaatcaccttagtttgttctcagccaatgagtacaaggagtatcttcagcttaaggaagcctatagcctatactaa

SEQ ID NO: 16896 - DNA, 270 bp, Glycine max
  Peptide Sequence Number=SeqID_133674
atggttacgatgacccctggtgctcaaaagaaactgccagacacaaccctagccacgttctccacaaacacacacactttatccaagaacaaagcaaagtgccaccaccacccatcatcattcacagcagctcagtacagtacacagcatcagcgtcagtccacagatattctcagactctcccaaacttcaaagcaacaccccacaccaaaccaaacccactttccaaaaatctactctaaccaatccccacattgtgaccaaatgtga

SEQ ID NO: 16897 - DNA, 262 bp, Glycine max
  Peptide Sequence Number=SeqID_133675
cgtgaatctttcagcaaatcttcccgttctcaatggaaagaactgggatcggtggcgggtgcagatgaaggcaattttgagctatcaagaagtcgcagaaattgtcgaagaaggttatccaatgcttattgaagattccacagatgcacagaaagtgcttcacaaagaaaacaagaagaaagattgcaaggcaaccttcctgattcatcaatgtgttgatgaggcacactttgagaagattacaggcgttgcaacttcgtga

SEQ ID NO: 16898 - DNA, 930 bp, Glycine max
  Peptide Sequence Number=SeqID_133676
atggaggtacctttaccaggaatgaagctgatggaaaattggaaagttgaggaagaaggagataaagatgatggtgatggtgatgtgggtaatgatgacagtaatggagtggatgtaaacacaaatggtgaggagcaggaagacattgctagtgaggagcatgatgacattgatggtgacaaggatgtagatgttgatgtgagggtaggccgtgaatggtggagtgatattccagaatacaatgatgaagtccaagaggatgaagctgaaccaattggttatgactctgaaaagttagatagctcgagaagttctgatgatgaaggtggatttgaaaaagaagtcttccctcaattcaatgaatgcagcaagtttggtaatgtgcatttggaggtgggaatggaattcagtaacatggaaatatttaaggaagcagttagggattacaccattgagttgggcagggatattaaatggaagaaaaatgatgctattagagcaagagccaaatgtagagagcctgggaacaaacaagcaactagacaatgggtagtgaaaaagttggaagataaaatccgagagcagccaagtttgaaatacaatgaagcacttgatttttttaaaaaggagtatggtgtccatattgttgagagaaagatatttagagcaatgaaagaagctaaggagttggttgaggggagtgagaaggagccatttattggacttgatggctgttttttgaaggggtattttggtggacaacttctgtcagctgttggccttgacagaaacaaccatatttatgtgttggcgtatgctgtggtagatgtcgaaaataaagataactggaagtggtttttaacatcgttgcatgaagatattggagactacaaggagcataagtggaactttatgtctgccatacaaaag

SEQ ID NO: 16899 - DNA, 3867 bp, Glycine max
  Peptide Sequence Number=SeqID_133677
atggcggacttcaacccttcctttgcttcctttcctacactagaggaaatcctcacccgtctttccctccaacaactatcccttggtgacaagattgatgcgcttattcataccctaacccttgttgtcacctctgcctctcccatgccctcccccattcccgtcgtcccacatccccattcctcgtccactgcaaccatacacaaacttaaattagacgtccctcgttttgatggcaccaatccccttggttggatctttaagatcaaccaattttttgactaccactctaccccggcccatgagcgcttaaccattgcttccttctatatagagggtcgagctcttgcttggttccaatggatgtcaagcaatggccaactcacatcctggtcggttttcctccaagccttacagacctattttgcccaatccccttatgatgaccccaccggagccttattcaaattgacacagaagggttacgttgcagcttacctgtcggaattcgaggagctagccaaccgtgttatcagtcttccccaacccttcttattaagttgtttcatttctggcttgtcccccgatatccatcgtgagatgcaggcgatgcaaccgctgactctggtccgggccgcgggcctagcacgttttcaagaggagaaggtgctggaacacaagcacgtgtttcgaacacaagccctttccacctctgcccttgtcacgatacccctcttgtcgccacctgtacagccgccacctccaacagtgaagcgcctgacactggataagatagcctcacgccgtgagcgtgggttgtgcttcatctgcgacgagaaataccatagaggtcaccggtgtgcctctagggtttttctctttgtcgctgaagaggaagacccacctccaactattatagcagatgttgacccattaccctacccgcccgacgcacccgacccgagcccagcccaaatcagtcttaactccttgtcgggtcaagtggctcctgaaacgttgtgtttcgtgggtctcgtctccaaccaccatatagtcctcttgacaactctattgaaggtgatggtgggcaatggccaacacttggagtgtcgttgcatttgtgccaatgttacaatggttgttcaatccttcccattcaccacaaacctctatgtcctacccattactggtgccaatgttgttttgggcgtgcaatggctcaagtccttgggccctgtgctaacggactacaacactttgagcatgcaattcattcatgagggaagattagtaaagctcaaaggtgatgacgatgccaacattcagatgatctctcccccccagcttcgtcgtatatgtcgtcgtcaaggggatggcacttgctttcacattgcagtgctcatagaggagataggtcccatgcccaatttagtgattcctcctgagttccaacctttgctcactaaattttgcggccataaacataagattaagctgcaagttgaggggatgcttcagaaaggattgattcagcccagtacgagtcctttctcgtccccggtcttattagtgcgcaagcaatatggctcatggcggttctgtgttgactacagggccctcaatgcagtaacgattaaggaccagtttccgattcctactatcgacaaactgttggacgagctaggtggtgctaagtgcttttcgaagcttgaccttctccagggctatcaccagatacgcatgaatgtcgatgatatactgaagacgacgtttagaacacaccatggccattacaagtttaaggttgagtatctggggcatgtcgtgtcccatcgaggtgtggaaccagtggtggcgaaggtggtcgccgttcaacagtggccaataccacgttccaccaaagctctgagaagttttttaggccttgcaggattttatcgcaggtttatcaagcattatgcctccattgcagctccccttgttaaggtgaccaccctcaagccctttcagtggacaagtcaagcccagagtgcttttgaacacctcaaagttgctttatcttcagctccggtcctggctctccctgatttcgatatcccttttgtggtggagtatgacacgtcgggaactggcatgcgtgccattttatctcagcgcgggcacccaatcgctttctttagcaagccatttagccccaagcttttaagagctttgacttacattcgggagttgtgcgccatcaccacagttgtgatccagacaccagagcaacacatgtacctcgccagattaatgggttatgactacgacatacaatatcgctctggtgtgactcaccaggccgcagatgctcggtcacggctatcggaatcacagaccaccatgcacatgatactctttgttccctgtttgacatttctcacagaattacgccaacaattagctgtgaacaaggaatacaggcaacgtcggagtgctatcctcgaatcaccagctgctcatcctggattctcggtggtgcacgatttgatcctgcacaagggccgcatttggctctatcacgaattaccgataattcctaccttgatacatgaatatcatcatgcaacaccaactgggaggcatactggggtcaccaaaactctagctcgaattttagagaacttccattggcaaggtatcagagatgatgttacgcgtttcgtggctcagtgcttggagtgccaactcaccaaatatgaaaccaagaaatccgccggcctgctttgtcctcttccggtcccgcacagaccatgggaggatctttccctggactttatcatgagtttaccaccgtataaaggccatactgtgattcttgtggttgttggcaggttttccaaaggtattcacctgggcatgttaccggcgactcatactgtgcatatggtagcttccctgttcctcaatattatcgttaagttgcatggcattgctaggagcctcgtttcagatcgtgatccgctcttcgtcaaccatttctggcataaactttttcgcttgagtggcatcctgctgcggatgagttcgacgtaccacccgcaaactgatggacagaccgaggtccttaacagggtgattgaacagtaccttcgcgcgtttgtttaccgtcgaccaggctcatggggtaaattgctcccttgggtggaatggtcccataattcttcatggaccgtaggcacgggctccaccccatatgaaattacctttggcaggaaaccattctcgttcccgaagtacattgttggatcctctaatattgattttgtggacgaattactcactgacagagatgtcacatttcaggccattcgcaagaagctagtcaaggcacaggaatacatgaaaacacttgcagatacgaaacacagagaggtggtctaccatgtcggagactgggttttactcaaactccgaccttaccggcagagcacagtcaaaagtcacccaggcactccggccaagctggtcaagcattactacgggccctttaagatcttagaaaggattggcgagcaaactcatgagtctgcgttaccacctccagcgatcaatggtcaacctgtggtttctcctttagctattctcgactattgcagaagtcaagccttagtcaacgctccatgggaggtgctggtacagtggcagggcctttctcctgatgaggcctcatgggaagattgggcccaactgcgtgacaattaccaccttgagaacaaggtggtcttctcgactaaggcccagggagtgataggaaagcagaagcagggaacacagcacagggagcaacaaacaacatcaacaaggcccaagcaacagaaaacataa

SEQ ID NO: 16900 - DNA, 354 bp, Glycine max
  Peptide Sequence Number=SeqID_133678
atggcagctttgaatcttgcctctctacccgtcacagttctgggacagctcaatagcagtgctatgaattttattccgttaatcaaatgcacaagaactaaaatcattatgcttgttagaaaaaaatatttcaagcgagtgatggaaaagcatggtatacagcctgaattatacttccatgacagtgatacggaagcaaaagcagggaacacaacacagggagcaacaaacaacatcaacaaggcccaagcaacagaaaacataaacaaggaaggacagagggtgccaatagcaaacaaacccaagagaaaagtaacaaggccctcatacctgaaggattacgcccgagggtag

SEQ ID NO: 16901 - DNA, 348 bp, Glycine max
  Peptide Sequence Number=SeqID_133679
atgtacggtctaatgaggctactacgaaatatttactcatggggtgggggcaagctcttctattctggtcatggtttctcttggctatatgggtcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 16902 - DNA, 318 bp, Glycine max
  Peptide Sequence Number=SeqID_133680
atggaggtaccagatgaattggaatctataaaaaataataaagtttgggatcttgttgagttgcctaatgggataaagcctattggatgtaaatgggttttcaaaaccaagaaggattcattaggtaacattgagagacataaggcccgattggttgccaaaggatttgctcaaagggaaggagttggctatagagaaaccttttctcctgtatccatgaaagattccttaggcatcataatggcattagttgctcattttgacttggaattacatcaaatacatgtgaaaatgacttttctaaatggtgatcgttga

SEQ ID NO: 16903 - DNA, 2663 bp, Glycine max
  Peptide Sequence Number=SeqID_133681
catcttggatatacttctgtgattttgggatcacagatatgaccaacacaagtgcagaattgtctcagggaaatggtggtgtttctattccccctcctaattcccagtctgggccacaagagcaaaatctgcgttctcaaggtggaagcggcaatatgaatgctgtctctcagaagggaaatgaagtgaatttgacccttggtggcattgacctcaacaattcaggcagtgttgttatcaaagcagataagaaacttttgactgtacaatttcctgatgttcatgatggacgagctttcacacttaaggctgaaactacggaggatttatatgagtggaagactgcacttgagaatgctttggcactagcacctagtgctgccaatgtgacagagcaaaatgtgaaggatagagaaccagttaaatctaccgttgttggccggccaattttacttgctttggaggatgttgatggaactccatcatttttggagaaagccctaacattcatagaagagcatggagccaacatagaaggaatcttgcgacaagcagctgatgttgatgaggttgaacgtcgagttcgggaatatgaacaaggaaaagttgagttttctccagacgaggatgcacatgttgttggtgactgtgttaagcatgtaattcgcgaattgccatcttctccagtccccgcatcttgttgtaaagcactgttagaagcttgtcgaactgagcgtggtagtagggttgcttctatgcgtgcagcaataaatgacactttccctgaaccaaatcgccgcttactgcaaagaatacttatgatgatgcaaactgtggcttcacgcaaagctgtgaatagaatgagctcctcagctgtggcagcttgcatggcgcctttacttcttcgcccccttctggctggggaatgtgaaattgaaaatgattttgatgtaggtggtgatggttctgttcaacttttacaagcagctgctgcggcaaaccatgctcaagcaatttgtataaccttattagaagaatatagcagcatatttggggaaggttctgtgacccctgatatatacaccgactcagaagaagagagtggatctgagagtgaggaggcaactgatgatgatgatgatgatgatgatttgtcctatgattatgatgatgatgatgatgaacaagatgaatcaatacacgagtctgatgcagatgatgatcttgttagtgaatcgtacagcggaactggagattccgaggctgatgatgaggaccatgatcatgctagttcaagttcaaaatcctcaggtaagagtgaaaaattgaaagcctctcggaagttatcatcaaagtcacttgaaggctcactgactcaacatgaagatattaaaagccttgaacatgtcccgagtccaaagaagactggctatatagatcagtcctataagcctgatgatatagttggaggagtttccactgatgaagctacattgcataattcaaattctcctagccctgcttcatgtatcaaaaaatccaataccatgtccaatggcccagcacctcggcatcgcaccatattgggtcgcacctctgcaaggaagaatctttccatggaatccattgattttcctattgaagatgaagatgaaattgaaaggcttgaagctgccaggacagaattacaaacccaaattgacaaggaggtgaaggcaaatgaacagctgcaatctcatgtggataaacaaaagaaagccttggaagagcgtcatctagctcttgagcaagacgtagctagactacaggaacagttgcacaaggaaaagaattctcgggtagctcttgagaacaaagcagagcttgaggaattagctctggtagaagcagatcttgccaacttagagtggaaggttgatgagattggggtgaggcttaatgaacttgagcagaattatggaactacttcggattcctctattcaactgcgacagatatcaaatcatgaaagaaaattgaaacgcaagacagatgctgaagttgctgctatgtcacaatctgacagatcaataagtaagggtacggtaatggcacaacaggacactcatattggtggagcagaaaatgatttcgagagaaagcctgattcaccacctttaccaaacaagcacccaccaactagctccaagcgatctggtacaaagggtgagggagcaaattccactccttctgcactgacaaaactgacatccagactgaactttttgaaggtgggacgaagtcagactccaaatgaactccaaaatatggataaaggccgagactcaagtcgctattcaatcaatgtggaaaaaggaaaaggatctgaacgtccccaatcacttctatcccccaaactaccatctcctagacttccatctcccagacatccatcccccaacagatttggagggtctgaagctcactctgtgccaaacccagaaaagggtaaagggtcagagccagttcagatttcagacaaatcgcatcaaagttcagagaaactgaaaaaatcagatagccagccagcccatcactcagatggatggaatcaacaaccaaaacacttggagagaggaaggtcagagggtcatcagacttataatgtggataaaggtcgatga

SEQ ID NO: 16904 - DNA, 1401 bp, Glycine max
  Peptide Sequence Number=SeqID_133682
atggaggctaagttggccaccaccataatacttattttctccgtaatttggcttatgagggtgaatggcatagacccttgtgcctctcaagcggataattccgacctgaacgtgattcccatctacagcaaatgctcaccgttcaaaccaccaaagtcagactcatcgtgggacaacagaattataaacatggcctcaaaagacccactccgattcaaatacttgtccaccttagtgggccaaaagaccgtgtccacggccccaatcgcttcgggccagaccttcaacatcggcaactacgtcgtcagggtcaaattgggaacccctggtcaacttttgttcatggtcctcgacaccagcaccgacgaggccttcgttccatgctcgggctgcacgggctgctccgacaccactttctcgcccaaagcctccaccagctatggcccattggactgctctgttccccagtgcggtcaggtccgcgggctttcgtgccccgccacaggtaccggcgcgtgctccttcaaccaatcctacgcgggctcatctttctccgccaccctagtccaagactcgttaagattagccactgatgttatccccaactactccttcggctgcgtcaacgccatcaccggcgcctctgtcccggcccaagggcttttgggcctgggccgtggcccgctgtccttgctctcccaatccgggtcaaattactcgggcatcttctcttactgtctccccagcttcaagtcctactacttctctgggtcgctcaagctcgggcccgtgggccagcccaagagcattcgcaccaccccgcttcttcgcagccctcaccgtccttctctttactacgtgaacttcaccggaatcagcgtgggacgtgtcctggtaccctttcccagcgagtatcttgggtttaacccgaatacaggatccggaaccataattgattcgggcacggttataacccggttcgtggagcccgtttacaacgcggtgagggaggagttcaggaagcaggtgggaggcactacattcacgagcattggagccttcgatacgtgttttgtgaaaacctacgaaactctggcgccgccaattacgctgcacttcgaggggttggacctgaaactgccgttggaaaacagcttgatccacagcagcgcgggttcgctggcgtgtcttgcaatggcggcggcacccgacaatgtgaactcggtgttgaacgtcatcgccaactttcagcaacagaaccttaggattttgtttgataccgtcaataataaggttggcatagcccgtgagctaactaggtttggatctttcgttgggttcaaaaacgtgatggtgtggttgagtttatgcacggaaatcaagcgtgtccgtgaaaggtga

SEQ ID NO: 16905 - DNA, 132 bp, Glycine max
  Peptide Sequence Number=SeqID_133683
atgagaactaagaagaaaggttactatgattctaagattgcgaatggaatcagtggagtgttgggtttccaaagtcagaacaagaagttgctcataagggtgtttaggggagccaattatccacgaatctaa

SEQ ID NO: 16906 - DNA, 483 bp, Glycine max
  Peptide Sequence Number=SeqID_133684
atgaagggttctggtttgaaaccagatacggttacttacactagtttgatcaatttcttgtgtaggaatggccagattggtgaagctatggggttgcttaaggaaataaaggagaatacatgccaggctgatactgttacattcaatgtgatacttgggggtttgtgtagagaagatagatttgaggaggctctggatatgcttgagaaactcccacaacaaggtgtatatttgaacaaaggtagttacaggattgttctgaactccttgacccaaaaatgtgagttgaaaaaggcaaaggagttgttgggactaatgctaagtagggggtttcgaccccattatgctacctcaaatgaattgttgatggggttccagccaggacttgagtcttgggaagttttaattggattaatctgcagagaaaggaagttgttgtatgtttttgagctgcttaatgaattagtgatcacaaattcttga

SEQ ID NO: 16907 - DNA, 765 bp, Glycine max
  misc_feature (359)..(359): n is a, c, g, or t
  Peptide Sequence Number=SeqID_133685
atggcatcactctcaggcatttgctcctcttccccgactctcaaaaaattcccaaaccaatccccatcgttgaccgaccctctccgcaaagaccacgtgtccttccccgcacgcctcgccgatcggaccctcagcctcgcgccgctccgtgcggtggctcgggaggtttccgacggagcgttggcggcggcggtgaagaagggtgatgagttcgttaaggagatggaaccccgtttccaagcggcgtttcgggcgatggaggagttggagaagggcgcgatcgcgaatcccgatgagagtcgcatggtgggacactattggctgagggaccctaagcgtgcgcccaactcgttccttanaacgcagattgagaacactctcgacgctgtttgcagttcgctaacgacgtcgttagtgattaagcctccttcgtctccggagggtcgatttactcaaatattgtctgtgggaattggaggttctgctcttggaccacagtttgttgcagaagcattggcacctgataatcctccactcaaggatttagtgatgactttgtcttctttcacttctctaccacagataagatttgtggacaacacggatcctgctggaattgatcatcagattgcacaacttgggcctgagctagcttcaacacttgtgattgtgatatcaaagagtggaggtactcctgagaccagaaatggtttattggaagtgcagaaggcctttcgtgaagcaggcttggattttcctaaacag

SEQ ID NO: 16908 - DNA, 1188 bp, Glycine max
  Peptide Sequence Number=SeqID_133686
atggcttccaatagtcattttccctcaaatcttccaattctaaccggcaagaacttcaacagatggagtgtgcaaatgaaagccttgcttggatttcaagatttgaccgatgtgattgagaatggaatagaaattccaaaagaaggagcctcagattcacagaagactgaattcaaggatctgaagaagaaagactgcaaagccttggtgatcttgcatcaatgtgtcgatgattctcactttgagaaaatcgcaaatgctaaattcgcaaaggaagcatgggacattctgaacaaggcttatgcaggagctgataagatcaagaaggtgagacttcagactcttcgaaggcaatttgaattgttgcagatggaagagactgagagcattggagattactttggaagattgcaggttcttgcaaattcaatcactagttgtggtgatacaattactaatctgacgttagttgagaaagttctgagaaccctgaatccaagattcgatcacattgtggttgcaattgaggaatcaaaggacttggaatcattatctgttgatgaattacaaggatcacttgaggcacatgaacaaagattgcaagaaagattgcaagaaatagcaaatgataaggctacagaacaagccctgcaagcacaccatcagtcaagaaatggtggttctgataatcacagaggcaagaaaggaagagggagattccagaacacgagaggcagaggaggttactccaaagataaaggtaaacctcaacctgatcaaagaagtggaaataactgcaatacaagaagtggtggttctggtactcatggaagaggaggcaaaaagaaatgggataaaagaaatgttgaatgcttcaattgtggaaaaagaggagctgtttctgacactgaaccagtgttgttgatggtcacaacaaagactagagctgatgcaaaagatcaatggtacttggacacaggatgttcaacacatatgactggtcacaaggactggtttgttagccttgatgagtcagtaaatcacaaggtcagatttgcagatgacaacactataaaagttgaaggtcatggcaaggttgtgattaaaagaagggatggtacagtgtcatacattgaggatgtgctctatgttccaaacatgagatgcaatcttatgagtcttggctaa

SEQ ID NO: 16909 - DNA, 595 bp, Glycine max
  Peptide Sequence Number=SeqID_133687
tgagacttgtagttgcaatagcaagcatgaaaggctggtcaatgtatcagcttgctgcaaatctgcatttctgaatggtcttcttgaagaaaaagtgtttgtcaaacaaccacctggatttgaagttgatggacatgaaggaaaggtatacaaactgaagaaagcattatatggcctgaagcaagctccaagagcttggaacaagaagattgacagtgtcctaattcagattggctttagcaagtgcatatctgaacatggagtatatgtaaaagcagaatatgagtcagacttagtaatacagtgcctctatgttgatgatttactcatcacaggaaacaacaaaatagagattgacaagattaagcaattgctgaagaatcagtttgaaatgactgacttaggatctttttcatacttccttggaattgagttcaaggaaactgaagttggaattgtgatgcatcaaagcaaatacgctacatacatgttgaagaagtttcgaatgactaactgtaatgcagcagccaccccaactgaaacaggattggcattgagtttgagagatgaaggagaacctgttgatgaaacttag

SEQ ID NO: 16910 - DNA, 504 bp, Glycine max
  Peptide Sequence Number=SeqID_133688
atggcaacaaagagaattctaaggtatattagaggtacaattaactatggtattctactgccaaataccatcacaaattcaaacatggaactggttggctatactgactcagactggagaagagataatgatgatagaaagagcactgttggatatattttcctacttggagatgcactggtgtcatggagttcaaagaagcaagatctggttgccttatcaacttgtgaagttgaatacatagcagcatcaatgtgctcgtgtcaaggcttatggctaagaaaactgttgaaagaaatgaagatccagaagactgaagctataaacatactggtggacaacaaatctgcaatcagccttgctaaaaatccaattgatcatggtggaagcaaacacatagaaacaaggtaccattttattcgggacaaggtgagcaaagggaagggtcacatttgtaaggcgcaacagccgcaacgcaacggcctagttacagtttctgcctag

SEQ ID NO: 16911 - DNA, 480 bp, Glycine max
  Peptide Sequence Number=SeqID_133689
atgacttctacactctgctcctctacttcccttttctcctcctccacgctacgacgtcgtttgcccctcgtcggcgcgttttgcatgctcagtttgggactctccaatctctgcacgcccttccattcctctgccctcaaaacgggatccaagttcggtattcgaagccactccagcaccagaatggaagggagtaactccactgtgccgagtattgttgtctatgtcactgttcccaacaaagaagcaggtaagaagttggctgaaagcatcgtcaaagagaagcttgctgcttgtgtcaacagggtaccgggtattgaatcggtgtaccagtgggagggaaagatttgtgttacaaactatgaagctcactctaacatggacacggacactccaacacaactaatgcctacaatacagaacactgccacctacaaaaatagagagagggggtgggagggagaaactcaaatgaaatga

SEQ ID NO: 16912 - DNA, 150 bp, Glycine max
  Peptide Sequence Number=SeqID_133690
atggagggtgttgagagctatactaaggttttgagtgagacttctgaggaggaagatgatctcctgattagaagtacgaggaaggttaagcgtaaagataacaaggaggatgatcttgagatggttgaagagtttaagaataatggagag

SEQ ID NO: 16913 - DNA, 528 bp, Glycine max
  Peptide Sequence Number=SeqID_133691
atggaagggttagtggacctagcagcgattgacgctttcctcgcctttcatcatggcaaggaaagcccagtcgtcgccattttggccatgtatgacacgttcgaccggggatgtgaaaagagcggcgcaagaattgaaggaagaatcaggattctatcttcatgtgaaggatgtcccatgagaagagtgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgagagagacgatgaggttaaagcttcggaagaaagtgatgaggtacaagccctaaaggcagagcttgaaagagcctgggtagtcgaagagaagttcaagtccatagccatcaaagggcttaatagtgagctcaagctccgaagaggtgaaaggaatcatcacgggtcaaaggcatga

SEQ ID NO: 16914 - DNA, 351 bp, Glycine max
  Peptide Sequence Number=SeqID_133692
atgcagccacaagcaaaggttataatcacaaaagcattggcaaaaacaacagtgctgtgtatggcctctatgattgccgtggtgatgtggttggatacttttgtcaattctgtgtctctactgcttccagacaaatgcttcagcgctgccccaatagagtctctgctatcatgtattacaatttctgcattctgaggtactctaatgagaacttctttgggaatgttactatataccctccacggcatgtagttggaaccaaaaacgtgtctagtgaagaagagattcagaaagttccactcagaaaaggtatggcttggtgcagtgcagcagagatctcaccaatgaagg

SEQ ID NO: 16915 - DNA, 447 bp, Glycine max
  Peptide Sequence Number=SeqID_133693
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggactctacaacaagccttaattttccttacttctatgttcttgggcatgcagccacaggagaaaatgttgaagacccttttattgctgtggaagaaattgataaagaagttgatactcaatttgctaaagacattgaagaccaagttgacataatgttattcctgaaacccaagctgccacaaatgttggacaag

SEQ ID NO: 16916 - DNA, 150 bp, Glycine max
  Peptide Sequence Number=SeqID_133694
atgggatcaaagttacagagcacatattctaataaaagcaaccttgatatgcataacagtggatgcagtggatctaggtacatcctttcctctggttgcagcaatgcaaacttccaccggcaaagctatggagctcctatcagcatctag

SEQ ID NO: 16917 - DNA, 228 bp, Glycine max
  Peptide Sequence Number=SeqID_133695
atgggaatgagaaagggtgaacggagtgagaatgaggatggaatgacaatgggaaaagaagagatgggaaaacccgggcatgacacgtggagggaggggcaaaataatgagaagaggaaaagaaataaaagcaaacacgggcataacacttggattgaagcgggaaaaatcataaaacccaaaaaaagacaaaagccaaaactttttgatgaatatgaaaaattttaa

SEQ ID NO: 16918 - DNA, 1272 bp, Glycine max
  Peptide Sequence Number=SeqID_133696
atggctagaagcatgatgaagcaaaagtcaattccacattctttatggggtgaagcagtaacaattgatgtatatctgctcaacaagtgtcccactaagaggttgaaagagaaacatatactagattctaggagaaggaagttggaagataagagtgagcctatgatcttgtcagtgagagtgaatcctggaactgggatactcagagagcttaagcaaagccaacctcagagacaaacacaactacctattagatttcaacactttgaaatgttgtcagataatgcagtaaatgcagaaggagatttgatacactttgcacttttggctgacattgagcctatagattgcaaagaagcaatgaaggagcaggcctggaaaaatgctatgattgaaaagctgaaagcaatagagaggaatcacaattgggaactaacaaagttagatctcaacaagaaaccaattgaagtgaaatgggtgttcaagcttaaattgaaccctgatggatccatagcaaggcttgttgtaaaggaatttttgcagaaacttggagtcgactataaggagcaaaataattggtctttattccatttagatgtaaaatcaacattccttaacggaccccttgatgaactgatgtttgttactcaacctcctggatttaagataaaagggaaagagaaaaaggtgtacttcacgaggccctacacgcatggtgtgtactacaaaaaaggagtcaagtcaagcagggtactgatttgtctctatgtagatgacctattggtgactggcagtgaccacaatgggattgaaaaattcaagagcctaatgaagtctaagtttgagatgacaactttggggaaactggcctatttcctagggatggagtttgtaaaaatagttgatggaactgtgatgcatcaaaggaagtacacaagtgatgtgttgaagtggttcaacatgttagattgcaacccaacaactacaccaactgagttcaactccaagttgaaagaagcaactgatgatgaattggtggatccaacactatataaacaactaattggatcactaaggtacctctacaacaatagacctaacctatgttatgcagttggcttggtgagtagatttaagcatgagccaaggagatcacatctcactgcagcaaagagggtactaagggacaagagtgatcgaatgagcactactagatacttattcaagctttttgatgcaccaatttcatggtgctccaagaagcaaccagtg

SEQ ID NO: 16919 - DNA, 789 bp, Glycine max
  Peptide Sequence Number=SeqID_133697
atggcaggcaacaacaaaattcccaaaaatcttccaattcttgtgatggcaagaattgggatcgctggtgtgcacaaatggaggtgttgttttgatctcaagatgttattgaaattgcagagaatgacgtccaagaatcaagtaattccactgaggcgcagaaaggggaagcaacaaagagggatggaagagccttgttcctcattcatcaatgtgttgacccccaacatttttgaaaagatccaatcttcctcatcaacaaaagaagccagagatattcttgctaaatgttacactagaggagacaaggagtcaaaaaagattcaagtcatgaaggttgaagagctgagattgattcaaagaggcacctcaagatttgctaacagtgatgacaaaaaaggttttgaaaaaagaaagattcaatgcttcaactgtgagaaatggggtcactatgttgatgagtgttggcataaaaaagggaaacaaaatagaaaccatggcgaagaggcaaatgtagctcaaaagggtgactcaaattcagatcatgtcattctgatggtgactactagtggggataacagtgcactagttgttgaaggaatgggaaacataataatcaacaggaaagatggaaagaaggaaatgattgagaatgttctatatgtgccagaaattggtgttgagttcaaagttatgtatgagaggcatagtggcactatgatcaagattctgaggactaatggagggggagagtatacgtcaagggagcttgagaatttctgtgaataa

SEQ ID NO: 16920 - DNA, 150 bp, Glycine max
  Peptide Sequence Number=SeqID_133698
atggttaatcacgagaggtacaccgtcaggtggagtgcgagtttgggaaatgatatgatataccatttgttgaaagatggggggatgtggattcgtggagtgaaaaggggacaagggagggggtttggttcgaacacaagagtgtggtga

SEQ ID NO: 16921 - DNA, 459 bp, Glycine max
  Peptide Sequence Number=SeqID_133699
atggaagttgataggtgcatacacattggtttgttgtgtgttcaagaagatgcaaaagatagactaaccatgtccgatgtagttgaaatgctggcgagtgacacaatgacccttccaaaacccaagcagctaacattttcaattggaagaatggcctcagcggaatcttctatctcaaaaagctccaagaatgtttccattaatgatgtaactgtctctataaccttaacaagagcaaaaacattggtgttaagaaggttcgggatcctttcgatgcacacaatcggaaccagtggattgtcgtatgttgagagaggagcgcaattagattaccataagagcattttctatctaattaggaaagcatttgacagtctaacgacggtgctgaaggttacgaggctttgcccatggaagagttgggataggctactaaagaataaaggtattgaagaataa

SEQ ID NO: 16922 - DNA, 1098 bp, Glycine max
  Peptide Sequence Number=SeqID_133700
atgggaggagattgtggaacctgggtaccgcatctgcaatttggatggcaatcaccaaatttgaatccccttgacatggggaagccagttggtatttctgcagctatgaaccctggctttaatatggtctctagcaatgtgacagtgcctgctttcgtgtcctctgcactgcctcatttgcagttagggcattcctatgaacccagtggttggtcttattgtttgcccccctttcgacaaggattttcccctgctctgaacttcaatgctgagggaaaaacccctgctgaccatgtgaaaacttttggggacaaaattggtccctatggtgaatccagctcccatcagaaacaatttcttgttattgaccagacgggtggtcaaacgactattgtttatagctctatgtttgggaatcctgatgagtgccttgcttcttggcattcaaaactgcatggtgctaactatttgagggggaatgaaccttctttcagaagagatttgaatttgaatttgaacttgaaagtgaatatgactgagccaactttggctcataaagtggatgagaatctgaaaaccagcattgaaagtgagatgcatgaagacaccgaagaaattaatgcattgctttactcggacagctatggttattctacccaggatgaggatgatgatgatgaagttactagcacagggcactctccgagtacaatgaccactcatgataactgtgaagcctttaggggggaaaccgcagaagaagttgcgagcattgccgggaaaaccaagaagaggaagcaattggatggttattacgatgacatacaactcattgataccggcagctctcagaatctgaacaagtcttctgccacaggagatgatgcagaatcgagatgttctagtaataacaacgaaggatccttgtctggcaataagaagatgaaaaaggataagatacgcgacgttctgagtattctgcggagcataattcctggtgggaaggataaggatccggccatgcttctcgatgatgccatacattgcttgaaaaacttgaaacacaaggctcaagcgctcagacttgatgccttgtaa

SEQ ID NO: 16923 - DNA, 135 bp, Glycine max
  Peptide Sequence Number=SeqID_133701
atgactacccgctatttggtgcactcatttggcacagtgatggctaagaaaccaaaggattggaagttagtgggtgggagcgggtggtacgtgggtgttttccctgagggcgtgagcttccaacacctggcatag

SEQ ID NO: 16924 - DNA, 174 bp, Glycine max
  Peptide Sequence Number=SeqID_133702
atggcacatgcaccaaatagggaatacgaccttggaggtaattggcttggtgctctccttcttcccatgaaggctccctgtggaaagtgtgaaaatcctatgatctctttgaaaaatggacctgatattgacgcttcggatgcttatcaagccatccgatactcctcgttctga

SEQ ID NO: 16925 - DNA, 1038 bp, Glycine max
  Peptide Sequence Number=SeqID_133703
atgggaagctgctcttggatggaaggtgggggagaggatcaaaattttaatttgatttttcagatagcagtgctcatttacatcctaaactataagtgcacatgggaaacctatatgactggcatctcaagggaatcattaatgatgagcaattctatgcttgagatattggttgcatctttgatctcatctatcattattgcctcaatcctctggaaattaaatggctttagtaggaaacttgacttacgaagtggatctaaaaggtcacttgctgatcctcctaaacaagtccttgctttaaaatcttgtgatattagttcaactagaccacatttgcttcttgttggtgggagtgatgccttcgcacgcttatatgatagaaggatgctgccgcctcttagctcatgttggaaaagaatgtctccacctccttgtgttaattatttctgtccaatgcatctttctgatcatggacatccaagcttgcacttaactcatgttacattcagtcctgatggacacgaggttctcctcagctatagtggagagcacgtttacttgatgaatgtaaatcatgctggagtgaatgagatgcaatatacttcaggagataattcaaagctgatgacatactctccaacaattaatgggacagagatgcagccttgtgtatctaatgtcttcccaaatggatttcctattaaaaagaacatcgctgcaaagcttgacaagtgcaggaaactaataaaatatgctaagaaatcattggacaatgggacaccctattatggaattgatgcatgtaatgaggttttgaatggctatagccatattattgggcctgcactgaaacatgaatgcttgtgtactcgtgctgcactattggtcaagaggaagtggaaaaacgatgctcatatggttataagagactgctatgctgcaagggaaattgataattcctcttacaaagcactatactatatgtcagaagcattgtcacagtttctgagactcattaagcctcattcaaaatag

SEQ ID NO: 16926 - DNA, 1491 bp, Glycine max
  Peptide Sequence Number=SeqID_133704
atgggttttggcgccccatgtgttccctcacccatcccaattctcatgggctacctctcttgcaatgcccactcctcaatcgccacctgccacccccaccacaaacccctcgccgcaacaccaatccgacactttccctacgccgacatcgtcgccgccgccaacggcttctcctccgacaccttcctgggccgaggcagccacggcagagtctacagagccaccctggacgccggcaagctcctcgccgccgtcaaaacgaccaaacttgtcgccaccagcacctctaaaaaccacgccaccaaatgcaccggctgcggcaactgcaccagccccgccgaaaacgagatcgagatcctctcccaaatccccagcccccgcctcgtcaacctcatcggcttcagcaccgacccaaacggcaacaaattactcgtcgtcgaatacatgcccaacggctcgctccacgatctgttacactccgttaaaaaaccgcccggttggaaccgtagggtccggttcgcgcttcaggtcgcaaaagcggttcgcgaactacactcttccaaccctcccgttattcaccgtgacgttaagtcttccaatgttttaatcgatcaagaatggaacgccaggctcggtgacttcggcttggccttaaggggacacgtggaggacgttcgcgtcaagtgcactccccccgcggggaccttagggtacctcgacccgtgctaccttgcgccggaggatcttagtgctaagagcgacgtcttcagcttcggaatcttgctcttggaaataatcagtggaagaaacgctattgatgttaactttagccctccgtctgtggtggactgggcggtgccgttgattaagatcggcgactttgccggaatctgcgaccgccgaatcggccctccgccggaccctgccgtggtgcggcagctcgcagtgctggccgccagatgcgtgaggtcgacggcggagaagcggccgtcgatggcggaggtggtggagtgtcttaatctggcgaggaagaggatccgcgcgtcaccgatttggaacagtctgcggcggcgcgtggcacgcgtcgagagcgcgcttccggtgtttgacggcaatgattgtgatgggagtgaggaatttgtgaggatggtgaataaaggtgggagtgggagtaagaggaacgggaaagtatcgagtgtgtcgcgtgtagggtatgggagtgaggcctccaataataataaagtgatgaggtcaaagtccattggttctggttcgttgaaagggagttgggtcaaaatgcaaccgcaccaaacggagaatgaagggtttgggagaaggaaggtgaagctaaaaaggtcaaagtctatgggggttttgcaaggttcgctactgatacattatggcagcgagaatgatgtagtacttcgttcgggaatggtcaagttggttgttaaggataagttggaaaaaccgttagtgaaatcgcgttga

SEQ ID NO: 16927 - DNA, 591 bp, Glycine max
  Peptide Sequence Number=SeqID_133705
atgggttatgaagatgaggaggaggatgatgataacaacaataccaacaataacgatgatgaccatgatgatggtggtggtggtggtggtggtgatgatgatgatgatgacaatggcggtgatcatgttcctcaacaacaacacacaattacacgtgagcgcatcctagaacaagaggagctcgagatgtcggggaaaggcgcaaagggtttgataactgctaagaacccttcttcctctaaggacaaagacaagaaaaaacccatttctcgctcctcaagagccggtcttcagttccctgttggacgcattcatcgtcttctgaagtcaagggtgacagcacatggaagagttggggcaacagctgcagtttattctgctgccatcctggagtatttaactgcagaggtgttggagttggccggcaatgcgagcaaagatctgaaggtgaagcgtattacccctagacatctacagctcgccatccggggagatgaagaacttgataccctcatcaaaggaacaatagctggtgggggtgttattcctcatatccacaagtcccttatcaacaagtcttcaaaggaatga

SEQ ID NO: 16928 - DNA, 870 bp, Glycine max
  Peptide Sequence Number=SeqID_133706
atggcggcagatgctttatctagacttgattcccttgagctcatggccttacagatgaaaaatgtggtttattggaaaggcatgtccaaggctgtcaagttttttgtgtttcaatgtgccacttgccaaaggagtaaatataacacagctgcgtctccagacctgcttcagcccttacctattcctgagcatgtatggcaacacatcaccatggacttcattgaaggtcctcctttttcttttggtaaagaagtcatttttatagtagtagataggcttagtaaggctcatttcatggccttatcacatccttatactgttgcgaatgtggcccaatgcttccttgataaggtctttaaattgcatgggtttcctgacaccattaccagtgatagggatcctgtttttgttagccacttttggaaggaatttatgtccttgctagggattcagtggtccaagtggttgccttttgctgaatggtggtacaattccacttaccacaacactattaaagcaagcccttatgagattgtgtatggccaagctcctcctgttcatttaccttatcttccgggggaatctaagattgctttggttgatagaatgcgggctagaaccaatgcaaagttggcccctaagtactatgacccatttctagtagaagacaagattggtgcggttgcatacaagcttaaattgcctattggatcaatggaacctgcagttatcattgacaaaatgacagtcaagagaggcaatcgtgttgtaaccaaagttttggttcaatggaagcatcaactacctgaagatgcaactttgaaattcttttatgacttgaagcagaagtttcctcactttaatccttga

SEQ ID NO: 16929 - DNA, 2121 bp, Glycine max
  Peptide Sequence Number=SeqID_133707
atggaaatatgccaaagggggggggtgggggagaatagtataaaagagttcaatgaatggattaaagacatggagatagaggaggcaccttgggtgggtagaaagttcacgtggtttggacccaacggagaggcaaggagtaagttaaacagatttatggtatccccagattggcttgctaaatggcccggatgcacacaacatccattggacaggaacttctctgatcattgcccggttctatttagatccaagtgtattgattgggatccaaagccgttcagaatccttgactgttggctaatggacaaatcattcaagtcaattgtgaaggagtgttggacgtctaatcatcagaggggttggggaggatacgtacttaaagaaaaaataaagagattgaaagaaaagttgaagttatggaacagagagcagtatggtgatacatttcagaaatataagaagattgagaaagagttaaacaacctggaagtgagtacaagtgatagacaactttcccctcaagaggtgatgaccaagaaacagctccaagaagatttgtgggtagttgcacaaaaccacgaatctttgctaaggcagaaggcgagatctagatgggttaaaaaaggcgattgcaattcccactattttcatttgctggttaatgcaagccgtagaagtaactctttgaacggagtgtggattgaagatccgacaagagtaaaagaggaagctagatcatttttcttccaccggttccaagaaactgaccaaaatagaccccgcttagatggtattcgcttccaaactataggacatcaccaaaatgacatgctaacagggagatttcaggaacaagagataaaggatgcagtttgggggtgtgggagtgacaaaagcccagtcccagatgaaattaatttcaaatttataaagcaattatggcatataatcaagcctgatgtcctgcgattcatggatgaattctatgtcaatgaaatatttccaaggggatgtaatgcctctttcatagttctaatcccaaaggagaagaatccacaagctctaggtgaatacagacatgtatcactcattggatgtatgtacaagatagtggccaaaattctagccaatagattgaaaaagatcatgccatgtataatagatgaaagacaatcaacattcatagaggacaaacacttgttacaaagtgcattgatagcaaatgaagtggttgatgaggctaatagaactcaaagaccttgcattgtcttcaaagtgtactatgagaaggcatatgattttgtctcctgggatttcttattttatatgctcagaaggttggggttttgctccaaatggataaagtggatagaggggtgcttgaaatctgcatctatttcagtactggtaaatgatagcccctcgtctgagttcattccacaaaaagggcttaggcaaagggatccgttagcaccctttctctttaatattattgctgaggcattgaatgggttgatgagagaggttgagaagcaaaacttattcagggaattccaagtgggctcaaataatgtggatattagcatcctccaatatgcggatgccaccattttttttggagagggttcgatggacaatgttaaggctatcaaggcaattctacggacttttgagatggtttctggctttaaaattaactttgcaaaaagttgttttggtgcatttggaatgtcagataggtggaagagggaagcaggcatacctataagggcaaaccctagacggattcctaagaaagtggtggagaaactagtgtatatacaaagaagattcctatggggaggtggcatagatcaaaacaagattgcttgggtcaaatgggagacagtatgcctcccaaaagataaagggggaatgggaatcaaggacatcaataccttcaacatcgccctgctaggcaaatggaggtcgaatctatttcagcatgaaggacaattgtgggctaggattctcgagtctaaatatggaggttggatgggattggatgaagcacatcgagacaatcatgagtccatttggtggagggatctaaagatggtcgttcaaaactcacaatag

SEQ ID NO: 16930 - DNA, 1461 bp, Glycine max
  Peptide Sequence Number=SeqID_133708
atggacaacaatggccgagagggagatgaattcaaaataaggagggagttttgcggtgcggtgtggtgcagagggagttttgccaagggaggttgtgaatgcaaggaacacaactcagtgaagaacacaaacaaaaatgagcagatacatgcatggaaagagatttgtgagtgtgtaggaacaggaacagaaacctgtgggtgtcagaaaatgccaggcttggctacaatattggtgagctgtgggtcacaggttggctcgaagcagagcttgacgggctctagtaaagttgtggtttgtaacattcatgttctttacaatcctaacaggggagaaattaaacttggtcaggttcgagtgctgcttgataaggctaaagctgtttataaactctggaatgacacccctgtagttatctgtggggattttaattgtactcccaagagtccattatataactttatatcagaacagaagataggaataagtgaaatatctgctaatggttcagttcaggcaacatccacagaaggcgatatagaagttattgaacaaaataattctcggttggacacgagggacctggacactaaatgtcacagcttggctaatcaacttggtagcataaaagaacctaatccttcttatagtgaaggtaggctccatattgatcatgtaaatggtgagattcatgacattactcctgtgacctcctcagctcctgaagaagttcacaatgatgcaacttggattggcagcaatgaacatataccagatgctgtctcaacttcaaataaagaatccaacttgcatgtccctgaagggaataaacatgtggagtttgactgtgccgcaacctctctccaggaagatgatcaatcttccaaggtgaggattgatcttgagtcgatagatctagacaatgtagaaatttcttcaatggaaccgtccagccagagctcagtttcctgtgtatttgaagatggagatagtccatctcatgaggaaattgctaatgaccaaaataactgctcatcaacatcatatctagttgacaaatcgcatcacttgtccaacattgattttccaccagatgtgaaagagaaagcattctttgatgagacagataaaaccgttataggcgttgaaagtgaagatgacattcgtttaatatcttccttacataatgctgaagaagtggctcttgatcttggcccatcaatgaaatcatatcttgaaaagccatatcaatctgaggaattagattctgcttccaacgacttgttgctgcccgtagaaagcaatgaaatggagcatgacttatctccaaggcagatttctaaatctattaattcagagcaagctacttataatccagcattgtggacccctatggaaataaatagaaactgcaacaggaaatgcagaatgcaccttcttggagcaccctttactgcttag

SEQ ID NO: 16931 - DNA, 134 bp, Glycine max
  Peptide Sequence Number=SeqID_133709
cgagaaagtaatcgaaaactatgagtgggcgtttcacgcggcaaactcgtacactgtttgcctgttgcgtcgcagatcacagtgttgcagatcagacatgcagactttttctgattttgataacactgcaccac

SEQ ID NO: 16932 - DNA, 269 bp, Glycine max
  Peptide Sequence Number=SeqID_133710
atggcaacgttcattgaaatatgcaaaactattaagattgctagtgtaccagacgaagccattaggcttagccttttctcattctcattggcaggagaagccaagaggtggctccactcattcaaaggtaacagtctgaaaaccagggaagaagttgttgaaaagttcctaaagaaatacttcccaaagtccaagactgcagaagggaaagctgcaatctcttcatttgatcagtttcctgatgaatctctaagtgaagcattggaaag

SEQ ID NO: 16933 - DNA, 231 bp, Glycine max
  Peptide Sequence Number=SeqID_133711
atgcatagatctcccacaggcaatttagttcctctggacttagaaattgaggctacattgagaaggaacagagccaagatgagaaggaaacttctgcaagacagaacagttgcatccattattgaggaggagacttatttctctgacttattatcacctgattcaccatcatcaagggaatccgccactcaattacttgaagtcattaccatggcagaagagcttgactag

SEQ ID NO: 16934 - DNA, 421 bp, Glycine max
  Peptide Sequence Number=SeqID_133712
atgggtgaagtagaggaggtgcaaaagcagatgaaggccgacatggaggccatgaaagagcaaatggccacaatgatggaggccatgatgagcatgaagaagataatggaagccaatgtggttgtagttgccgcaaccagcgctgttgctaagtatgagtggcccctattatgtgcaaattcaaaacaacacgccttcccaccatatggtttgcctcccaactatacaccacccaatgtggcatacactcccagtgaggatgtcaataactctgctcccatactcattgaaagccgacaacctcaaactgatcatgcacatgtctctcaacccatgggggagacacatgaaatgccccaccacaatctagcggactttgagcgttgcctcggatatgacactaaagggcaagcagttggtg

SEQ ID NO: 16935 - DNA, 288 bp, Glycine max
  Peptide Sequence Number=SeqID_133713
atgcatttatcacttccaaaatgccttgaaagagtggaattctactctttggaaacatcttttatgccaaaaatagactgcttaggcgactcgatgggattgccaagaagctatatcaagcgagccaagtcaaagagcataattggattcactggaagccttcacttaagccttagactcaaagtgcttaagcaaggcaatgaagcctatggagggacacaaagaccttgcttaagcgcaacattttatgcacttaagcgaggagagtcaaaagctgaagaattttag

SEQ ID NO: 16936 - DNA, 344 bp, Glycine max
  Peptide Sequence Number=SeqID_133714
atgttgtgccttattcagctcacatcccatcctatgctgatatttggggatgggtcatggcttcagattctccattagacttgagtgcagaagaactagacctcagaatgagacataggattaaggaggagaatggatatcttgatgggaaaacattcacatcagtctcaactttgagcaaaactgttcgcaactcagaccaacccgtcttagaatgggcagacttctacatcggttgtcctaataaccgatgtagaatgtcagaaatctacaacggttgctcaaccgtcatcgtaggacaacgtgtttcaacatctccagctacaacaatgcgtgataactga

SEQ ID NO: 16937 - DNA, 153 bp, Glycine max
  Peptide Sequence Number=SeqID_133715
atgccaccttctctcagaaagaaagattcaatgagtgcttgctctatcttaattaagaagaatttgaggcgtaagataattgccttaggagataatttctggccgtggccctggttacatgtcaatatgtcacgcttgaaagacagatgctaa

SEQ ID NO: 16938 - DNA, 321 bp, Glycine max
  Peptide Sequence Number=SeqID_133716
atgtctatgaaccatgaccgttctacccatgtagtgtatcctgataatgaaactcgagagtttgctgaagcaatacgtagccatttggacccaagtttgacttcttcaaattcgattcaagggggatgtcaatcccaccaaccaaccatagtatcaatgaatctcatatgttggaattataagggtgtaggtatgaagcggtttaaaggtctcatgagtgacctgattaaggagcatgatgttggtcttctttgtctgctagaaactcattcaagtggggataaagaaacaaaatttgttcaagggtttttaattggatag

SEQ ID NO: 16939 - DNA, 207 bp, Glycine max
  Peptide Sequence Number=SeqID_133717
atgggttgtgatggggtcgtaaaggtagaggacaaagatggagttgggctaatgaatgaagaaagctttggaagaagtgatgtggggaaaacgatgcgaatgggacaaagaggagggtttttgcgcaaggacttcacacttaatgtagggtttgagtctagatacaaaataactcagaagaaatggagtggtaaacccacaatgtga

SEQ ID NO: 16940 - DNA, 255 bp, Glycine max
  Peptide Sequence Number=SeqID_133718
atgaccagatctccttcgttgtgtgaagtgttgtatttatttgagaaaatagctttaagaagcagccttgctagggagagaaagaaagggagagggggcgaggggagagctttgtcatcgctgcaaatcatttttgacagtgatgtgtggcataacttgcaattgagacaacccgcgaagctggtggtagcggtgtgtgcggaggccgggacattgtcacttgtaagaacccggtatgttgaggttagaacctaa

SEQ ID NO: 16941 - DNA, 855 bp, Glycine max
  Peptide Sequence Number=SeqID_133719
atggcttccaatggttcttttccctcaaatcttccaattctaaccggcaagaacttcaacagatggagtgtgcaaatgaaagccttgcttggatttcaagatttgatcgatgtgattgagaatggaatagaaattccaaaagaaggagcctcagattcacagaagattgaattcaaggatctgaagaagaaagactgcaaagccttggtgatcttgcatcaatgtgttgatgattctcactttgagaaaatcgcaaatgctaaatccgcaaaggaagcatgggacattctgaacaaggcttatgcaggagctgataagatcaagaaggtgagacttcagactcttcgaaggcaatttgaattgctgcagatggaagagactgagagcattggagattactttggaagattgcaggttcttgcaaattcaatcactagttgtggtgatacaattactaatttgacgttagttgagaaagttctgaagaccctgaatccaagattcgatcacattgtggttgcaattgaggaatcaaaggacttggaatcattatctgttgatgaattacaaggatcacttgaggcacatgaacaaagattgcaagaagagcaaatgataaggctacagaacaggccctgcaagcactccatcagtcaagaaatggtggttctaattatcacagaggcaagaaaggaagagggagattccagaacacgagaggtagaggaggttactccaaagataaaggtaaacctcaacctgatcaaagaagtggtggttctggtactcgtggaagaggaggcaaaaagaaatgggataaaagaaatgttgaatgcttcaattgtggaaaaagag

SEQ ID NO: 16942 - DNA, 819 bp, Glycine max
  Peptide Sequence Number=SeqID_133720
atgaaccacccaatgtgcggcaaaagaacctccaaggaaagcagatggcatcgggaggagaagaagctcaagcgtcgtcgcgaaaacaaccaaacagcacaaggaagaggaatgtacagaacgcgtgaacagtgttggatgtacagaactgaggaaccagatagcaattttcaagaaaaactaaaggaggggcgtctgggaatcccagactttcaagaagatgatgtgtatggatggctgattcaaatccaacagcactttgacatgaagaagggagggaagctgcagttggattcaggaattgttcaggtttcaacaaagaatgaagacattcttgacatcattggagaactgaggaaccagattgcaattttcaagagagaactcaaggagggacgtctgggaatcccagactttcaagaagatgatgtgtatggatggttgattcaaatccaactgcactttaacatgaagaagagagggaagctgcagtcggttgtgaaagtattagaaggacatgcttatgattggtataaacagtgggaggtcagtaatcctaaggtgtcatgggaagagtttcagaggacagtgctcaagaaattccaggccaggtatgatctgaatttgccagttagggtccaagaaagggaagggaaatcttgggagcaagacaaaagggaaaatgaagggttgaagattgagaaccagaattgcagcaagggaggagaaacggaaaacagtgaggaaaaaaaatactatgctagatatggtggagaagaaccaggtcaaacaattttgaagaaggaacaaaggcaataa

SEQ ID NO: 16943 - DNA, 453 bp, Glycine max
  Peptide Sequence Number=SeqID_133721
atgattatactcctcggtcacatagactctgatgtcatgcaaattaccaatttcttaaaacctcaagctattagatactctgacaagaaggcctatggacagtccaagttagccaacatattacacaccaacgagcttttttgtcgcttaaaagtatggtacaaattttctgttcctaggaacttcagattgctggaggagcttcaacgtggtgaaaaaggaattggagatgacacaggtagctatggaatggatgatggtgatgacatttacatgcactcttggactggcaccattattggcccccataatgacaaccgatgtaggattggtggatattctacatcgattattaggaaaatcaatgtaggatatttaccatggggtgacattctacgacgtttcacggccacaaacgatgtagaattacggacattctacatcggttattag

SEQ ID NO: 16944 - DNA, 3705 bp, Glycine max
  Peptide Sequence Number=SeqID_133722
cttgcatcaatttggcgctctcaactcgctgctgctccccccaaaaacccttgctgttgctggggaaccatgagcaagtctccgcgcagagatctgcaagtcttcgatttcaacgaagaggatgaggtcgcctccgataaacaccacaatttcctcgctcgcgattccgaggtcaataaggttggcatcaagagtgttgccagtattcattgtgttgatgtagctggtgctatgtttaatttggaaaaggattgttctgacccctctcctgacacagtggaagatatatatgatagtaaagagaatagttctgtgttggaagctgacaaagaatcaaatttgattagtcatgaaagccgtcatcattttaaaatagatattcataaccataacaaactagagaaaatggatacaagtggcgaagtatcttcacctgaaacaagccagaatgaatcaattgatgtcaattcagaggctgatgatagcatggatgagagtgctccaacaagtcctgcttcggattttccagagaatggtgtgtcattaaatggttgtggactgaatggcacagacaattctgacatggatgacacaaatacagaagttgttcttcatcctgattatgtcatataccaggataattattatctggggccaaagttaaccttttcaccttgttttgtcaagatcaatgtttcaactacatgtataaagcaagaagcttttgatcttgaatggacagttgatgatctcattgacattaattgtcagttgtttcaaagtagtggaactgtcgtgataaagcttcgagtaatatcaagtaatgcaagccaatcaaaacatgtaagcgatgcttcagatagtaacttatctctgttactgattaagtgtatgtctatacatatgctaggcattgaggaattggaaattgcggttgctgattacaattggtctcttagacatagacaaatcacatctcttaatctgaaatacttggcttcttggaacatggctcttcgggcgagccctggtgcagcggtaaagttgtgccttggtgacctgttggtcatgggttcgaatccggaaacagcctctttgcatatgcaaggtaatttccagctcaatgtggactggtttctgcctgctgaagcttttctcaagcgaacactgatccagaagttaatctttgaacttgtggaaaatcatggttcacatgaaatctcttcctctgactgtagtggtgatgatgagtgcttagaaaataatgataacagaactgggattgatcaccctgaagtcaataaggagccaacaacttctcatgctgggcagggaatagaaatcactctattgtctggttcatcgtctttggatcctcaatcctttaacaattcaggattggttcttaaagagctttttgatccaggagctactgcaggagcaatgttgggacagtgccaatcctttgaccagcggtcatctgattatcgttcaatattttcgatggaggaagacacggatcttggggaccagtttatgtacttggctacagatcccaactaccagcaagtggctggaattacacctcaaacatgttcattgccatatcttcctagggattgtggagatgagaaatgtcatagaccacaaatctctctgctagtggatcgtgatgtggtgcagccatctttagatgcatcaaatagtgtcttggatgattcagaagatataacagtctgcaaaaattgccttgttgtgaatgagcctgggtcatctaatgaacctgaacaaggtgagaaaacttgttcagccatggaaaaagctgagcatgttatagatatttccaactcggtggtgggaaattctctagactcgattacgaagtgtgatgataacaagaatggagatctccactcttctggtcaagaaactacgacaatttcagtgcagcagtttcctgatgcattggatgatgaggaagctccaacaataccattacaacaagtttctgatgcagtagatgacgaggaagctcccacaacaccattgaaacaagtttctgatgcagtagatgatgaggctggatgtgatgatggtcagatgattgatggcatggagcctgataattgtgaggaacaagctgcaaagaggaggcggcttatgcctctaagtacagtggtgattggtgaagtgaatagcggggagatgcagaagggcaactatcaaaccgatgcgttcattggtgccgaagggaagcagcagaagcatgacatgagcgcccccacaccaactgcttcttcttctgcctttgcccaaagcatggcgaatttcgacgctgattccgtcacttaccttaagcagcgagatgccgcggagatcgacgagacactcatgggtccacttggcttcagcgttgaccagctcatggagttggctggtttgagtgtcgccacttccatttctgaggtttacaaaccgagtgagtatagtcgtgttcttactatatgtggtcccggtaacaatggtggtgacggtctcgtagctgctcggcacctgcatcacttcggttataagccatttgtctgttacccaaagcgtacccccaagcctctatatgctgggttagttactcagcttgaagcactgtcaatcccattcttctcagtggaagaactaccatcagatctttcaaatggttttgacgttgtcatagatgcaatgtttggattctcatttcatggttctccaaggcctccttttgatgatttgatccagagacttgtctctttacataataataataatcaaattggccaaaaaagatcagttatagtctctgtagatattccctctgggtggcatgttgaagagggagatgttgatggtacaggcattaaacctgatatgttggtttctttgacagccccaaaattaggtgcaaagaagtttggtggtcctcaccactttctaggaggtagatttgtcccacctgctattgcagaaaaatataagcttatacttccaccatatcctggaacttccatgtgtgttcgaattggaaagcctccacgtattgatatctcagctctaagagagaactatatctctccagaatttcttgaagagcaggtggaggctgacccttttaatcagtttcataaatggtttaatgatgcattggctgctggtttgaaggaaccaaatgctatgtccttgtcaactgtagggaaggacggaaaaccaactgctgtggcaatgctatttggcaaatgcttatttgtgttcacctactgcaattgctttgcgcaggtgactattgcttacattctctctagccacatcttcagattgacttattcttacatggaattgatgaagttaatttttcatgccaaagaatatcatgccttcttgaaaacctatgggcctgttcagaaagtctctgatgaggaatcagaacagtatttccatagccgccctagaggtagtcagattggagcaatagtcagcaagcagagtactgtagtgccgggtaggcatgttctttatcaggagtacaaagagctggaagaaaaatactctgatggaagtttaatccctaaacctaagaactggggtggatataggctaacaccacaacttttcgagttttggcaagggcagaaatctcgcttgcatgacaggtggttgctaccccgtttatga

SEQ ID NO: 16945 - DNA, 792 bp, Glycine max
  Peptide Sequence Number=SeqID_133723
atggtggatagaaaaggagaccatagaccgatgactcgcaccaagtgcccaggtaggcttcatgtactcctagattacaagatatttatgtggagagtttccatatttgacgagactcataaccatgagcttacacctgttaatcacgtacatcgtatggtcaggtatcatgtgatgtctaatttagacaaagctcaagtggatagtttgcattcatttggtgtaaggatctactgcataatgggatatttgttaggtcaaaggggtagttatgatagtattggctttttaagaagtgatttgtacaaccatctacatcaaaagaaacgtctaataatcaaagagggtgatgtgtgtgttgcgcttagttattttgaaggcaaggatgttattgatccaatgttctattccaaaattgagacttcaacggatgaaaaattgaatcatctatttttagctgatggatgtagcagatcaaatttccaatgttttggtgacatctttgcctttgatgcgacttacaaaaagaatagatgcaataagccattggaatttgcattagatcgagaagccacggtggatcatgttattcgattgtatcaaaggaaatgcatgatcaatgttgatctattgcaaaaggagccttacgctccaacatcattgccaccgataaaggatcgtggtggtgtggatagcacaacatcggccatgaaacaccttggtggcacgatgattgttgggtctgacgaaggggtggatagtgatgggatgaagtgcagtggcgtttcatga

SEQ ID NO: 16946 - DNA, 186 bp, Glycine max
  Peptide Sequence Number=SeqID_133724
atgatgccatactattttcagattccattaggagcgattttagccattgttgatcctgtgatcattgctgtttcaaactggatgtccaccatcattttaggaacttttaggaataactgggaagcgtattttaacgatcctagaccattggagccagagagattaaaggcgttgcggatccagtga

SEQ ID NO: 16947 - DNA, 207 bp, Glycine max
  Peptide Sequence Number=SeqID_133725
atggctacctccactgtcgtcttgcaccgggcgggttcccaaagagtggcaccatccgtggtagacttggtgaactttgtgtttgaggatgaagaaaaggatatgtctatcgaggaggatccatctattgatgaggaggaactcgttacggagtcaaagtcgatggagaaggactcttcacaggattcttctgatgggtctttctag

SEQ ID NO: 16948 - DNA, 255 bp, Glycine max
  Peptide Sequence Number=SeqID_133726
atgtgttcctgtacacgtagagtgataatgttttgttttcctggtgtcgtcgcaggtgaagagatcgaagacggtgctgcgggggcgaacgacgcaggagctgcagcagggggagggagtggggcgggagcaggacttggagcgagtgagcgaatgagtatgagaatatctatgaaaaggccgagacttgcaagagtggtgctcacggtggctctggctcacaacggctctcgatggcttttcatgagagagtga

SEQ ID NO: 16949 - DNA, 213 bp, Glycine max
  Peptide Sequence Number=SeqID_133727
atgaagagctctcggagtacaaaaagcacagttatggcatggcaccgaagagaattgaatgcagttttctcagcagtgtctgcccttgagctttcaatgtccaaggagcttcacagattccattgtgcacgatgtagagttccgtggcatatagaaggtggtaaacttcttttggagctaaatagagtattgagttgtggccagccaaactga

SEQ ID NO: 16950 - DNA, 372 bp, Glycine max
  Peptide Sequence Number=SeqID_133728
atggtggattacaccgatgagaatgtctcggtccaaaacctcattgtcgttattcttggggacaagaataaagtgaagggaggaagtgggaaagtgatcaatagcaaactcgaggacaaaatatttatatctactttaatcatggaggtccgggagttcttagtcatatacgcggaagcttgtgatatacgaggaagcatgtttgagggtatgatgcctaaggatttgaagatttatgccacaactgcatccaatgcacaagagaatagttggggaacttattgtcttggaatggatccttctccacctccagagtacatcatttgcctaggggatttgtacagtgttgcttggatggaagataagtactaa

SEQ ID NO: 16951 - DNA, 312 bp, Glycine max
  Peptide Sequence Number=SeqID_133729
atggagtccgtggcaatcgttggtggggccactaatatttggataatgctcatttttgttggatttgtgattatcatgaaggtatatgtgtttggttttgttattgtgtctccatccatgtcattgccattgatgtcggtgacattggccttgacgcaatggtgttggatcattcttgaactcgcgctcaccgacaagctagagtgtcgaagaagacgaagttcaacatggtggcgtcacacgattgtcatcctctgcaaagagttgaaaagagtggtgtgtgaaaggatcgtgttgaggttgaagcattga

SEQ ID NO: 16952 - DNA, 195 bp, Glycine max
  Peptide Sequence Number=SeqID_133730
atggaacaaccacccaccaaagcagtggaatccttatctgtctccgaccttgagatcccccaatcatccaattccaatccaactcatctgttggcccctgatgagaagtttcaaattgtgaggagcgtcggaaaagagtgcattcaggaagacaaactctttaacctcctcaccaaaaaacccgaacccatttga

SEQ ID NO: 16953 - DNA, 240 bp, Glycine max
  Peptide Sequence Number=SeqID_133731
atgaggacacggtggtgttgggtgcacaatggtgttcggggtgtgattgtgttggggcgtagtggttatggaggcttcatggctgggattttttgggagaggcaaggacacaggatgtctggtgaggggcaaaaaattcaaccaatcgttcagagcaatgcgttgccattaagtcttctattctggcgaaaatatgcgatacctttcattgctactgaagaattctgctgtacttgttag

SEQ ID NO: 16954 - DNA, 1062 bp, Glycine max
  Peptide Sequence Number=SeqID_133732
atggtgacgtgcgtgaaagagatgtgcactgttgattttctagataagaaacttacactagtgcacaaaggagtgaggctgtcggaattcataggggcaaaagctgtcaaagaatgttgtgaaaaccctgaaacatcaaaattggaaataaactcaagaattgaaaagaatgctaaagaaagggggaacatactagggatttcaaacatgaaagtgacagtgttactaccattgtcggccttgatggtgatgatatcgtcattaccagcccatggagatgttgcggtcgcagcagtagtgctcaaagccctcaaatcggaggaggagcgtgacgagggcaacatggttggagtccatggcttggagggagaaccctatggaggagcagttgaagtttgcatcgttcacgagctccttgatggactccaaaaccttcttcaggagggagccttgcatgagatggagttccaacatcttgacgatgatgatcagaggctgaatgagaaaattcacctttttcttccattgatgttcgtgctcctcacaaagagaaagtcttgcaagctctcattctttcaagatttcttttatcttggctcaattttcacaaacggtagaaaaaacaacagaacaaaatcaaatgaatgtgaagcaacaaatgagtctatgataaaggaagataaaatcaatagacagtttaacattttgggttgttacattttttttatattctcacaaaaatgttttaatctcactacggtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcttgatcaaaagactctcagacagtggcattgatgttggtgaagcagctgaggcagaagaggaagcagctgaggaggaagaagaagcagctgaggaagaagaagatgcagcagaggatacagaatcagatgatgatgattctgaggccaccccatga

SEQ ID NO: 16955 - DNA, 339 bp, Glycine max
  Peptide Sequence Number=SeqID_133733
atggaacttccaaaagggtacaattcaattgataaaaatcttgtttgcaaactcaacaaatccctttatggccttagacaagcctctagacaatggttttgtaaattctcaacaacattaattgctaatggtttctctcagtcaaagaataactattctctctttaccattggcaaaggtgcttccttggccaaacttcaagctctgttcaaactaaagatccttggtcccttaaagtactttctcggactagaaattgcaaagtccagcaagggaatcatactgactcagcgaaaatatgctttttccctgttagaagatactgacttccttggctga

SEQ ID NO: 16956 - DNA, 813 bp, Glycine max
  Peptide Sequence Number=SeqID_133734
atggtttttttgctcaaaaataaatctgaagcaccaactgtgatcatgagattttttgcaatgttaaagactcaatttgcaacttcaatcaaatgcctaagatcagataatgctaaggagttagctcttacagacttcctagcatctcaagggaccttacatcaattctcatgtgttgaaagacctcaacaaaattctgttgttgagaggaaacatcaacatttacttaatgttgctagagcattatttttccagtccaaggtgcctatttcattttggggagaatgtgttgttactgctgttttccttatcaatagattgcattcaccattgctgaaacaaaatactccatttcaagttcttcatggttctgcacctgattattccattttgagatcttttggttgtcttgcctttgcagctactttagcttctgagaggaacaaattctctccaagagcagttctttctgtgtttgttggttatccacaaggagtcaaggggtacaggttgtataacttgcatactaggaagttttatgtttcaagggatttagtctttcataagagcattttcccttttcaaactttacccaattcatctcaagaacctggtttccttaatgaattagctatttccttacccattcctgaatctataacctcaaacattcaacctagagccattgaacccaatacttctgaacctgatcaccttatttcctctacacaaataatctgcctattcagttatatgattctacagttgataataccattggtgcatcatctacattgtcttctcctccattaa

SEQ ID NO: 16957 - DNA, 687 bp, Glycine max
  Peptide Sequence Number=SeqID_133735
atggaagccaacactttgaagctagcttcctacaaagttttcacaattgttgcattcatccttctagccaaatttaacatcatttcagcttgtgagaattctccaatccccaccaattccaccctaaccaagattgattacactgccaccaattatggaaacacaaccattccatccgaatccaattacactcaaaccttcaaaagctacattaaagcctcttgcaattcaaccacgtatccatcaatatgctacaaaacactattcccctatgctacaaaaattgaagcagatcctctcaagctatgcaatgtgtcactctcccttgccttaaaggcagccaagagtgcatcctccaccatatcaaagattctaaagaaaaacaatttgacaaaaattgcagaacaagtggtgcaagattgctttgggaatgtgaaggattccattggtgaactcaaagattcccttgatgccatgggacatttggatggtgttgatagaaagtttcagatcagcaacataaagacatgggtgagtgcttctatcaccaatgaccaaacgtgctcagatgggtttgatgagatgaacgtggattccactttgacggacaagatcagaaaaattgtcttggatgtggcaaggaagactagcaatgctttgtatttcatcaacaacaatgtatactaa

SEQ ID NO: 16958 - DNA, 723 bp, Glycine max
  Peptide Sequence Number=SeqID_133736
gatgcgggatttatgcataaacttcagatccttacaccttatcgtggtgtccgttaccccttgaaagagtattctgctagagggcaaaaaatacctaaagagttgttcaaccgtagacatgcatcacttgggaatgtttccgtattgatggtagttggacaccacaaggttatacaaacagtacacgccttgaataaagcaggatacacggatataaccaaaagccgtgttaagaataggctaaaaacattgaaagatagatggcgtgaagttcatgaccttttcaatggcctaactggatttgcatggaatccagttactaacaaatttgaagcagaagaagaggtgtgggctgaactaatcaaggatgcattaagtccatccaagatacttggatctatgataagggagaatctaatgattgatctgaatgatgtcatgaatgatagcactgtgaatgatgctggaatgggaaactttgaagggacatcaacatcaaggggaacaaagcgcaaggcacccatgatagaagcccttgatgcacagatggaaaaactgagcactagttttcacttagttgctgatacaattaattctagtaacactttgtctgaaaaattaacaaatgttgcagaaaggaaagttaccattgttgaacaacaagtggtgattgctcagcgtagcatgttggccttagagaagagaaatgacattatgtattag

SEQ ID NO: 16959 - DNA, 526 bp, Glycine max
  Peptide Sequence Number=SeqID_133737
atgacgagggcgaagataaagataaagaaaatcgacaacataacggcgaggcaagtaacattttctaagaggaggcgagggctgttcaagaaagctgaagagctttctgtgctatgcgatgctgaggttggtctcattgttttctcatctaccgggaagctctttgattatagcaacgccaggattcacgatgtcggatacaatgtccaggacatcctgcccgaaaatactggagttgctgaaagcattgaagttgcaggatccacgatgtcggatacaatgtccaggacatcctgcccgaaaatactggagttgctgaaagcattgaagttgcaggatccgcgatgtcggatacgatgtccaggacatcttgcccgaaaatactggacatataaatctgttatatctttaacagattattgtgcaattttcaggaagaatgatagatctcatccagcacaagatgttgcagcccagataagcacactgctatataaccatggaggctgcacgagttttgaaccaa

SEQ ID NO: 16960 - DNA, 207 bp, Glycine max
  Peptide Sequence Number=SeqID_133738
atggccattgagggctttacaatgagaggaggggtgaaagaaagaaagggagtaaatgaaacccctaggagagggggttctgtggtggtgcaaacttgggcttgggccttcgtagtctccctgagcgcaaagcctcgcgctcagcgtcacgtcgcgctcagcgcgtgtcctgcgcttagcgccttgctggacttgggctgcttctga

SEQ ID NO: 16961 - DNA, 429 bp, Glycine max
  Peptide Sequence Number=SeqID_133739
atggaagctcagacaaagatgatcaatgccttcatctcaaggaagatgtggaagaaaaggggtggattagactggaaaggatccaagaaaccacatagagaaagaaaggacaaagataaaagatccaacatatgctacgagtgcaagaaaccaggacacttcaagtcagaatgtctagatcttgataagtcaactcccaaaaaaggatatgagaaaaacctgaaattatcaaatgataaacttgaacagtataaggttctccaaaaacaacctcaaggtgttattacacttcatcaagagattgaatttctaagagaaactctatccaaattttttcgaagcactaagaaactctatccaaatgcccaattgacaaatctggaaatggatataaaggaaagaagtatgatcatgatgaggaaaccatag

SEQ ID NO: 16962 - DNA, 210 bp, Glycine max
  Peptide Sequence Number=SeqID_133740
atgaaatttgtgcaatttcagctcattagtggggttaagcgtgcatccatagctaagcgcagcttcagcgcaccagaagaatctggtagagtgtcaatatcaaggtcgtgcgctaagcgcaagatcagtgcgctaagctcaaatccacttactcgcgctaagtgcgagggtggcgctaagcgcaacatcgcgggatcagagcctatttaa

SEQ ID NO: 16963 - DNA, 282 bp, Glycine max
  Peptide Sequence Number=SeqID_133741
atggcagaaatcaaggaaggatcatcaaccaaacctcatagtcattgtttcactaaagctcaagtgtttagtcccattacatcaaggaaggatcatcaaccaacctttgcatttcatctcatgtcatacaacaataaacacacaaaattgaatccgaaggactttctaggctgtgatgcaatcctacccccaatggtattcgatagaaaaatccaagaggattgggctagagctactaaagaaggctctagggttctcatgaaccttagggtagatttttga

SEQ ID NO: 16964 - DNA, 553 bp, Glycine max
  Peptide Sequence Number=SeqID_133742
atggtcgccaccgtaccgctgtttacgctctgcttcagccgtttttttggcattgctacgcgcaagctggaatggttcggtattgcgatcggtctggcgggaatagtgatgctcaatagcggcggcaacctcagcggcaatccctggggcgcattgctgattctgattggttccctgagctgggcgtttggctcggtttacggttcccgtattgaattaccaaccgggatgatggcgggcgcgattgaaatgctggcggcagggatagtgctttccgcggcatcctggttctcaggcgaaaaactcacccaaatgccctcctggtctggaatatttgccgttgcgtatctggctatttttggctcgcttatcgccatcaatgcctatatgtatctgatacgtaacgtaacgccggcggttgctaccagctatgcctatgtcaatccggttgtcgccgtgctgctggggaccggatttggcggcgaaagtctctcatttatcgaatggctggcgctggcggtgattattttcgcggtcgtgttggtgacgctgg

SEQ ID NO: 16965 - DNA, 246 bp, Glycine max
  Peptide Sequence Number=SeqID_133743
atggggctccgaataagatttgatggtggaggatgcatgaacagcgctaggcaatcaattcgtggggctccggactcgatggcaatcaattcgtggggctccagactcgatggtggaggctgcatgaatggcaataaattcatagggctccgactaagatttgatggtggaggatgcatgaatagcgctaggcaatcaattcgttgggctcctgatgcaatcctaccccgcaagggcattggatag

SEQ ID NO: 16966 - DNA, 570 bp, Glycine max
  Peptide Sequence Number=SeqID_133744
atgactccagtgatgaaagaaattatattcgatttctcaaattttgtaagagtaactcttcaaggcatagccatagcgatagccattatcaatcagatatttacaaacttcctttcgagtataatgattcatgcaactcgaccatttgttgtgaatgagcggattcaaacaaaaattaaaggatatgaggttactggtaaagttgagcatgtaagctggtggtcaccaacaatagtgagagtttctgattgtgaagcagttcatattcctaatcacaatttgagtgtaaatgttgtgaggaatcttagtaagaaatctcattggggcatcaagactcaccttgctatcagtcacttggatgttaacaagattaatagtattatagcttatatgcgcaaggttttggccaaaaatcctcaagtagagcagaaaaaattgcacataagggtttttctagagaatattgatccagaaaatcaggctcttatggttgatgatatatcttttctgttcatcggcttttttaagattcaccctgagatgcttcttgaagcatggtgcttagaataa

SEQ ID NO: 16967 - DNA, 753 bp, Glycine max
  Peptide Sequence Number=SeqID_133745
atggcacagcagagcagagtggtctacttggaattggcgagaaggactagagaggatttggctatacacagggacagcaggcatgctgcgggtgttgagataaaattaggaggtttggatatggctgctcattcagcctgtgattttggtgggggtaaagctgagaaacttgctctagtgaagtaccggcaggtgctttggcagggaagggtattgaattctcaattcactgatgaagagttgagaaatcaggggcgttgtccactgactcctgaagagattggattgctcctggcagctttgggtttcaacaatagaacacggctttatcttgcttcccacaaggtttatggtggagaagctaggttagctactttaagcaagttatttcctcttatggaagataagaagagcctagtctccacagaggaaatggccaaggttaaaggaaaggcatcactgttagctgctgttgattattacgtgagcatgcagagtgacatcttcatttctgcttctccaggcaatatgcacaatgctctagcagcgaatcgtgcttatatgaatctgaagaccatcagaccaagcatgggactgttggggcagctatttcagaataaaagcataggctggtcagaatttcagcgtgcaattcttgatggacataagaacagacaagggcagataagattaaggaaggagaagcaatcaatttatacgtatcctgctcctgattgcatgtgtagagcttaa

SEQ ID NO: 16968 - DNA, 600 bp, Glycine max
  Peptide Sequence Number=SeqID_133746
atggtatcagagccatcaggacttgtccttcattattctgctattgagttgctactcagaactcttgttgttgagatcattgaggagaaaccagaagaggagcctgaaattacacacagagtattcttggatattgatattgataaacagcgtttaggtaggatagtgattggattatatggcaaagttgtaccgaaaactgtggaaaattttagagctttgtgtacaggggagaaaggcaagagtgaaaatggcataaagcttcattacaaaggaacaccatttcatcggataatatctggttttgtgattcagggtggagacattgttcatcatgatggtaaagggtctgaatctatttatggtggcacctttcctgatgataatttcaagattaaacattctcacgctggtgttgtttctatggcaaattcaggacctgattccaatggctcacagtttttctttaccacagtgaaggccagatggctaaacattacatattttagaaggaaagtgattattttacgaaagcataggttgcacaacaataacatcaagatggaaaacgagagcaataacaatgcttcaaaaagttag

SEQ ID NO: 16969 - DNA, 240 bp, Glycine max
  Peptide Sequence Number=SeqID_133747
atgctaatggaagacaacagaacaggcaggttttctttgttgactacacctcacagcacattatgtgttcacaaaatgcttcctcaaaagtcaagaccatatcagtcttggggtttgatcaacatctgtatcgatagggatctggctaaagggtacgttatgatggtgttatcagttgatctgatcatattcctttaccaacctgtcaagcaaagagaggctttttgtggagtaatataa

SEQ ID NO: 16970 - DNA, 1446 bp, Glycine max
  Peptide Sequence Number=SeqID_133748
atgggttctagcgaggatccgaacaacaaagtcgattttccgtacgagtccccggcatcgcaaccctttctatcgaaaccctcgtacccttcatcgtcttcttcggctgtggaagaagaatcggagtcaaaccagcaattccatcacatcacttacaattcaggtcctcgctccttcaaggaccttcctttcctcatcctcttccttctcttcgtactttcctccttcgcctttggcatcttcgccatcatccaccgaaacaacagctacccctctctctcctccttcacctacgaccccaccaccacctcctgcgtcctaaacccttctaattcctcctcctcctcctccgtctccacgctctccctcgtcgacacaacatcatccgtttctccgaaattggtgaagggtctcatatggactctcgtcatcaccttcgttctcagcgtccccttgtgctgggctctgcttctcttactcaagcattacaccaaacagattgtctacgctgctattccactctttatcgccatccccgttttcctcaacgtgtattggttcgtggcctgcaccctcggcgcgtcttgcagcaacgctttccccctcgcgtaccgggttctgattttggtgttcttgtttttggtgattgggatcattgtgtggatcttggtggtgaattggcatcgcgtggagctcacggtgagcataatcggggtcgcttcccacgcactttcgaggaacatggctttgttcggggtgctgccttgtttgtctgttgggctggtgctgtattttgttccaatcgtggttttcatggtgtttgcgaggtttaatgggaagattgttgtgaagaatttgaagagtggatatgactgtgaatggaaggaggattcttgggtgccagcttattatgctttggctgttctcaccatgttgtggtctgcggcagctatggttgaagctcaagtttatgtcatcagtgggactattgctaattggtatttctccaaggaacatcaaactcctaagcggagtattcgaactcctctcagaaatgtttttggtccttcttctggcacgatatgtttgtcaggattgcttgtctgtgttgttcgaatggtgcgttctgcggttgatagtgcaagacaagaggatactcctgggatagtgaaccttgtgttgcggtgctgtgtaaatgcattgctgacagcagttgattttcttaacaagtttaccataaactttgctgcaataactggtgaagcctactgctcttctgcaaggatgacatatgaacttctaagacgcaatcttctctctgctgtttttgtggagaccatctcatctcgcatcctggctggaattgtctttgttttttctgcatcatacacaatagtggtacgtggtgttagtatgactctttttaatgcttgcactttgcattag

SEQ ID NO: 16971 - DNA, 306 bp, Glycine max
  Peptide Sequence Number=SeqID_133749
atggtccaattcgtccaatgggagcaaaaattttggggagcatcaagtggtggcagcttccatttggtatctgagcgcgcattggtgcgctatccaatcgttgattcatcctatggtggaggacttcttctggcagttctcaaattagataatatacaggcacttgtgcggactgtcaagcttaatcagttgggaattgaaggatcaatcgaatttgttgatgcatacggaagtaacatgcatggacctgtatggaagtggtctagaagggatggttctgatttaggtgttggttcgggtggttag

SEQ ID NO: 16972 - DNA, 216 bp, Glycine max
  Peptide Sequence Number=SeqID_133750
atggagtcggtcttctgtcaacggagaaattataggaaaactacgttcccattgacaatgctaacgttttatttacttttctttcttgaacatcgtatatacgaggaattttcaagctcaaatatgaggacccttcaacactttggcggaatggcggtagagagctcatcgtcattaggaatggaaatacgtaagatggttaatagtaatctttaa

SEQ ID NO: 16973 - DNA, 306 bp, Glycine max
  Peptide Sequence Number=SeqID_133751
atgtcatatattaataaaaaaagtattaacggtgtaggaagaaaatccccaaagaagattgacaaaactaatgcatttgttgttgaactttggggtctttatgaagagtatcaatggtgggaaagaggaagtgttgctggaggacaccttattcaagagatccagaatctgttgaagatcgggatgcgatattccttgaagcatatttatagggaggcaaatgcgtgtgcggatgctttggccaacatgactactggtttagaggttgtgtttgtgatgtttgagcaacaaccgtttttaaattag

SEQ ID NO: 16974 - DNA, 736 bp, Glycine max
  Peptide Sequence Number=SeqID_133752
gtcgacaacatctgcacgtagacaacgtgcaattgcagctgttgctgtggatgtttaccgtgtggatcatgctactgacaagggttttataggcgaaccccatgatacatcagtgttgacgtcatatgttgatcatgtggcagccagagtttgggcagaagaagaacatactgagttgaagttggcctcttatgggaggaaggaagagaaatttggaaggtcagcacttgagattgaaggcataaggtggcacaaggaaactagtagtttccatctaccgataagagaactgaccataacccttgatgaagtggcatgcttattgcatctgcccattacaggtgccttccataccttggatgctattgttgtagacgaagcggtgaacttgttagttgagttgcttgaacattttcctacaattgcttccattattgctgatgaggattaccatgagaggaaaccacatgcttgtcactggaagtctagaaaggcattgccaatgacgacgtatcataagagcttggataaattgacgccagattttgtgtgttggataccttatgcatactacatggagtggttctataggatatctcaccccttcatgagtccgacacagcttggggaccctcctagacatccacatgtggtgcatcatgatacatttattgtaccagatcctcctcaggagctcatccacgcagcagctatgtcacaaccacccgcaccttga

SEQ ID NO: 16975 - DNA, 1548 bp, Glycine max
  Peptide Sequence Number=SeqID_133753
atggaatccgaatgcgtgcgagttgcggtgaatattcgtccattgattacgtcggagcttcttctcggttgcacggattgtatttccgttgtccccggcgaacctcaggtgcaaataggatcacattcttttacatttgataatgtatatggtagcacggggttgccttcctctgcaatatacgatgattgtgtggcgcctcttgttgatgctctcttccatggatataatgctacagttcttgcttacggtcagacgggctctgggaaaacatacaccatgggcaccaattataacggagacggaagtagtgatggaattatacccaaggtattggagaccatattcaacaaagttaaggctacaaatgactccacggagttcttgattagagtatcatttattgagatattcaaggaagaggtttttgatttgcttgatcccaattcatctaaaggagaggtgatggcaaaggttgctgcgcctgccagagttcccatacaaatcagagaaaatgtgaatggaggaataacacttgcaggggtaactgaggctgatgttaagacaaaagaagaaatggcatcttatctctcgagtggttcattgtcacgtgccactgggagtacaaacatgaacagtcaatcaagtcgttcacatgctatcttcacaatcacaatggagcaaaagaaaggtgatggcatcttatgtgccaaactccatttagtggacctagctggttctgaacgagtgaaacgaactggtgctgatggcttgcgtttaaaagaaggaattcatataaacaagggtttgttagctcttggaaatgtaataagtgcactgggagatgaaaaaaagcgaaaagaaggaggccatgtaccatatcgtgatagcaagttaacacgcctacttcaggattctctcggaggaaacagcaaaactgtgatgatagcatgtgttagtcctgctgacacaaatgctgaagagacattgaacactttaaagtatgcaaaccgtgctcgtaacattcagaacaaggcagttattaatcgagatccagtggcagctcaggtgcagacaatgaaaaatcagatcgagcaattgcaagctgagcttctattttataaaggtgataccagtggaccaattgaagagcttcagattcttaaacacaaaatatccttacttgaagcaagcaattcagagctacaacatgagcttaaaagacgccaagtaacttctgagagtttagcacaatgtgctctcgatgctcaggttgaaaaggaccaactgattttgaaaatagaatcaatacgaaacggtaaatcatgggatgagattgactcaaattcaaatcaggattatgacctactgaaatcttatgtgtcaaagatccaaaatctggaaggagaattgctatgtttgaaaacttcaaatgccacgaatccaagccgttttgttgattgtgctggttctgatgatgatggatatggatcaaaacatgctttatttgctcgtggtaatgatggatatggatctaaaatcttctga

SEQ ID NO: 16976 - DNA, 612 bp, Glycine max
  Peptide Sequence Number=SeqID_133754
atgtcacattctgattggaccataaacaagtgcgtcattttaaccaagtgtgatcccatcagaggggagaaccttactgatctggattacgaagttgttataagggtcgatgatgctaacgaagtcggtggatccaggggcggtgccgatggcttggtacattgtggcggcgagggcagtgtcgttggcgatctagtggagcttcttggcaccgaagtagtagtcgaggaggatgtggagggagagggcgtttttgatagtgtagatggaaaggtgcttcgagagaagggtgaggtagtggttgaaggtggagaactcagggtgctttgcgaggatgttggtgatgttgtgcgcatcgaaggaggtggtgaggaggaacagcgtcgccgcgagcagtgcctgaaggagctacattatggaagctatcaacaaccgcaagttattcagtggaatgctccccctgaggaacagtttaagctaaactgtgatggagcggtggataataacgggattgcagcagcagttgaaggggctgaactgtgtgttgtggtgataggtgtgaatttagatgttttaatgggttccggattttttattcatgttcttgttgat

SEQ ID NO: 16977 - DNA, 246 bp, Glycine max
  Peptide Sequence Number=SeqID_133755
atggatttccttcacgcttgtaccatacggattgggtttaacaaagtaaaaaaacaaacacagacaggactcatgacaaggaggcgagttgggatgaaagatgaatgcaagaagaataacggaggggatggatggactcgcggcgcatcaaggaggggaaggaagcatcaatggtgtcacggcgtagcaggagagaaagaggtgtatggatcctctaccgccaatagccatgtagagccatgttga

SEQ ID NO: 16978 - DNA, 2283 bp, Glycine max
  Peptide Sequence Number=SeqID_133756
atgtttgacacttcggttaattataatggaacagtgttaactaatggcaagcttcttaagctagctacaacttcacaggctgaaatgaagctgtacagtaattctgatgcttcagttcttaggcatcattatgaaaagaaacttcttgagatggaacaagagaagaaaatgttgcagaaagaaattgaggaactcaagagcattcttgcaaatatttcatccacctctgatgatggtgctctaaagttgaagcaggattatcttcaaaagttgaatgctcttgaggcacaggtctctgagttgaagaagaagcaagatgctcaggctcaacttatgagacaaaaacataagagtgatgagtttgcaaaaggacttcaggatgagatccagagaattaaagcacaaaaggttcaacttcaaaataagattaaacaggaatccgaacaatttaggttatggaaagcttcacgcgaaaaagaagttctccagcttaagaaagaggggagaaggaatgagtatgagatgcgtaagctgttagcgctgaatcagagacaaaagatggtattgcaaaggaagacagaagaagcttccttggccacaaaaaggctgaaagaacttttggaatctagaaaagcttcctcacgtgaaactatgggtgttggaggtgggaatggccctggagttcaggctttcatgaaggcaattgagaatgagattgaagtaaatgtccgagtgcatgaagttcgttcagaatgtgagcgtcaaaaggaagtgagggctaaaatggccgaggagatgatgaggttaaaggaagaagcacaaatggtgaatcaaaatagtacaagtgattgtcccacatcgatgtctccgggtgcaagaaattctaggatttttgcccttcaaaacatgctttcgacttcttctgcaactcttgtgtctatgttatcccagttgtcagaggcagaagagctggaacgggttttcagtggtaaagggcgttggaaccaagtccggtcccttgctgatgccaagaatgtgatgaattatttgttcaatattgcatcttcatccaggtgttcattacgagataaagaagtgatttgcagagagaaggacacggaaataagagatctaaaagaaaaagtagtggggctaagctactcacttcgacagttggacatgataaaagctgaacttactcacaagttgaagttgcagagtgaagctttgaaaagatattcagaatatgtgggagattcagaatattctgacttgaatgttggagtccacaagtatgacttgcgcaagtcggaataccaccggtctacccatctattggaggacatggatatatctaagacagagtcagatgattatgatctgacagatgacgagtgggaagaatcaggaaagttaagggttaggaaaaggaaatctaaaacaagacgcacaggcatggaaaataatcaatccaatatcaacaattcagaatatttccaaaaaaaatcaggagatatacttgtagatacacctggggaaactgcatcagatatttgctgctcttgtagcagaacatcatcatgcaagacaacaaaatgcaagtgcaaagctatgggcaacagttgtgggagttcctgcagttgcctatcaaccaagtgtgccaacagagcatcaatatcaaatgaatcgcaggagccaacacaatcggcaagtattgaagaaacagaccttcttgttactcaaggtgcagagttaattcagggagcactggttgataggcttgacgagataaacagtgaccgagggcacagaaaacctctctctgacataggaaatacacaggccaaatcaaatgcaaagaacggtaatccaaaaaagaaaacagccaccgtaattattgttccaaatccgccaccttcttcgcaggcagagaatactgaagtccccatccccatccacaaccgcaagttcaaattcaggaaagaaaataataacagtgaaacaagtgtagctgtgaataaaccaagacataaaaggtccaaatccagacctgaaaacgctgcctcagccccaagagcagagggtaattttgtggacccagatgaacccttgaaaatgccaggggcttttcgaagggcagcatcatccaatagtagtggcgtgcctttttggaacaggaatgctgctggtaataataactcagatgaacctgaagtttttgaaacaaggaatccactacggcaaaaaagaacattagacgaaaaagagaacaacagacgctga

SEQ ID NO: 16979 - DNA, 1755 bp, Glycine max
  Peptide Sequence Number=SeqID_133757
atgaccggtaacgagtttcgcttcttcttgtcctgcgatatcagtgttcctgtcaccttccgcgtcgagcgccttgaaggcaatttgccccttccgaatcccaaatcacccgatttagaaactaatgcccccacagagaatagaacaaaagagttgtttgtggagtgtgctttgtacattgatggtgcaccgtttggccttccaatgagaacaaggttggagtcctcaggaccatcatattgttggaatgagctcatcactttgacaactaaatatcgagacttaactgcccagtcacaactcacgttcactgtttgggatctttcgcatggtgaaggattaattggaggagccacaattcttctcttcaacaacaaaaagcagctcaaaactgggaagcaaaagcttaggctttgggcaggaaaagaggcagatggaacattccctactagtacacctggaaaggtccctaggcatgaacgtggggaattggagcgattagaaaagcttgtgaataagtatgaacgaggtcaaattcaacgggtggactggctggatcgcctgacatttaaaactatggagagaatcaaggaacgcgaaagcttgaaaaatggaagttctcatttgtacctggttgtggacttctgtagttttgagcatcgagttgtttttcaggaatcaggtgcaaatttcttgtttccatcacctatagcctccaccaatgatattgttgttgtctgggatccagaagtgggaaagataaatccctctgagcacaaacagttaaagctggccaggagtttgacccgtggtgtcatagacagagatctgaagccaagctcaaatgagagaaagtccattcagcgaatactaaaatatccaccgacaaggactttgagtggagatgagaggcagctcttgtggaaatttcgattctctttgatgtctgaaaagagggctcttacaaagttcctgcgttgtgttgaatggagtgatgtccaggaagcaaaacaagcattagagttgatgggcaagtgggaaatgattgatgtttgtgatgcactggaacttttgtcgcctgtttttgaaagtgaagaggtccgtgcttatgcagttagtgttcttgaaagagctgatgatgaagaacttcagtgttatttgcttcaattggttcaagctcttcggtttgagcgttctgacaaatctcgcctttctcatttccttgtccagcgtgcattacgcaatattgaattggcaagctttcttcgctggtatgtggctgttgaactttatgatcctgcatatgccaaacgattttactgcacttatgagattctggaggagaatatgatgaagatagcagctggtgttaatggagaggaagatgggtttaaacagtggcagagtttggtacgccagacagaattgactgctcagttgtgttcaatcactagagaagtaaggaatgttcgtggtaatacacagaagaagattgaaaagctgagacaactactttctggtcttcttagtgaacttacctattttgatgaggttgttcaaatggtatcactaatggatcgattgcttaagttggaaaatcttgatctgcacctaacaccatacaaggtgctagcaactggacaagatgaaggcatgttggaatttattccatctcgctcattggcacagttgagagaattagggagagaagaggagattgagaaaatcaatattattcaacccaactgtaactga

SEQ ID NO: 16980 - DNA, 449 bp, Glycine max
  Peptide Sequence Number=SeqID_133758
tattgttggagaacaaaagtgcttgactaaagatgctggtgacaaagatattctcaaagtaaaaatgaaaggaaaaagctttgttttaaatccattggaggatgagcaaattgctttttcagtaaaaaagaataacactaaattatgggacaagaaaccaaaagttgatgaagatcaaccaagttctgaaatagcagctctcacatcttggaatggtgctgctgaagcaaggttgccaccagcaaagggacaagaaaaatctgctttagagaaagtagctattgtgcagaagcatacaaacaagaagacacaattgagtgagaaagctgcaaaaattgagcataatgagaagtgtttaaagtttctgacaaagaacttgaacgctgaaaatgtcaaggctcaatcacatgagaaggaagcaatagtatttcagcactgtaagtcagcag

SEQ ID NO: 16981 - DNA, 627 bp, Glycine max
  Peptide Sequence Number=SeqID_133759
atggtggtgacagtaagatgcgggcactgcacaagcctcttttctgttaatatgtcgaaagcttcttttatccctttccacctcttagcatctcttagtcatcttgaggtgatgggttattaccttgcaatttctatatttatttcctttggaattttatctcaaaatgcatttgtgactgtctccactctccagccaaaagaaagtagtccagaagaagatgctaacaagactttgaacagccatagtgcatccatgatgacctattctgattgtgaggaagaggatgtaattccaatgagtcatcatgttgtgaataaaccgccagagaagagacaacgaacaccatctgcttataactgcttcatcaagaaggagattaaaaggctaaaggctgaaaaccctgacatggcccacaaggaagcttttagtacagctgcaaaaaattgggccaattttccccaaactcagtggtgcagaggagatgaagagagctgtagccagacagatcaacttgtgaactcacaagtggaccctcctgatgctgaggtcaatgaagaaggtcaaggattccgtggaagaaaggtcccaagaaattccatcttggaaaggacacagtttgaatga

SEQ ID NO: 16982 - DNA, 2949 bp, Glycine max
  Peptide Sequence Number=SeqID_133760
atgttgggaagggcagcaaccaatgcatattcatggtggtgggcaagccacatcaggacaaagcaatccaaatggctagaacaaagtctccgagatatggaagatgtgatggctgaaaccctcaacatcattcataatgaaggagagtcattttcccaaagggcagaaatgtactacaggaagaggccacagctggtaggttatgtggaagaagtctttcgctcatatagagcattagcagagagatatgatcttctatcaaaggagctccaaagcgccaaccacactattgccattgttttcccagaacaagtccattatagaattgatgaggatgatgctgaagaaagtttccctggaacaaattcatcatctcaagatcccaacaatcaaacaccaaaaccaggcattcctaaagctccaaatttcccaaataaggactttagaagtccatcaatgttgctttctaggaagggtccacttaggagggtttctagccctgcaaaatcccctcccacaagtcctagttcaggtctgagtaaggctgaagcactagcagaagttgacaagcttcagaaagaaattttggcactacagactgagaaagagtttgtaaggagcttgtatgaaaattcctatgaaaagcactgggaaattgaagaccagattacacaaatgcagaaaagggtttgcagcttgcaagatgagtttggaattaatacattcatagaagataacgatgcacgagctctgatggctgcaacagctctgaagtcatgcaaagagaccctggctaagttgcaagaggcacaggcacaatcatctgaagaggctaaagaatcataccaaatggttaaggaagctcacagcaagtttgaaacccttagagacctattcatttctaaacataagagtcaacaagaccaagtaacagaaccaaaaagcattgaggaagaagacatgtctagcttggaagaagaaatctatgaacatgatgtggggcggttgcaagacacaattaaggaaaagcttgagggagattcagttagctccctcactatgacagaaatggcagagaagattgatgagcttgtaaataaggtcgttacccttgaaaccacagtctcttctcagactggcttggtaaagagactgagatcagaagcagatgaacttcaaaaaaaattattgagcttggaagaggacaaagaagtgttgatagaagattcagaaggaaccaaaaagaagctggaagaagtggaggaggagttgaagagagttaaaactctcaatcaaagtgtcaaaaggcaagacaacagcctccagacacagtttactgaagctagttgtgatcttaaacatctttcaggaaaattgaatgatgtgaagctagatgaggagggggagaacttgcaacttcacaaaaacaaaagtgcacatgatggagaactgaaagaggagtctgaaaaaccaggtgacaacacagaaaccatgaaggatattgagacaacaaaggaagaaaaggaagattgtagtgtaaatcttagtgatgttgaaaatgaagataacaagtccaattcgaaagaaaatgttgattttaggactgaagagattccagagcaaatgctgcagaataaggatgatttgtctgaggcaaggagtaatcttgacactgaatcacttgatcaggagactggtgaggaagaaaatcaatccaacaggagtcagatgattgcaagtggatttgatgacagagaaaagattctgaaggaattcacatcagttttaaagaactacgaggatgtaaaggacgagctcaatgatgtggtgaagaaaaaccaggacagcatttttcaattggcacttcagaagttgtatactaggcactacattacctccagtcctcagaatgtagatctacacttgcaggtgagggaattgaaggatactgttgaaactaaagatcaagagataaacattttacaacagaagctgacctgttcggaaacaaatccagatgaaagtccttgcacccctgttacagattataaatacacaccacaagaagcacttcttggaactgcagctcaaggaaccgaccctcaggaccctgaaaatccatcttcaaatacagatgcaattgcagttagtacttcttatgcagggaaacaccaacaatatgttgaaaacaaaggaaggattggcatattagtgaaggtgagaccaaaccagcttgataagagccactcactttcaaccttggaaaagaaatttcgttccaacattgatgatttgcttgaggagaacttggagttctggttgaggtttagcacctcagtgcaccaggttcaaaagtttcaaagttctatagaggacttaaaatttgagcttaaaagaataagggataacatgtttcaagagaactcaagttctatacaatctgagataaaaccaatatttagacacctaagggagataagaactgatttatcactatggctggaacacagtgaagtgttgcatgaagagttgcaaggtaggcatccatcattgtgcaccttacaagatgaaatagcaagaacagccaatccaaaccctgcatcaaataacatggcaaaactaagtgggtatcaggctgcaaagtttcaaggtgaggttctcaacatgaaacaggagagcaacaaggtttctagtgaactgcaaggatgtgtcagttttgtgaaggaactgaagggccaagttgagaagatgctagaagaactgagtcaagaaattggagttaacaatcatgaccatatgaaacactccacaagtagttctagaatacccttgaagtcttttctgtttggaatcaagttaaagaagcaaaagcaatcgttcctctcatgtgtaactccaacaaagagacaacacaggaatctagcagcggctgaagatgcccctatatag

SEQ ID NO: 16983 - DNA, 474 bp, Glycine max
  Peptide Sequence Number=SeqID_133761
atggttactgctaatcgcttttggtcccaaatctttggggttgctttttccaataaacgttggttacatgtcgttatgttatttgtaccagtaactggtttatggatgagtgctcttggggtagtcgatttggccctgaacctacgtgcctatgacttcgtttctcaagaaatccgcgcagcggaagatcctgaatttgagactttctacatcaataatattctcttaaacgaaggtattcgtgcatggatggcagctcaagatcagcctcatgaaaaccttatattccctgaggaggatgtgtttctggttctgaatctaatgattctgattggtattggctggttggagcctcatggaactggattttcaagtgatgatgatgttgaaactgatgaagaggataacaattttgctgtgcttgttccctgttatggatgcaaccatggagccatggtggagaaggatatttaa

SEQ ID NO: 16984 - DNA, 258 bp, Glycine max
  Peptide Sequence Number=SeqID_133762
atgttgtcagtcccctcatcaaacagcaagttatatggttgcgcaaagaacaggggtgcagatacaaccaaattcaaagaggggcaccacaaagccctcttacctcagagactatgtataagaaagaaagggagaaaagaagatgacctggaagctgctggtgtgcttcatgacgacactactggtgtgcttcacgatacaaccaacttagagagacaaagcttaagggcgcaacagtactcaggtagtgcaggctag

SEQ ID NO: 16985 - DNA, 180 bp, Glycine max
  Peptide Sequence Number=SeqID_133763
atgatgcaatcctacccaggaggggcattggatagaagactccaagaagattgggccagagatgcaagagatggccctaggattctcatgagccttaggacaaagaagctatgtaaactcgatccatcttctgccccaacttttgcaagctggttacttccatacttgaccttgacttga

SEQ ID NO: 16986 - DNA, 210 bp, Glycine max
  Peptide Sequence Number=SeqID_133764
atggaaaattcatggaaaattagaatcactccgcgtaatagtgcacctatacgtcttcatcgacgttgtttttcgaccggaagaccgcgagctaattatcgagactttggattatccggacacatacttcgtgaaatgagcaacttggtagctcgcaaggctcataaccttgaggtcacgggttcaaatcccgtctccgcaacattttga

SEQ ID NO: 16987 - DNA, 906 bp, Glycine max
  Peptide Sequence Number=SeqID_133765
atggaagaaaagagtgaaggttacaatcattactctactgatggtggtggtgtaactggggttgcaggagtagagactggctgtggcttggtttctactaatgctggctatgtaactgaggaagctgaacttgcagcaagaaagactaattttgaagttgaaccacaaattcagctcaaattggttgagaatgaaattgagatacagagatgggcttgggaattgaaggaagtagatcttacacaacgagagaagcaactacaggaaagggagcatgagttggaaattctgttaacaacattggataaagaagagataaacaaaacaaagttagatgtacaaatgtctttggtttcattggaaaataatttaagccaatttgacaatgcgaatgagagacacgaagccttgaaaagtgaaacaaatgacttatcagttttggaagtgaaactaaaggaagaaattgatggtgtacaatctcaaaagttggagacagtagcggaggcagataagctaaaagtagagaaaccaaagtttgaagctcagtgggagcttctacatgaaaagaaagaagagttgtggaaagaagcagaatacatagcagaggaaaagaaggcagttttggctttcattaagaaggactgtgataagctaagacaagagaaagagaatatgtgtgatcagtacaaacgagacttggagtcgctaacttgtgaacgagaagagttcatgaacaagatggcacatgaacatgatgactggtttggcaacatgcaacaagagcgtgcaaatttcttgagggacgttgagatgcagaataggaatatgaatatccttattgacaagaggcgtgaagaaatagaaaaaccaatttggtttttggattcagctacacacttagtttga

SEQ ID NO: 16988 - DNA, 201 bp, Glycine max
  Peptide Sequence Number=SeqID_133766
atgtttggagaagctatactgtctcagttcactcttaacatgcctaaagaattggtagcaaccaagattgttgtctggactacggtggttaatccatttaccaaatatcctttatacataagagcatgcatgtcattatatataccatggaaaatgtcattcaacataaggaatgactttgtttccatcctgcatttatga

SEQ ID NO: 16989 - DNA, 479 bp, Glycine max
  Peptide Sequence Number=SeqID_133767
gtagtaatttctacggttgtgttgatcgtggtcgccctcacatgactgacaagtgccctaactttaaactgccaactagttggtgccacattgaagcttgtcacagttctgccatcactggtggtgacttgaaaagagaggggttttccattgagctaagagtggatttgactgttgatcaaacacaaaaggtatttgataggatcctaacaaagttaggtcgtactgccccaccagttcttggcactactacaaaagttatgttttacgacactatttctaaggcgcccaaccaggtcgtccccaaaatctggcgggcatgtgtcggcgctgctgtgcacatggagcatgcctctccctcgcattacctcagccctctcatccgcggcgcgacgaggagagtgaccgcggaggccatggctagagcttctacagtacagactagctcaagctcagtgactagagttctctttcgctag

SEQ ID NO: 16990 - DNA, 402 bp, Glycine max
  Peptide Sequence Number=SeqID_133768
atgaccctacggtcacatttccagggacccgtaaggcccgggctaaaggatctgagggcccatcttctgctactccccctgcttctactgcaccagctcccttaccaccatcaataccagctcctcttggcacctccgcttagaagtatccatgctttggctcagcattggcccattatgagcatggaggagttttcagctcaagtggcctggcaaggagtccagccttcttcttttgggggaggtgaggcctctacagcccaggagcctcaaccagagccagaggtagctgctcaggaggctgatccagaggccgcttcagctgctcaggaggacattgcagaggctactccgcaggcatcaccagtgactacacctgtgctggagctctctactccgtag

SEQ ID NO: 16991 - DNA, 309 bp, Glycine max
  Peptide Sequence Number=SeqID_133769
atgagactaagtttgttgagggatcaaggacaaagtttaaagagagttaggctcatttacttgaggaatcatggagaaaaattggaaggtgcagcagctggtgtctcgctaagcgagggctatgcgcttaacgagtatcatctcctaagcgagacatcagcccgcttagcgagtaagaagaatctggaagagaatctgccacgcaagcatgcgctcagcgcgccatcagctcgcccagcgagtcatttgtctcttcctgcgctttgcgcacctggctcgctaagccaaaagtcacttactcgcgcttag

SEQ ID NO: 16992 - DNA, 252 bp, Glycine max
  Peptide Sequence Number=SeqID_133770
atggttctttttataggagaaaaattggaaggtgcagcagctggtgtctcgctaagcaatggccatgcgcttagcgagtatcatccgctaagcgagacatcagcctgcttagcgtgtaagaagaatctggaagagaatctgtcatgcaagcacgcgctcagcacgccatcagctcgcccagcaagtcatttgtctcttcctgcgcttagcgtgcttgactcgccaagccaaaagtcacttactcgcgcttag

SEQ ID NO: 16993 - DNA, 507 bp, Glycine max
  Peptide Sequence Number=SeqID_133771
atggaagccctcagcagctctaaaactcaaccgaaaacaaaagaaaaaagtggaattgaagagaacaccaaaatgaagaagaaagaatggaaacggaggaagcaaattggtggggaaatgacacaaatgaaggaagtgggtttgaagttggatcttcaagggaaagccagtgttttacaggtggaggagctgaaaaattctgaggtacaagaaattccttcattccataagttgcaatatacattcatgagcatggaacgtgttgtgacacattggttctacatttggggccaaaagaacccagatttagattgtgagtcattttccacaactttgatcaaaagattcaaagatagctatggtagccatgtctttgaaagattgactaccttaaagcaagaagagcaaattgagacggaaacccacattgaagaaagggagacttccacactcttcttgaaagagaggaccaacgatgtacccgagcttaagaaaatgttgcagtag

SEQ ID NO: 16994 - DNA, 405 bp, Glycine max
  Peptide Sequence Number=SeqID_133772
atgggactcctttccactttattaaaatggattgaagttgatccaccttcgagggatgaaaaactgagaaatgaaaggatatgcaaattttatcagcacaatcggaatccatttgtcgaccatccggagtatgccaaccttatatggaagcaacctatttttctcaagacagtatccttgattggatggacaggttatgaggaacatgctgctgctctagcagaagggcaaccagctccagcattatgcagcagtggggacgttcgagatttaaacatggaagactttaaatatgctcatcagcagggtgttgcctacgatatttccgtgattcaaatttgtcaccatgagcaggtcagggcaaccacgggatttgaagaagtgttcctctcatttttcacttaa

SEQ ID NO: 16995 - DNA, 423 bp, Glycine max
  Peptide Sequence Number=SeqID_133773
atgaccggtagattgctggccggatcattaacctttgattgtcgcatcatgcactatattatcattagaattttgcttccccgttcttctaatttggctcaagcctctgaggagggcttgattttgatgtgggctttccttaccggtcgttcgattgactgggatcacttggttaggtaccgaatgcataaggcattatgggccaatgcacctcttccatatcctcaattggtcaccctttttctccgtcattttcaaattcctcttgatgatgaaccttttgttcaagtcaagagatcatttgctataggtgctggtgcagtcacttcatttggttaccgtaaggatcgtgatggtcaatggctgaagaaggacgcactccctccacaagacgagcgtactccttctcctcctcctcaatga

SEQ ID NO: 16996 - DNA, 219 bp, Glycine max
  Peptide Sequence Number=SeqID_133774
atggcagcttctgatcccgacaagttgatggtcaaagctgataaactaacaagactcagtctcacgaggtggagtgcggattggaaaagtgctactgttctttatgagcaggcagctaatgggtttagagttgccaaggactatgagaatgctaaaatagcatatgagaaagcttcgaaaggacaagaaatgctttcttcgtatccttatatgatatga

SEQ ID NO: 16997 - DNA, 561 bp, Glycine max
  Peptide Sequence Number=SeqID_133775
atggttaagggctccaataatgagacattggatggtggaggtggcaataaagtatcttttcgagacaaggggatgcagggaaaaatattgtatggttcgcgccctatggtggatttgttcaagcagaatttagcaaagattgagtataaggatgggaatccccatacgcccaaggttcatatccatgattctgtgtttgaaggcctccatgcaccttggcaagatgccttggtcatcaagttgcttgggaaaagcatcgcttatcccattttgagggacaaattagatcgtacgcggaaactcaaagtaggtttcgatatgtttgacatccacaatggttattttatgctcaactttgaccatgaggaggaccgcaagaaggttgttactgcgaacgtgatctctgacaaagtggatgtctatggcaatgtgcttcatgcggctatgcaccactggattgacagcaaggtagacactagagctcggtattcaacttctgtgaaggagcgtgccatggctttttgtttgaaggacttccaagaaattgggttaccaccatag

SEQ ID NO: 16998 - DNA, 747 bp, Glycine max
  Peptide Sequence Number=SeqID_133776
atggctggtaacaatgatcaagcaatacataggtgcatttccacactagctacggtgttctccattaaggacttgggattcattcattttttccttggggttaaagccattcctaccactcaaggactattccttagtcaacacaaatatattcatgacttgcttgaccgcacacaaatggcagatgcaaaaaagcatcacaggagcccttcagtatttgtcaataataaggccagacatagcctacacagtcaacaagctcgcacaattcatgcagagcccatcctccacacacttcacaacattgaaaagactccttcggtacctaaaagccacaccatttttcatggacttcatttaaagcattcatcttccaacactttccatgcattcagtgatgtcgattgggctggaaatagagatgattacacgtccacatttgcccacattacgttctatggtggtaacccaatttcttggaagtccttcaaacaaaaagccatggcacgctccttcacagaagttgaataccgagctctagtgtctgcatctacagaagttctttggttatcatcatttttgtttgaacttcatgtatgtatacccactactcctgccatatattgtgacaatttgggtgctacctaccttgctgtcaatccagtggtgcatagccgcatgaagcacattgccatagacatccactttgtcagagatcacgttcgcagtaacaacctactggtctaa

SEQ ID NO: 16999 - DNA, 264 bp, Glycine max
  Peptide Sequence Number=SeqID_133777
atgggtataaatgcttgtggtgtctctaggattgatgcttttctgagaagtgaccagaatcgttgtgctagcaacctacttgctgcctacacagatggagatgttgaagaaatcaaacgtattgctcagtcaagtgttatttcacatcttgaccatgtgatcattaagcttgcgaggaaacttccaacaggcgatgtgagttcattgaaggctaacaaggctgaagatgaagaggagccactcgatgaaaatgacctcacttaa

SEQ ID NO: 17000 - DNA, 366 bp, Glycine max
  Peptide Sequence Number=SeqID_133778
atggctctgtgtaagtttggctacaacctcgtcgagtcggtcaatggtggcttgccgtgtgttatgttttggcatggtgatagcagggataaaggccattacagagcaagggccagctgtaatcatcaacaatttccactaatagacttgttggctaaatatcctaacaaaatcgttaatgctatatcagaatggcaaaatgttgttgcaaggctggacaggaaatctggtatagtgctagcggatgattctgtgccttgtcactatctggataggagaaattacacgaagtcactgaggtatttgggccttgtggagtatctcttgggtctattgggctcgagattgctatcaggtccagtctga

SEQ ID NO: 17001 - DNA, 450 bp, Glycine max
  Peptide Sequence Number=SeqID_133779
atgacaaagaaatttggggagacaattaatgtgaatttcaataatggaggacataatattaatggggatcaaactgttacatatcctgatcttaatactattattgagcaacaaccgttacaaggtcgttacatagcaagggacagttgtaatcatcaacaatttccactaacagacttgtcggcaaaatatcctaacaaaatcgttaatgctataacagaatggcaaaatgctgcagcaaggctggacaggaaatctgtatctcttgggtctattgggctcaagattgctatcatcacctccatttgggagaaagaccttgtcctcaaggtcataggaggtagaaaaatcccatttccaatccactatggacagtgcctggatgacggggtcatttcccacggtaagtggcgcagtgatcctggaagagttggtgtagggccacattga

SEQ ID NO: 17002 - DNA, 1587 bp, Glycine max
  Peptide Sequence Number=SeqID_133780
atgaaagcaatctcttgcttccgagatgtttctgatatcatcaaatctggtgttcaagaacttggtgcagctccaacagaagtgcaaaaggtagcataccaagaaaacaataagaaagatggcaaggctttgtttatcattcgtcaaagtgttgatgcaaatatcttggagaagatattagatgcgaataatgcaaagaaggtatgggatattcttgtgaaatcctatgaggttgctaacaagttcaagaagtacttcactcgaatgctaaccctcacaaaccagatgaagaactatggtgataggatagaagatgcaatgatagtggacaagattttgagaaccttaaccccaaggtttgatcacattgttgttgcaattgaacaaggaacagaccttgagggaatgaaagtagaagagctacaagggattcttgaagcacaagaaataagactcaatgaaagaaattcattgagatcctcaaaccaagctttgcaggctcaaacttacaaagggaattctagtgatcaagacaaaaacaagaaaggcaagggaaattggaagaaagggaagaatcaaagtgaaggattgaattctgcacctaaacaacaacaaaattctaaagacaacaataaaaattgcaaagacaaaaaggtgccaaggaacgttgatgaaactcaattggcacaagatgaagattctaactctaataatgtgttgttgatggcaacaaccaatattaaaaataagaatgtgaacttgtggtatttggacacgggttgttccaatcatatgaccggacacaaggagtggtatgtttccattgataataaggctctcatcagtgatgttctctatgttcctaatatgaggaacaatctactgaacttggggcagctacttgaaaaaggcatttcaatacaaatggaggacaatcacatgaagctatttgatcaatctgcctccactgcggtgtatattctgaacaaaattcctacaaagaagttgcaaggatgtactcctgaagaagcatggtctgggcacaagccacctcctagagcttggaatttgagaattgacaactttctggttcagcagaagtacacaaagtgcactattgagcatggaatctacatcaggaatcgaaggaatgatgttctaattatatgtctctatgttgatgaccttctaataactggaagcaatattgaagatatggttgaatttaagaaaaggattatgcaagaatttgatatgactaatctagacattttggggaggttcaacataagtgagtgcaaccctgcaatcacacctgttgagataggaattagccttcagctagaaggagatgaaaaggaagttgatctgactttatacaagcaaattgtaggctcactgaggaagcaaggtgtagttgcattgtcaacttgtgaagtagaatacattgttgcagctatggcaacatgtgaagttgtgtggctcgaggctgtgatgaaagaacttaatttgaagatgaccaagtttcactttttgagagatcatgtgaataaggagaagtttgagcttgagttttgtagatcttaa

SEQ ID NO: 17003 - DNA, 231 bp, Glycine max
  Peptide Sequence Number=SeqID_133781
atgactgctataaagaagagagaaaggaaagacaagaagaagcctgcaaaggcagataaaagagaaggaagttcaaagagactgaaaagtgttcctatcacaaatggactagatacctgtccttctaccaaagggtcttctgttcatagttccttgccaaagtctcgggtgtgtgagtattcggcagagcgaagggagatatctacaaaaggcacttcaatgctcaagtga

SEQ ID NO: 17004 - DNA, 1102 bp, Glycine max
  Peptide Sequence Number=SeqID_133782
caagaatggaacttgcgaagaagacagcagagagcttcatgacacaagcagcaggctcatcacttcaacaacgttgaattctagcccagatgtgaaaagtgggtgtcttcatgggggaaatttgagcaggaccccagcacctaaatttcgtggagtacaagtgttcacgtatagggagttagaaattgccactgatggattcagcgaagcaaatgtgattggtagtaatggaattattggagggcatggtttgatctatagaggtgttctaagtgatggcactttggcagcaattaagttgcttcgcactgagggtaagcaaggggaacgtgccttcagaatagaggtcgatctcttaagtcgcttgcactctcctcatttggtggagttacttggctattgtgctgaccaacaccacaggttactgatttttgaatacatgcccaatggaacactccactaccatcttcacactcccaacgatcaatatcagctgttggattggtgggcccggatgaggatagcccttgattgtgccagagcactggagttcttgcatgagcatgcagtctcacctgtgatccacagagactttaagagtaacaacgttctactggatcaaaatttccgtgccaaagtgtctgattttggattggctaagatgggatcagagaagaggaacggtcgtgtgttggggaccactggatatttggcaccagagtacgccacgggtaagcttactacaaagtcagatgtttacagctatggtgtggttcttctcgaactgctcacgggacgtgtgccagttgatatcaagagggccccaggagaacacgtccttgtctcttgggctcttccaaggttgacaaacagagaaaaggtaattgaaatggttgacccagctcttcgcggacagtactctaagaaggatttaattcagatagctgccattgcagcaatgtgcatacagccagaagctgattacaggccgctcatgacagatgttgtacaatcactgataccacttgttaggaaccaatcctctcttagttcatccagctccctacgatttcagaaacaaacgccaagtcctactcattag

SEQ ID NO: 17005 - DNA, 1182 bp, Glycine max
  Peptide Sequence Number=SeqID_133783
atggagaagcagaacgaagaagaagaagagcaaaagaagaagaagaagagttcggtggtgataagaataccttcttatcaggaagtggttgaaagttcgcaggcgaaatccactccttcgtctctcttcgttccctcccaaaccttttccgaagctttcgccttcgtcaaatcctccgacttctactctcctcctccgaaatcgagggaaactggtcaatcggacgctccatcttcaacatcgacaccatctcccgctactgctgcagcttcgtcaacaataccttcctctcaaaatcgcaattcaattcttgtcagccacagacagaagggaaatcccttgctaaaacacattaggaacgttagatgggcatttgctgatgttgtttgtgactacatgcttggccaaagctcctgtgctctctatctcagtcttcggtatcatcttctgcatccagactacttgtactatagaataagggagttgcagaagaatttcaagcttcgtgtggttttatgccatgttgatgtggaagatgtaataaagcctcttcttgaagttacaaaaacagctatgcttcatgactgtacactcctttgtggatggagcctggaggaatgtggccgttacttggagaccataaaagtctatgaaaacaagcctgcagacattattcaaggccaaatggatacagattatctatcacggcttactcattcccttacaactgtccgacatgttaacaagactgatgtagtcacccttggtaccacatttgggtctctttctaacattatgggtgcatctatggaagatcttgctcgttgccctggcataggagagcgcaaggtcaagcgcttgtttgacacttttcatgaacccttcaagcgtgtggaatccagccggcaagccattccagagacttctgtccagaacaagccagctagtccagagtcatcgatcaggaacaaagctgaatcttcctccttgattgaagacaagcaagaggatacagaagatgtgagcaaacgtaggaagaaagaacccgaagttactgtcaaatctgccctttctgcagcttttgccaaatattctggtagagttgggaagaggaaaagcacttcacaagtggaggaaaaagaagaatcaattatttccaaagaatcagaagctgaaacataa

SEQ ID NO: 17006 - DNA, 951 bp, Glycine max
  Peptide Sequence Number=SeqID_133784
atggttgcagttaagccatccacatcagttaaaaatcaagcgcagattagaaatactacagagaaggtatccagtagtttagtaccacctcaacagccatctcaacaagctttgttgggatcctctgatttgcatgcaaaatccaaattagcagatgaaaaaccagtcttgaagggtaatctaatttcagatcatgtggtaaaatctgccacagcaactttggggacacgagttgatcccctttcaaatactatatcacaaattaaagttgctcaagtaaaaaatgctacagataccaagccagcagttagctctttgacaaaaccatccatttctaccaatttgccttctgacccaaagaacaaacatgttacctctttggctgataaaggtgctcaagtaaaacatgccgtggatactaagcctgctgttagctctttgataaagccatccatttctaccaatttgccttctgacccaaagaacaaacatgttacccctttggctgataaagttccattgaagcaagttgttaatcccacaaaagagttaaaagtttctgatcccagcaccacaccaaaagagaaggtacaagaaaatgagcctcctaaagttaccactggaagccaggttgatagcagcctagagaaggggagatttgaaaaaggtctagagacgagcacacctcttgttaaaattagttgtggtgaggaagtttcaaaagataaagcaaatccagtagtagtgtgtgaagagcaaggaagtgttaagaaggccactgagaataacaacattgacaaggggagtcaaaatttagatcatgacaagaagatagattctattaatcaaagttcaaatgatcaaaacgcgaatgataaacatgtaaatttgccagtacaagatgaactcagcctaagtgccaaggtagtaaaaagtgatggggaatgttga

SEQ ID NO: 17007 - DNA, 291 bp, Glycine max
  Peptide Sequence Number=SeqID_133785
atggagcctcagagatctcactacagagagataactaaaataatacttgaatttatgactgcaggggaattcagctgtgaggttggcactgatggtaaagtgttgatatctggagtaactacaactggagagaatactgtatccaggagttgtcatgaaagggaaatgtacatgatggcaaagttctgtccaatcagagtccttccatttattccaccaccaccaggcaccaacgaaggttactataaattgatgcaaaatgtcaaatggatatggttttgttttgactga

SEQ ID NO: 17008 - DNA, 795 bp, Glycine max
  Peptide Sequence Number=SeqID_133786
atggatcatcaagggcatgggcatgggcatggccagaacccatctatgggggttgttggaaatggacctcaatttccttatggttctaatccataccaggccagccatatgacaggttcacctggtatggttgttgcatcacctgggaccattcaatccactggtcaaccaccttcaactcagctaggacaacatcaacttgcttatcagcacatgcatcagcaacaacagcagcagctgcggcaacgtctccaagccttctgggcaaaccaatatcaagaaatcgagaaggtgaccgatttcaagaaccatagcctccccttggcgaggatcaagaagattatgaaggctgacgaggatgtcagaatgatatcggctgaggcaccggtcatatttgcgagggcatgtgaaatgttcatattggagttaaccttgcgctcttggaatcacacagaagagaacaaaaggagaacacttcaaaagaatgatattgcagcagccatcacaagaactgatatctttgattttttggttgacattgtgcctagggaggacttgaaagatgaagtgcttgcttcaatgccaagaggagatgtgcctgttacagggcctcctgaggcacttccttattgctatatgccacctcaacaagttggagctgctggtgtcatgatgggtaataagcctgtgatggacccatatgctcaacagactcatccctacaacatggcaccacaactgtggccacaaccaccaccaccaccagagcagcaacaatcatctccagatcagtag

SEQ ID NO: 17009 - DNA, 441 bp, Glycine max
  Peptide Sequence Number=SeqID_133787
atgcattcgtacggttacagagtcaatgctttgttaaccttcgccataaccattctggccgttatgtccgccatggcttctctctccgataacctcaattcccccactccctttgtgcatgctcaggtcaccaacattaactggtttcagaaacagcccaacggcgacgacgaggtttttgtatttttagctgctgagtatgaaacccctaagaaacccttgaatcagatatcgctgtgggatggtataattccttcaaaagatcatgctaagttttggattcatacatccaataagtaccgcttcattgatcagggaagcaatttgcgcggtaaagaatttaatttgacaatgcactggcatgttatgcccaagactggcaaaatgttcgctgacaaaatagttatgccaggatataaattgccagaggaatacagatga

SEQ ID NO: 17010 - DNA, 1770 bp, Glycine max
  Peptide Sequence Number=SeqID_133788
atgagtaaacaagacacgatgaaaattcagaattaccttctcaaggtcaatatccactgcgatggctgtgaagagaaagtaaagaaaatcctgcagaaaattgatggggtgtattctgtgaacatagatgcggagcgagggaaggtgatggtgtcagggcatgtagatccagctaaactgctaaaaaagctaaagaggtcagggaagcatgccgaactttggggtggccagagaggcatgatgtacaaccaaaactaccccacctaccctcagttcaagaacatgcacatagataacaccaaagggggcagcaaggacaacaagtctcagaatcacaaaggtggtgctcagaaaggaggtggtggtggtggtggtggtggtggtggtggtcaactagcacacttccaaaatgctaatggagggtcaaaagtaccccccaagaatcagaaatctgtcaacttcaacttatcagaggatgaacttgatgagagtgattttgatgaatttgatgatgactatgatgagtttgaagatgatttggaagaagaggaggaagaggaagagtatggtaatggttatggacatggtggtcatggtcatggtcatggtcatggccatgggcagcaggggcaggggcatcctatgcaacataacaagatgatggctatgatgggccaggtggggaatgggcgtgggccacatgggatgaatgggcctgctatgaacggccataaagggaatgggggtgtcaattatgggggtgtcaagaagggtgaggtcattgatctgcctatacaaataaagggcaaaggtggaaacttcaacgagggtaaaaatggaaaaaagggcaatggagatggtggtcaaaagaacaaaggtggaaagcaaaagggtgggggagataataatcatcataacaatggtaacaagaaaaagaactccaaagacaaaaacggtggtggaggcttcctagttcggttcctaggcttaggaaaaaaaaagaaggcaggaggaggtggaggttcagccgacacagcaacaaacaagaataaaaacaacaaaggaaagaaagatggaggaggaggaggaggaggaggaggtaaattcgacaaaattgactttgacttccaagattttgatatccctcctaccaaaggtaaaaatggcaagggtgggaataatggtaaaaacaataatgacaagggtcatggtagcaataatggcaatgtgggccaccacatgggccccatgggtcagatgggcccaatggttcagagaggtccaatgaatcagatgggcccaatggaccatatgaggaatatgaacatcaatatgccggcggtgcaaggattaccggcagccacggccgcagcagcgatgaacggtggttactaccaagggatgcagatgcagatgcaacaacctaacccttacaacatgcagcagcagcaacaacaacagcaactaatggccatgatgatgaaccaacaacaacagcaacaacagcaagcaaacatgaacatgtacccaccacacatgatgtatggaaggccacacccacaccaacaccaacatccatctatgaactactttccacccccaccaatgccctcacaccccatggcggatcctatcacacacgttttcagtgatgagaacactgagagctgcagtatcataactacagaagtgccaactacacttcttaaactttctccatcgatctatggcagagccaagggatttgtgggaccacagtccacgaggtga

SEQ ID NO: 17011 - DNA, 237 bp, Glycine max
  Peptide Sequence Number=SeqID_133789
atgacttccattggccctgtctttgcctactgcattggccccgtcattgtcctagatgctctggcccttgtctttgtccccaatgcactggccactgtctttgtccaagatgcactagagagagaattgagttgggaagagaacacacttcaagaaaatgttctcatttggaacagtgaaaagatgaagagattcaagagaaacaaagaaaatgctgtgggaactgcaaagaaatag

SEQ ID NO: 17012 - DNA, 969 bp, Glycine max
  Peptide Sequence Number=SeqID_133790
atgaaacaatcttggaattgcctgaatttgactgggctatgtgcacctcggtctgacgagcctgtcgtcgaagacggcaactggtggccggggaataggggctgtttggtgtgtcaagaacacacatgcgggagcggctgtgttcactttggggacgcatttggtgcagatgaaaagatcaggggaaggcacagctctgggtattggctgacccaatactcgctggaaaaatggctggcgaatggtggctgccaaaaaactactgacagccggcagcagaggtcggaaaagtcactggaaaagttgaaaaaattgccagaaaagtggggcctttgggcattaagacatatagaccctcaaagttctgccactgtgggtactgagtttttgaaaatgattccgacatttgatggaaaagaggcctatttttggtttgggcaatattttgaagccattagagcatatgaggaagagaagctatcagaggcagtgaaggctctaagaggtgatgctctcaactgggcaagaaacaaatataagaaagccacaagaattgggagaaacccaacaacatcctggacaaagaatcagaaaacagaactaaaaacgaaattcttgatatcaagaatcatggtggctgagatgacaaagatgggtctttttggggttgcgaagaggagaaagcatggaacatcatggaggaaaagaacataccattgtgaaccacaaccatcaacaaatctagagatcaagaaccatgatccaggtggtggagaaagaagcaatagtgaggaaacaaaagaaacagagaacaacaaccattttgataatggcagggacaaaaaaattgatcaattgagggagaagagatgtgactctgcagagaaagaggcgactgagaataagagaagcactgatttgaatatggaggaggaagaaactgattggccaataacagagagagaatga

SEQ ID NO: 17013 - DNA, 285 bp, Glycine max
  Peptide Sequence Number=SeqID_133791
atggagaagcaaactcagcttcatccagctctgttgaaggagttggatgttcctttttctactccaattctgctctatgataatcaaagtgctgttgctatagcacataatccagtcttccactctcagactaagcatattgctgtccaagcaactgtgtatcacattcctgctctggatcaatgggcagatgtactgaccaagccgctttctcctaatcgctttgagtttcttaggggtgaactcaatgtggaggatttcacttgtagaaatcctcccccttga

SEQ ID NO: 17014 - DNA, 762 bp, Glycine max
  Peptide Sequence Number=SeqID_133792
atgccagagaagaagaacaagaaagtttctttcaccgaagaagatgctgttacgctcatgcagaggtacgacgcaactacggtgttcactttacttcaggaagtggcgcattaccctcaccccaagattgattggtgcgagttggtgaagaaaagcgcgactgagatttctaacgccagagaatatcaaatgctatggcggcacttggcgtatcgccattctttgcctgaaattttcgaagatggggatgaacctttgcctcatttccaggatgatgatagtgacctagagtgtgagctagaagcatttccccctgtaagtgtggaatgtgcatcagaggctgctgcatgtgtgaaggtaatgattgcttctcgtacactgagtgaatctgcccctagtagctcaacaatagaggctccattgactataaatgttccagtttgccattcatctagaactcctattgaaaattcacagccctctaatttgatgcaagggacaagcattatttttccagttaccgttcagagacagacactgccaactatatcatcgacagatggtatagaaaccaagggaatagttggtggtaacatggcttccaaaagaaaaagaaaggcatggtcagaagaagaggacatgcagctacgagctgctgttcaaagatggggtgaagggaattgggcaaccatggcaaaaggagacgactttcctattaagagaagtgctacacagttggctcaggtggttttcaaatcctaa

SEQ ID NO: 17015 - DNA, 672 bp, Glycine max
  Peptide Sequence Number=SeqID_133793
atgggaccaccaaatcttcaaatacggaacacctacttcacgggaccaccaaatcttcaaagctttttacggaaggatatcaacagcaagaaaaggatagcaacgaaggatgcagaatcacaaaatcttcaggaaaaagtgtcttccgagatgattccagaagaaggttcttccgaaaagagtcttcgtggaagggcattttcgctcattcactgtttgctgggtgccccaacaatattgctgggtgcacgtagcaactcccaagacacatttgttgcaatctatttggaacaaacaactagttcgtgggacatgctaggtgcacccagcaatttagtgaatgggccatttttccatttatgtaaaaatttaaaaaagcgctactcctctcggaagaaccacgcgctccttcctgctgcttcttttcttcttcctgttcctggcacttcttcttctccgcgagacccgcgagcccggctgcttcgatcagacgcgttttgccttcgagacgccgaaaaaaatgggaaaagcggagtggttacggtggcgtgctccggaagaaccgtgaaggcatcttccgaaacttccgaaagaagggtcatccggaagaacctttcttccggaaatcttccggaagaagggttcttccggatgacctttgagtattcctga

SEQ ID NO: 17016 - DNA, 1501 bp, Glycine max
  Peptide Sequence Number=SeqID_133794
atgatgaaggggtttcagtttgcagggcttgataaagccaccatagggtgtaaaactcttgactgtgaaagtccctttggagcgaagcctaaccgacgtgtccttctaccgtctaatgttcctattcttgctcattccctagaacacacccaacgaaactggattgcttggtcaaattccccttctgatttaattatacaaattggtgattctagctttcacttgcacaagcttgcaattgcctcaagaagcgaatatttgaaccggcttgtatttcagaggggaagcaacagagaaaaagctggtgacagtctcatcatccaaattaaaaatctcccaggtggtaaaaaagcttttgaattaatagtcaaattctgttatggaagaaaaattgatataaccgcagcaaacattgttccattatattgtgctgcacatttcttggaaatgagtgaagatcttgaagaaggaaatctcatatccaagacagaagcatttctaacctttcaactactatcttcatggaaagacacatttcgaatacttaaaagcagtgaatccatttccccttgggccaaggacttgcatatagtgaaacgttgctctgaagcaatagcttggaaagtgttcacaaatctaaatgcatctagtttcacttttgaaaatgaaacacccttaagtaataatagtgttgataattggtggttcaaagatgtatcatgtctacgcatagatcattttattgaagtgattcaatcaattagaaaacgtggaaccaaaccagaacttgtaggttcttgcatagaacattggacaagaaaatggttttcccaagtcacatctggacttgataaggaaactcctatgcccataactctccagttacatagaatttcaactgagggcttgattaacatacttcctagtgaagaaaattcagtcacttgcaattttttgcttcacctactaaaggcaggggtgatgctgaagataaatccggagttgttgtgtgtgctagaaagaagggtagctttaatgttggagaaatgtcgtgtacctgatctcttggttaaaaatcaaggatacaaagattctttgtatgatgttagtgtggtacttagggtgttaaggttttatgtttgtggcatgtcaagcaattcttcagcaaaaccccacagtgttggaaggttagttgatgggtatctcacacaagttgcaagggatgagaatctcacaatggaaagtttcaaatcacttgttgaagcattgccacaaaaagctagacactgtgatgacaacctctatagagctattgacatgtaccttaaggcacatccaaatttggcagaagaaaatagaacagatgtttgtagagtcctagaataccatagattgtcacacgaagcacgtcagcatgtgatgcaaaacgatagattgcccttgaaattaaccacggaatttgtccttttagagcaagtgaacatggcaacctcaatgacaa

SEQ ID NO: 17017 - DNA, 1948 bp, Glycine max
  Peptide Sequence Number=SeqID_133795
atggggaaagcagtaagcattgatgagattcccgatgagtgtttgggttgtattttccagttattttcccccggcgagcgcaagatgttctccctcgtatgtagccgctggctgaagatcgaaggacagacctatcagcgtctgtccctgaccgcggatggtctactgtcaatcccatgtactttctctcgcttttcttccctcaccgaactcactctaataaattcccttagtaagagcattggggacgaagctctcaccctccttactcaccgctgctgccctaatctcaccttcttcactctccactcttctattcactcagacgcttgcttggagaatttcgccatgaaccacaagggtttgaagaagttttcggccgtgtcttgcattttcacatacaaaggcttgaaagcattcatggatcattgcgtctctctggaagaactccgcctcaagtatcttaactcaaaccccaatattgccaacgccgacgaggatgggtttgtaacgtcgtcatcgctcaaagccctttatttggagggcgttgatttttctatcttaaaagcgatttcaaaacgttccagcttagaagttttgcatcttgagatgattggcatgtgcagtgacgaaggacttgttgcagttttggagggttgcaaccttttaagagaacttcgtatccgtagaagctattgttgggaggccaaccttatgggtgataaagttttgatagccattgttgaatgttgtcctaaccttcaggagttggttctcgatgggttgaatcccagcaccaaagcgagtttggaaatgttggcattcaaatgccggagtataggccgattggcgttgcgcggaaaaagctcgattagctatagcgacttagcttccatattggccaaactgtttcagtccgatggatacatgcaatctgcagacgctatgggttttttcggtgtgaggaaggaattgcaatattccaacataatcaccagaattgacgacatccccgacaactgcttggcttctattttccagttatttccccctgtcgaccacaagaacttctccctcgtttgtcgccgctgcctcaaggttcaaggacagacccatcaccgtctctgcctcacccttccctactcaaaattcctcgcatctatttttactcgtttcgattccgttaccgaactcactctccaatgtcttaatctcatgagcatgtgcgatggaaatctagtcgtcatttcagacctctgccctaatctctcgtacgttggcttggaggtcttagccaggagttgcgagcgtttaaagaagttctcttgtacatcttgcacttttggactcaacgccattgacgcactcatacatcattgcagttctctggaagaactctccatggagcattcaagtgtcaaaaccgacggagctgaatttgtaaatttctatcctttaattcgcgccaagaatttgactactgtgaagattgttcagtcctctgttgaggagtactgggataggttttttcattcgttggcaagccaggtcacgagcttgctggaagttcgcctcgatgggttcggagttagcgataatggtttgaaagcaatttcaaaatttcctaatttagaaactcttcatctcgtgaagacccctaagtgcaccgacgcagggctcgttgaagttgcggagggatgcaacaagagtttaagaaaacttggtattgaagagtcccttcaaaagggccccaacaaaataggtaacaatggtttgagagcagttgctaagtgttgtgctaatcttcaagaattggttctcattggtatgaatccaagcaaagcgaatttggaaattttggtatccaattgccagagtctaaagcatttggggttgtggggaagcaataagtttggcgacactgagatacgctgcattgcgggaaaat

SEQ ID NO: 17018 - DNA, 2076 bp, Glycine max
  Peptide Sequence Number=SeqID_133796
atgcacggtcggcctcgcaaagcgttgaagcaagaagatgaagccgcttcagcagccaaagctgaaaagcttcgttcactccaagctcagttcctcgccaatcaccacaatcacatttatagcaaggaagcgttagatgtgagcgcgaagcttctagaagtgaatccagagtgctacacagcttggaattacagaaagctcgccgttcaacatcttctctctaactccgattccgatcctcactctatcttcgatgacgagctcaaactcgtggagattgcgctgaggaagaatttcaagtcttacggcgcgtggcatcatagaaaatgggtactcagcaaggggcattcgtccatagacaacgaaatgcgccttctgaatggttttcagaagatggatcctcggaattttcacgcctggaattaccgaaggtttgttgctgaactgatgaaacgatcggatgaggatgagttgaaatacacagaggaagtgatagggactaatttcagtaattactctgcttggcacaatcgtagtgtgcttttgtctaatttgctgaaaagaaaggctgaaggatatttccctaaagaaaaagttttggaaggggagtttgagcatgtccacaatgctatttttaccgatccagatgatcagagtggctggttttatcatctttggcttattgatcaaacagtgaaaactgatgctcctctacttgtttcgtcttggccttcacatggatctaatataactctaattggggacaacgaccttcgtggttgtggtttgtctctgctgaatggtacactatcagacactgaaacacttccaatcattctttatttcaatcaagctgtcgaaggaataaactcatccacagtggctattaaatctgaacttttaaaggaggaacttgtttggaaaccactttcaatgaaaattttaaatactgcacaggtttgggttgtatatctaaaccttggaaatatggagcttcaaccatcaaaaacttactctgtagagatcaatattggacattctaagggtgttgtatcttcaaatggaaatcactatggtgatccttcccaaatttcctttgaagtgtttgtacagactgcctctactgaacctactgaaggacagggtgggaaaaggactacatggaaggatacaaatttccaaaaaattgatcattttcaggaatcagattccattcttcctgctgatcaaaatccccatattccgacaacttccaattggtgcactgaggaaattggtgaagaaataactaaatttcaggacttattgtccgagtatgattgtaaaattggaaaacttacacttgctagacttttgactgctcttgacttgttatcatctcaacatgatggaagaaaatctaacaccgaagaagttcttcaactttacacggatctgatgaagttggatccaacacattctctttactacaaagacgagcatagtctaatatcactaaagcggataacttcaactagggactctttactaccatactgccactactataaagatgcaacagaaacaatcactggttatttttgtctaaaattacaaaatctatcattatcacggatgggatccattgagaatttattgtgggtgcaaatgctagaccttagccacaacgaacttcaatccatcgaagggttggaggccatgcaacttctatcttgcttaaatctgagtcataataaatttggtagttttactgctttggggcctgtgagattgcttaagtcacttaaagtgttgaatatttcatacaatgagttaggctctcactcgattgacaccacgagatacttatgctcttctcctgtatcacatactgaagaatttgcctgggaccgttttgaaatcctcactggcagcattaatgccacaaaattttgggaagctttcttgatatttggaagcttgacattgacagagttaaacataacagggaatgcagtagctgatgagaacttcaggtcatttctcgttaaagttttgccaacactcaggtggctagatgatgaagaattatcttga

SEQ ID NO: 17019 - DNA, 540 bp, Glycine max
  Peptide Sequence Number=SeqID_133797
atggacgtgacagcaactgttgacaacatccccgacgagtgcttgggttccattttccggttacttcccaccgccgacgaccgcaataactgctccctccctcatcttgtattttttggacccaacatcgttgacgccctcatacatcatttcggcgctctagaagaactctccatggagcattctcatgtcacaaccgacagagctggatttgttcattcctattcttcaattcacgcaaagaatttgactatcttgaagattgttcagtgcttcgctgcggagtacagctgggataggttttttcattcgttggcgatacaaaatgttacgagcttggtggaagtccaccacctcgatagcgtcaaaattagcgattttggtttgatagctatttcaaaattttcgaatttagaaattcttcatctcgtgaggacccctaattgccctgacgcagtactcgttgaagttgaggagggatgcaacaagagtttacgaaaacttatattgtgtcatttgggaggtggccccacaaaatag

SEQ ID NO: 17020 - DNA, 1032 bp, Glycine max
  Peptide Sequence Number=SeqID_133798
atggcttcaccagtcaaccaaagtggaaagggaaaagagaaggtccagcagactctcagaaccatttgcacttctcctaattcttccactccttccaagtgggtatatgctgtcttctggaggatattacctcgaaactttcctccaccgaggtgggaattaggaggaactgctcttgatctctccaaaggaaataaaaggaactggatccttgtctgggaagatgggttctgcgattttaacgaatgcgagcaaaggaagagtggtagtggttacttgaacggtagatttggagctgagttattcttcaagatgtcgcatgaggtttacaattatggagagggactcgtggggaaagttgccgcagataatagtcacaaatgggtttacaatgagagtcacaacgagtgtgagtctagctatgttgcttcatggaatgcttcagtcgaacctcaaccaaaggcgtgggagtttcagttcaattcaggcattcagagtatagtcataatcgccgtcagagaaggcgtagtgcaattgggttctttcaacaagatagcagaggacctgaatctggtgatcagcatacaaaggcaattcagctaccttcaaagcatacctggtgtgtttggtattcaaagaccatacttacgactccaacacccatacattgtgaagcctagtttcatagcaagcaatgcaatgcctctatatgatatggggtggaacaccccacagaatggagcaccaggcccatctctttgttcaggttctccttctctaccattaccaaccatgccttgcaattttggagctttgctatcaaagttaccatctggaatcccttcccataattccactcaagtccctaatgcagggacacaaagcatcattgagagagtgaagattgaagattgtgaatttcatcccacccatgatgatgatcacaaagtaaagtcactcgtgatggatgatcctatgatggtgaaggaaggatggggttggagattagaataccgtggtggggatggatga

SEQ ID NO: 17021 - DNA, 807 bp, Glycine max
  Peptide Sequence Number=SeqID_133799
atggtgaatcgaagtaggttgagtatatcatcgggtgttccattgatgttcacttggttcaaatgtggaggattatctgtgggattaagctgggctcacgttcttggagatgccttttctgcatttaacttcatctccaagtggagtcaaatactatcaggtcaagccccaccaaaatctcttcacacgccaaatctccctcaacccaaaacctcacctaattccattgttgagaaccctctaatttccattaaaaagacaaatattgtaggagagtattggctcgctactaatgacaacgatgtggctacttactcttttcacatcacttccaaaaaacttcaccatttgtgcatagcaaacataaggggccaacattttggaccaaatgttgtgaccatatgtactagtgaatctaatcgtgcagaaaatgaattccccaccaatggcttcttagtgttaagcaaagttgaagcagatttttcaactgggaaatttgaaatttccgaattggtaaagctgattgctgagaacaagatggttgagaaccatgtaatggaagaattggtggagggagatgaagggagagaggattttatagcttatggggtaaacttgacgtttgtgaatttggaagaagctaatatttatgatggggtgaagctaaatgaacagaaaccaattatggcaaattgtacatttcgtggggtgagtgatcaaggggttgttttggttaagcaccagaagttaaggaacatgatggtaatggaaggattgttacagtttctttacctcatgaagaactag

SEQ ID NO: 17022 - DNA, 573 bp, Glycine max
  Peptide Sequence Number=SeqID_133800
atggtgtgtactctggaagcaatgccagaatctgcgccgctctcgttctatttaagtggatgggacgcgtttctttcggatgacctagcctcttctggccaaatcattgcaacggcgtcaacatccgcaaccacctttgcagatctaaaggtgcaccgaccacaactgccaacattcgcaaccgcgaactcgtccgcgacgctagcaggccgctcctgctcgccgatggtggtgctatccagatctgagagagggagaatcgttgtcgttcatcgccgcgatggtgcttgttgtggattcgcggttagtggcttgcggtggttggttggcggtggattttctggtacttcgtggtggttccgccgtggccgtggtttcactgctgttatcgccctacttgggttccttcgcctcgccgttctggttgttacagtggtgtccgcggcggtggcggctcttggtggagacgacgaggataacactttgttgaatgacaaagacgttacagagatgctcaactattatgaaggtgaaaaaagagccaataatgtgttcttagttgactttgtgtga

SEQ ID NO: 17023 - DNA, 1995 bp, Glycine max
  Peptide Sequence Number=SeqID_133801
atgaatccgtatctgtgggtgatgtgcaatgatgtggaggaaggtagaagaatacctactttgatggcgctaaaagcggttgagcccagcgacacttgtatggaggtggtgcttgttgatagacgcgaggattctcgcttgaagctgcttcaggataaagcgcaagagttgtattgtgcttctgagaacacgttgctgttggtggaacaactagggaaacttgttgctatttatatggggggtatgttcccggttgagcaaggggatcttcacaagcgctggaagttggttagtaagaagttgagaaattttcacaagtgtgttgtgcttcccattggcagcctgtctagtgggctttgtaggcatcgggctgttctttttaagagattggcagattatattgggttgccctgtcgcatagctcgaggttgcaagtactgtgttgcagatcatagatcttcttgcctagtcaaaattaaagatgacaagcagctctcaagggaatatgtggttgacctagttggggaaccaggaaatgtccatgggccagattcctcaattaatggagcatatgtttcttcaatgccttccccgtttcaaatttctcatttaaaagaatcacaatcaccctatatggatgacacagcaagttctataagttccaatcacagacctgttaatcctgaaagtcttccatattcaggctctgaacagaatgatcaacaacttaatgaaactgatttgctgaaaagtcacaagggctccatttatgcttcagttgatcaaatctgtgaaggaacagaaccatctctaattccttttggtttagaagggaatgatgaggaatgtgcagttcttagttcagttttgcctaccatccatgaagatgtttcaaaatctcttcatccagccattgaagcatcattacatgaatatccaaggcttagtgaagatgtagtgcaagaaacttcccacaacgagataattgtaaatggaagttctgtggtgaaaagtactttccagcaatctatgcttggttcatcctgccagtcagaactgaaacaggtaggcattagaattgaaaaccagggttgtttacctgctgctgggaatattccaagatatgtaaatcttgaaccgtcacttgcaatggattggcttgagatatcatgggatgatttaagaattaaagagcgtgttggtgctggctcatttgggacagtgtaccgtgctgaatggcatggatcagatgttgcagtcaaggttttaacagttcaggatttccatgatgatcagttgaaggaatttctgagagaggttgcaataatgaaacgagttcgtcatccaaatgtggtgctctttatggggtctgttacaaaacgcccccatctatcaatagtgacagagtatttgcctaggggtagtttataccgcctgatacacagaccagcatctggtgaaattctggataagaggaggagattacggatggctttggatgtggctaaaggaatcaattatctccactgtctgaaacctccaattgtgcactgggatctcaaatccccaaacttgctagtggataaaaattggactgcgaaggtttgtgattttggattgtccaggtttaaggcaaacactttcataccgtccaaatctgttgctggaacacctgagtggatggctccagaatttcttcgcggtgaaccctccaatgagaaatctgacgtattcagttttggagttatcctgtgggaacttgtgaccatgcaacaaccatggaatggacttagccctgcccaggtggttggagctgttgctttccagaataggaggcttgctatccctccaaacatctccccggctttggcctccctcatggaatcttgttgggcagatgaccctagtgaacgcccatcttttggtagcatagtggactcactaaagaagctggtaaaatctccagcagaggtgataaagatggcggattcatag

SEQ ID NO: 17024 - DNA, 2187 bp, Glycine max
  Peptide Sequence Number=SeqID_133802
atgccgattcatccgcacttattactcttgctactactgctgcttgcgtcctcaaacgcccactgctccaaactccccaccttagttttcaccgacgcaaccgctctcctcgccttcaaactaaaagccgacgtcaacgaccaccttcacttctcccccctcacgcgcggcctccgcttctgcgcgtggcaaggcgtggaatgcaacggccccaaagtggtccgtctcgttctccaaaacttagatctcggaggcgcgtgggctcccaacacactctcgcgtctcgaccagctccgcgtcctcagcttgcagaacaactcactcaccggacccttacctgacctcaccggtctcttcaatctcaaaagcctcttcctcgataacaactacttcaccggttctctccctccctcactcttctctctccaccgtctccgaaacttggatttctcccacaacaacttctccggacctatctccgccgcgttcacctccctagaccgcctccacagcctccgtttaagcttcaactcttttaacggttcaatccctccgtttaaccagtcctccctaaaagtcttcgaagtctccggcaacaacctctccggcgcggttccagtgactccgaccctgttccgttttccgccttcctccttcgccttcaaccctagcctctgcggcgaaatcatccgcgtgcaatgccgtcccgcacagcctttcttcggacccgcggcgccgcccacggcggcgctcggccagagcgcgcaggtgcacggcgtcaacggcataatccggcagccgtacgagaagaagcgccacgaccggagggcgctgattattggcttctcggccggaatattcgttctggtttgctcgctggtgtgcttcgcggcggcggtgaggaagcagaggagccggagcaagaaggacgggaggtcggggattatggcggcggatgaggcggcgacggcggaggctgcggcggtgatgcggatggagatggagagggagctggaggagaaagtaaagagagcggaggtggcgaagagtgggagtttagtattctgtgcgggtgaggcgcaggtgtatacgctggaccagctcatgaagggttcagctgaacttttagggagagggtgtttgggaaccacttataaggcggttcttgatagccgtctgatggtgacggtgaagcgccttgatgcggggaaaatggcttcgcatgcaactaaggaagtgttcgagcgacacatggaatccgttggtggccttcgacaccccaatttggttcctcttagggcttatttccaggccaagcacgagaggctcataatctacgactttcagcccaatggcagcctcttctccctcatacacggttcgagatcaagcagggcaaggccattgcattggacatcgtgcttaaaaatagcagaggacgtagcacaaggtctggccttcatccaccaggcatggagactggtccatggcaatctcaagtcctccaatgttctccttggaccagattttgaggcatgcattacagattactgcctttctgtgttgacacacccatccatatttgatgaagatggggattcagcagcatacagagctccggagactcgcaaccccaatcatcacccaacccacaaatccgatgtttatgcgtatgggattttgttgcttgagcttctgacggggaaatttccctccgagctcccattcatggttcctggtgacatgtcaagttgggtgaggtccatcagggatgacaatgggagcgaagataaccaaatggacatgcttcttcaggtggctacaacttgtagcttgacctcaccggagcagaggccaactatgtggcaggtcttgaagatgttgcaggaaatcaaagagattgtactattggaggatagtagtgaattggacatacgcagtagtttgggagagcgcataacgtcccttttttgggctttgtatatcgctgcttgggttgggaagtttaaagaaaatattgtcattcttggttgtttaaactttattcagcttttgttgtttagtgctgaaagctatcggctgtggggcggtcaagtagccagagaaattcactgcatcccattttcgtcaagtgtacagctagctgagcgtgtcactacagaattctgcatccgggctaacgagtaa

SEQ ID NO: 17025 - DNA, 267 bp, Glycine max
  Peptide Sequence Number=SeqID_133803
atggcttccaggagaccgggtttaattgctttgtttgatgttgacgggactcttacagctcccaggaaggtgtctcgccaatgggagaggcgagaccctatgttgccaatggaggaagcgggtcccttcacgctagccagtatcgctagtgcgactgacggcaccctcccacgtcagcactgtatcgctgttgacaatgatcactcatactttctcgctattatcattgacgggttccatacaaaagtaacccctttgcataaatag

SEQ ID NO: 17026 - DNA, 2628 bp, Glycine max
  Peptide Sequence Number=SeqID_133804
atggatcttttgtctctgcaagaatgcttgcaatttggcaagaccactaatcacttttgctatgaagcttccagcaatttacttgctggtaccaatccattattaaaaagttttgcctcaaactgctgttattgtttattctgctggaggtctattacttattcttcttcttttatgtgtccaactagtcgatctcatgccatcttcacgatcacattagagcaaatgcgcaagctcaatattcctggtgacagctgttcaaatgataccatgaatgaagagtatctttgtgccaagttgcacttagtagatcttgctggatcagaacgagctaaaagaacggggtcagatggtctgcgttttaaggaaggagttcacattaacaaaggcctcctagcacttggtaatgttattagtgcacttggtgatgaaaagaagcgaaaggaaggtgttcatgttccatatagggatagtaaacttactaggcttttgcaggattcactaggaggtaacagcagaactttcatgatagcctgcataagtcctgctgatattaatgctgaggaaacccttaacactttgaagtatgcaaaccgtgcacgcaacataaaaaataagcctgttatcaatagagaccccatgtccaatgagatgctaaaaatgcgacaacaacttgagtatttgcaggcagaactttgtgctcgtgctggcggctcttctgaggaagttcaggtccttaaggaaagaattgcttggcttgaagctgctaatgaagatctttgccgtgaacttcatgaataccgtagtagatgctctattgtagaacaaagtgaaagggaagcttatgatggtagcacatacattgtgaagactgatgcagttaagaggagcttacctatcacagaagctgaatatccaataagtgaaaccgtgggtgattctagggaaattgaagaagtggcaaaagagtgggagcacacacttctacagaatagtatggatagagagttacatgaattgaataaacgcttgcagcagaaagagtctgagatgaagctttttggaatatctgatgctgaagtactcaagcagcactttggaagaaagataacggaattagaggatgagaagagagtagttcagcgagagagagattgtcttttggctgaagttgaaaatcttgctgccaatactgatggacatacacagaaattagaggatatccatgcccaaaaattgaaagcacttgaagcacagaagaagcaagagagtcaggtccaacttctgaagcaaaagcaaaaaagtgatgaagcagcaaagagactgcaagatgaaatacagtgtataaaggcccaaaaggttcaattgcagcaaaggataaaacaagaagccgaacagtttcggcagtggaaggcttcaagagagaaagagctgttgcaagttcttcagagaaaaactgaagaagctgcaatggccaccaagaggttaaaggagttgttagaagcacgtaaaacttccagccgagaaactttagttacaatgaatggaagtggaacaaatggtcagagcaatgagaaatctttacaacggtggcttgatcatgaactagaagtcatggtaaaagagcatgaagttcgttttgagtatgagaaacaaagccaagtgcgagctgcccttgcagaggaattggccatgctgaagcaagtaaatgagtttgctgcaaagggtcgcggtcctccaagaaagaatggatttgccagggcatcctccatgtcaccaaatgcaagaatggccagaatagcttcacttgagaacatgctgagcatatcatctaattcacttgtagcaatggcttctcaactttctgaggcagaagaaagagaacgagccttctctaatcgtggacgctggaatcagttgcgctctatgggagaagccaagaatttgcttcaatatatgtttaattctgttgcagatgctaggtgccaactctgggagaaggacatggagatcagggaaatgaaagatcaaatcaaagaacttgttggtctcttacggcaaagcgagatgaagagaaaggaagttgagaaggagctaaaagtaagagagcaagctgttggaaccacattggctacaccaccatctaatcagatccaggcacctgatcaagttgaagaaaaaaatattagtcttgtaggagtagaagaaattaacctcggcagggcacctaagggagactccccaaatccatcgaaacaatatgctgaagacatgaaggggctcttatcaccagtgtctatgccagtgcctaaacagctaaaatacacgccaggggttgccaatggtttggtgagagaatcagcagcatttgtagatcagggtagaaggatggtacccatcggacagttgtcaatgaaaaaactagcaattgtaggacaagcttctggaaagttatggaggtggaaaagaagtcatcatcagtggttactacagttcaagtggaagtggcagaaaccatggagactttcagaatggatacgacacagtgatgagacaatcatgagaacaaaaccacgctcacaggctttgtcacgtatcagggcactaggagcaggtaataagcagtaa

SEQ ID NO: 17027 - DNA, 1110 bp, Glycine max
  Peptide Sequence Number=SeqID_133805
atgactagcgaggtccatgatgagctaaaggcactgtccaagtttcagtccaagctgcagcttgacaagctcttcgattggttttggacttctgccgatagtgtcatcgcggaagtctacatcgacttcatcatcttaattccccctcgttgtttcgtaaacgaccagggtctttattgggggctcttcgtctatactcatgacttgactgtcgcagccaccagagacttcgagcctttgaaatgtcttccaataaagtatatacgtgaaactcccttggttgataaggaccttggacaccatgaaattagtgatgactatggagatgaccatggggtcatcctggttgatgaggttgatgcctttgaaatctctgtcgttgacgtcaatatctctgatggcgtggaaatgatgcttttgggactggctggaaaaccctccataagaaaatccgctcgcaatgtgacgcctttgtcttcctctatcctctgttcagtcccttcttctatcagtatctcggctcctagaatggttgtcctgggcccaacagtcttcagtattttggccatggttgcgatggatctacagtgcttggttctgtccaattcgggtctgggggagctcgtccatgttgttataaggttttttgcaccaaatatcagtaaacttgttaggtcgcaaggccaacaacatgaagtccaaggttgcagatgtaatgcgatgcgattagctagtcgcatactgggaactaaagcattcgacaagggtgtcaaagttgacgatggattggggagggagccatccataccacatcaatgttacccccttaagggatgtgggaaagactcgatacaggatcacgtcgtcgttggtgtaaagattaacctgaatgaggagtgcatccagatgttcgtctgtcgtccgtccttcttgacaatcatcttacatgagcctccaactctttgtggtcggccttcaattttctcaattcctcttcatagcggtgttccatctttgcgatgcgggccaaagtgtgtgctaaccatgaatgcaggtggctacggggtgttaccacggtgggctcctcaatctctcatatgggatttacag

SEQ ID NO: 17028 - DNA, 939 bp, Glycine max
  Peptide Sequence Number=SeqID_133806
atggacagtgcatccaataagaagagaaatgaggtaggtatcattctagaggcgcccaacaacgttgccttgaaatactatcatgccgtaaagatctttgttgaggattttgattgtttcgagatgtaccacataccaagggaaagcaatactagggtcgacttgctctctaagttggcaagcactaagaagactagacgcctcaagaccatcatccaggaggcactccaagcaccaaccatagataccaaagagggcatggcagaagaaaaggaagaacaaattggaggacccaggggagggttgacaacacctttgcttaaatgcctaaacaaccaacaagcacactatgtcatgcaagagttgcatgagggaatctgtgaccttcatatcggaggatgctccttggcaactaagatagtgcacaccgactactattggccgacactcaaggtagatgccctcgacttcacgaggaggatggacatactaggaccattgccaaaagcttcaggacaagtcaagttcttattggtcgccattgactatttcactaagtggatcgagacaatgccattgcaagaaatttcagccagcaaggtggggaccgcaaatagggttatccttaaagccctatgcacaagactcgacaagtataagggtctatggaaggaggaactccccaacatattttgggcttatcactgttcacttggacgtgaagaggaggaaggcattgttgaagctcgtcaaggcactgtcatcatcacaccaacacttagcaatgacatcatagtagaagaacgagaaacaaaaacaagaactgacaaggaagttgatgcaactagagaagtggaagaaggggtaggaatttcctcaatatatggagaaggaggcaaagaagaattagaaacattcgtggaagcaacaacaacttga

SEQ ID NO: 17029 - DNA, 516 bp, Glycine max
  Peptide Sequence Number=SeqID_133807
atggttgtaaagtctcacagcgtggccaaacatgtaattgatttggaagaaatgtttggagagatatgcaagtatgacatgtgccttaatcctgagaaatgcacctttggggttggcggaggaaagttcttgggcttcatgatcacccatagtggaatcgaagccaaccctgacaagtgtaaggtgatactagagatgcatagtcctaccaatgttatagaagtccaaaaactgaatggtagactagcgtctttgtccaggccattctacaagctattttggaaaactgagctattcctatgggaggaggcatgtgagcaagccttcttagcctttaagaaaactattgccacatcgtcagtcctaagtcgaccaatgccaggagcacccctgctcctttatcttttagtagctgaagaggctataagctcagccctcgtccaggaagatggaaagcatcaaatacctatctatttcattattcatgtccttcatgatgctaagaagcgatactag

SEQ ID NO: 17030 - DNA, 1107 bp, Glycine max
  Peptide Sequence Number=SeqID_133808
atgggtgcaagcgattctgggggctccatccatcaaaccttggtggaatgggaggtcattccaataggcaactcctcgtcggaggaggtacgccatgaagcttccaacagtgggtcttcctccttcgagaggttgatggacctgtgccatgccgacgagggtagctctcgaccttgtgagagggtaaggccttctactgctcctctagacaaaaaacctatccttgtcactataattcttccttcttcccttttggtggcaacgggaaagagtgatgatggtgacgttagggtttcgccccataacaagcgtagccataatgccggaacgccctcatctcattccttcattgttggttacgaatgggtgaaggacgatgtcctgaagtactgctcttcgataacgtcctctataggcgtcggggctctatggtgccaattggggattgctaaagtgggcgactcccacaagatgactatccaagcttgtgggaaggatgaattttcattcctacacgctgctttcgactgtccacccttcttctatgtctatcgttgcctgttcaaggttttgaatctgaccttttcattgaacaccttccaatgtgccctattgaggtgccttatccacttcatcccaacaactgggcaatgctggcaaggaagattggttggttggatgtcgcttaatagtgtgtacaagaagatgttcgagtttgactcgagcgtgttttgtagatttaaggaccatttcttcaagttgaaccccacaaggttcaaatcctttgatgagcatttgatgtccatagaggagagggcgaacaaggatattttggagcgattgccagtcttgttggacgcacaagccatcctatccctaccttcgtcaagtgaccctcttattgttttggatggtaaagcgttttgtctttccctttttcatgttagtactgctggtgatgacatgcctcctgcccctgttatcattcctgagtcctcaggtggggaaagaggtcaagttagagttgatcttcctcaagcttctgaagccggtgaggatgaattttttgacgttacacttgacatgcttccaccttccgtgacctag

SEQ ID NO: 17031 - DNA, 400 bp, Glycine max
  Peptide Sequence Number=SeqID_133809
atgaacagactccagcggcaacaaagataccaagatagttggagtggtggaggtgtcattgttggtggtggcgatgtcgatgatggtagcaatagaggtgttggtggtgacgaagatgatattagtggtggtggtagtggtgacgatggcaacagaggtggtaacaatgacgataatggggtgatactggtgttggtgatggcaacaagtgatgatcatggtggttgggacaaggttggtggtggttgtaatagcagtgatggaggtggtattgttcgtaatggtggtgacaatgacagtagtcatgatgatggcattaatggtgttggcgatgacaataacggtgccagtggtggtaccaccaatgctggtgatgatggtgatatcagtagaaccagtg

SEQ ID NO: 17032 - DNA, 807 bp, Glycine max
  Peptide Sequence Number=SeqID_133810
atgaggctgcttcatgttttcatcaagcaatttgtaattgcctacaaggattgggaacctgtgaattcaggcatattattggagtctacttctgttgagagtttatcatctgccgatgatgtggttgttggctgctcagctggacatcctgttgaagtcattcgggtattaattgaagaggtcacacagttaagctcactagttactgagttgaacaccgacatggggcaatcctcaacagatttatctggggcttctgcaaaattgtttatcacttctgaaggattttttattttggatgcactgaaaattatcactcgttcattatataattgcagagtttttggatactatggtggaattcaaaaacttacagccttaatgaaaggggctgttgttgaacttaaaaccataagtggtgccctttctgctgatgaaagttcaaatatagacaaaaaggatgagttattctgcagtcttgtaggctttatttcacatgctgatgctccaatcatctcttcaaatagttcaaaggttttgtctactgaagcaaggttacattggcgtcagaaagcaattgtttctgtgatggaagctggtggcctaaattggttagtaggtaagagaaagatgtcaacggtggaaattggcacagctcttccaaattccgattcttcaaatcacggagaaacacaaaaacaaaagcttgagcgtttctgtttcttttttgatacagttgttaaaaagagagaagagagcgaaagtagggggagggataattgggttgggggagggatacatgggtga

SEQ ID NO: 17033 - DNA, 413 bp, Glycine max
  Peptide Sequence Number=SeqID_133811
ccgatcaggacggtgtcgaggacactgtctgtgacaaatacggcatcaacaaggaaaagtgggcccagttttgccagactcgcagagacccttcttgggaggatgtgcgcatgaaggcacaggccatccagaagcagaatactgccccccacgttttgtctcgtgggggttatgattatttggagcagaagctcctggctgagaagaccaagaagaagatgcaggaagctgcacagtcaggaagcgttgatggtgtcatcgacccttcatccccgatcagacaccacgtgaagtggaagatggcccgcacgaagaagacaggggagatgacgactgaggccgcaaaggaaatcgctgagaagattgatttgtttaaggagcaggccacacagggatcgttctatgaacactag

SEQ ID NO: 17034 - DNA, 3474 bp, Glycine max
  Peptide Sequence Number=SeqID_133812
atggcattagaatgcgttggtggtgctgttctttcttctttcctcggggctctatttcagaagctggcttctcctcaagttctggatttctttcgtggaacaaagatcgaccagatgctgcggaaggacttagaaaacaagctcctctccatccaagctgtgcttgatgatgctgaacaaaaacagtttggaaatatgccagtgagagactggcttattaagctcaaagttgccatgcttgacgttgaagatgtcttggatgaaatacaacactccagactccaagtgcaacctcaatctgaatctcaaacctgtacttgcaaggtacccaatttcttcaaatcttcccctgttacttcctttaacaaggaaatcaattccagcatgaaaaatgtccttgatgacctagatgatcttgcaagccggatggataatctaggcttgaaaaagcctagtgatcttgtagttggatcaggatctggtggtaaagtgccacaatcaacatctttggtggtagaaagtgatatttgtggcagagatggtgataaagaaattatcattaactggctcacttctaacactgataacaagccgtcaatactttctatcgtgggcatgggcgggttgggtaagaccacgcttgcccaacttgtatacaatgacccaagaatagtgagtaagtttgatgtcaaagcttggatctgtgtttcagaggaatttgatgttttcaacgtatcaagagcaattcttgacacgattactgattcgactgatcatggtagagagctagaaatagttcagagaagactaaaagaaaaattggcagataaaaaatttctcctcgttttggatgacgtttggaacgaaagcaggcctaaatgggaagctgtgcagaatgctcttgtttgtggagctcagggaagtaggatccttgtcacaacacgcagtgaggaagttgcttctaccatgcggtcagaaaaacacatgctggggcaattacaagaagatgattgctggcaattgttcgctaaacatgcattcagagatgataatcttccacgagatccagtatgcacagatattggtatgaagattgttaaaaaatgtaaaagacttcctctggccttgaagtcaatgggaagtctattacacaacaaaccatctgcctgggaatgggaaagcgtgttgaaaagccaaatatgggaattaaaggacagtgatattcttcctgctttagcattgagctatcatcaccttcctccccatctcaggacatgctttgcttactgtgctttattccccaaggattatgagtttgacagggagtgtttaattcagttgtggatggctgaaaatttcctaaactgccatcaatgcagtacgagtccagaggaagttggccaacagtacttcaatgatctactatcaaggtccttctttcaacaatcaagcatatataaaaaaggatttgtcatgcatgaccttctaaatgatttggcaaaatatgtttgtggggacatctatttcaggttgagagttgatcaagcagaatgctggagcctggatgaatatcacacgagttggaattgcaagatgtcgatacatgaattgttctccaagttaaagttcttacacgtcttatctctgtctcactgtttagacattgaagagctgcctgactctgtttgcaattttaaacatcttcgttcgttagacctttcccatactggcattaaaaaactacctgaatccacatgttcactctacaacttgcaaatactgaagctgaattattgtagatctttgaaggagctgccctcaaatttgcatgaactcaccaatttgcatcgccttgaatttgtaaatactgaaattataaaggtgccaccgcatctgggaaagttgaagaatcttcaagtatccatgagttcttttaatgttggcaaacgtagtgagttcaccattcagaaattcggagagctcaatcttcttcacgaaatattatcatttagggagctgcagaatattgagaatccctcagatgcattagctgcagatttgaaaaataaaacacgccttgtggaactagagtttaaatggaatttgcaccggaaccctgatgattctgccaaagaaagggatgtaattgtaattgagaatctacaaccttccaaacacttagagaagttgtcaatcaggaactatggtggtaaacaattcccaaattggttatccgataattctttatcaaatgtggtgtccttagagttgaacaactgtcaatcttgccaacatttgccttcccttggacttttgccatttctcaagaaccttgggatttcaagtcttgatgggatagtgagcattggtgctgattttcatggtaatagctcctcttcatttccatcgttggaaagattgaagttctacgatatggaagcatgggaaaaatgggaatgtgaagctgtgacaggtgcttttccatgtcttcaatatcttgatataagcaaatgtcccaagctgaaaggtgacctcccagagcaacttcttcctttaaggaggctaggaattagaaagtgcaaacaacttgaggcttcagctcccagggctctagaactagaactacaagactttggaaagctgcaacttgactgggctactttgaaaaagctcagcatgggcggacacagcatggaagcattgttgctggaaaagtctgatactttggaagaactggaaattttttgttgccctctgctatctgaaatgtttgtaatattttgcaattgtagaatgagggattatggctgtgactctctaaagacttttccgctagatttcttcccaacactcaggacccttcatcttagtggctttcgtaatctacggatgattacacaggatcacacccataatcatctcgaatttctgaaaatcagaaagtgccctcaattagaatcactgcctggaagcatgcatatgcagcttccatctctgaaggagctacgaatagatgattgtcctagagttgagtcgttccctgaaggaggtttgccatcaaatctaaaagagatgcgactctataaatgctcgtccggactcatggcgtcactgaaaggggctttgggagacaatccctctctggaaaccttgtcgataagagagcaggatgcggaatcttttcctgatgaaggtttgctgccactctctcttacttgtctaaccatcagtggttttcgaaatctaaaaaaactggactacaaggggctctgtcagctctcctctctcaagaaattgattcttgaaaactgtcccaacctccaacagctaccagaggagggtcttcccggatccatttcatattttacaattggttattcctgccccaaactcaagcagcgttgccagaacccaggaggcgaagactggccaaagattgctcacattccaaccctgcatattagtacagggtga

SEQ ID NO: 17035 - DNA, 846 bp, Glycine max
  Peptide Sequence Number=SeqID_133813
atggaagatgacgcagcgattgaggtgaggaaccatgtttccccagaaccagagccagagtcggaggaggattccagttgttgttgcccaatctgcttgggaccattccttcaactttcctacctcgacaaatgttttcataagttttgcttcaattgcattttacgctggaccaaggtggttgctggcaagcaccgttctccaccttcttctgtaaaatgccccctctgtaagactgaaaatttttctatcatatatggagttgatgggagttgttttcaacgacattatgtaaatcaggattttgaggatagttttatcttatcaagagcgcacagatatagattacaatgctattacactgaacaaggtttcttagatgacatattcaatatatcgcaatattggagatctctaaagtacaatcagccaaactgttggcttgaaaattggttaagaagagaaattcaagctcttatccaggaggaggatgttgacatcattttgcaccatatccttgctgtggtcaaagcagcattatggactaggagagagcagaagtcacacatgaatgcacctgaaaagaaacaggaggagttcaagatgtcagtctctgaagccgcaaggccttttctggcagcaagaacggacagatttgtatatgagattcaactatttcttgcttcgggaatgaatattgaagcttatgatgctgcttacatacaacggttaggttggagctcacctggggtaaacactgaggtttctcatagtgaattggttgatcgctcaactgtgattccatacatgcacctatttgatggtgactttgatgaaaatgagtag

SEQ ID NO: 17036 - DNA, 1065 bp, Glycine max
  Peptide Sequence Number=SeqID_133814
atggagaagaaaacattgaagaatttgttagaaagtgtgagcaagaccagtttaactacacatacgtggaaatgtagccatcaagtagttgaatatatggttattactagacatttcactgacgcgagatggaatcttcaaaaaagagttttaagttttgtgaaagtgcctactccaaggcgtgtgcaagatggccttagtacaattaaggatatcattttcaatattcgtgaaagtgtcaaatatattaaccacaacgatgcaagactaaaggcattttgtgatgttgttgagcaaaaacgcttgaaagaaaggaaacttgttattgattgtccaacaagatggaattcaacctttaatatgctgtcaacggctttgaaatttaagactgcatttgcttcttataaagaaagagagcctcactataattatgcaccttcacttgaggagtggaatcaagttgagaaagtttgtaagctgctggaagtttttaatcttgctactcatgtcatctcaggtagtgagtatccgattgtaaatttgtatttggcagaagtttggaaggttaaacaaatacttgataaggagattgaagatgaagatctcttcatgagggaaatggtaggtccaatgaagaaaaagtttgacaaatattgggggggaatgtgcaaatttcatatggtgagtatatgttttcccttgatatattctaaagaagttgttgatgagaatataaagaaggtgaaaagttcatttgaagaattgtatgatgagtatgtaggtctatgtttacaagagtctacgtctagtgttgttaatttggatgataatatttcatcatcctcccaattcaatactccggttgtcactggttttgacaaaattatgagcatgctacgggaaaaggaagttgtttctcctataaaatcagaatcgcaagattatcttgatgaaggtatttatgttcctaacactaattcctttagtgctttggactggtggaggaacaatagcatgaaatataagatattgtctaagatggttgctgatatactagcattctaa

SEQ ID NO: 17037 - DNA, 195 bp, Glycine max
  Peptide Sequence Number=SeqID_133815
atggcgtccaagcgaaacaagcagcagctgggctcttggagaggagaaaacgcagaggctcacggaagagggaagaaaagcagaagcaagaagaagaggcgacaaaacggctcattcgataaattgctgggtgcaccagcaatattgctgggtgcacctagcatttcccatgtgtcttatgcaaatgtagcatag

SEQ ID NO: 17038 - DNA, 789 bp, Glycine max
  Peptide Sequence Number=SeqID_133816
atgatgtatggggatgtattgaagcctgaaatccttggagactatgtgaaaaccaatgttccaagtttgaaacatttcatgagtaaagataatacagaccaaatatataacattccatcactggctgcactttcaagtgccatgcggttgcttcaaaggtttgaattcaagaataaccatggtgaatggatcagtgcagttaaacctgatttaggtcctggaatatcagaacgtgtatcagatgccctaaggacaacgggggagaacattgatatctgttattctataaaaagggaactacacgatgctctttcggctcttcttgggattctctccttggtcttcataaaaggaaacctcccttctttccgtccatggagaaataatgtgcaaacatgcttgttacttcatagatcaatcttacttttgaagaaactatttgagaccctcctggctcctggtctgtacatacatttcagcaagccttttcatttgtcaaaagactttggtgttctaatgatccccacagttccaggtcctcccccaaaactacaaacaaatacatccgacttagaaatttttcgtgcaagggcttttagcctgctgtccattgctggagtatcaggattttgtcaggtaagcataccgctagggatgtataataaccttcccctatcaatttctctggtggccagacatggtgcagataaatttttgcttcaccttgttgagagtctttatgacagcattgaagatagaaagcagcatatcatagagcacaaactttaa

SEQ ID NO: 17039 - DNA, 237 bp, Glycine max
  Peptide Sequence Number=SeqID_133817
atgaagcaagaagcaggacattcaggctctgctccaccgtcatcacggttaagtaccctcaacgagaaattagaaatggttcttgcgactctgcctacttgtatcaggtggatgtgcctgtctatagagcaggtattgatgttaaaccttcagaaattgccaaacaaggttcagaagaggcaaaaaagaagaaaattgatgttgttattgttgatactgctagtaggctgcaagtga

SEQ ID NO: 17040 - DNA, 684 bp, Glycine max
  Peptide Sequence Number=SeqID_133818
atgaacgaactaaaaaacgtacgtaacctagcaagccttgtctcagagcagcagcaccggaagaacgaagcagaagaagagcaacaaaacgacgtcgttgcagcgggagcgcgacgacgacgcgcctcggttccagtcggtgccaatggcgtcgccgacgggaaggtatggcggcggcggagggggaacgccgtcggagaagagggagtagtcgaggaaggtcgcgactccgtggacagcgagggacggggtggagaagaggtcggggtgggtgagggggacgtcgtcgagggagaagttgttgggggagttgtcagtgacggagatggattttccggcgaggagggtggggaggcgggcgcggtgggggaggaggaggaggtcggagaaggggaggcgctgcgggaccacgtgagcgtcgcgctgagagggaggatcgtggcgtttgcggaggagaggatcgagacccacgtcgtgaagtccgacgcgcctatgagcgcatcgatgatgttgttgagttgctgggctggtggtgatgacggcggtgttggggtggtgggacccaccattgtgaggaagaggagaagaaggggaataatgtggtcgtggtggtggttatgcatggttctttctttctttcttgggtttcactttcttggaggagggtggtttctaactacttga

SEQ ID NO: 17041 - DNA, 555 bp, Glycine max
  Peptide Sequence Number=SeqID_133819
atgtttctgatatattctcctttgcatgcttgtgtggtttcccttgcagatgaggaggatctacttcatgacatcaacgtatacagaaaagttttgaaccttgctgttctggatgaaaatgaaaaggcttcatgcttagctgaagagatagcagaagatctagagaacacgaaatgcgaagactttcgtgactactaccctctgcctagttacacctccagaattcctagcttccaaaagagtgtaaacaaatgcaagatcaacatcaacacaacaaaagatggggtcatcatgcctgtttgtgtgccaaagttggactccgatgctttgttttccaattataccaaatctaatcgcttctctaagtatctcaataattccaagtacaagatagcagggattggttccgaggacgattggatggttcttattatcagcaccaacacttcttctggagatttctcctctgcaacttctctgctttctggggctttgaagggtcactaccttatgatggcattcttcttgagcacgtttattgttctcctcaattaa

SEQ ID NO: 17042 - DNA, 135 bp, Glycine max
  Peptide Sequence Number=SeqID_133820
atggctgagaaatcgtaccttagaaagaagcgccttaactttcggacattaaacccaactccaacatcctcactaatcaggcgtggattccacatgatgaggggcgtaggctgccaatatatggatagtttgaaa

SEQ ID NO: 17043 - DNA, 915 bp, Glycine max
  Peptide Sequence Number=SeqID_133821
atggcaatgcctgttaatgatgatacactggttgaggctgaaactgaagatcagagagaagaaatgtcatcatctgaatcagagcaggatgaagatgtgaaattaactgaaccatctaaaaatgcagtgtataacagagatgctctactagataaacttggagacatcagttggccagagaatgtggaatggatacacaaactctctgttgatgttgatcaagagcaagaagtagatgtcaatgatgacttggcacgagaacttgcgttttacacacaggcattggagggaactaaggaggcctttgagaaatttcagtcaatgggtctccctttcctgagacctgcagactattatgcagaaatggtgaagacagatggccacatggtaaaggtgaaaggtcggctattagcagagaagcgaaagatggaagaggctgacgagagaagaaaggctagggaggccaagagattggccaaagagattcaggctcagaaattaaaagaaagggctaagcagaaaaaggaggacattgaatctgttaagaaatggaggaagcagcggcaacaaagtgggtatgctgacaatggcaaagatgcagatatgggttttgactttgaggatggaaaagtatttgagaggtcaaataagaaaaggccaggggtgtctccaggggatcgttcaggagggaaggcaaagctagcctttggtaaaggaaagaaacagaagaaaagagatggtaagaattccaaatttggttttggaggcaagaagggaatgaaaaagcagaatactgctgacaccaccgatgattttggtaaatataacaagggtgctgtttctggaaacaagagaaagagttgctttatgttgtccattgcgcataaggtatacgtcgtagttagggtagcgtag

SEQ ID NO: 17044 - DNA, 2157 bp, Glycine max
  Peptide Sequence Number=SeqID_133822
atggcaaaagctacttccggaaccgtcaatcctcacagccgtaccggagttcggattgtcgtcgccggagaccagggcaccggaaaatctagcctcatcatcacggccgccgccgaaaactttccggtgaatgtaccaccggtgttgcctcccacgcggttgcctgaagatctgtatccggatcgcgtgcctatcaccatcatcgacacctcttcccgaaatgcaattttatgcttatatattgattcagtttatttcgaaacttgttggtcatgggttcgaatccggaaacagcctctttgcatatgcaagggtaaggctgcgtacaacatccctcccccataccttcgcatagcgaagagcctctgggcaatgggtgctgaggatagtgataaagttgctgaagaattgcagagggctgacacagttgtccttacctatgcatgtgatcggcctgagacacttgaaaatcttagtatattttggcttccacatcttcgcaaactagaggtgaaagttccagttatagtagttggttgtaagcttgatttgagagatgagaatcagcaggtgagcctagaacaggtgatgtcaccaataatgcaacagttccgagagattgaaacttgcattgagtgttcagcatctaggcatattcaggtccccgaagttttctactatgcacagaaggccgtgcttcatccaacagctccattatttgatcaagagtcacaaactctaaagcctcgatgcgtgcgagccttgaagcggatttttatcctttgtgatcatgacagagatggtgcccttagtgatgctgagctgaatgactttcaggttaaatgtttcaatgctcctttgcaaccatctgaaattgtgggtgtaaagaaggttgtacaagaaaaattgtctgaaggggtgaatgaacgtggacttactttgactggattcttatttcttcatgcccttttcatagaaaaagggcgtcttgagacaacatggactgtgctcaggaagtttggatataatgatgatatcaagcttgctgatgatctaattccacctataaaacgtgctcctgatcagagtgtggagctgacaaatgaagcaattgagtttttgagggcaatttttgatgcgtttgatagtgatggggatgggatgttgagacctcgtgaaatcgaagaattattttctactgccccggaaagatataagcgactccaatcagaattgcttttcaatcaacaaagagtaaagattgggagtccttggactggaattccatatgaggacgctgcagaaaaaaatgcatttggaggactatcactagaagcgtttttgtcagagtgggcacttatgacacttctaaacccaacttttagtgtggagaatctgatatacattggttatcctggtgatccatcatctgctattcgtgtgactaggaggcgacgcatggatcgcaagaagcagcattcagacagaaatgttttgcagtgctttgtttttgggcctaggaaggctggaaaatctgcattattgaattcttttattggaaggccatattctgaaagttacaatccaaccactgaagatcattatgctgtaaatgtagttgatatttctatggaaaacaaaaaatatcttgttctgagagagattcctgaagatggagtgaggaagctcctgtccaataaggagtctttggcctcatgtgacattgcagtttttgttcatgacaggtctgatgaatcctcatggagaacatcgtctgaactgttggttgaaattgctagccatggagaagatactggctttgaggtgccctgcctgatagttgcagctaaagatgatctggattcatttccaatggctatacaggagtcaactagggttagccaagatatgggagtagaggctcctatacccatcagtgtgaagttaggagatttcaacagtctttttcgtaaaattgtaacggctgctgatcatcctcatttaagcattccagaaactgaagctggaagaagccgcaagcagtaccacaggcttattaatcgatctcttatggctgtttcagttggagctgcggtggtcgtagttgggctggcagcttatagggtatatgctgcaaggaagaatgcgtctggttaa

SEQ ID NO: 17045 - DNA, 423 bp, Glycine max
  Peptide Sequence Number=SeqID_133823
atggaagagaaatggattggccagagctctggaaacggattttccttgcacactggcttctttgttttcctctctgttcttgttcctttgcttgttgatatcttccttcatgctgaacgcgacactcgtgctgagtgcatgtccaacttgatcaagtggccacgtgtcaagccgcaggatgcgtacttgctcgagacaactgtcttccaatttgttctactcagattgtggaaagtgttcagtgacgacaaggaaaggccagatagatatttgcttgccaaggaattcgagagccgtcctgatgctgatgacatcgagcttctatttgctgatgaagatcagaagtcagagcaagggcaaggtttgcttgacaaagcagcaggcatattctcttcaattagccggatgatgaagtctatatga

SEQ ID NO: 17046 - DNA, 2970 bp, Glycine max
  Peptide Sequence Number=SeqID_133824
atgatggccaagaccacgctagattcgggatggcttgcagctaggtccaccgaggttcatttcacaggcactcaactcaccaccacgcaccctccctctgcctccacccaaccatggatggaagctattgtccctggaactgttcttgctaccttggtgaagaacaaagcggtgcctgatcctttttatggactaggaaatgaggcaatcttggacattgctgactctggaagagaatattacaccttctggttctttacaacctttcagtgtaagctgtcaggcaatcagcactgtgatctgaatttccgaggaatcaattactctgccgatgtctatttaaatgggcacgagatggtcctcccaaaaggaatgtttcggagacattctcttgatgtcactaatattattcattctgatagtagtaacctgcttgctgttcttgttcaccctcctgatcatcctgggagcattcctcctcaggggggacaaggtggtgatcacgagataggaaaggatgtggccacacaatatgttcaaggttgggactggatggctcctataagagataggaatactggaatatgggacgaggtttccatttctattactgggcctgtaaaaataattgatccccacttggtgtcatcattttttgacaattataagagagtatatctacatgccacaactgagttggaaaacaggagctccttgattgctgagtgctctttgagtatccatgtgacaacagaacttgaggggaacattcacttagtagagcagcttcaaactcaaaatctttcaattcctgcaagatcacgggtgcaatatacatttcctgagtcttatctcttcctttcaagtgctaaagatttgtattggcagctcttcttctacaagccgaatttatggtggccaaatggaatggggaagcaatctttgtacaatgttattattaccattgatgtcaaaggacatggtgagtctgattcatggaaccatcactttggattccgcaaaattgaaagccatattgatgttgctactggtggaagattgttcaaagtcaatggagaaccaatttttatacgagggggtaactggatattgtctgatgggctactgcgactttcaaagaagcgatacgaaacagatatcaagtttcatgcggatatgaattttaacatgattcgatgctggggtggtggactcgctgaaaggcccgagttttatcgctgttgtgattattatggtcttttggtatggcaagagttctggattactggggatgttgatggacggggtatcccagtatcaaatccaaatggtccactggaccatgaccttttcttgttttgtgcaagagacacagtcaagcttctcagaaatcatcctagtctcgccctctgggtgggtggaaatgaacaaactccaccagatgatttaaatgttgccctgaaaaatgatctgaaacttcatccttattttggacatgcagaagaaaaagaaaaacctgtaggtgacttgtccccaagattgggggatcctagccaatatcttgatggcacacgaatttacatacaaggatcattatgggatgggtttgcagatggggagggggacttcagtgatggaccttatgaaattcaaaatcccgaagatttctttacggatagtttttataatcatggattcaaccccgaggttggttctgtaggaatgccagttgcttctaccataagagccataatgccttcagaaggatggcaaataccactgtttaacaaacttcccaatggttatgtagaagaagttccaaatcccatatggaaataccataaatatattccttattcaaacccaaccaagaaggttcatgatcaaattcagctgtatggtgatgtaaaagatcttgatgatttttgtttgaaggctcaactagttaactacatacaatatagagctcttctggagggatggacttcgcgcatgtggaaaaaatatacaggagtattgatttggaagacacaaaatccttggactggtctgagaggtcaattttatgatcatcttcttgaccaaacagcaggtttctatggctgtcgatgtgctgcagagccaattcatgtacagcttaatctggctacatattttatagaggttgttaatactacatccgaagaattgtctaatttagctatggaagtttcagtgtgggacctcgaaggcacatgtccacactacaaagttcatgaaaatctcactgcgctgccaaaaaaagtaacacctattgttgacatgaagtatctgaagtcaaaaaatcctaagccagtctactttcttcttctcaaactctacaaaatgtcagataatacaattttatctagaaacttttattggttgcatcttcctggtggagattacaagctattagagccgtataggaagaagaaaatacctctcaagataacatccgaagttttcattgaaggatccacttatatacttcaaatgcatgtgcaaaacacatctaaaaaaccagactctaaaagtttaacaatggtacacagttcaacagctagacaaagcagtggctgctttgttacagactctctggaaaccgtagatagtgggactggaaaagagcatgaagttggttggtttaaggggatacacaaatgctttgctgggaaaagtcatggtttgaaggtttctgaaattaacggacaagatacaggtgttgctttctttcttcatttttctgttcatgcttcaaataaggaccacaaggagggggaagacacaagaattcttcctattcattactcagataactatttttcacttgtgccaggagagaccatgactattaaaatatcttttgaggtcccttctggtgtctctccatgtgttactctgcgtggctggaattaccagggacaaaccatccatgaagctctttactga

SEQ ID NO: 17047 - DNA, 1722 bp, Glycine max
  Peptide Sequence Number=SeqID_133825
atggcttccaagtcttcttcctcttctcatttgtctaagcaaaaagcgtttctcattctctcactcttctccataggcctcttgctctctctgctttcaatgaagccaaaaagagtctccaatgtcacaaacaaatttgaggtagataaaagaaagccatcttggtttgaagtcatagagaaaaactatgctagcaagaggatcaatgtaggtctagttaatgttgatacaagagtagatggtggtctatatgagcagctacatgcactacaccctcaagtggaaatagtgtccgttgattttgatcatgttgatgagagcttgaaatggaaagactttttccctgtgtggattgatgaagataaaaaatggggtggtccaaagtgccctgatttgccaatgccaacttgggaagagtaccgagatctcaatgtggtggtggcaacagttccatgtggaaaaagggatgtgtttaagttgcaagttaatttggtggtggctaatttggcagtggatagtggatgggtgaataatttggatgcttatgaacctgtatatgttgtgtttattgggtcatgtgatcccatgatggatattttcaagtgtgatgaccttttgttgcatcaaccaggtgagtattgggtgtacaagcctgatttgttcagcctcagaaacaaaatgcttatgcctgttggttcctgccagattgctcctggctatgcagaaacgggtaaggaggaaattaggaggggctatatgtcacaatcaccagcgacattgaattacaattacaccatttcaaaattagcctatgtgacagttctccactcttcagaagcttatgtgtgtggtgcaatagctctagcacaaagcatccttcaacacaacaacaacaacaacaacaacaacaacaacaactacaccaaattagacctactcctccttgctgatgaatccattggttacaaatctataaggggtctaaaagctgcagggtggaagatcaaacgcatcaaacgtatcttaaacccctatgcccaaaagggttcatacaacgagtggaactatagcaggttacgtatatggcaactcaccatgtatgacaaaatcattttcctagatgctgatcttctagttttgaagagcattgatggtctctttgcttaccctcaattatctgcttcacctaatgacttctccttgttcaagtcggggttaatggtcattgaaccatccacgtgtatgtttgaggacttgatgaagaaaagtttggaggtgaaatcatacaatggtggtgaccaaggtttggtcaacgaggtgttcacgtggtggcacaggttgccaacaaaagtaaactacttgaagagttttgaagagagagaagggaatgatgtgaaggaggagattcctgaggacttgtatgtgatgcattacttgggtttgaagccgtggatgtgttatagagattatgactgtaattgggacatgaatgaacttcatgtttttgctagtgacttggctcaccacatgtggtggcaggtttatgatgccatgcccaaagagttgaaatcctattgtggacttactgagaagatggatgagaggatagtgcaaaggagaagaagagcaagaagtgccaatttgtctgatgggcattggaagattgaggttaaggatcctagaaggacacattatgaggatttgaattatagtagggagtga

SEQ ID NO: 17048 - DNA, 861 bp, Glycine max
  Peptide Sequence Number=SeqID_133826
atgatgtcaggaaattacacctccatcgatagccaaaaggtttcaggatctgtacctgctgttgatcctccacccttccaattctcagattcaaatcttcagacatttcctccatctggagcacagggcaagattggtggtggctcgagacatccacgtgatgttgatgatacgttttcaaaaccagtgtctggttctgatgaaccccagcagcagagtggttggtttaaggctttctcacttgcttcttacaaaccatactttgatgttgacactatagatgttctagacaggattaaagactcactctatccattcaatggaacattcaatgaaaaaactgcttcccaccctgatttgtatggaccgttctggatttgcaccacattaatatttgtagcagcatctattggcacatttgtgacatacatagctcacaaactgaaggaccaggaatggaactatgacataaatctggtgacttggtctgccggcttgttctatggttatgtcaccattgttcctctttgtttgtatgtaatcctcaagtacttctctgtaccatcgggctttgtccaactactctgtctctatggatattccttgtttgtctttattccagcactgtgtatgtctgttgtgccattggagatattcagatggatggttgctggtgtggctgggttcatgtcagcaacttttgtggcactaaacctccgagcacatattatgtcagcaggtgaaagatgggttttgattgttgctagcatttttgtattgcagttggctctagctgtcgcattaaaggtgaaatgcggttatcagattaaactgtcatttaattcattcatggcgatatag

SEQ ID NO: 17049 - DNA, 336 bp, Glycine max
  Peptide Sequence Number=SeqID_133827
atgagccggtttgcattttctcaatgtggaatcggacgagccaagcctaaagagaaagatcctgaagggttagaagaaaacaaaggcttggtagatggtgtaattggcataaatggaagagagggtagaggaggcaatttggggagaggtggaaaccctggaagtgaaaatggtggagggttaagaaagccaccaattggttgtgggaaagatggtattggaggccgtgttggtaacaaagggttgggaacaaaatttgggtttgggaattttggtgcaaaggaagcttcatttcatggcatttctacttggtacctaacttatgggtcgttctaa

SEQ ID NO: 17050 - DNA, 330 bp, Glycine max
  Peptide Sequence Number=SeqID_133828
atggctaatctagcaacaaagttaaattccatgggaatggtaatgaatgagtcctttctggtacagttcataatgaactcgcttcctattgaatttggccaccaagtgaactacaacactattaaagaaaaatggaaatttcaagaaattaaggccatgttaattcaggaggaagagagattaaagaaaatgaaggacaacttaattcatctcacgactcatgatggagccagtatcagcaaaagcaaatcgagtaaaaaggataataggaatgcccatttgatggttaaaaaagggatttctttcgatccaaaccataggaggaactga

SEQ ID NO: 17051 - DNA, 132 bp, Glycine max
  Peptide Sequence Number=SeqID_133829
atggcgctaagcacgacgtcgaggagctttagaattggaaaatgtattgcctccttagaaccggataagacagggctaagttatcgtatgtctggacacggagtgcggctaagttcaacaagaggcatctaa

SEQ ID NO: 17052 - DNA, 774 bp, Glycine max
  Peptide Sequence Number=SeqID_133830
atgttgactcacttagcgagtccatgcgctaagcgagtcattcgaaactgccaatggcttccccaagttagggttcgagggcacctgataaaatttgatgttgattccctcaacacctttttggagactccagtggtcgtggagcaaggggagagcttgccctcttactccaggtttgctagactgaggcctgatcctcaagagcttgcagcccggctgtgtatccctgggaggggatttgtacttaatgccgaaggtctgccgtggaagctcttgaggaaagatcttaccactctggcccaaacctggagtgttctatcttattctaacttggccccgacatcccatacttctgatcttaatctggatagggccaagttagtctatgggcttgtaatgaagatgaacatgaacttaggatcacttatttctggtcagatttcactcattgctcagtccaactcctcacggcttggatttccagccctgattactaccttgtgcaagaagaattgctggaacctggatgacctttcggtcacttttccaaggacccagaaatccaaggctagaagatctgaggccccgtctccttcagctgcccctgctccccctacatcagccccatctacttctgctcttccttcaccaccagcagctctagttcttccaagtccctccactcagagctcagagcttttcatgtctatgttacagagcctgcatcagggccaactcctgatcatgcagagtttgcaggatgtggtccagtag

SEQ ID NO: 17053 - DNA, 483 bp, Glycine max
  Peptide Sequence Number=SeqID_133831
atggagcataccccttatgcatcaatggttgggagcttgatgtatgcccaaacatattacactatgctttttgctggagaagcggtatcatggaaaagtgcaaaacaatatgtgattaccacttctatcatggaggctaagtttgtggcatgctttgacgccataattcaagcattatggttgtggaactttacttcagagtttggtattgtcgaaaatatagccaaaccgctgaggatttattgtgaaaatttcgtagttgtcttcttctctaagaatgaaaaatactcgaaaggagctaagcacatggatttgaagcatttgtcagttaaggaagaagtacagaaacatagagtgtcaattgagcatattggtacaaaattaatgatagtggatccattgactaaaggtttaccacctaagacatttattggccatgttgaaaggatgggtgttatggataagtccttgttaacgatgtaa

SEQ ID NO: 17054 - DNA, 2028 bp, Glycine max
  Peptide Sequence Number=SeqID_133832
atgggagtgaaactgagaaagcgaggtagagagagaaacaaagagtgggtgggagagagaaacaaaaagaacgtgagtgataggccttgcctcaactatgccaggaaggagaatgtgcaacatggtgcgacggcaacaacgaccagatgggggaagggaaggagcaaaaattggagggatgcaccggacatactgtcgttctacttcacaaagtttccaaatgacatgggagaaaaggtactatggatcgagttcaagaagtggagtgacgttagggagctacacgtgaacatcccgatgcatggaagggaatggaatccgatagagacagtcaacaagaaacaccaggaaaaggaggaggtagccatagaaaaggtggaagagagagacaaaggtaaaggaaaggggacagcagaacatatgacaccgaatacaggattacaacagcagaatccccagcgagaggcaactttcagatcatatccgaatgtggttgcagcagacagtatgcatgtggtgaaacggtggacattgaagtatgcgcaggcatcaattaaaccaaaatacattggcggtgacatggtgcttctcatgtggctcaatgacacaagagcagaagagctgtgcagagaaggagtcgaaagtggtttatctatgttccatactctagagaaatggagtccaagcttgaggcctggtttcaggttggtatgggtgatgtgcttggggattctgttacacgcatgggatgcggaaaacatcgcaaggatcgcggaggggatcggggaggtggttgatgtggacgaagacgtagatgatctttggaggctagatagggcaagagttttaatcaaaacaccatggcctcttacaattaaccacacagtaactgcgtccattaatggggtcgattatgtggttacgattgtagaagagctgatggatattctgtcggaggaagcacaggttggcggcgagcttccgggaaccaacacagcagcgggtgtagagggagacgaacctgacagaatcatcgggttgcagcaatttcctgttggttattatacaaactttgtaaccacggtcaacaatgatgccaggaggtcgtactcaccaaatggtgaccccactctattcgggttaggtgaggaaagaactgaacaaaaagctgacgagatcagtgctttaggcggaaatacttgtgcatgcattagagaattgtctgctttgctggatgcacttgaacattctgcctgtaatccggaaattgcatgtgttcttgtggggagtttggttcgcatcttgcagctttctcctgagagaacaattgcttcctttaagaacttgaatgcagtctctcgtgttctacaagttgcctgtgttcaagcacaagagtctagaaggccaggaagtatggagccctccaatgagaatagtggcatggaagcattggtatcagtgcaagatcaaaatacatgcaattcacctaagattatacaaagttgttttaattgcatgaaaatgtgcatggagttctttgccaagtttatagcagctgctgaagatactaggagtttgatattacatagttttacatgcattgattgcttgtttgatttattttgggtggagggtttgagagatgatgtgcttagacacatactcgatctcatgaagattatgccattctccgaggaagataaaaaagcgaagttgcagttatgctctaagtatttagaaatgtttactcaattaaaagaacgtgagaaaagttttgttgatctatctgttgatttgttggtaggaatgagagatatgctccaggctaaccaagcatactatcagactctatttcgggatggggaatgctttttgcatgttgtatcattactgaacagcaaccttgatgaggcaaatggggagaaattggttctgaatgtactccaaacacttacttgtctgcttgcaagtaatgatacctcaaagctgttttttgattgtggcaaaccaattacggcaaaaacttaa

SEQ ID NO: 17055 - DNA, 633 bp, Glycine max
  Peptide Sequence Number=SeqID_133833
atgattaagagcaaattttgtctatggattcaaagggcagcatttagagctctggctggaaagggctaccagacgctgcagagtctgctattggatttttgccaattgcattcaagtgaaatccttttagatgctttgctcgatatgcttgttgatggaaaattcaatgtcaaaatgagtcctatgataaagaatgaagatgtaataatattatatcttattgtactgcaaaagagcagtgagtcattgcagcatcacgggctagacatttttcagcagcttctaagagactccatttctaatagagcttcttgtgtcagagcaggaatgcttgattttcttcttaattggttttctcaagaagataatgacagcgtgatctttcagattgcacagttaattcaagccattggtgggcatagcatatcagggaaggatatccgcaaaatctttgctttactccgaagtgagaaagttgggatgaggaggcagtactgctctgttttgttaacaagtctcttgtcaatgctacatgagaaggggccaactgccttttttgatcttgatggaattgattctgtaagtcctgaagccattatagatatatctctagaactccatgttcttctttag

SEQ ID NO: 17056 - DNA, 2670 bp, Glycine max
  Peptide Sequence Number=SeqID_133834
atggatgaggctaatcctatttcttcccctatggttggagggtgtaaattaaccaagcttggttttgaagatttttctgatcctaccttatacaggtccattgttggggtcttgcagtatgctaccataacaagaccagagattagtttttccgtaaataaggcgtgtcaattcatgtcgaagccttcggagcagcattggttatctgtaaagcgaattctgaggtatcttaagggtactgtcaatcagaaaaccatgaacaacttgcagaaagtgtttggagcatggggggttaagtggccggcaatcagaaggatggtcaaagagcatcatattgatcttctgtgtttgcaagaaacaaaaaaggagattattgacaagtctttgtgtcaggccttatggggggattccgaaattggatgggaggcatatccatcagttaattcagctggtggtattctttgtatcaggaatgagagagaatttaaggttgagagcagattcattggagctggctttatattgctgtcaggaaagaggggggatttcaataacattaggacttctacagagataataggatcgtctcagagggggcagatggacggaaccaaagcggaattcaatgattggattgacgacatggaggtagaagaagcaccttgggtgggaaagagattcacgtggtttagaccaaatggtatagctaaaagtaagttggatagattcatggtttccccagattggcattcaaaatggcctgggtccactcaatctacgctggtcaagaacttctcggatcattgccccgtcttactttcatccaagagtgtcaattggggcccaaaaccttttagaatactagactgttggttatcagataagtccttcaagaaagtggtttttgacagctggtcatccaatcctcagagtgggtgggggggcttcgtgttaaaagagaaaatcaaagccctcaaacagaagatcaaggtgtggaacaaagaacaatttggagacactttcagaaaattcaagaagatagaagaagatttaaataaaatggaagaggagtcaacagacaggcagttggaagacaacgagcgggccctcagaaagcagctacaacaggagctatgggaggctgctcaagctcatgagtcgttactgagacagaaggccagatctagatggatcaaggaaggagattgtaactcgagatatttccatctgatgattaattccaagcggagatcaaattgtttgaatggagtgttggttgatggatcatggaaggatgagccggaaatagtcaaagaggaagaggtgagaagggctgtatggagctgcagtagtgataaaagctcgggcccaaatggaattaattttaaattcatcaagaaattttgggatgtcatcaaaccagacttcctcagattttttgatgagttctatgctaacggagtcattccgaggggattgaatgcatcttttattgccttgatcccgaagggagcggaccctcaagtgttgaatgaatacatgcctatctcactaataggatgtacttataagattcttgttaaggtgttggctaatagactgaagaaggtagtcgaagaggctaaaagacgccaaaaaccttgtatagttttcaaggtggattatgagaaggcgtatgattcggtgtcttgggagtttttgatttacatgatgaggagaatgggtttttgttcaaagtggattttatggatactcggttgcttaaaatcagcttcaatctcggtattggtaaatggaagcccctcatctgagttcttaccgcataaaggactcagacagggagacccactatcacctcttctattcaatattgttgccgaaggattgagcggtctaatgtcaaaggctatagagagaaggctctataaaggttttttagtgggtatagataaggttgaagttagcctactccagtatgcagatgacacaatattcttggggcttttggggtgtcggatcagtggacctatggagcatccaagtgggtcatccgagcaaaacaagattgcgtggatcagatgggatacggggaagacatgggcaagggtactacaatcaaaatatggcggttggaggaatctggatggagctcagaggactagtagcgattccatgtggtggagtgatctgaagaaggaggataagtggacaggtggagacaggcaattagcagaaaaatacccaaggctgtacaacatatcggatcagcaacatcaatttgttcagcaattaggagttttcaatgaagcagggtgggagtggcaatttcaatggaggagaccattgtttgatagtgagataaagatggcggtcgcattcatacaagttgatgggcacaagatcaggtttgacattgaggatcagtgggtgtgggcggcagagtcaagtggtagttattcggctaggagtgcatacagagtgattagagaagccataccagaagaggaacaggatggagaattcaaggaattatggaagctcaaggtcccaatgaaagtggctatgttcgcatggaggttactcaaagacagattgccaaccagagataattggagaaggaaacgagtagaattgcacgaatatgtgtcctttatgcagatcaacggatga

SEQ ID NO: 17057 - DNA, 3150 bp, Glycine max
  Peptide Sequence Number=SeqID_133835
atggagcagttgaaattggcggcagattctgaagccaaagaggataagtctttgggacacaagccaaaaaataacaatgcccttgagtcttctgacagtctgagaaataaaaagatatcagctcgatgggatccggttgaagcatgtcggcctataattgaagaagcacctgttttttatccgactattgaagaatttgaagacacgcttagttacataggaaagatacgacccctagctgaaccccatggcatatgtaggatcgttcctccagcttgctgggctccaccctgtcctcttaaggagaaagatctatgggaaaatactgaatttcccactcgtattcaacaaattgatttgcttcaaaatagggaacctatgaggaaaaaaagtaggggaaggaagcgaaaacgtagaaagcactccaaaacaggcacatgtaggaggaagcctgccaatgcagcttctgaagctaagaatgcttctgagtctgaagagaaattcggatttcaatcagggtcagacttcacgcttaaagactttcagcaatatgctaatttttttaaggaatgctactttgggttgagagatgctaatggagacagaatagtgagtgaaagtgaccatcaaaagagatgggagccctctgaggaggaaattgaaggtgaatactggcgaataattgagcaaccaactgatgaggttgaggtgtattatggagctgacttggaaactggagcacttggaagtggttttcccaaggccgcatcattaactaagagtgagtcagatcaatatgcccagtctggctggaatctgaataattttgcccgactgccaggttctgtactaagttatgaaggaagtgatatatcaggagttctagtgccatggctgtatgttggcatgtgtttttcatcattttgctggcatgttgaggaccatcacctctattcactaaactatttgcattggggtgacccaaaagtatggtatggagtacctggaagccatgctgcagccttggaaaaagtaatgaggaagcacttgcctgatttatttgaggaacaaccaaatctactcaatgatctgcaggttacccagttttctccttcaattcttaaatctgagggagtgcctgtgtatcgcacagttcagcattctggggaatttgttattacctttcccagggcatatcatgctggcttcaattgtggcttcaactgtgcagaggcagtgaatgtggctcctattgattggttaatgcatggacaaaatgctgtcgagctttacaggttacaatgccgtaagacatccttgtcacatgacaagctgttatttgggtcagcactggaagctgtacgagcccttgcagagctagctcttggaaaggaaactccaaaaagtttgaaatggggaagtgtttgtgggaaagatggagatcttaccaaggcagttaaggcaaggataaagatggaagaagaaaggctagactgtcttccaaatcatcttaagttgctgaagatgaacagtgattttgatttgtacaaggaaagagaatgcttctcttgcttctatgacttgcacctatcagctatgggttgtgagtgctcccctgacagatattcttgtcttaagcatgctaatttgttctgcttgtgtggattggagaaaagatttgttctgcttcgatatactataagtgaactaaataaattgcttgaagcattagaaggagaatcacatgctattgaggtgtgggcaaataaaaactttggaatgatttctgccaatgccaatgaggtttgcttagataaaccagaccttgagaaagacatgtacaaaatcaagaattgtgaagaaatggaaagctcaactggctttgcaggaaccaaggataggtcaaatttaaatgcacctagcagtcctaatagtcatattacttcagagatagtgcagtctgaggctcaccctgtaacttcaagtgcagcatatgaaagtatagatagtcataatgataataataatgataaaaagttgatcacagacaacaaagataaagtggatcaggctggttctctggatttgaatcttgatgttatctctggtgaaaatgaaaatcatttgctgcatattgctggtaagcatcatagtaaaggtgttttagtagaggaaaaagtgtgctgttcagaaaccaaacaggaagaagacaacatggaactttgtggtgagggtaacttatcaaactcgttttctgttctaaagacagatttttcatcatgttcaaggggtgttcgtaattattgtacatttgatggtggaaaaattgagatggatctgcaaatggattctgattctggaaatcagcacaacaatctatttgaaaggaaagccatagacaccacacatactagtatatctttgacagacgaaagctgcttagtgcaaatgtttggtacttctgtaaagcttgtaagtttgggatctgctgtttatggaaagctctggtgcagtaagcacacactatacccaaaaggattcaagactcgagttaatttctttagcattcttgatccaacaagaatctgtacctatatttctgaagtcattgatgctggttttcttggacctcttttcaaggttaccatggaagaatgtccaagtgaggctttcacagatacctcagcagataattgctgggaatcagttctgaagagattacatcatgaaatcatgaggcaaaggagtctaggtgaactagaacttcctctcttagagctcctgaaaagcattaatggtcatagaatgtttggcttccttttaccatctattattcaggccatcgaagctcaagatcccagccatctgtgtgtagagtactggaatcacaaagttgccccttctggcagtgttgttgataacttcacatatggttccagtggtattattatcaataccaaaaattttggtattgatttgattaagcaggaaaaagaggacatccttgaagagatgaaattaatactgcaaagggcaagtcctgatgagttaagcacaatgcataagttactcagctctgatgcacagtgctgtgagtggagagtggcattgatagcgctgatggatgagatccgaaacgctcgtcaataa

SEQ ID NO: 17058 - DNA, 516 bp, Glycine max
  Peptide Sequence Number=SeqID_133836
atggggccccttcgttttctctctcacaccttttttttaggagatgacgcatcctggcttgatctcggagctcctaccggaggagcgagagggccaagcaatgtcagcaacggtgctggtgcagtgtgcttcttactcttcttcgtcttcttcttcgacttgggagcagaaacctcagtgttgggtgctaccacgggtgtcggagttgtcggtgtcagtgcagggggagagctcaccggaactagcgctggcggcgagctcacaggtgtcacagcaggaggtgtagccgcaggaggagtggtcgcgggaggtgtggtcaccggaggagtggttgctagagctggagcagcagctttagacagaggagatgctaccatgggagatgaaacaagagggtttgcgattgcagcattgggggatgaagctggtggagatgaagtgggagaagcaacaggcgcagttgattttggtttagaaggggttgtggttgggaatgctatcaacacttttttttaa

SEQ ID NO: 17059 - DNA, 672 bp, Glycine max
  Peptide Sequence Number=SeqID_133837
atgtggattgcaaagcttgtgctaatgtccatgggggttatctccactcttgttttgttgaaagtgacaatagtcccatatacattccatcgtcttctctcaactcttcctcagttttgtgtctcagttacaagctggctaagactctcattcctctacatcattttcaacttcatcatcatcaccattgcagcttccttcgacttccaccccaaaaccttctctgactcaccaccaacctctgatcctaagcacacaaccaccatcattttagacactgccaaccacccaactgagtcagagaaccaaaccaatgcacctaaggaagaagaaaaggagctagagcaacaacagctgattgaagagtctggtttgacctatgacaaattcatgatccacccttcacttgaaagttgcacgaatgattatttcttgctggattcagatggtgatgacacactggaagctatgtggagggctatcttggagggacaagggaaaacaatgaaaccacaactgaagaatagtgacacatggggtgcaatccaacgaactgccctaaaaagagaatgtcaatttttctgctatgtgtctcgtaatccagaagtcaaagctccctttatcttgttatttccaacatctttaatcctacccaaatttgttttggactaa

SEQ ID NO: 17060 - DNA, 192 bp, Glycine max
  Peptide Sequence Number=SeqID_133838
atgaaagcaaaccacccacgaaatgaaacctcgaagcacgcagcacgacaaacaaggcgaaagcagaacatagggcataagagaacagatgctaggcgccaaagaacacgaaacaacaatcacgtgtccgccacgtgcatccacaaacgatacaaagatggttatagggacaagaccgtctttgtatggtaa

SEQ ID NO: 17061 - DNA, 525 bp, Glycine max
  Peptide Sequence Number=SeqID_133839
atgaattttgatattcaaaggcaaaatgaacagcgttgtgaacaagaaattgaagatattaggcgaggagttaggtctggaaacatcacgcctgatacttcagtaattagattctctgatgaagcgcttgatgagcaaaatcatagtatcagggttgctgatgaaaaagtagccttggctgtccaggcatatgatttgctggatcaaggatccaatttccacgactctgctatctgtatcttttttctttccaattttctttacactcaggtagatacacacatacaacatcttgatcagtatctgaaaaggtttggtgaggagattcggcgtgaaagagaaaatgctgcaataactggagtgcctgcttcaggttctgagggtaatacaaaatctggaaggggtaatgaaagtggtactggtagaggagggcgaaaaaaggctagacttgaatatagacagtgtttcatcctaacaaggagtttcctccttcaaaacactaggaacaacaatctgataccttaa

SEQ ID NO: 17062 - DNA, 561 bp, Glycine max
  Peptide Sequence Number=SeqID_133840
atgttcggctccatcaaccagatcgtctccgccgaagacaccgacggccccgtctccgaccaccacatccattacagttcccacaccatcgaagacgacggcgccgcctccgatcaccacatccattacagttcccacaccatcgaagaagacggcgccgcctccgaccaccacatccattacagttcccacaccatcgaagacgatggtgccgctgtcgaagacgtttccgccgttccgggccctgaaatctctatcgacaattctagccagctcacgctctcgtttcgcggccaagttcaagcagtgttgttgctgctgggaggaaatgaactaacttcgggttcgcaatgtgcggagctatcatctcgaaatcagactggtgaggaggaatatcctgcaaaatgtagtctaccacatcgagcagcgtcattgaataggttccgtcagaagaggaaagagcggtgctttgataagaaagttagatatagtttttactgtgtgaagaactcagatcactctacgatgtatattttgaaggattgggttgatgaggagtaa

SEQ ID NO: 17063 - DNA, 735 bp, Glycine max
  Peptide Sequence Number=SeqID_133841
atggaggaagcgcaggctaagggggagctgccagcattcgtgggggaagacccaattggttggattgctagtctttggatcaaaagacttagagatcgttatggtaaccacttctttaaaagattcagtatcttgatgcaagaagagcaaacagagacagaaatctgcattgaagaaggggggacttccacaatgttcttgaaagagaggaccaacgatgtacctaagccaaagaaaatgttacagcagttggtgaagaaacaagaaattaaaccagaacaggatgggtcttggaaggagaaggcgttccagaaggaggaacccaaatcttatgggttgcaccatcattcttgcaaagtcagcatttcagagttgaagcatgggctactaaaaagttcagaaaaagttcttgagggcataaatcttgaggccaagggggtagaggaaatcagggtggaagaggataagaatctgcagcagaaaatgcaggaacaaaatagtggttttgcaattgtcatcaaagaatttcattcttgggtagtaaacgtcatagaagttgaaggtgataatggtttctttatgaagcccacagccatggaaattgtgattatatggagatggattgcacctacaccaccacccgaccccctagacgcaaactcaaatacgatccttaatgggttgtcatcagcaagccacaacctcccatggagagggatgggtcttctatgttga

SEQ ID NO: 17064 - DNA, 573 bp, Glycine max
  Peptide Sequence Number=SeqID_133842
atgtcagccaaaccacgagataccaacccacttgctagtaaatcattatctgggatgctaagggaaacagagtcactatgggtgggcacaacagagatgcaccactcttccactaatttgttcctggagaaagaaaaaggaacaaaggtaaaatttacattctgcatggtggatctgattatggatgtaatgggccaagatgagtgtggagatagcaccactgtttgtggcttctacaatgcagtttcagttgagttggtgacagtcgaggagaaacataaatcaacattgagacctttggacatccatggaaaacagaacagacatgaaaccagtaccgaaaccaacgaacccaggtttacccgtgaagtttcatcgcagaacaggaatggatttataccgctaaacttggatgattgtgtagctgattacatgttaaaagagcagaggtggaaagagattgcagcatcacacatggaggtccaaattattcagaatttgcttccatcccgacctccaccggagccacagaactcaaccccacatgcaggggagtggatgattcctagttaa

SEQ ID NO: 17065 - DNA, 216 bp, Glycine max
  Peptide Sequence Number=SeqID_133843
atggagaggtatgaaggtggccttcaaagagaggggattaagattttgatgcagaggtacttgcaccgtgaagggactctctctctctcttcaccttcatttcttcacttgttggttggttcatctatggcaggagcagaagggtataagcccgtggaagcccttaaaactgcccttgaaggcacatatgcgatcattggggatgagcgttgcaag

SEQ ID NO: 17066 - DNA, 345 bp, Glycine max
  Peptide Sequence Number=SeqID_133844
atgagacaccactgtctccttctcctctccctcgtcttggtctcctacgctgcccggcggtcggaatctgcgctgggcggctggagccccatcaaggacgtgaacgacagccacgtggcggagatcgcgaactacgcggtgagcgagtacgacaagcgttctggggcaaagctgacgctggtcaaggtatcaaagggcgagactcaggtcgtggccggcaccaactaccgcctggtcctcaaggtcaagaatggatccaccacggccagttaccaagccaccgtgctggagaagccttggctccatttcaggaatctcacttccttcaaaccccttcgttcttag

SEQ ID NO: 17067 - DNA, 1179 bp, Glycine max
  Peptide Sequence Number=SeqID_133845
atgcaatctgaatttgatgctttggtcaagaatggcacttggactttagttgagttacctcctaacaaaatggctattggctgcaaatgggtctttaggctgaaacataatctagatggatttgtcaacaagtataaggctcgactggttgcaaaaggttttcatcagagaatcggtcatgattataatgaaaccttctcacctgttactgaaagaatcattcttactcttgtcatttcaaataactgttcccttcaacagctagatgtaaataatgctttcttaaatggtgtgctagaaaaggaagtttacattcagcaaccatctggttttgaaaagtctgacaagcagctagttttcatagggaatgactttaaactaattcgaacactggtgactcggctaaacggtgtgttttctttaaacgatcttggagatcttgactattttctagggattgaagtcacttatcatcctgattgttctcttactcttactcaatccaagtatcttagggatcttctaacaaagacaaaaagggatgaggctaatcctattgcatttcctatgcattggcaagctgtgaagagaattctaagatatctgaataggactttaacgctgggattaaggctacaaccctctaaactatccaatttttctgtccaggcatgttgtgatgctgactgggcttcagatctagatgatatgctatctacttcaagggcagaaatttgcttaggacctaatctagtgttctggtggtcaaagaagcagaaagtttttgctagatctagtacagaagcagggtatagaagcctagctcttgcttctactgaagtgacttggattcagactttgctatttgaattaaaagttagacacactacaccagtgatcttttgtgacaatatgagcacagtctctcaagcccacaacccagttctgcattccagaaccaagcatatggagcttgatttgttttttgtcaaagaaaaatttatggaaaagagtcttcaagtgattcatgttcctactgttgaccaatatgctaacatcctcaccaaatctctatctccttccaacttcattgtttttagggacaagctcatagttgttcacaaaacttttgtaaacgaaggacctcatgagcttgtcagggatattagagtaggatag

SEQ ID NO: 17068 - DNA, 318 bp, Glycine max
  Peptide Sequence Number=SeqID_133846
atggagattgtactcagtaaggttgattgtcatttgtcaaatgagaccccagatgtttcacttaagtggagaatgaggcttggaagacgcttcaagaggtccttccatcgcgtcgacaagacgcaggttcttacgccgtgtttggcgttcaggaatgttagtatgtggaggagaacgcaatcgtttctgctctggccgttgctgcgctttctccgtttcatcttaggagaatcaaacactgtctcgtgcgatagattacgcgcgttcggagaagaatctaagcgtgaaagaaatagggaaatggaaacgagaaattag

SEQ ID NO: 17069 - DNA, 210 bp, Glycine max
  Peptide Sequence Number=SeqID_133847
atggcgtgggagagggtggtggcattgaggaggtcggcggggaagaggctcccattcgggtttgtaaaatcggttagccatcaagtttcctcaaaatcagtcggatttgatcggatcatcccgagtcagatgcatgaacggtccaatagcaaaatcggtacgattaggtcatcaaatatcgattggaccgggccgaaccgggttttataa

SEQ ID NO: 17070 - DNA, 646 bp, Glycine max
  Peptide Sequence Number=SeqID_133848
atgaagtgctacttctggcaacatgttgggaacatatcagaggcaaaaaaacaaaacttgcatggttggttacatggatggctatggtgtgggcaatttggagcaaaactgaaaggttttgattatcctttatatgcttggagtgtggatatcgatgttgcgagctgtatggagcacttgtctgattctgaaagtgtgattgatatagatgccgacaagtggtcattctttgaagcgattggaattttaaaagaagactttggatatggtgatcaaccaatgaggctatggtggaaagggggtgatggtgagtataaggagactactatggacaatcatgcattggaaccgtctaattatataatttctaacaattgtgaggtggagttttttgtggaatgtgttggtggtaatgagggggttgcagatgacaatttttatggtgtagcaagtgataatgctggtgctagtgtttttgttcataatgatgatgacaaaactaacaatcaatgtgtacgtgttgaattaatttatgtatttgattattacattagccaggaggaaaaattaccaagtaaagtcgggagtgatgcacatttcaagccaaaggacaaggctggttggggtaaaaagattgttggtggag

SEQ ID NO: 17071 - DNA, 201 bp, Glycine max
  Peptide Sequence Number=SeqID_133849
atggtggcgtttctggtgctctctagagctcctcctccgactactctgttagggttcttgtgcgtcagaaaaaaagaagaagaaagaaatagaacgtgtttttgtaaaagctattctgggttaaaagaagtaaagggacggctattacatcaggtgctgcaagggaatgatcctaacggggacgcgccaacaatgacatag

SEQ ID NO: 17072 - DNA, 414 bp, Glycine max
  Peptide Sequence Number=SeqID_133850
atggtgatgagattgggtggcgacggtgcggtctggggagaagtgaacgatgcgacacgatctaggacgagaaggacttgtggggcgggggaaactgtccctatcctcgtcgtgcctgtggggaaatatttacaaagcagtaatcgattagcagtagccaacattcttttcaaactaatttacaaagcagtaatttattaccatcagaatcacattggagagtacatcctttgtgatacaagtagagcgtacatctacttggattgtaatactgagaagaagagagggtacatctcttgtggatcagttccagtggagggtacatccacatggttgctcaaagagaacaagggagggtacatcctttgtggggactatgcaggaccaatctctcctcgaagagaactaagataa

SEQ ID NO: 17073 - DNA, 159 bp, Glycine max
  Peptide Sequence Number=SeqID_133851
atggagatctatcatgtctacattgagtacacaggaattgaattctggagaaagaatgcccgagaaacaaagtataagggaatgactagactcctaagccctgaaaagatagaaaaccgcaggaggagaaaggtcactgttggttttgggaaacgatga

SEQ ID NO: 17074 - DNA, 366 bp, Glycine max
  Peptide Sequence Number=SeqID_133852
atggtttgcaatgaaaatgctaatatgaccgggcaattgcttgctgatgatgaaccctttgtaaaggttaaatgctcttttgccattggagctgctattgttgcgtcctttggatatcggaaggatatggatggtcaatgggtgcggaaacaagaccttccacctactgctcctgatgaacgtacaccttcaccactaccacaaagggatccctcctcttcactgctgcatgatgttctaagtgaactttgggatctttgggcctttgtaggtgatcgttttgatgttatggattcacgtataacacatcttgaggatgatatgaacttcatccatcaatgttttgatcctccgacagatccatag

SEQ ID NO: 17075 - DNA, 746 bp, Glycine max
  Peptide Sequence Number=SeqID_133853
ggatatgatatcaatggatattgtttccacacaaagtcacatgatgcaagaagtagcatgcagaacagtggggttagtgttgacggtcaggcagatcactttaatagtgtttttgataataatctgattcacgaatccatgccttactatggagtcattgaagatatttgggagcgtaattatgacctcgaaaagggtggttacaatgacaacctattcatcatggcagtgcaagctagacaagtgttttatgtccaagatccatccgactcgagatggtcagtgtttgttcaaggtagaaaattctctatgagtgactatagtgatggttcatcagttgatgtcagtgacatgccaatcgcttgccaacaaatgcccatcataaatggcatagatcatgatgatgttgtacatgcaactcgaaatgatcatcataaagttaatgtcaatccagccactaggagaggatcaggccctcataaagagaagtttcatagttacctaagagtagttgcacgagacaaaacttcgattgcgcacttgagttggaatgatgtactagaaactctaaagaatctgatatggggtgacattttggccaaattcaacatccccgagggtgacaatgcgaaaaagaagatcatgtcaatggtggctactcgatggaggcaatttaagtcctccctgacaacaaaatatgtttacggtaacagtgacgggcaagcaaaagatgatccttctgttaa

SEQ ID NO: 17076 - DNA, 393 bp, Glycine max
  Peptide Sequence Number=SeqID_133854
atggagattgggctcaagaaaggttctccttcctttaatgaggctcgtggagctggttttactgaggagaatggaattctggctgacatatgtcaaagtatcttaagcagtgatgttgtgttgctattcatttctgatgctgcagagattggtagacgaaggtctgcacacttgctgaagtaccctgatgctaaagtaataagccttggaattggtgatacaaataaacctattcctgtagtcataactaatgcaatgtcaaaggatcatatatttgtctcagatggagcaaagtgtgatatatctcgtctccagattgtctttgggtcaaatgtaaaaatggttgtgcaagacccttcatacccggtaattgtttgctctgtcattgtttaa

SEQ ID NO: 17077 - DNA, 318 bp, Glycine max
  Peptide Sequence Number=SeqID_133855
atggcaggatttagctcatacactaaaatccatccatgctctacagtccgtgattatagctctctattaaagcatacaacatttcagatgcatgctgaggttcaattgctttcgctagtactccccgttcgtcaagatatgccgaatggttactccaagcttgcaagtgggacaaccttcacattgggactcttggtgatgacaaggaaaaatgtggatgaccctagtgagcctcttaggattgtgttcaatgttgcaacttctgtttggatgccagtgtcatggcaaaggttgttcgactttctgcgtgatgaatga

SEQ ID NO: 17078 - DNA, 606 bp, Glycine max
  Peptide Sequence Number=SeqID_133856
atggcctcagaaaatggagagaaagtggagataggtttgaatgcagttcctcaagagacacataagccaaagaaggattgggttcttttgtccctcagaatggttgcattttttgccactgcttctgccacacttgtgatgacttttaacaaacaaaccaaaagcttcgtagttgccaccgtcggtagcactccaataacagccactcttgctgcaaagtttaaccaaactccagcttttgtgttctttgtgatagccaatggaaatgccagtctgcataacttggtgatgatagtaatggaagtattaggaccccgatatgattacaaaggactccggcttgcactaattgcaatattagatatgatgactatggctctggcttcagctggggatggtgcagcaacattcatgtctgaattgggaaagaatggtaattcacacgcaaggtgggataagatctgtgacaagtttgaaacctattgcaaccgaggtggtgctgcccttattgtctctttcgttggcttcattctcctcttcattatttcagtgatgtcggttatcaagctgctcaagtcaaatcgcattaaccacgcttctccataa

SEQ ID NO: 17079 - DNA, 1590 bp, Glycine max
  Peptide Sequence Number=SeqID_133857
atggctaaagaagaaggtgactcttgtctttggcacaagagacttggacacttaaactgcaacaatctcacattgctttctcaaaaaaatatggtgtacgggttgccaacaattgagaagaaaaatggagtttatgaaggatgtatgcttggaaaacaccactgccaaccatttccaaaggaaggagcaaggagagccaaagaattgactattggttatacacctcaagaaaatggtgtatccgaaaggaagaatcaaactgtgacgaaaatggctaagtccatgttgtttgagaaaggaataccaaaagaattttggcatgaggctgttaatatagttgtgtacctactgaatggattcccaacaaaagcggtgtttgctatgctcaagttcccaaagaaaagaggacaaaacttgaagaagcaggttgaggagaaaacaattccagcaataattttaaagcaaagtctagcctcatcagaaaatgagcaacaaattccaagcacaccatcgtcaccaacctctagttcttcatctccaagcttaagtccaataaaagtaaggagtctgagtgatatttataccatgtgcaattattgttctgtagaaccagaaaattttgaagaagcagttaaggaagatgcttggcggaaggcaatgcaagaggaaatagatgcacttgaaaagaacaagacatggaaactggttgagaagccaaaagacaaaattggagtgaaatgggtctacaagcccaatgttgactacgaagaaacattggcacctgtggcatgtttagacaccattagagctttaatctctcttgcagcccaaaatggatggaagttgtatcaactagatgtgaaaaggaaatatgctgcaaaaatattgaaaaattttgagatgtttggctgcaatccaatcgatacaccattggttgtgaatgaaaagttgaagaaagaagatggtggaagaaaggtagatgctagcaactacaaaagcttgattgcaaaaagggtgctaaaatacattcaaggcactttgaactatggaatcaaatatgacaagaaggtggaagcaaatgtaattggcttttgtgacagtgattgggcaggctgtatggatgaaatagaaagtactttcggatatgttttctcactgggtttaggagaattttcatggtgctcaaagaaacaacaaaccgttgcccaatcttttgcaaaagctgaatatatttcagctggcttagctacccaacaagcaatatggttgaagagaatatttgaagactttggtgaaaagcaagggacaatgactatccattgtgataacaaatttgctattgctatcactaagaatccatcaaatgatcaagttgctgacattttcacaaaggctttacctagagaaaaattccaaaaattgagagaagcacttggagttcaagaacagcacattaagggcaagaatggagctggaagatcaagagttttgttgtggaaggtggcaaagggtgttttagctacaaatgaagcaaggtgtgaaggggggtttccagaatcatggagttgtccaatgtgtgagaatgagaag

SEQ ID NO: 17080 - DNA, 413 bp, Glycine max
  Peptide Sequence Number=SeqID_133858
atgaccttgtcctttttgcagaaacatccttggaccaagtggagaatatatcagcttgccttgacatctttagtgatagctctggagaaaagtatattagtcaggctataggattccaatgtacagatgatctagggaagtatttaggaattaagttgcatcataagagagtcactattagaaaatacagtttcaacatcgattatttacggcattctacatcggttttaaaaccgatgttgaattcaaaatccatgcctagggcagtttgtgacaagttggaccaaacttgttggaatttcatattgggggatactgaatccacgaagaaggtgcattgggtggcacgaaaggacctatgtaagcccaaagagaagggggagtattggactgcgtttggcgaggcatgttaa

SEQ ID NO: 17081 - DNA, 258 bp, Glycine max
  Peptide Sequence Number=SeqID_133859
atggggattatcatgatgttaaattgtaacggcgcaaagatgcggaacaagaacaactcttcttgggatgggataattcagaacaataatggtgtttttatgggagggttctcgtgtaatctgggaagtgtgtctgttttgcatgctgaaatatggacaatgtttcatggacttcagcttgaaagagagcgggggatttataatattgagttacaatctgactcggtggaggctattgctttgatggtggacgattga

SEQ ID NO: 17082 - DNA, 213 bp, Glycine max
  Peptide Sequence Number=SeqID_133860
atgtcacatcctatcagagcattgtgtcccgacgtccttcagcacaagggagaccagtcatggttacagtgttttgcgagaatgctccaaccatgtgggattggcacaagcttaaaggagcacttaaaccaggtgacccccaaggcctacactccgaagagtctgtcagggcctctccctcctgatttaggtccaacccagaaaacattttag

SEQ ID NO: 17083 - DNA, 369 bp, Glycine max
  Peptide Sequence Number=SeqID_133861
atgccaactattgtagatggggtctccaatatttgggtttggaaggagtgcatatatggggagttttcaattaagagtgcttataggtacttaacttcctcgacccaatctttggaggatgaggtgatgtatgatagaggtattctagaggatctaaggtgcccaaagtgtggtgaggagactaaggacattcttcattgcatgatcatttcccatgacatgtctgttgaaaatctccctgagtcatttccgacggacatggagagtgtctctgttggtcatctacctgctgatcatctgtctgttggtcatctgcttggtcctggtgatggtcccgatgctgttggtgaggtcgttgttattgattaa

SEQ ID NO: 17084 - DNA, 363 bp, Glycine max
  Peptide Sequence Number=SeqID_133862
atgcgtaatcattttcatgctaaaacaaaagcaaaatcaagatatcttcacacagagctaaccattggacaaacaatttttgtccaagaacaaatagatgttattctggaaggtctgccaagtgagtatgagtcactggttactgcaatcaacaaagaattgtgtactgcctattgtattggaaaatcccaaagacttccctctcacccctctgaatttgtctattgtgctcctcttgagttaatatttgaggaagcaatgccttcgaagattattttgatgatgctaaagactcaagtcaagaatcaagagtcaagcaagtttcaagaatcaaagaattgttcaatcaagattcaagattaa

SEQ ID NO: 17085 - DNA, 294 bp, Glycine max
  Peptide Sequence Number=SeqID_133863
atgtgtaaaaagtttaaagaacaaagtggaaccacacagtccacactaaacacggaaggaaaaccagaggcagcaagaaaaacagaggtagcgagaaaaaaccagagaagaaataggaagcaagggcctatctgcgcggggaaggaaacggacgcggcactgtgcagcaatggaggcgcttgtgggaacaacaaggagaaaacgcagaagaactattcttttgttaaacctggggtacgattccgtgaaattggtgaagttattaatcgtcatgcttcaatgtctgactattaa

SEQ ID NO: 17086 - DNA, 477 bp, Glycine max
  Peptide Sequence Number=SeqID_133864
atgggggtaatggccttaaaacacaaaaaaaatggagaaatatttggaaactattcacaagatgacttaccgagtagcaatagtatccccaattctttctctattgagagatcttgtactccaagaaatggaagtcaaggttttgtgcctgctcaacatgcttatccatattatattttaggattttttaatcacgttatattgattaaatctttcaacaatcaaagcaacaacaacccgtgttcagggactaaaaaagccctaattgggaattggaaaatgactacttacgaattcacgaatgatgcccttgtagacaaggacgggaataacaatgtcgaagatgccaacaagagaaaggttgcaacgatgccttcggccttactcggagctaccggaacagtgactcagcggggaatttttcattggagtcagacaaaaacatcgacgaagaagaagaagaagcgcaacgagtaa

SEQ ID NO: 17087 - DNA, 300 bp, Glycine max
  Peptide Sequence Number=SeqID_133865
atgttacatttctacaaatccatttatgtttctacttttctggttaagatttttgagttatatagtgtggatagtcaagaaatggaaagtagtatagttgatgctttagttgcttcaagaaaacctagaagagatgaaagggaagaagaagaacttgaacaagcatttttcattattgttagtgttgccactatgcttttgagtgcaatgacttggtatcacggcaagtactctgttagggaacgagcccaaaatttggaattaaaaagacatagtttcctcaatcgtcaatacaagtaa

SEQ ID NO: 17088 - DNA, 141 bp, Glycine max
  Peptide Sequence Number=SeqID_133866
atggataccttagagccctacactggggcaatgaggggcatcgtgcatgaacctcaagttccctgctacaaggtcatgacaaaagacaacgattggtacctcaaagccttacactggggcaatgaagggcaccgtgcatga

SEQ ID NO: 17089 - DNA, 753 bp, Glycine max
  Peptide Sequence Number=SeqID_133867
atggcgacgatgtatagtcctctgatgttgagtacgtgtactcctttgaaggtaagggtgtgtaaccctacgaaggcgagtgcgtgtagccctctcaaggggaggatgtgtactcctctgaaggcgagggcgtctagccctcggaaggcgaggttgtgtagtcctctgaaggtgagaacatgcagtcctgttaaggcgagggcgtgcagtcctctaaaggggaggtcatgttgtcctctgaaggggaggacgtgcagccctctaaaggcgaggacgtgtagccctctgatggtgacgatgtatagtcctctgaagttgagtatgtgtactgctttgaaggtaagggtgtgtaaccctacgaaggcgagggcatgtagccctctcaaggggaggatgtgtactcctctgaaggcgagggcgtctagccctcggaaggcgaggttgtgtaatcctctgaaggtgaggacgtgtagtcctctgaaggtgaggacgtgtaatcctctgaaggtgagggcgtgtagtcctcaaaaggtgaagccgtgtagccctcgtaaggcaaggacatgtagtcctccaaaggggagaacgtgtagtcctctgatgtggaggacatgtagtcctctgaagtggagtacatgtagttctcttaaggcaatgacgtgtagccctctgaaggcttggacgtgtagtcctctaaaggcaaggacgtgtagcccactgaagggaaggacgtgcagacccctgaaaggttag

SEQ ID NO: 17090 - DNA, 1255 bp, Glycine max
  Peptide Sequence Number=SeqID_133868
gagcgcaaaccgtgatgctgatggagctgattgcgcatccgcactggttctggctcacgctgggtggtttactgctggctgcggagatgctcggcaccagcggttacctgctgtggagcggcgtggcggcggtgctgggcatgttgttcgccgccctgacgctgctgtgcgtgtttttctggtatcgctggatgcgctttcgcgaaagtgcgcagcagcccaatacgctcaatcagcgcggcagccagctgattggccagcacctgacctggcgcgtgcaggcgcaggaagatttgccggcgggcacgccggtgatcgtgaccggcgtgtcaggcatcacgctgctgattcagccgcgtttgccgccctcccgatgaccgcagcccgccaggtgattgatgatgggacattcggcaccgtcatcgcccgggcaggctgcagccagttccagcagacgcgcgcgcatcgcgtgcagctcttcaatatgcgccgcgatctcatccgccttttgcagggtgcgcgctttaacatcggcactgtggcgcgccgggttattaaacagcgcgaccagttcgcggcactcctcgagcgtgaagcccacctgccgcgcctggcgcagaaaattgagctcgtccagatggcgctggagcagcgcagcgatgtggaacaggccgaagtaacgcagcaggaagcgcgcgtcaccggcgcagccagcgtcagcgatctgattgccaccgttgagcaggctggttatcacgccacgctgaaaaatgaggcgtccagcccaaagcctgatccgttgccagctcaggagccgcagccggaggcgctgacaacggagtcgcagccggcagaagagaatcttgcggtgcaccacctgctgattggcgggatgagctgcgccagctgcgtcagccgcgtcgagcaggcgttacagaaagtgcccggcgtgagccaggcgcgcgtcaatcttggcgagcgcagcgcgctggtgctgggcgatgccataccctcagcgctggtcagcgccgtagacgaggcgggttattctgcggaagtgatcgaagatgaacaaacccggcgcgagcgccagcaggtcagcgcacagcaggcgatgcgccgctttagctggcaggcggcgctggcgctgatcgtcggcgtgccgatgatgatctggggcatgctcggcgatcacatgatgctgaacgacagcaatcagacgctctggcgcgtgctcggtgccgtcacgctggcg

SEQ ID NO: 17091 - DNA, 360 bp, Glycine max
  Peptide Sequence Number=SeqID_133869
atgatggtgtgcccgttagttggacatgttagcgatacacgtgaggagccacatgaaagggtgggaagtaatatgggcaatgtgggttatggaagtaatgtggatgtgaatcatttgttgtcacaaatagaggagctgaagcggaaggttgtagtaaatgaagaaaaagtttgtttgtataaggaacaaatcatggagttgaagaagatgctggctaaagaagaacatcaatctcaagcaagttatgaagttgttgttgaactaaggaaaaaaattgcaaagcaacatactaagattaacactgaacaaaagatggtcaaggttttaggatgcattgtagcgttccttggggtttattaa

SEQ ID NO: 17092 - DNA, 233 bp, Glycine max
  Peptide Sequence Number=SeqID_133870
ttcgaatagctgcacgtcttctatggtggcattggcgaatggttctatcagaaaatgcagaagagctgccacttgcagacatggaaaaatcaaagcccactaggaagaagatggagtggggggagaaaaaagatagagtaagggggacaaataagaccaaggagaaacacacacacttaagacttcatcatgttagaattaagaggagagaagctttagaaaccctaatttga

SEQ ID NO: 17093 - DNA, 402 bp, Glycine max
  Peptide Sequence Number=SeqID_133871
atggaagacaacgacaattcttccacccttgttccaaataattcaactaaagagttaagcaggattcagattgagcaacatgctgatgtggattatcatgtttgtccatcattagaggcaccaaaagaggacattggggaagacagaatgaattcaagtgctgggtttggggatgcttcagcagatggaagatcggtttctcctactaaggaatcgccatcatgctctatgttggatgctgagaaaccatattcatcttcaaacagagtgatgtctgcttttccagaggccaacacccaacgagtaggcaagtttgagacagatctgatggctcctcctcctatggggctgtccccagaagtggatgacttgtcaatgggtgatttcatatcagaaacttaa

SEQ ID NO: 17094 - DNA, 513 bp, Glycine max
  Peptide Sequence Number=SeqID_133872
atggggtggcatggatccggaaagagcactgttcttaaaaacattcttgatgacaaatcactatttcggtcagacgctttaaatgttgctgtggttgaggcagatgctttgaaggaaggaagcccacgggcacgaatcttccacttctgcatcatctctctgctagtgacagctttaaatgagggcctagatgtgatcttggatactacctcatcatgggaaccatatgtgacgcaaactattgctatggcaagagaagttcacaaacacagcttttgtgggagaataaaggtgatcccaataacagcagtggaccctgaagctatcaaattcttggaaagcttttgtgggggaataaaggtgatcccaacaaaagcagtggaccctgaagctatcaaattcttggaaaggttaggcactttgaatgctgaagctgattccatctacgaacttcacaaggaacctagccccattatcgaatctggaattgaatattccacgggtctcagttaa

SEQ ID NO: 17095 - DNA, 219 bp, Glycine max
  Peptide Sequence Number=SeqID_133873
atgcaaagattaaaaatttcagggcagggcatatatcttgttatgaattctctgttttatgggtttgggattggaattgttttatgggaagccaacttgtgtgtaatgggtgtaggaacatcttggtttaccctagaggagcaaccaatgtttgctgtgcattgtgcaacaccgttacctctgttcctcctcctgtttcacagttcacacttggattga

SEQ ID NO: 17096 - DNA, 456 bp, Glycine max
  Peptide Sequence Number=SeqID_133874
atgctcttgcaggtgttggcagttgactggaataccatgcaggcaccaatgtttgatcgtagattgctaccatctgactttgttcatccatattatcatgtggatacttatataaattgttatgcatccattctggaaccaattaatagagaagatatgtggcagcaaactggacttccaactgtcttaccccctcaagttagagtctcaattggcagaccaaagaaggctaggagaagagaaaatgatgaagcaccaaaacctcataagctaaagaggacaaacacatctttgaggtgcggcgggtgcggtgcgatgcgaggtgctgtgccgtgcgaggtctgggtgaggtgcagtgcgatgcgaggtgttgtgcgatgcgaggtgcaggtgcaaggtgtcatgcgagtgccctacggtgcgaaaacacacttgagcgttctacatgcaagttga

SEQ ID NO: 17097 - DNA, 1449 bp, Glycine max
  Peptide Sequence Number=SeqID_133875
ggttataaaggttctgttcagattttctatcgccaacttggaataaggttggataaagatcttgttaaagtttggaatgatgatggagcaagggaaattgttaagattgccatggatttgattcaaaaacatgttgaagtatatattgatcatacttcacacatgacagagggagttttactggctattgatgagggaggaaaacccatggtcgaaggagattcggggaatgatgtcattgatggaaaagatagcgatagagaggttgacaagtttgagttggatgatagggataaggaaactgatgaagataagggagatgatgataattatgaggaaaatgataactatgatggggatgacttggatgctgaatatgatactgataaattagaatctgatatagcaagtgaagaagattatgactgttatgcacttactatggcagcaattaatggtgaagatatatcaataaaaccagtttccaggagatttcaacctcatgaaatgggaagagattttaaatttgaagttggtatggattttgattcaattaatcagttcaaggcatccatcaaagaatatgcaaacatgcatggttttgggctgaaattcaagaaaaatgataatgttagatgtagggtgatttgtcaggatagttgtgaatggatggcatatgtgagtaaggttggtggatcaacaatatatagcatgaagacttacaatggaaagcacacatgtgcctggtctggtggtggtaatttggcaacaatcagtgaaagctattgtgtaaaaatatctagcaagaaggcatattgggcaagaaggattgcaaaggaaaagccatctgcatatggtagtggagaagagtttatgcgattttatatgtgtcttaatgatgtaaagcaaggatttctgcaagcatgtaggcctattattggtcttgatagttgtttcttaaaaacaccttttggtggtatattgttggtggcaatgggtcaagatcccaatgaccagtactatcctcttaccgtggctattgttgaaagtgagaacaaagactcttggaagtggtttctacaaaaattattaagtgatattggtcatgagcataagtgggtcttcatttcaaatcaacaaaaggaactgctacctgtttttgaacatagggtgtgcgtgaggcatgtatatgcaaacatgaagaaatattttggaggtggtgttgttcttagggacaagatgttggcagcttgtaaagctacatatataggagattgggagcaaaaaatgattatgctaaaacatgaggtacatgactggttgatgcagcttgacccaagattttggtcaaaggctcacatgtcagagtactctaggtgtgatatgatcatgaacaacatatcagaggcttttaatggtaggattttggaagctagggagcaacccatc

SEQ ID NO: 17098 - DNA, 282 bp, Glycine max
  Peptide Sequence Number=SeqID_133876
atgggtcatgaagatgaggaggatgatgatgataacaacaataacgatgatgataatgatggtggtaatcatggcacctcgcaccgcatcgcacgacaccttacacggcatcgcatggcacctcgtacgacacctcgcaccgcacctcacacggcatcgcacgacacctcgcaccgcacgatagctcgccctgcacctcgcatgacaccgcacgacacctcgcacggcaccgcaccgcacctcgcaatttttgttgttgttaagtattattttctgttgcag

SEQ ID NO: 17099 - DNA, 912 bp, Glycine max
  Peptide Sequence Number=SeqID_133877
atggctacaccacccaactcccctcctcctcctcttgagtcaacaacaccttcaccatctacatcgaagaagacaagaaaagcaacacgactcaaatcattggctactagaccagctagggtggagagaccagtggttcatgttaatcctgtcacggggagaggcgatggtccccacagaaagaaattaagaaaatattggtggattgtcactcacgatatggtggatgttacatttgataattggaaacaagtccctatagctcaaaaggatttgatctgggaggatattcagggcgaggatgacaaagtatgtgagaagtacgacataagcaaagaaaagtggacccaattttgtcaaagtcgtagagacccttcatgggaggaagcatcccaatccgggagcactaatgcagtcgttgatcctctatctcccattagaggacacatgaagtggaagatggctcgcaggaaaaaattaggtcaagtgacgtttgaggcaacaaaggaaattacaaacaagattgattccctaaaagagcaggcctcacagggaagctttatcgcccatgtgtcgtgggatgctaccgtgtttggggttcataatgataactttccattgtacataaagcatgaagatctttctgaaatagcacacggtggtcaatgtctgagcatctctgacaatgttgtgatctggttttgttccttgcacaataggcctaacaactacttgaaaggaattattaacaggaattcaacaacaatcaacaaagtaaatccaaggcttctgctagatggtgatgcaatcctccctaggaaaggaccagttaccagagccatgagcaagaggctccaagaggattgggctagagttgataaagaaggccttagggttctcatgaaccttagg

SEQ ID NO: 17100 - DNA, 447 bp, Glycine max
  Peptide Sequence Number=SeqID_133878
atggcgttttctacttatcctaaatcgccaacactgatggcgtttttagctgatattaaatcgccaatcttactgttgttttccatgtacacagacctgccctctgaaaaagagcagggaaaagctgaccctagctggtgtcgccaagctaaccagcgattttactctgcatggccaaagcgccagtgcagggcatgttcaaaagagcaccctcatggaaaatgtttcaaaacagccctaaatggggaaatagtttgtaaaagaaccccatttggggaaatttgccagttgatgatagtttcgagatggtggtggtttgtggaggtttatagtggggtgaatcaaggttctgattcatcgttcctcgatcttctggaagtgttcgttggtgaagtcgaggttgtccatggtgacacaatctgcgcattggagaagactaaggagtga

SEQ ID NO: 17101 - DNA, 348 bp, Glycine max
  Peptide Sequence Number=SeqID_133879
atggatccaaatatcgatttagatgaatttctagatcaaatgattgatgaggaatttgaagacaacaccaatgaagaaatcattaggttgactcttaaaagccaacaacaactacatggcaacaccactaggcatagccaaagaagaaaagtggtacatcgtaatcgtgaagaagacgtgctcaacaaccatgatgaatactttcaattgagggttgatacactacgtcgaaaaggcctatctccattgcagaagtacacaactgctattcatatattggcttatggatcacctgctgacagtgtggatgaatacattctaattggtgaaacaactgcattggaatga

SEQ ID NO: 17102 - DNA, 504 bp, Glycine max
  Peptide Sequence Number=SeqID_133880
atggggaatctcacatgttccctcttactactcttctccactatagtcattgtcactgaccacattgtgggtgccaatggtgatgctgcattgatagaggttgtgaagaaacacatcgagatagggataggacttgaagcattgccattggttgaagaagaaccaccaaataagaacaatagccaatcaaattacaatgttgatgccaatgagttcccctctgagggattgcatcattccctcccccttgaaaaggatttgacctcaaatccagaggttcttgaaactctgggcttcttccctcaacacctagatgaagatgctctcataccacatgatgtagctccatatggagcttatacaccttggatcttcttcatgaatgatgtcctttgcttcttgaagttcatggcagcggaatggagaatgaagaaagacaattggagacatcacttcaaggagaagatgagtcaagaagaagctcaccaccataggaagccatag

SEQ ID NO: 17103 - DNA, 195 bp, Glycine max
  Peptide Sequence Number=SeqID_133881
atggttgttgttgtggtggttgatgatagtttcaagatggtggtggtttgtggaggttctgattcatcattcctcaacaggaagtgttcgttggtgaagtcgaggttttccatggtgacacaatctgcgcattggagaagactaaggagtgagaccaatggactcgccgtcgtgaggttcaggatcaaaggatag

SEQ ID NO: 17104 - DNA, 609 bp, Glycine max
  Peptide Sequence Number=SeqID_133882
atgattaaaaatgcgtacaacaatgacaatgtgcgtcaaagtgggcaattttgtgaaaaaaattggactcaattaaaatctcgatggaataggatctatcctccagttcaaaagtttaacgggtgctacaaacaagcagataaacataagagaagtggaagttcggagaatgatgctatggctgatgctcatatgatttattcacaagatacaggtaaaatatttaagtgttcaaaaagaacaaaggtttctgcttctggaaattactcgtcgtcgtctaacccaaagacactcgttgaagtcgaagaatatgatacgccatcgccaatatctctcccaattggacaaaaagcagcaaaaaggaagagcaaaggaaaagaatcttctaacactctcgatttatctggcatagaaagtgtaatgaaagacaaaaatgtgaacacatcaaaacttattcagttaaaggaggcacaggaaaggtgtctgcaagaacaggagcgacgtatggagtatggaatcctcatgaaggatacatccaacatgtctgaacagcaacgcaaagaccatgcaaagtattttgaccatattaggaaaaaactaggatattaa

SEQ ID NO: 17105 - DNA, 171 bp, Glycine max
  Peptide Sequence Number=SeqID_133883
atggctgttgcaaccagaggaattgaaagagagataacatcgcttcagatggaggaaaaaaaactggtggcagagattaaaagagaagcaaaaacaggaaatgaggttgacactgatattggtaactgttggaaagttgccttagttgaggtcacgcttggcctgccttag

SEQ ID NO: 17106 - DNA, 165 bp, Glycine max
  Peptide Sequence Number=SeqID_133884
atggcgagttcactgcgaaacggccacgtggcagggaaaccgccagtcgtaatggctacttggcctcaggtggaactcgccacctctactggcgaagaaagggaagttgcaactcccattggcgagttagggcagaaggatcagccatttcagatggcgatttaa

SEQ ID NO: 17107 - DNA, 750 bp, Glycine max
  Peptide Sequence Number=SeqID_133885
atgattgatgagcccatctattggatacccactttgaagttcctagcctcttgccgagggtggcagcctactatttccccacccgaggatgatccacatgcggagcatcatatgacattagcaaagttcaacatcatcctgggttttgagatagatgcctccatcctgactgaagactattgttgggcaaagttaggagcatatgagggatacacaggggccaacacttggatgaagatcacatgccaaggtggttacaaagcacaacactccaaggccagccagattagataccccattctgcgagccattcagaagtggctttcaggtttccttcactgccgcaagaacagtgacggccacatcatcattggtgctttcattgccaagttggcacactacctgggttatgaccctgacactgacgataccccacctgttcccatgtttgtcattcgccgtgctacatttctgagcattggctgcattcgtcaggaagaaaatggttatgtcctcattgagcatgcaccacagcaacagccccccgagggagcaccgcataaggacgaagacatgcaggacagccttagcaccattcagtcatcagcagcctcagttttaattagatggaagagtgcttccaatctcactatgctgctctggcaactcacctcgatggcatgtaggagcggatggacactcatagggcgatggttcagacattcctggatgcctatgacgccagattga

SEQ ID NO: 17108 - DNA, 399 bp, Glycine max
  Peptide Sequence Number=SeqID_133886
atggatcgagtatttaggaatgacagccctacaaagcaggtgtatgaagaagcagctaaggaagttgctctttcagttctcagtggcatcaactcaagcatttttgcgtatggacaaacaagcagcggaaaaacatacaccatgagtggcataacagattttgccatagcagatattttcaactacatagaaaagcgcacagaaagggaatttgttttgaagttttcaacattggagatctataatgaatctgtcagggacctccttagtgttgacggtacacctctcagacttcttgatgatccaaagggttttggaggggaagaggggagaatgggggtggaggaggaatgcggagttgagggtggtggtggcaccgggaagaagatgaagagatga

SEQ ID NO: 17109 - DNA, 339 bp, Glycine max
  Peptide Sequence Number=SeqID_133887
atgactagcggtttccctgccacgtggccgtttcacagtgaactcgtcattgacaatggcggtttgctttgcaatccatgcatgaacttgcatcgggctttaggtagagttttaggaagatccttaggtagacaaattattggtgatgaggaagaagcccctcagcgtcgaaggctgacaacatccgcacgtagacaacaagcaattatagttgttgccaaggatattgaccatgtggatcatgttgctgatgaggttcatgaggagccacacgagccaattatggatcatgaatgtagtaagttgaagttgtcctctcatgggaggaaggtgcattaa

SEQ ID NO: 17110 - DNA, 1005 bp, Glycine max
  Peptide Sequence Number=SeqID_133888
atgtcatcgtcgtcgattaatgcagttctggtgaccggaggtccggaacagatagatgttattcttgaaggtttaccaagtgaatatgagtcactggttactgcaatcagcacaaaggcagaggatactgattcagaatcagcacctcaagtgcagtttcctcaacataatgatgggggcagatctcctaattccagaggaagaggtggcagatctggttatggatatagaggagacagaaattatggtaccaatgataacagaaactatggaaataatgatagcaggaatttcggaaatggtaaccacatgaattatggaaatgctgcaaattatggaaatactgataggtataaaatacagtgtcaagtctgctacaagtttggacacagtgcagctgattgctatcacaggtttaatccaaattataggcctaattctcagccacagcagaatgcacaagctcctcaagcctacttagccaatgctaatcctgctcagcaggcacagaattggtacatagattctgaagcaactcatcatgtcactgcatctcctcagaatttgatgaatgaagttccaacctcgggcaatgagcatgttttccttggtaatggtcaaggtttgcctattatttccactggttcagcaatttttcagtctccatttgcctctaatgttaaattaactctaaataatctattgcatgttccccacataactaagaacttagttagtgttgatggttcaatactccccagaggtgctcttagccaagatggcctctatgtcttctcaaatcttctgaattcttctgtcaagtctactgttggaggggcttctgcctctgttcatatgtcttcattttcagctttgtcttctcattgtaataatgtcagtactactgaaatcaataatagtaactctagtttagtttccctttggcataacaggctaggtcatcctagttctgctgttgtaactcatgttcttaaggactcgtaa

SEQ ID NO: 17111 - DNA, 270 bp, Glycine max
  Peptide Sequence Number=SeqID_133889
atggcaccacccactgacctgagagttatagcttctgaaggctttgatctaatagacaggttttatggtccatcagcacaaagcagacccaaaaggaatggggtatttccttcaagacaaggaccttgggtggttcaagtgcccaatgatgagttggaagagcctatgagtgtcatcaatagcagagatgctgcagctcgctatggtgggattacgattgtcaattaccccaagccacaaactcgtcttgctagatcattcaaaccttga

SEQ ID NO: 17112 - DNA, 279 bp, Glycine max
  Peptide Sequence Number=SeqID_133890
atggcaaatcttgttccagctgtaacatttataatagcagcttgtgcaggaatggagaaagtgaatattcgaagcacgagatctttagccaagataataggaacagttatatgtgtgagtggggcagtttccatggctttgttgaagggtccaaagctactaaatgctgaaattttgccatcaaaatccatcatggcctcaggaggcgatcattggttactgggttgtctatttctcactggatgctgttgtgcttggtcagtctggctcattttgatg

SEQ ID NO: 17113 - DNA, 162 bp, Glycine max
  Peptide Sequence Number=SeqID_133891
atggagaaaaaagaagctcaagaagtggtacatgaagtggtgaatgagctagataatatacctaattttaatggtgcacttcgacatagagcaatcaattggttgacaggaaatcccattaagtttgagattataaaagctcttccattggaaaagatatga

SEQ ID NO: 17114 - DNA, 999 bp, Glycine max
  Peptide Sequence Number=SeqID_133892
atgttcacggctagtaagctagccttcacattaacaccacctcgtccatgcactgcacctttgacaccaatctcttccttgtcctcttcttcttcttcttcttctgcttcagcttctggtatcaacttcattcagttcaatggacgccacttatgcctccgacgcaggctgtttctactctctcctaaggccactgcagatcaacaagggaaggttgaagaatttgaagatgattcaaatgttgttgatagtaaaatcctcccatattgtagcatagataaaaaagagaagaaatcaattggtgaacttgaacaggaatttcttcaagcactgcaagcattctattatgagggaaaggctatcatgtcaaatgaagaatttgataatctcaaggaagaactcatgtgggaaggaagcagcgttgtcatgctaagttctgatgagcaaaaattcctggaagcttctatggcttatgtgtctggaaatccaattatgagtgacaaagagtttgatgagttgaaactgaggctaaagaaagaagggagtgaaattgtggctgagggtccaaggtgcagtcttcgtagtaaaaaggtttacagtgacctatctgttgattatttgaagatgttcctgctgaacgtcccggctactgtgattgcattaggattgttcttcttcctcgatgatctgactggatttgagatcacatatctgctagagctgccggagccttttagtttcattttcacttggtttgctgctgttcccctcattgtgtggatagctctgtcactgacaaatgccattgtaaaagactttgtgattttaaagggtccttgtccgaactgcggtactgaaaacacctctttctttgggactatactttcaatttcaaatggtggttccaccaacactgtcaaatgctccaactgtggcactgcaatggaatatgattcaacttcaagattgattacattaccagaaggaagtaacgcctga

SEQ ID NO: 17115 - DNA, 404 bp, Glycine max
  Peptide Sequence Number=SeqID_133893
gccatctctcccactctcgcgttccttcttcgtcgcctcgacttcttcgttgcgacactgagagagttgagggagctggcggcgctttgacttcttcacagtgtcactctgtctctctttttcttctcacactcacgcctcacacagttcctaaatccctagccaattcctacattgtctgcgcactggcaccaaacaaccataagatctgcaccgtcgctgaaatcggcctcaacgacgcatgccgtcgggaatcagcaactttgtggttgaagcgcaagggcactggtgctgctggaaggaaacaatcgaagaaagctgctaaggaggggaagaatccagaggaatacgagtctgacaagttaaagtttgaagtcaatgatgatgaggtagatggatattaa

SEQ ID NO: 17116 - DNA, 2268 bp, Glycine max
  Peptide Sequence Number=SeqID_133894
cacattgaaccaaagaatctttgcctttcattcttctccatccagcagaacatggattctttctttttcattgctctccatttcgtgttgagcttccacattcattttgctcatggaaatgaactaccttccgccgcaagcagttcaaaaacatatattatccacgtggaggggccacagggtaagaatcttgctcaatcagaagatttagagagctggtatcattcattcatgccacctactattatgagctctgaggaacagcctcggatgatttattcataccggaacgtgatgagtggttttgctgcaagactcacggaagaagaactgagagctgtgcaaaagaagaatggctttatttatgcgcaacccgaaaggatactgcatcgtcaaaccacgcataccccacaatttctggggttgcagcaagacatgggattttggaaggaatcaaacttcggaaagggagtgattgttggggtggtggattctggaatcacacccggtcatccttccttcagtgatgcaggaatgccgccaccaccaccaaaatggaaagggaaatgcgaacttaatgcgacagcttgtaacaacaaactaataggagcaaggtctttcaacctcgctgcaacggcaatgaaaggagcagattcaccaattgatgaggatggacatgggactcacacagcaagcacagctgctggtgcttttgttgatcatgcagaattactaggaaatgccaaaggaacggcagctgggattgcccctcacgctcacctggcaatgtacagagtatgctttggtgaagactgccctgagagtgacatattggcagcattggatgcagctgtggaggatggcgtggatgtaatatcaatatccctcggcctaagcgagccacctccatttttccatgatagcactgcaataggtgcatttgcagcaatgcagaagggaatctttgtaagttgtgcagcaggaaactctggccctttccatggctccttaattaatggagccccttgggtcctcacagttggagcaagcaatattgacagaagcattgcagcaacagcaaagctgggaaatgggcaagaatttgatggggaatctgttttccagccttccgatttctctccaacattattacccttggcatatgctggaaagaatggcaaacaagaagctgcattttgtgctaatggatccttgaatgatagtgatttcagaggcaaggttgttttgtgtgagagaggaggaggtataggaagaattcccaaaggagaggaagtaaaaagagtaggtggtgcagccatgattctcatgaatgatgaaagcaatggcttcagtgtcttagctgatgtgcatgttctacctgcaacacatttaagctacgattctggactgaagattaaagcctatataaattccactgcaatacctacagccaccattttattcaagggaactataattggaaactccttagctcctgctgttacatccttctcttcaagaggtcccaacttgccaagtcctggtattttgaaaccagacatcataggaccaggcgtgaacatcctagctgcctggccattccccctgaataacgatactgattcaaaatccactttcaacattatgtctggcacatcaatgtcatgcccacatcttagtggcgtagctgctttgctcaaaagctctcatcctcactggtcaccagctgccataaaatctgccataatgacttctgcagacataatcaattttgaacacaaactcattgttgatgaaacactttaccctgcagatgtctttgccacaggttctggtcatgtgaatccatcaagagcaaatgatcccggattagtttatgatattcaacctgatgattatataccttatctgtgtggtctaggctatggtgatactgaagttgggatcattgcacacaaaacaattacgtgctctgagacttcaagcattcccgaaggagagctcaactatccctcattttctgttgtgcttggttccccacagacattcacaaggactgtgacaaatgtgggtgaggccaactcatcttatgttgtcatggttatggcaccagaaggggttgaagtgaaggtccgaccaaataaccttaccttttcagaagcaaaccagaaagagacatattcagtgtccttcagccgcatagagtctggtaatgaaactgccgaatatgctcaaggatttttacaatgggtctctgccaaacacact

SEQ ID NO: 17117 - DNA, 264 bp, Glycine max
  Peptide Sequence Number=SeqID_133895
atggtggtgaacttcttcttgactcatcttctccttgaagtggcgtctccaatcatatttcttccttcttcattcgcttccattaaacttcaagaagcaaagaactccattgatgaagaacatctaaggcctacaagctccacatggagctacatcatgtggtatcaaaagcatcttcgtctaggtgatgttcttttgcttcctctatctttttgttcggttctatcttttttcattcataatcttcttgtgctgaacctttag

SEQ ID NO: 17118 - DNA, 2162 bp, Glycine max
  Peptide Sequence Number=SeqID_133896
atggatgctttccttttcattcttacattcttgttgagcttccacaaactttcttctgccgcaagcagttcaaaaacatatattatccatgtggaggggccacaggataagacactagatcaaacagaagatttagagagttggtaccattcattcatgccacctactactatgagctctgaggaacagcctcgaatgatttattcgtaccggaacgtgatgagtggttttgctgcaagacttactgaagaagagctgagaacaatggaaaaaaagaacggctttatctctgctcgtcccgaaaggatgctgcattgcctaaccacaaataccccacaatttttggggttgcagaaacaaacgggattatggaaggaatcaaactttggaaagggaataataattggggtgctggattctggaatcacgcctggtcatccttcatttagcgatgcaggaatgccgccgccaccacctaaatggaaagggagatgcgagattaatgtgacagcttgcaacaacaaactaattggagtaagggctttcaaccttgcagagaagttggctaaaggagcagaggcagcaattgatgaggatggacatggaactcacacagcaagcacagctgctggtgcttttgttgatcatgcagaattactaggaaatgccaaaggaacagcagctgggattgccccttacgctcacctggcaatctacagagtatgctttggaaaagactgccatgagagtgacatattggcagcaatggatgcagctgtggaggatggcgtggatgtaatatcaatatccctcggctcgcatacgccgaaatctattttcgatgatagcactgcaataggtgcatttgcagcaatgcagaagggaatctttgtaagttgtgcagcaggaaactctggccctttccatggctccttaattaatggagccccttgggtcctcacagttggagcaagcaatattgacagaagcattgcagcaacagcaaagctgggaaatgggcaagaatttgatggggaatctgttttccagccttccgatttctctccaacattattacccttggcatatgctggaaagaatggcaaacaagaagctgcattttgtgctaatggatccttgaatgatagtgatttcagaggcaaggttgttttgtgtgagagaggaggaggtataggaagaattcccaaaggagaggaagtaaaaagagtaggtggtgcagccatgattctcgcgaatgatgaaagcaatggcttcagtctctcagctgatgtgcatgttctacctgcaacacatgtaagctacgatgctggacttaagattaaagcctatataaattccactgcaatacctatagcaaccattttattcaaggggactataattggaaactccttagctcctgctgttacatccttctcttcaagaggtcccaacttgccaagtcctggtattttgaaaccagacatcataggaccaggcgtgaacatcctagctgcctggccattccctctgaataacgatactgattcaaaatccactttcaactttatgtctggcacatcaatgtcatgcccacatcttagtggcatagctgctttgctcaaaagctctcatcctcattggtcaccagctgccataaaatctgccataatgacttctgcagacataatcaattttgaacgcaaactcattgttgatgaaacacttcaccctgcagatgtttttgccacaggttctggtcatgtgaatccatcaagagcaaatgaccctgggttagtttatgatattcaacctgatgattatataccttatctgtgtggtctagggtacagcgatacccaagttgggatcattgcacacaaaacaattaagtgttctgagacttcaagcattcccgaaggagagcttaactatccttcattttctgttgtgcttggttccccgcagacattcacaaggactgtgacaaatgtgggtgaggccaactcatcttatgttgtcatggttatggcaccagaaggggttgaagtgagggtccagccaaataaactttacttttcagaagcaaaccagaaagacacgtattcagtgacattcagccgtataaagtcgggtaatgaaactgtgaaatatgttcaagg

SEQ ID NO: 17119 - DNA, 1431 bp, Glycine max
  Peptide Sequence Number=SeqID_133897
atgaagagtgctattaagactgctgttgctgagttgcttccggttcttgcttctcgaggttcagagtcagaattcttttctggagacagagctgtggatgcagatggtggaggtgcatcacttgctagcaagttgcggagcctatcatctgactgttttgtgcatcttctgagtgctattttcttgatagtacagggggggatgttccttggtgaggttttggtgtgtcctcctactttgaaacagtttgtactgcagaggtttgaagtatttgtcaaaatgggaggaaacattgtgtggcaatgttcagttcctgcacatttagtgcgggctgctgaagtgaaaaaggccatcgaatggatcttaagcaaccgtgatggtcattatgctgctgattcagttgtggcggcaattgctcatggtgcagcagctgcagaaacatcccaagaaagcgagtctcatggtactacatttttgccatattcagcacaaagaagtgttgccaagggttcttcatttcagggaaaagcaattgattctatgagctcctcaaacatgtcaaaaaatttcagagctgatatattgcgagaaaacgcagaagctgtctttgcggcatgtgatgctgctcatggaagatgggcaaagcttcttggggtccgtgcaattcttcatcctaggttgaaattgctggagtttctaaccatatacaacattacccaggagttcattactgctacagaaaaaattggtgggaggttgggatacagcatccgtgggacactgcaatcacaggccaaggcttttgttgattttcagcatgaatctcggatgtcaaagattaaggcagtgcttgaccaggaaacctgggtggagattgatgttcctgatgaatttcaatccattatcagtttgctttttacatctgataatttgacttctgagaaccttaatgaaaccgaggatgatatttctaccagttacaattgtgtggtgactaacaatgatgttctgccgatggcagacagttcagagtcaactgctgaacagcaaattatgcagtctaattccattgaatcatcgatgaataatgaaacaccagatagatctaaatccccggttgattcaacggaaccaaataaagctcatggtaggatttcatcagcacatagtaacaatactgagaaagaccataaaaaatctacatctcaggctctttattacaaaggtgttggttatcacatgatgttgtcggagtacattgatatgaacaaccttttgccaacactatcctcagaagttgttcaccgtatagtagaaatcttgaagtttttcaacacaagaacatgccaacttgtgcttggggctggtgctatgcagcctctatcatatccttgttcatccaccttaacatttccatttgttatgcactaa

SEQ ID NO: 17120 - DNA, 654 bp, Glycine max
  Peptide Sequence Number=SeqID_133898
atgttgactattgctcttactcatcactggtctattcagcaaatcgatgtgaacaatgctttccttaacggctatttggaagaagtctacatgacacagccacctagattcgctgattctgataaaagtatggtctgcaaactcaagaaagctatctatgggttaaaacaggcacctagggcctgggtcatctcctgttcttattcaaaacttaattaccaaactacatgctgttttgctcttaaacaactaggaaatttggattattttctgggtattgaagtaaaacatttgagtaatggttctctactgttatctcaagctaaatatatttgtgatcagcttgaaaaggctaagatggttgatgccatactcactcctatgccctctgatctaaagttgactaaacatggtacaattaagcttgtttcagtacctgttgctgatgctactctctatcggtcggttgttggggcacttcagtacattactgtaactaggccagaactgagctacagtgtaaacaaggaacattggaaggcattcaagtgtattttaaggtatctaaagggtactatagactatgggttgtctttaaaatctgctcctcagggagaaccctatacttcagaagctttctgtgatgctgattag

SEQ ID NO: 17121 - DNA, 222 bp, Glycine max
  Peptide Sequence Number=SeqID_133899
atgaagtatagatatgtaacttgtaagattgaatacaatgctccgaggttccaacatttaacatctattgcacctcctcaagcagacctaaggaagatcggtgcagaaggctttactctgatagacaagttctatggtccagcaagaaggaacagtgccaatgatgcattccatgggcgaagaggagaacattgttgggttgtttataatatatgtgtctaa

SEQ ID NO: 17122 - DNA, 267 bp, Glycine max
  Peptide Sequence Number=SeqID_133900
atggcacctcctcaggcagacctaaggaagatcggtgcagaaggctttgctctgatagacaagttctatggtccagcaagaaggaacagtgtcaatgatgcattccatgggcgaagaggagatcgttgttgggttgtttataatgtgtctaatgatgtcatggaagattctgctgcaattggcatggaggcaacaactggccattttgctgcgaaatctgctatgaattatccaaaggcagtttcagaaactaatctctactcataa

SEQ ID NO: 17123 - DNA, 375 bp, Glycine max
  Peptide Sequence Number=SeqID_133901
atgcagagccatagacagactatagagtgggttcatttgagtctttcttccagaagaatcttcgaatacccattcttgaaagctgcaatctgcaagcatatacagcttgtcaaatttattagggttgtggcaaattttatgtcagaagtgagaggtgggagagtgagatttgatcctgaccgtatattgatgagtggaggggccacaggagcaaaccagctaataatgttctgtttggctaatgatggagatgcttttctggttcctagtccttattatccagcgtatgtgccctctctttcatcacgcctagtttcattcaatgaatcacactatttcacacccatcaaaacgttaaaagtgaacacaaattaa

SEQ ID NO: 17124 - DNA, 2916 bp, Glycine max
  Peptide Sequence Number=SeqID_133902
atgtacccatctctatgtgttgcatcatggaagggtgtgagacatgaatttgaagctggttcaaaagcaacaatcatggtactccttaaagatgcatttgggaacagtatctctcagacggctgaagtgtcttatttgcctgattttaagttgtatgtgctgcatgaaaatggttctgttgcaagtgctccagatatctcaaacatagggtggaatgagtttgattatgtagtcattgagtttgttgtgacgatagcgggaaagttctccttgagcttagaaggaggaaatcaaaccttgaatggttctccattgccattgaagcttgacttctctctccctcaaataacaggaactatagatgtctctaactgtatcgccaaatggaacattgaatcacatgcatggcaattggcttccaagatggaaatctttatacatcagttagatcaatatggaaatctggtttctggactgtatccttttgattctgaagttgttgaaagagatacaaacttgtcaataccgatatcagatcttcactttgaggaagtggatgctggaattcagttgttttcgtttagcaatttggagccagggaacttcctgctgacaatatatgattccaagcatgataaaagcatttccaatatgccatatgtttatactgtatttattggttattgtgatggtgttaaaagtgttgttaatggatccggtttaaatgattcagtagctggtgtaaaggcagaattctctgtttatttgaatgacatttatcaatatccttcccctattgaagcaaacatacttcaagtacaaattttaagagaaaatgactcctacagcgcttcaccaatcatatatcctatgctaaacaataatgcgagcacaatagcttcaagagtgagatatgatggaattagtcacatggaagccgccccgtcaccttcaatagagcttggcaacaatcctaatgggagcgagagctttgtcatggccagtgcttttcatgtgaaatacatactagaaaaaagtggcttttatgatattaacatacattgtgggaacatattattgaacgagggacattcattcaggaaagaggtaaaagcaggtgaagtaaatgtttccctgtcaagtgttgtgaggttttcttcaaaggtgccaaagctgtcgaaaaatgaaatagttgtgcagcttgtggattcatatttaaatcctgtcctctcacagcaatcaaggttgaaattggagattgctgcttctaccaatagttctggctttttaacttcggacattaaggataataaggatggatcatacagctgcagctatatggccgaagatgttggcacttacgagatttgtgcttcctttgatggcaagcgtttcttgtcatgtcccttcagtatcaatgtgtatagcagtgaatattttccaaaggctaacaatgatacaatatctctttgggaggatcagtccattgcccttgatgccttagcaaatgattattttgcgggtgataaagcaagtatagttgaattctcaaaaccagatcatggttcacttatgcagaatggaaggatctttcgttacactccttataaagggtattatggaaacgattccttttggtatacaatttctgatataaatggaaatcttgctactgctttcatgtacatatctgttctcaatgttccacctcagtttgtttctgttccaaatcaactgcaagcaacagaagatttgataagccctagatttggtggtttcaccgggtttgagttaacttattcaaatccaaaggagaatatttctgtcaatcttagtgcacaatctggatgtatacttctgtctccagtggcaatgcaatttgggcaagtaatgtggagcaaacttacaatttattcaggaaatgaaacaacaaccagtttaataatagaaggctctgtggaagtaattaattttgcgcttcagtcaattcaatatctaggaaatgaaaatttttatggtggagataccattcaagtctctgccaggaataagaatggggtgaattcattaggtgttccaatatttgttgatcctattaatgaccctccatttattagagtcccatacttcatcatattgaagagtaatgaagatgagacccttatctttgaccaagagaaagacaagtttgactttttcattggagatcccgatcttcttaccttccctggtggtcaggctcatttttttgtgacgttctctatggaagtaaatgatggattcttagtaacaaacctaccagttcatttgatcaacacaactgaattgaagcacagatataattatcagtggcagcctcttcagacatatgttactatctcaaagcactttattgtcaaagctcatggaatcagatttctgggcacagtcaatgactgcaatagtgttatgcagcaactgttctatcatggaggtgagcgtggagctgtgttaacattgacactaaatgacatggggaactatggatgttatccagattgtgcagagggaatgtcaatgccattatatactgaagctatagttaatttgatgagaaaacagccaatgagttcatttcttgctcacagaaagaagaaaccacgagaaaaggtcttcagagctatctactgcacaaagttcccacagagaaactgtaagagtacaaatatagcagatgaattacaatttgcacatagcaacatgacaatgattttgttcattgttttttctgctctaaggaaattgttaaaaagatcaattcaattgtattggcacagatacatcttacataacaagggtgtgtttggaaacacgttgaatggaagaattgcgtgttccaatgcaaaaataagacggacacaaacacatactaaatga

SEQ ID NO: 17125 - DNA, 831 bp, Glycine max
  Peptide Sequence Number=SeqID_133903
atggataatagcaagtcagctgcaatgaaaggcgtctggaggaacgatctttggtcaactgagattctaataacaatattcatgagcgtcaacattgtggaccttgcagttgcctcactggtctgcaaaatgtggaacacagcttgtcgtgacccatctctttggggaaaaattgatttatccacactcaacaactcatactttttcaacataccaaataatcaaccaggagcttacaagcgtacaagtggaaaaattactcaattcttaaagaccccaaatctgaaacaactagttctaccaaggaaaggtgacttttcaagaaaagcagtgcatatggcaatgaagtcatggggaggccttgagtccattaacattagctctggtgtccccactgattacatatttcctgcaattcacgaatactgtaagagtgtcaatgggatcaaattccattgtgaatttgaagaaaagcacgcagaagccttgattgaatctacccctaacttgaaggtgttcagcattcggtccacggtagtgagcatgaaggctttgaggagtgtgctcacttccgtggaacatttggaggcggtgaatatctatcacagcttcattgtggatatgtcgcatgatgaattcagtatttttgcaattcaagatctacataagtatctgcccccatcaaaagagcgtggtgttcccgtgtcctctagcatgaggttcttcatagtcatcaacctattcatctgctcccccgaacacaagttcaagatcatcacaggatccaaacacaacaacacacagggagtgagttattacattcctagctaa

SEQ ID NO: 17126 - DNA, 294 bp, Glycine max
  Peptide Sequence Number=SeqID_133904
atggcaccacaacaagatcttgttgaaataggattggaaggatttgaactcatagataggttctatggtgcaccaatcagaaggccagctaataataacgtgggcaagcagaggcaaggacgttggggagttcaagccacccaccaaagccacaaggaagagccagtagttatcaatagcaaagaggctgcttctaagtttggtggaatcatggttgtgaattattaccccaagactaagccacagaaccgttgggctttggtaaacataaaatcagttataacagctgaataa

SEQ ID NO: 17127 - DNA, 165 bp, Glycine max
  Peptide Sequence Number=SeqID_133905
atggttgtgttcccatggaactggaacattttgcaggcaattcttatgaaggaactatctcatctaagaaatatgttcgaaagttatgctgatagtgtcaacaataatcccgtttttggtggaagccagaatagagtgttgctaggtgcacccagcattctataa

SEQ ID NO: 17128 - DNA, 228 bp, Glycine max
  Peptide Sequence Number=SeqID_133906
atgtgggacttgaagctttttttttctttgttttttcaaactttcacccattgtctcctttattctaacaaccctgatttgagatggcttgacatcatggagtcctcggaatcacttactgtaggatctccacaacttttgcaagggacacccacctatattgttggtgattcaaccgaaatcaatcaaaaaggggctcaaaagctagcaactgatctcgggtactaa

SEQ ID NO: 17129 - DNA, 318 bp, Glycine max
  Peptide Sequence Number=SeqID_133907
atggatgaacttattagctcactgaaactcaatgtctctcagaaagccaaaacaaagcattatttcaaaacactaaacttagtatccaattttgatgttgagaatagtgatgacgagctttctgaagaagaagaagaagaagaagaaaaagaagaattggcctttacgactgaaagggttcaaaattgctcaaaaggagaaaaggaacaagaaggaactacttcaaaagagacttccaacaaggagaaacctctgggcaagtcaaatgctttgaatacaacaagtctcgctatatcaagtcttagttttctttcctaa

SEQ ID NO: 17130 - DNA, 315 bp, Glycine max
  Peptide Sequence Number=SeqID_133908
atgcttcttgtaacacccttgattattgacttctcgatgcctctcacactaggacactacactcaacatccttgttggtcagaatcttccatcggtctgaacccttcgcaagtaacccattctaagacctttacaaccagctctgacaccgctcaactactctcaagatcattgactgtccccacataccagcacgatacttttcagcgtgctttgtccttactcacacactttttgggaaacttcccagaaggtcacctatcccgtaactactccaagtcaagcaagcttaactgtgaaattcttaagtggtag

SEQ ID NO: 17131 - DNA, 420 bp, Glycine max
  Peptide Sequence Number=SeqID_133909
atgaaaatgagagattacaaaccttcaacaaagcttcaaatggcttgtcagtatttgcgagtggtgaaagagaggattaaggagatattcaatgaaaaacaaagacacttgaaacttgaaagtgaaatgaaggtttccatttgtagatctataacttgtcttggcaagcgacgtgccaacgtgacacatagtaatggaagagtctcacccttcaacacatgtgtttttttcttggtggctggtggctccttcatggcggttccagagactccagaatggtggttggtgactcctatgtggggagtgtgcttgcagcctagcatgctaccccttagcaaacaacatgtcttgagaaacaatatggtgcgacagagatttgggtttagggttagggtggtgcccgaagaggaggggcagtaa

SEQ ID NO: 17132 - DNA, 300 bp, Glycine max
  Peptide Sequence Number=SeqID_133910
atgggtggtggtgcatggccgttcttagttggtggagcgatttgtctggttaattccgttaacgaacgagacctcagcttgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaaccttatcatttag

SEQ ID NO: 17133 - DNA, 948 bp, Glycine max
  Peptide Sequence Number=SeqID_133911
atgggaaggcaaccctgctgtgacaaacttggggtgaagaagggtccatggactgctgaggaagacaagaagctcatcaacttcattctcaccaatggccaatgctgttggcgcgccgtgccaaagctcgctggcctcaagcgctgtggcaagagttgtcgccttcgttggacgaattatcttcgtccagacttgaagagagggctactcacagaggcagaggagcaacttgttattgatctccatgcccgtcttggcaacaggtggtccaagattgctgccaggttacccggaagaacagacaatgagattaaaaatcattggaacacccatatcaagaaaaaactccttaagataggtattgatcccgttactcatgagcctctcaaaaaacaagctgcagcatcttctcaggatagttcatcctcccctgcagagcatttgccgcaacctggcaataaccttgatgatcaggtcaaagaaactgaagggattcttctcaactcagaggagaattcaagttcatcacaagctgaaaattcttctggggatgattcacttttgctagatagcatttgcagcgacgattctctattaaacagcatgtggctggatgaaactcctctggtggaagcattatgggacacaacacctaaccttgagaatactagtaataacatgggtttgttaccatcttgggaggataattgtgcttggttattggactgtcaagactttgtattttacaaaaatgtttctctcggaaggtggaaggtgaacgtttcctcttgtgaggttcctcgccaaccaaaacacaaaattgatagcaaagcaaaaccaaatcatcatcaaaatggcacaggacataacaaatgggaaatgtctagtgagtgcagaaacatattgtacaaagaagtctactttgaaaataatgagatagatagatag

SEQ ID NO: 17134 - DNA, 1413 bp, Glycine max
  Peptide Sequence Number=SeqID_133912
atgggctggccttacataggagaaaccttccgaatgtattctcaagacccaaccattttctttgccacaaaaatcaagaggtatggctctatgttcaagtcacacattttgggttatccttgtgtgatgatttctgactcggaagcagcaaagtttatattgaacaaagatcaactcttcaaaccaacatatcctgctagcaaagagaggatgttggggaagcaagcaattttcttccaccaaggagcataccatgctaacctcagaaggcttgtccttcgcacagtcatgcccgagaccattaaagacctagtctctgacattgaatccattgcccaaagttgcctcaaatcatgtgaaggaaagttgatcaccactttccttgaaatgaaaacttataccttgaatgtggccttgcttacaatttttggaagagatgaaaatttgtgtggagaggatttgaagcgatgctactacactattgagagagggtacaactcaatgcccataaaccttccagggacattgttccacatggccatgaaggcaaggaaagagcttgcacagatcttcactcaaataatctccacaaggaggaacatgaagcaagatcacaatgacttgttgggcttgttcatgagtgaaaaatcaggactcactgatgagcaaataatagataacatcgtcggtgtcatttttgctgctcgtgacaccactgccagtatacttacgtggattcttaagtaccttgatgaaaatccatgtgtcctagaagcagtaacgttagctatcatgataaaattcgacggcaaattcagttgcaagttgcaccatgaactgtgtgtggtcgctacttcgatcgctaatagagatcaaagttttgcggaagagcaggagtccatactaagggccaaggaagaaagtggagaaaaaatggatctaaattggtcagacacaaaaaacatgcttataacaaccagggtcatacaagagactctaagaatagcatcaattttgtcttttactttcagagaagctatagaggatgttgaatttcaagggcatctcataccaaaagggtggaaagtattaccgctttttagaatcatccaccatagtcctgacaattttaaagagccagagaagtttgatccttcaagatttgaggcaattactggtgatgacatctttgccaacccccatagcttcgcagatagaagagctagcgagtggggaaggtcaccacggttgtggaatgtgagcaagaaggaggggaataatgcggagagagaaaagttgagcaagaaaaaggaaagagaaagatgcgtgaaaagagggaatgatggtgatggtgcgagtgtcgtcaacattctttttcatggtgctcatacccacttccaattctctacttga

SEQ ID NO: 17135 - DNA, 423 bp, Glycine max
  Peptide Sequence Number=SeqID_133913
atgggtgagtttacgattcagattagcaatgaccttgttaaccagcttgttgatgatatggtgccgaagaaaaaaactagaaagactagacggaaggtggcaagagagactgaaaagccccaatctaatgaaactataaagcccgacagtgcagttactccagggtggccagtgcagttccctttatttctacctacaacattgcctgtacaaccttcccattcagagttagaaggtattcagtctatgcttcaggaaagtgagagggttttgcaaagattgcagaagcaagaggagaatatgttgcaggaagtaacccaaaaggcaaaggatcttcatgataaagagtataagcttccaaacccaaagcctgagccttgcatggccaagagacttacaaggaacatatcaaggaccccttga

SEQ ID NO: 17136 - DNA, 1038 bp, Glycine max
  Peptide Sequence Number=SeqID_133914
atgcttcccttttcaactctctttcaaaccccgttaaccaccgagtattggtacaaccaccccacaacaacacttctagcgttcttgctcatctcccttgttacttgctatgcatggctcaagcccaaggcccaaaggcttccaccgggcccatcgggcctccctttcttcgggaacctcctatccttggacccagacctccacacttacttcgccgtcctggcccagatccacggtccaatcttcaagctccagctcgggagcaaactctgcatcgtgctgacttcgccgcccatggctcgcgcggtgctcaaagagaacgacaccgttttcgcaaaccgtgacgtccctgccgcgggccgggccgcgagctacggcggatccgacatagtgtggaccccatacgggcccgagtggcggatgctgcggaaggtgtgcgtggctaagatgctgagccacgccacgctggatacggtgtacgatctgcgccgcgaggaggtgcgcaaaacggtgtcgtatttgcacgaccgagtggggagtgcggtgaatataggggaacaggtttttctgacggtgataaatgtgataacgaacatgctgtggggaggggtggtggaaggggcggagagagagagcatgggggcggagttcagggagcttgtggcggagatgacgcagcttttggggaagccgaacgtgtcggatttttttcccgggttggcccggttcgatttgcaaggtgtggagaaacagatgaacgcgctggtgccacggttcgatgggatatttgaacggatgattggtgaaagaaagaaggtggaattggaaggggcagaaaggatggactttctgcagtttttgttgaagttgaaggaggaaggcggtgatgccaagacgccactcaccatcacccacgttaaggcactccttatggtacgcttcctctcacaactcttgaatttcactttccaattttacttatgcagtatgggtctatgggacaccttggccttacattttagaattcgtcggcagtag

SEQ ID NO: 17137 - DNA, 207 bp, Glycine max
  Peptide Sequence Number=SeqID_133915
atggaggcagaaatggtcgaagatggtgatatggtggtggtggagacgtgcgatgatgttggggtcacagatatgaaggagagaggcacgtccatgcctttgagaatttctgctgaagtatggaacaccaactatggagggaaatcccttatggttttggctatttcagctaaggattttaccatgaatgtcaaagggaaggaatga

SEQ ID NO: 17138 - DNA, 360 bp, Glycine max
  Peptide Sequence Number=SeqID_133916
atgatgatacgacttcagcaagttgcagcaaattcaaccctacttgttacccgaaaccctataagcctaaaagacacaggaaaatttgaaaagaaaaggaacacagagagagagagagagaaagaattgagcatccatagttgcattcttcatcaagttgatcttgcagaattattttttcatggtgcggaagaagatggagacaagaatggaagcggtggaaagaagtttgatggagttgaatcgtcattcggaggaagtgctgggatgcaccaacaggaggacgcatggcgttggaactctgaaaccatgatgcaagatattctgggacgattagaggcactacaacccagaggttga

SEQ ID NO: 17139 - DNA, 1005 bp, Glycine max
  Peptide Sequence Number=SeqID_133917
atggctgtgaaccttgggaacttggcgttgctactggacctgacttcgccgcggagcgtgattctggagaggaaagcgcgtcccgccggatccgacgtcgttttgtgcgcgccgccgtccaagagggactacccctcctcctcctcctacgcggtggtggcgcgtgggaagtcgaactcggagaagaacggcgtggatttcgacagcgacgaggaggaggaggaggaggaggaggggggaggcggcggtggggggttcgtggactgggagacggaaatgcggcagagagtgagggagttcgaggagaggagggagctcgagaagaaggccgaggagttgcagagtcgcgttggagaggaaggcgaggaggaagaaaccgaggaagaaaagaggatgagagtcaggaaagagctcgaaaaggtagctaaggaacaggcagagaggagggccactgctcagttgatgtttgatttgggtcagaaggcttatgggaagggatcctatggacgtgccattgagtttcttgaagctgcacttactatcatacccggacctacattattcggtggtgagatacaaatatggctggctatggcttatgaagcccataaccgccataaagattgcattgctctataccgacaattagaaaagacgcacccaagtgttagcatccgacgccaagctgcagagcttcgttacattttacaagcgccaaagctcaagatatcccaggaggagatggtgactatacccttgattggttctacttatgacagactttttcatcccgctacttatgcaattgtactactagaactagcttttttaccaattgcacctagacatgtggaagccactgcttatattctctgtcttcaagtgaaactttcatgttcatcctccaagtatttgttcggcacctttcttatttcagttaaatgcctcagtctcggtaacttccatgctagcctcaactctggcctccaaagtccaaccctttaa

SEQ ID NO: 17140 - DNA, 1293 bp, Glycine max
  Peptide Sequence Number=SeqID_133918
atgtcgcaggtgaatgagcaccaccaccacgcaccctccacgccagggaaattgaagccagaaaaatccccatacaaccgcctccgtatccactcctctctctccaaactcactctctggtcctccttcttcctcgcattcatcctcttcctcttcattctgtcaccgccttcgccctccgcctccccccgccgccgctccctcggcgactcctggggcggctcccactgggaaaagcgcgtcgccaagtccgctcgccgctcctccccctccagcctctctgtcctcgtcaccggagccgccggcttcgtcggctcccacgtctccctctccctcaagcgccgtggcgacggtgtcgtcggcctcgacaacttcaaccgctactacgaccccgccctcaagcgcgcccgccagcgcctcctcgaccgcgccggcgtcttcgtcgtcgacgccgacctcaacgactccgccctcctccgcaagctcttcgatgtcgtccctttcacccacgtcatgcacctcgccgcccaggccggtgtccgctacgccatgcagaacccccaatcctacatccacagcaacatcgccggtttcgtcaaccttctagaagcttccaaatccgctaaccctcaaccctctatcgtctgggcctcttcaagctccgtctacggcctcaattccaaagtccccttctccgaaaaagaccgtacggatcaacccgcaagcctctatgccgccacaaagaaagccggcgaagaaatcgctcactcctataaccacatctacgggctttccatcaccgggcttcggttcttcactgtttacgggccctggggccgacccgacatggcgtacttcttcttcacgaaggacattctgaaggggaagcagattacgatattcgagtcactcgacggcggaaccgtggcgagggatttcacctacattgacgacattgtgaaggggtgtttaggggctttggataccgcgaagaaaagtaccgggagtgggggcaagaaaaaagggcctgctcaatttagggtttttaatttggggaatacttcccctgtgcctgtgagtgagcttgtggcgattctggagaagcttcttaaggtgaaggccaagaagaaggtgcttccaatgcccaccaatggagatgtgaagttcactcatgctaatattagtttggctcacagggaccttgggtataggcccaccactgatttggagactgggcttagaaagtttgtgaagtggtaccttgaattttactccaagaagagctcttggtga

SEQ ID NO: 17141 - DNA, 186 bp, Glycine max
  Peptide Sequence Number=SeqID_133919
atggtgagatcaacaagccccagcctcgttataggtgtagaaagagttaacaaaaatccctttgaatgcaagaattttgagctgctacggattgtagcccccatggcattactaccagatgagggtattcgaaaaatcaagctgaaaccagcagctccaccgcctaccgtactagctcatctataa

SEQ ID NO: 17142 - DNA, 1095 bp, Glycine max
  Peptide Sequence Number=SeqID_133920
atgaaaggcgtgttttcggcgcccggtgattacgtccacttcaagtcccaagtccctcttcacaaaattcctattggcactaagcagtggcggtattacgatttcggtccaaaagccgtgcctccgcttatatgtcttcctggaaccgccggaaccgccgatgtatactataaacagatcatgtcattatctatgaagagaggggaagaatggtgggtcagaaacggttttatagagcgtgctgacaggggaagggaagatagtgtgcagggttaccgtgtcatatctgttgacatacctcgtgtatggaataatactgagtggattcaagcatttgaaaagttcttggatgctattgatgtacaccatcggtatgtcttaacaggaattcgtgatggtccccatgaaccgtttattgcagattcagtggactttgttgtttctcaggtagaaaccctctctagagaagacttggcctctaggttgtctctgacaactgatgctgcttcagtgggaccacttcttctttcagtttcatttatcactataatggatactaatgactactgtgcaattcctcaacaacttaaagatcaactgggtgaaaggtatcccgaggcaaggcgtgcatatttgaaaacagggggagattttccttttctttcaagaccagatgaagttaacttgcatcttcagttgcaccttaggcgtgttggtgtggaacctcggccagatttggttcacaacatacctaaaggtgatattggaggaagccctagcaaagaaaataacgaagatgactctgacgagtcacataaggataatggaggagggtcagaaaacccacctgctgaatatgagataaatcctactagcccagaaagctcgggatccggtaatttagacaagcagcctctcgatagttcagagtgttgccatttgtttcctggtggattcccaagggaaaagcacattgtgcctccaggaactcctttacatttcgtgtgggaatatattgttttttttcatcttcttcacatccgttcactgtgcattatatggaactattctttggaatttaggcaatttgtgtaa

SEQ ID NO: 17143 - DNA, 534 bp, Glycine max
  Peptide Sequence Number=SeqID_133921
cgtcctagtcgcaaccctaataagaagaaccacagcttcaagcgagtgacatccaccagccatgggtcgtatgcacagccgcggggtatatcctcttctgctttgccctacaaaaggacaccccctagctggctcaagatctcttcgcaagatgtggaagaaaatatctgcaagtttgcgaagaagggtttgaccccgtctcagattggtgtcattcttcgagattctcacggtattgctcaggtcaacagcgtcactggcagcaaaatccttcgcatcctcaaagctcacgggcttgcgcctgaaattccagaggatctttaccatttgattaagaaggcagtttcaattaggaagcatcttgagaggaacaggaaggacaaggactccaagttcaggttgattcttgttgagagcagaatccaccgacttgctcgctactacaagaagaccaagaagctcccaccagtctggaagttgtcagagatggctgtggtttttggttttaataatataattgttgagaagatttga

SEQ ID NO: 17144 - DNA, 294 bp, Glycine max
  Peptide Sequence Number=SeqID_133922
gttgaagaaaacccttcgggatggaagaacaagatagtcaaatacttgaagcataaggcactcccaatagacaagagaaaatccaaaaagctaagaatgcaagcttccaggctgactatgtgcttcaagaactacatgaaggtgtctgcggcatgcattttgggagagaacaatggccataagagtgttgagggtcgagtactattgaccaactttgaggacagattgttcaagctttgtagagaaatggctccaatgccaaaagcatgggaatttgatacatcggctgactga

SEQ ID NO: 17145 - DNA, 241 bp, Glycine max
  Peptide Sequence Number=SeqID_133923
atggctgaagagaatctcacagaacctttcgatttctcacgattcctagacctgatggggaagcacttgaaggttgagccttttgatggcccgctacatgatgcattcaaggtccatgacaaggaatccaccggtcacgtctctgtcactacgcttcgtcacattctcactaacatcggtgaaaaacttgaaccttctgagtttgacgagtggatcaaggaggccaatgttgtttctgatg

SEQ ID NO: 17146 - DNA, 1560 bp, Glycine max
  Peptide Sequence Number=SeqID_133924
atggagttcttaatcaacaacatccttcctcactctgcaaaatccttcctcttgactatcaatacctccaaggtcgggttttataacaaagtggttgggggggcagtgtcatgcgacatgtggatgtgtcgggcaaggaatgaggagcattggctgaggccgatgaggggtgagagttatgaactcgtgaggggtgaagcgggaggtggtggcttgtcagggtttttccttagtggtggctatgaaggtttatgccaaagaccaagttcttactcttttgtagggttgttgccctttagtgctatggataaggatatggccttagctgtcctaattgacgatgatctggttattatgatacctgagacattggtccataacagtgatgatcaacaaggagaaacgtgggaggttggccctattgaaacgttcaatgcaaaggcctttaagatgactatggcctatgcttggagagtgaagggaggggcttgccctttttcggatgagaaagaagaaattagatttgggagtttctttcgtatctgggtccttcttgacgtttctaaacccttacatctggggactagagtgaaagttggggagaaagatgcaagatggattcccctgaaatacaagaggttggcaaatttttgttatgtctatggtaggattgaccatttgttgagagactgtgaagaaggaggtgtagagggggaggagaatgacacccagtgcttaccaattggcattgacctaagatcgacttttatgaggccaaatattgtggcttggacccaacatgatgtttcatttggcagtctaaagaaactaaacattatgaataaagaaagtagcatagtcctccatgtgcttagggatattggtgataatgaaggaggtggaccccaaaatgtcaatgaagaggaatcatccataaccaaagtggcttatctagaaaaccttaatttgatccattcagagggaccaaaggtctcgcttattctcgatagtgtggagagacaaatgttacaagggggtagtgcgagccctaaaaaatctcatccaaaaggaagctcccgatttggtgttccttatggaaacctaaaagaagcttgtggagatagacacctctcatggaatcttctgggcaatctgaagcttgaatggaatatgccttggttctggattggagactttaatgtagtcttatctcaagagcagaaagtgggtagagatattgttgatttaaaccaaacacgacaatttaacagtgcccttgttgattgcaagctctctgatataggaataaatgaaaggtggagaagaaagtggcctaatattattgtttctactttgtcgagatatagatcagaccataatccgatcttgacggagtgttgcgatctgtcgagtggacgaggcaggaggaaaaagatatcaaaggtgtataagtttgagcagatgtggcttgagagatgggaggaatttgaatctatagtctttcattcttggattcttaggcagaatctcaagagaatgggggccaactttgaagcttga

SEQ ID NO: 17147 - DNA, 918 bp, Glycine max
  Peptide Sequence Number=SeqID_133925
atgttcaccttgctggttttcatgtgtttcggtggagaagttcagaaggagaaaatcgaagacatagaacacgttcagcgttgtttaatgtcggagcttagcagattcggcgtactaaacttgttgcccggagtggtcactcgcgtgttgttgcgaaaacggtggcaggagttgctggatcttcgtcaggcccaaaaggacgtgtttacccaattaataaaaacaataaaaaatgttagtgatggggatggaggtgttatttgttacgtggatactttgttgaagttgcaattacccgaagagaatcgcaagcttgacgaaggtgaagttgtggcgttgtgttcggagtttctcactgcgggcacggatacaacttgcatggctttggagtgggtcatggcgaatatagtgaagtacacgcacgtgcaaaagagggttgtggaggaaattaaagaagtgctgggtgatagaaaagataaggaagtgaaagaggaagatctgaacaagttgccgtatctaaaagatgtgattttggaagtgacggaggacgtggttttgaatgattatttggtgcctaaaaatgtgactgtgaacttcatggtggcagagatggggagggatcctagggtttgggaggatccgatggaattcaagccagagaggtttcttagtagtggttttgaggcctttgatattattgggagtaaaaaggttaagatgatgccctttggggctgggaggagggcttgtcctccttataacctcgcaatgttccatttggagtactttgtagctaaattggtttggaattttgaatggaaggcttcgagtggagggaacgtagatttgtcacggaaacaggaatttactatggtgatgaaacatccattgcatgctcaaatttatcctaggttctag

SEQ ID NO: 17148 - DNA, 567 bp, Glycine max
  Peptide Sequence Number=SeqID_133926
atgggtgttggactattcccatcaaaccctattcttgtggatcccacaactacaacctttaatccgtggaaaaatagaatccacaaggtaaaaattgcacacaacagaggaaaaactggaatagctttcttattggtgatagagagagaacaactcaagagccaagagcctgatgttcttaaagaagtgaagcagaaccttgaacttggatcagtgaagtttgaggtattgtgtgacaaagaccaaacctcaaaaaagatttcatcagtgggcacatatgagagacgtatcctcgaaattaacaggaaaagagtcaaggtggtaaagcctgccactaagacttcttttccagctacagaaattcgtggtagttatgcccctccctttcatgtggagcttttcaggaatgatcaacaccgtctgcgtatagtagtggacagcgagaatgaagcagatttgatggtacactcccgacacattcgggatgttattgttcttgtgattcgaggacttgctcagcgattcaatagtacttccctcaattcccttctcaagatagaggcataa

SEQ ID NO: 17149 - DNA, 207 bp, Glycine max
  Peptide Sequence Number=SeqID_133927
atgtataataaggtagtcaaacttgagagtcttacctacactggtggagggtttgtggactcaacatattggctgccaagcaatgaagcccttgcagccttttcacaaccaagcaagaaaccaagctgtcatgtttgtcacccagatcacagggatgggttgaagcacgtgagtgggtgcttggaggagagattggtgttgccatag

SEQ ID NO: 17150 - DNA, 2016 bp, Glycine max
  Peptide Sequence Number=SeqID_133928
atggagaaaagcatcaggattatttgtgatcacaatgtacataccaagctcaaaggcaatcagaaactgatactgcccctgtttcagtcagtaactgatggtatatcagatcaatcagaaactgatactgttcctgttcagtcttctgatactgagcaaacagattcaccagtgactgataatgctgtcataccctatctttctgttccttcatcatcaaacattaatacaacagaaccttcatcttcaaacactcccccttctccacctagaccagccaatactcgacctatacgaactagatccaaatctagtattcacttaccaagaataaatccttcccttcttttaactccttgtgaaccaaagagtgtgaaactggccttgactgatccaaattggctttcagccatgcaactagaatatgaggctttgatgaagaatcacacttgggattcagtgcctcttccatcaaacagaaaagctattggttgtaaatgggttttcagggtcaaggaaaatgcagatggctctatcaataaaaatcaagggattcttgctcagctagatgtaaataatgtctttcttaatgacttgcttaatgagactgtctacatgtctcaaccccctggtttccaacaatcaaatccatctatggctgagataagctactcagtcaacaaagtttgccaatcctttagattcccactggattacagtgaaaagaatcctaagatacttgaaagggttgaatgcaaggtatttgattcaaagtttgaatgcgtttggatgaaaaatgaagacgataacaatggtgttcaagtgagattaaagaatgaagccccaccttttcgcgtggtagtgacattgaataccacatcctccactacgtccaccaccactacatcctccacagtgaaaggagtaagagacaagggcaaaggaattcccaaggttccacctattgttccaatgccaaccgttgctcctaatccacctccattgcaggtctactatcgtcggacacaggcaccactgacaacgccacctagtgatcctccaacatcatctcctactacaaatgcccttctaccactgctgcctacacataaatatcccattgcactatgcaaaagtatttggttcactcgtaatgataatcctaagtatgcctttactcttaaatgtgaccatttaactccttcctatttctctttcatctcttctttggattttgtgcctatacctaagtctcaggtgaagccatggctgaccacaattggcaacagggatgttggcagaaatggttgctttggatgccagcaacacatgggagctcctgccatccgacattgctctcttcaccagttggacatcaaaaatgtcttcctacatggtgacttgcaagaaaaggtgtacatggatcaatcccctgattttacagtttcaagcgactcacgccttgtctgtcgacttcgacattctctttatggcttgaagcaatctcctcgtgcctggtttggttgtttcagctccactctgctagagtttgttgtatatgtcgatggaatcttcatcactggtgatgaatctgatgacattctctgccacaagtttcacctccacagtcaatttcaaaccaagaacttaggtccgctcaggtacttcctcggaatcaaagttgtccaatcctcatctggcatagtcatttctcaacagaagtatgttgtagacattctaatcgagaccagtatgcttgattgtcgttcgagcaacactcctatggatcctaatgtgaagcttcttcagagtcaaagggagccattgaaagaccccaaaagatattgtcgtctagtcagcaaacttaattacctcactatcactaaaccagatatcacatttgcagttagtgtggcaatgtcaaaattgtttgctattcttatgctgattggccaggatcaccatcagataggaagtccacttctagatattgtgttctcattggagaaaacatga

SEQ ID NO: 17151 - DNA, 815 bp, Glycine max
  Peptide Sequence Number=SeqID_133929
atggaacaggcaacattttcattcagtgatgataatctgcttggaaaaggaggatttggcagggtctacaggggcactttgaagtcaggagaggttgtagcaatcaagaagatggagctgcctgcaattaaagcagcagagggggagcgcgaattccgagtggaggttgacttattaagcagacttgaccacccaaatcttgtttctttgataggatactgtgctgatgggaagaataggttcctagtatacgaatatatgcataatggaattggagaaagaaagatggattggcctttaagacttaaagtggcactgggagcagcaaaaggacttgcttatcttcattcaagttcttgtcttggaattcctattgttcatagagatttcaaatccaccaatgttcttctagatgccaaatttgaagcaaagatatctgattttgggcttgccaaactaatgccagaaggacaggagacacatgttactgcaagagtacttggcacctttggctattttgaccctgagtatacatcgactggaaaacttactctacaaagtgatgtttatgcttttggagttgttcttctggagcttttgacaggacgtcgagctgtagatctgaaccagtgcccaaatgatcaaaaccttgtactacagaaaaacgtgggattgggaattgtgggaatggtgttaaacggatggagatcgaggatagtagcagacccacaattcccattcgaggtgttaatggaggaactggacttcgttttctcaactcttgttgtgggctccattctcaatttcatcctcat

SEQ ID NO: 17152 - DNA, 372 bp, Glycine max
  Peptide Sequence Number=SeqID_133930
atgagggaagctttggacaaaagactgttttccagctttatggtggggaaaaataatgagccagtcaacattctgcaatacgctgatgataccatactctttggcgaagcaaatatgcataacgtgaagactattaaggctgtcttgagaagttttgagctggtttcaggtctaaagattaattatgccaaaagctgtgttggtgcaattgggaaatcagaactatggcagagggaggcagctgattatcttaattgcaacatgttgtccatgccttttatgtatctgggtatccccataggggcaaacccaaggcgtagtgaggtctggggtcccatagttaggaaatgtgagagaaaactagccagatga

SEQ ID NO: 17153 - DNA, 432 bp, Glycine max
  Peptide Sequence Number=SeqID_133931
gcacaatgccaccctttaatgcattgattaggaggttgacactcaacgctctgggagccgttatctcaaccccttacctagttgtgaaattattgaatgatgacttgaaggtggttacaattagggcttcgggtaagttaatcctgatcccggggatgtgggagatactaattgttgatttggattgtggaatcaagctttcagttggaaagccattgagttcaaatgggatgaaaaatgtgaggcaactttttagaagtaaaagggattttgtcgtcaccattggtactcataaaactgaagccaatttactttgtatggaacacgctccaaggagccaagctcagatacccaaaagtggagaagatggtctttgctttgattacatcagcaagacggttaaggtagtacttctagtcacatcagatagtg

SEQ ID NO: 17154 - DNA, 444 bp, Glycine max
  Peptide Sequence Number=SeqID_133932
atggacttggggaaaactgttctggagggtaaatctgacactgttcgggtaagtatttgcataacccaggtcattgagaaccgagttcttggtattccttatgagctcacaccgagaatgttggcgctcaaactaaagccacctaacctgtctcagaaaaacgatgatctcggactcgttcaccgttggatcgtcgtgaaatttgggcaccacgttcacaacccaattaagagcattctcaccattgggaatttcgatattatgtctgagctaagagaaatacccctcgcattggagaaaaataaatcgcatggtgacagtacaagtggaggcttcaatcccttctctgtctctttgacgtttaggaattctattagagcagctagaggaaaaaaattggaggaatctcagagaaccgctagagatgctgctatcgctggctga

SEQ ID NO: 17155 - DNA, 807 bp, Glycine max
  Peptide Sequence Number=SeqID_133933
gccggagctaggagcggtgcttcgtcggggagcgagcctgtgcggaggtcgctaccggagctccggcgaagttcggtgacttcttcacgcgttgctgtgaagccggctgtggcctcgccggcggctccggcttcggcttcgagaacttccgttgcgagtaaggtggaggtggcgaagaagccggtgagtaagccggcattgtcggctttgacttcggcttcgtcgttgtcgagaaggattggttcttcgtcggtggatagcactgccagcagcagcggttctgctcggaggacggtttcaagggtttcgtcgccgacagtttcgagcgggttgaaggcggggtatctgtcgacgtcgcaggataggacgtcggcgatgtctgggaggaggaagggaagcactgctgatagcagggattctcggtttattgttcttccgcaagttgagattaaggccaatgatgatttgagactggatcttagaggacacagagttcgtagtctcaatgccagtggattaaacttatcctcaaacctagagtttgtttatctccgagataatctcttgtctacactggaaggagtagaagtattgacgagagtgaaggttcttgatttgagttttaatgaatttaagggacctggatttgagcctcttgaaaattgcaaagtactgcagttcctgtcagtagctcagaataagttgaagtctcttactatggctagccaacctcgactccaggtcttagctgccagcaaaaacaaaatttctactcttaagggtttcccatatttaccggttcttgag

SEQ ID NO: 17156 - DNA, 286 bp, Glycine max
  Peptide Sequence Number=SeqID_133934
atggaagtgtcgtcggagaaatccggcgaagacgtggcgccggaaatgcttcagagttctccgaagaagaatgttccagaagcttccagaagagctgcgaaaacggttgctgacggtccggtttcggcgaagaggaaggttgaaccgcggaccggttcggtcacggctgcgacgaagagatcaggttcaatcggaggttctgcgagtgcgggttctgcgccgagacggaacagcaccggaggattgtctcagaaagcgtcgatctccgatggaaggagaaaaaccg

SEQ ID NO: 17157 - DNA, 397 bp, Glycine max
  Peptide Sequence Number=SeqID_133935
atgggggtagagtgtgcacaatgttgtttggatcttggcaaaggaggggcggagtggtgcgatgcgatgcaatgcaatgcggtgtggtggcaaagcgtgttgcaacacaaatctcgcggggcaagcttgtcgacactacgtgacacaaatctcatgggtctaggttgttggtgcgacatggtggcagaggaagatggatcgtggatctcgtgggttagtgtggcagagggtgggggttggctttgggtggtgctggaaatggtgaatctggatagttcaacaatgaggggaaggagaaggggcgacgcggggctcacgggtgcgtcttccatgggaggaggatgcgcggagtcgccaccaacgtttattcaaggaaaacgtcggaaaaaccggaaag

SEQ ID NO: 17158 - DNA, 177 bp, Glycine max
  Peptide Sequence Number=SeqID_133936
atggagaggaaagattacttctatgatgagtaccttaatattaactttgatgatatactaaactattggagcagatatgttggactatggtccagtcctgaagtagagccaacagagacagaaattgccaggaagaagaacagagttcaataccaattaaatcccaaaacacactga

SEQ ID NO: 17159 - DNA, 285 bp, Glycine max
  Peptide Sequence Number=SeqID_133937
atgattgattcaccacaaggtgttgttgcaacttggctggaatggtgtgtgatgtggactctatccaaaaccagccaaaaaagtctctgtgagctgaaggtagtgtgcagccaaaaagatattgaagcaaacactgcagaaggggagataaagattccagtggcttgcacttgcaacttggggtctggctttttcaatatcagctgtactatttgtggcaaagctgttgttgagatgggaccaattgtgacccatcttgcatctcttcgtggtatctcaggataa

SEQ ID NO: 17160 - DNA, 171 bp, Glycine max
  Peptide Sequence Number=SeqID_133938
atgggttttcctttgccggcagtcatttaccctgcagaaaatttatctggtcagaagatcttctgttctctttcctgcattcgttattcgctctcccttaaggagattttgctgtccttttcttcaggggaaaggatgaggattcttttcatgggccaaggttcaaagtag

SEQ ID NO: 17161 - DNA, 1965 bp, Glycine max
  Peptide Sequence Number=SeqID_133939
atggacttgaaatcttctttggacccacaagacaagctccttggctcgtggatcagtgatggcgatccatgcagtggttctttcttgggggttgtgtgcaacgagcacaacaaagtggctaatatatcattgccaggaagaggtctttctggggttgtctctcctgctgtggctgaactcaaatgcttgtcaggtttatacttgcattacaactatctctctggggacataccaagagagattgtaaatcttaaagaattgctcgatctttatctcaactttaataatctatctggaaccattcctcctgatatcgctaacatgactagtctccaagtgctgcagttaggctataaccagctagagggtaacatacctgaggaattgggttcgttgaagcagcttaatgatatttctttgcaacataacaaattagctggtcaaattcctcaaagcttgggttcattggagaagctaaggaggctatatttgagctataacaacttcaatggcacgatacctgcagcactagctgatattgcaaacttagaaattctagatattcaaaacaattctctttcagggactgttccttctgcattgcagagattaagggaaggattccaaggtgcaaacaaccaaggtctctgtggagatggcttttctactttgaaagcttgcaataaagatacaatatttggcgttagtcaaattagtgccccaaatatatccataaacagaattcctccaataacattcccaaagcctgtaaatacccacttgcattgtaaccagaccccttgctcaaaatcaagaagctttcttcatcttgtcattgctgcaagtgttacaactactgttatcacactcataagttctggacttttcatatttgtcagataccgccgccaaaggcagagggttaggaacacatcagattattctgaaggccaacgtagtccttaccagcctaaagagttctacagaagttcatctccacttgttaatcttgagtattattatgatggttgggattcattggctgatggtcaaaatgagagtggattatcccttgaatatttgaaccgttttagattcaatattgatgagattgaatcagcaacacagcacctttctgaggccaatttattgagtaagagcaaattttcagcagtctataaaggagttcacagagacggttctcttgtggctattataagcattagtgtgacttgctgcaaaaccgaggaaggtgaatttttgaaggggttgagcctgttaacctcactaagacatgaaaacattgttaagatgagaggcttctgttactcgaggagtcgaggtgaatggttttttgtctatgattttgcgaccagaggtaatctgtctcaatatcttgacaaggaagatggaagtgaccatgtaattgaatggtccaagagagtttctatcatcaagggaattgcaaaaggtattggttatttgcacaacaatgaagcaagcaagccaataatagtacaccaaaacatttcagttgaaaaagttattctagatcatgaatttaaccccttgatcacggatgctggcctccctaagcttcttgcagatgatgttgtcttctcagctcttaaagcaagtgctgccatgggatacctagctcctgaatatattactacaggtcgctttactgagaagagtgacatatatgcatttggggttatagtccttcaagttctatctggaaaggcattgatagggggttcaatccgggaagcagttgaagctttcagatttgaagactttgttgacacaaatctgaagggagcttattctaaatccgaagctgcgattctttcaaaacttgcaattcagtgcacccttgaagtgccagagcaaaggccaactatggtggaggtgattcaagagctgaccatgcttcctaatccttcttcacattcttcataa

SEQ ID NO: 17162 - DNA, 917 bp, Glycine max
  Peptide Sequence Number=SeqID_133940
gaaggaagacggctttgtctgctgttcactctgcagcaccgcgcggcgcggtgcttaatctgctacgccgcttacatttttacattggcctgtttgtcgcgccgttcatcttcgtggcggcgctcagcggcacgctctatgtgctgacgccgcagctggaaaatctgatctacgctgatgcgctcaccgcgcagccgcagggcaatgcacaaccgctctcggcgcagatcgccgcggcacgcgcctatgcgggcgaaaatcagcacatttatgcggttcgacctgcgcccgccgcgcgcgataccacgcgcgtacagttcagcgatgccacacttggtccgtcgcagtcgcgcgcggtgtttatcgatccctacagcctcaaagtaaccggcgacatgacggtgtatggcaccagtggcgtgttgccgctgcgcaccacgctcgatctgctgcacagcagcctgttactcggtgactttggtcgcaactacagcgaactggcggcgagctggctgtgggtggccgcgctcggcggcgtgctgctgtggctgggcacgcgaccaaaacgccggctgaaaaccgtgcgaaaggggtttgccttcacccggcactggcacatcacgctggggctgacgctgatgctcgggctgctgttcttctccgttaccggcctcacctggtcacaatgggcaggtggcaatatcgataagatgcgcaccgagcttaactggctgacgccacaggtgaatacggcgctcagcggtgatgcgcccgccgcgccggccgatcctcacgccgatcaccgcagtatgccggacatggacatgaccagcatgccgatgtcgtcgatggcgaaaccggcggcgcagccggcgaagtcactgccggcaaatgccgccgacgctgactgggatcgc

SEQ ID NO: 17163 - DNA, 1337 bp, Glycine max
  Peptide Sequence Number=SeqID_133941
atgcagggcttcattacaaacaatgagagagctttagtggagctatttggggatgaggagaataatcgtaaagctgttgcatgtttaaatgtgatggctactcggattgcaacactttttgcttcattaagagaatttccttttgtccgctttcgtgctgccaagtccctagatgcaaccacaatgactaccttccatgatcttattcctacaaaacttgctgctggtgtctgggactgtcttatgaaatataaaaaaactatacctaatttccctcagactgagacctgcgagttgctcatcattgatagaactattgatcagattgctcctgtgatacatgaatggacatatgatgccatgtgccgtgatttgttgaatatggagggaaataaatatgttcatgaggttcctagcaagactggtggtccacctgagcgaaaagaggttctcttggacgatcatgatcctatatggcttgaacttcgtcatgcacatattgcagatgctagtgaacggctgcacgagaagatgaccaacttcatttcaaagaataaagctgcacaaatccaacatggttcaagaggtagtggtgaaatgtcaacaagggacttgcagaagatggttcaagcacttccacaatacagcgaacaaattgacaagctctccctccatgtagagggtatccctcttactgagattaaccccttgggaactgttacaatcgagaccagaaaaattaacagaattattagggagtcaggacttcgggaacttgggcagctggagcaagatcttgtttttggagacgcagggatgaaagatgtgatcaaattttttactacaaacgaagatacaactcgtgaaaataagttgcgcttgttaatgattcttgcgtccatatatcctgagaaatttgaggctgaaaagggtctgaatttaatgaaggtagcgaagttgacagatgaggatgcaattgcaataaataatttgagaatgcttgggggagaacctgataccaaaacgacttcgacgagttcttttgctcttaaatttgatatgcacaagaaaaagcgtgcagcaaggaaagatcgatctggtgaagaggatacatggcagttatcacgtttttatcccataatagaggaactcatcgaaaaagttagcaaaaatgaattatcaaaactggactatccttgtctaaatgacccaagtccaactttccacggtacaacttatgctgtaccagtaactcacaatcctcctgctcattcaatgagatcaaggcgcacaccaacttgggctcgacctagaggctctgatgatggatattcaag

SEQ ID NO: 17164 - DNA, 141 bp, Glycine max
  Peptide Sequence Number=SeqID_133942
atggttaagccagttcaacctgtaaattattctgtgggcatcaacgagttggagattgatgtagtggcaacttgtcaagccatagttcaaccgtccaaatcaaactgcacaacctctatagttttccacaagctggcataa

SEQ ID NO: 17165 - DNA, 1152 bp, Glycine max
  Peptide Sequence Number=SeqID_133943
atgcaaggacctgggggtggcagggatcctttcttcgattttggtggttttggaggctttggttcctttgggcctcccaggagtttaatctcaagcttttttgggggtagggacccatttagtgaccctttcttcgcccaaccttttggagggatgtttgagtctagtccctttggtggtcctactggatttcctttccccactggtatgaatccatctgggttccttgagcatccagccccgggtttggatccatctgggttccttgagcatccgggtatgcatccatctgggttccttgcacggcaaaatcctgagcctagtagacaaaggaggggaccaatcattcaggaattggactctgatgaagaaaatgatgacaccgcggagaagaaagaaaatccgagaaagcatggtaggtcagatggtgaaccctctgttgaacatccagatgatgaaattgaagggaagaagatcagacaggctggaaatgagagcagaatcaatataattgggcctcagcctcaatctcacagtttctgcttccagagctcaaccgtcagctatggtggcccaaatggattgtattatacttcctcaaggacaaggaggagtggaagtgacggagtgacatttgaagagaggaaggaggctgatagttccacaatgcaagcttctcacctaatttctagaggcattcatgggaagggacattcactctcaagaaatctgaattcagatggtagggtggatactaggcagacgctgctcaatattaatgaagtgttgccgagggtcgcagctgctccatggatgcctggtgcattacatcttgctgtcgcgccgggaatggccattcctgaaggttttggttgtgattttgtagatgagcttgctggctttgaagaacaatggaaggaaaagggtcaaaagtatttgcctggatggactgcgagtgttgaagctagcggtagtaatggacaagctgagcaggccaggagtggaggttgggcactcccttcttcggagtatagtcataccgtgggaacaatatctgaagctagagatgaagttggttcttctcgctcacaggagaggggcgtcgccgacactaaggccctaatgtttctgaaatacccgactcccaattaa

SEQ ID NO: 17166 - DNA, 2397 bp, Glycine max
  Peptide Sequence Number=SeqID_133944
atgcgcattgttaccactgccaaccttttcaaatcactccacaacctccagttcatcagactcacctcttctctcccccttctactcaaattttcagataaacatcatgttgaaacaccaccacacggcgccacctattcaccggataatgaacacgtcggaaagtcaacgctggcaatggacctcgcttccctactcgaggagcctccattgaaacccaagcccaagagtaggatggagcagaagcggtttctcgagctccgaatcaaaaagagggtaaaagagcaacacttcaatggcaagttccacgacctaatgaaaaccgtgatttctaatgcagaaacccttcgtgatgcttacaactgcatcaggataaacgcgaacacacacgacgcggcttcgagccacgacggtgcttcctttttggatgacctagctgaagagcttggtaaaagggattttgacgtgtgtgccaatacgtcgtcgttctcaacgaggagaggttccgcgaacaaagaggtattggtgcttcccaatttgaagctgagggttgtacaggaagcgatgagaatagccttggaggttgtttacaagccttatttttcgaagatctcgcacggctgccggagcgggaggggccgtgccgccgcgttgaagtacgtgtgcaagggtgttttgagccctgattggtggtttacgatgctcgtggttaagaaattggatgctgctgtgttggagaagatgatttctataatggaggataagatagaggatccttgtttatacgatttcattcggagcatgtttgatgctagagtgttaaatcttgagtttgggggtttccctaaggggcatggtcttcctcaggaaggggttttgtcccctattctgatgaatatttatcttgacctctttgacagtgaattttgtaggctttcgatgaaatatgaaggaatatgcaatggtggagggttaaatgatggagataggtctggctccatgttgcggggttggttcaggagacagttggatggcaatgatgttgtgaagagttctggtgtgaaagtttactcttgtcgccatatggatgagatgttttttgcggtttctggttcaaaggatgccgctgttagttttatgtctgaggtccggagttatttgaagagttctttgctgttggatgtgcgtgatcaacctgatgtgtttccctgtgaggggcctcatggtatccggtttttgggaactttggtgaaaagaactgttagggagagttctgctgtaaaagctgttcacaagttaaaagagaaagtggagctatttactttgcaaaaggtggaggcttggaattatgggacggttagaattgggaagaaatggttgggtcatggtttgaagaaagttaaggaatcggaaatcaaacatttagctgatagtagctccctcctgaacaaggtttcctctttccgcaagtctggaatggagactgaccattggtataagcacttattgaagatatggatgcaagatgttcaagcgaaaaatgccaagagtgaagaaagtatcttatctaagtgtgttgcagaaccggctcttccacaggagctaaacgattccttttatgaatttataaagcaggcagagctgtatatatctgccgaggcagattctattctcaagcttttgccaaataataacagctcaatagaacatcctttagcaaaaactgaaattattgctcctatccatgccataaaaatgcgtctcctgagatatggattgactacatctaagggattcccccgatctgccaatttacttatcatgctagatacaactgaaatcattgactggttttcagggatttcttgccgctggctgaaatggcatgaaaattgtgccaactttgatgagataaagctcttgatttcaaatcatgttaggaaatcatgcattcgtactttagcagcaaagtatcgggtacatgaaactgagatagaaaagcagtttgatgtagaacttagcaggattccatcaacacaggacattgagaaggagatgataaatgaagcattggatgctcaagcttttgataatgatgaagcattaatgtatggaattgcttatagcggtttgtgtttgttgtctctagcaagaattgttacccaggcaagaccatgtaattgctttgtaatagggtgctcatcttcagcacctagagtctatactcttcatgtaatggaaaggcaaaagtctccaagctggaagactggattttcaacttgcattcacccaagcttaaataaacgacgagtagggttgtgtaagcagcatttgagggatttgtatcttggccatatatcacttcagtccattgatttcagagcatggaagtcataa

SEQ ID NO: 17167 - DNA, 639 bp, Glycine max
  Peptide Sequence Number=SeqID_133945
atggctagcggcaccacaagaatgctagtgaaggagatgttgcaactctcttcttccacacttcacttctcttcttcggcgcttcgcggcctctctcctcctctgcccttctcaattcaattgcgacgctcgcgggggcgccctgcaattcgatgtgcttcctcttcctcagactcagatgcttccaacaaagtctcgtctcgtctgtcgcaggttcagcatcttcttcagcaggccgaacaccgcgctctctccgccgaccagggcccacctcctaaaatcaccttagatcatgttacggtgagctttgccagaagtggaggacctgggggtcagaatgtcaataaagtgaacaccaaggtggacatgcgcttcaatgttaaaaatgcatattggttgagtgacaggatcagagacaagattttgcaaacggagaaaaaccgtattaacaaggatggggagcttgtgatttcttcaaccaagactagaacgcagaagtttgtgtctccccttttgtactatttgttttctcttcccttgggtaacattgaggatgctttggcaaagcttcaggtgttcacttgtgaaaaatgtgaggctctgcatttgaaggaggtggccacaggagatagagattga

SEQ ID NO: 17168 - DNA, 2274 bp, Glycine max
  Peptide Sequence Number=SeqID_133946
atggcggcgacgaacgccggcgtggcggcggcggactcggccgcttcctcggacgaggcggcggcgaagacggcgcagaagcgctacgaggggcttctgatggttcgaaacaaagcgataaagggtaaaggcgcatggtactggacgcacctcgagcctctgctggttcacaacaccgaaacgggactccccaaagcggtgaaactccgttgcaccctctgcgacgccgttttctccgcttccaacccttcccgcaccgcctccgaacacctcaagcgcggcacgtgccccaatttcaactccgccgccaaacccatttcctctgtttcccctgttcttgtttcttcttccacttctcctccttctgcttctccctttaacaaccgcaaaagaaccaccacttcgccctcagcttcgggttcaggctcgggttctctctaccacgcaccctctcggtttggaataggtttgattcctcatcagcagcagcagcatttgaagctatctggtgggaaagaggatttgggagctttagctatgttggaggacagtgtgaagaagctcaagagtcccaaaacttctcctgggcccactttgagtaaggcccaaatcgacagcgcgattaagtttctcggcgattgggtctacgagtcgtgcggcgccgtctctttctcgagcttggagcatccaaagtttcgagcttttctcgcgcaggtcggtttgccgccggtgtttccgagggagttcaccggtacgaggttggatgcgaggttcgaggaggctaaggttgagtccgaggcaaggattagggatgcgatgttctttcagattgcgtctgatggatggaagtggaagagggagagggagagttattatgattatgatgatagcaattcggggttggtgaatttgagtgtgaatctaccgaatgggaccagtttgtacagaagggcgttgtttgttactgcttctgcgccttcaaagtatgcggaggaggttatgtgggagacaatcactggcatttgtgggaatctcgtgcaacagtgtgttgggatagttgcagacaggttcaaggccaaggccttgaaaaatctcgagaatcagaatcattggatggttaatctaacttgtcagtatcagggtttcaacactttgatcaaggacttcgccaaggagcttcctttgttcaggaccgtcgttcagaattgtctcaagctagccaatttgttcaattacacctctcaggtcaggaacagtttccacaagtaccagctgcaggagtatggccacacctggctgctccgggtgcctgctcacgagttcgaattcggactgcccgtgtgtgctatgatggaggacactttgagctctgtccgcgccttgcagctggtgctcatggatgagcctttcaagatggtcgccattgaggaccagggcgcgagggaggtcggggacatgattcgcgatgtggggttttggaatgacttggaggctgtccatggtttggttaaattggttaaagacatggctcaggagattgaggcagagaggcctctggttgggcaatgccttcccctttgggatgagttgagggcaaaagttaaggattggtgttcaaaattccacattgcagaaggggttgtggagaagcttgttgagaggaggttcaagaagaattaccaccctgcttgggctgctgcttacattcttgatccgctttacttggtgagggatactagtgggaagtaccttccgccatttaagtacttgacaccggaacaggagaaggacgtcgataggctcataactagactcgttgcaagagatgaagcgcatatcgctctgatggagctcatgaagtggaggacggaagggctcgatccggtttacgcccaagctgttcagatgaaggagagggatccggtcactgggaagatgaggattgtcaatccacagagcagtaggcttgtgtgggaaacttatttgactgaattcaagtccttggggaaagttgcagtgaggctcatattccttcatgcaacctcatgtggcttcaaatgcaattggtctttgtggagatgggtttgtgcacaaggtcaccactctaggaatgcactcaacaaggtgcagaaattgatatttattgcagctcattccaaactcgagagaagggatttttccagtgatcaagataaggatgcagagctgtttaccttggcaaatggtgaggatgatgtgttaaacgacgttcttgttgatacatcctcagtgtaa

SEQ ID NO: 17169 - DNA, 483 bp, Glycine max
  Peptide Sequence Number=SeqID_133947
atggaatacactttaaagctggaagatcttttaaaggggtgtcttgaaagcacaagaccaagggtcagtcacctaccaccgataaattgtgatttttgtggaggggagcatttcactaacaactgccatgtctactccatgaaaaattcttggtgggaacaagagttacacccttacaatcaatatgaagaagaaagaacttctaaccttgagaatgtgtttatggtattcatggaataccatgctagctctaaagccaatcaaaactcaatgcaaaaccaggaaattcaggttggcaagaactactccatggaaaattgtcagtgggagcaagagtcacaaccctacaatcaatatgaagaagaaagaatttctaatcttgataatttgttgatgcaactcaaggaaacatatgaatccactcaacacgtatttaaaaatctagaaattcaagttagtaagctagcaaaagaaagtggttaa

SEQ ID NO: 17170 - DNA, 564 bp, Glycine max
  Peptide Sequence Number=SeqID_133948
atggtcattgaccaatccctattctatgatttgacccaattttctagcgaaggtgtaccatttgaaggtacactggatgatgattggaaattttatttttctgtgcatgatgcccgccggttggtttgcaccaaccaagcggatatgaccggaaggctgcttgccagttcattggctcttgaaagccgcatccttcattatctaattgttcatatcctactccctagatcttcaaaccttgcacagagatccttcttgatcggtgttggtgtggttgcctcctttggttaccacaaagagtgtgatggctcttgggtaaaaatgggtgctcaaccaaatgatgatgaaggacactttccggttgaaggagacccttctctccttcagagtattttggacaggtttgatggacttcaaacctatgttggtgagaggtttgactccttggaacgtcaagtggacacacgattcgaggtgatgaactcaaggattgcaaaggttgaagaagatgtcaccattattcgcgactgctttgatttacctccaccaccaccatcagtttag

SEQ ID NO: 17171 - DNA, 150 bp, Glycine max
  Peptide Sequence Number=SeqID_133949
atggtgtgtaaacttctcataaaggggagaaaggagagaggggagtatgctggtcagctgggtgtttatcaatggaaaagaaagagtggccactggaaatacaatgttcctcaaccttctttcagacttctcttcagtaaacttggctaa

SEQ ID NO: 17172 - DNA, 363 bp, Glycine max
  Peptide Sequence Number=SeqID_133950
atgaaaagcactgatgagaagcatcaaattgaaggactagagaaagaaactcggtctaaacgatggacaataacactaacacaccagcaactaacttttacaaaaaaattgaaggttgaaggagaaaagaagaaaattggaagcaggcccagccaagtacgcgcgcttagcgtgcgtcatgcgctaagcgggtcaggaagcacaagcgctaaacaaggtgttaagctcgaagatgcagaatccattactcacgctaagcgcggagcacgcgccaagcgcgcgatccaacagaagcacacgttaagcatgcaacacgcgctaagtgcacgatctgaatgcactaagcacggtgtgtcgcgctaa

SEQ ID NO: 17173 - DNA, 414 bp, Glycine max
  Peptide Sequence Number=SeqID_133951
atggtgatggtgacggtgaggggaacgaacctggatggaagggtaagagatgagttggagggggccgacgacgaggaagaacatgcgcatgacgtctttgtagcacttgaaggtttcggccagggacaagcggacttttggttggatcttgtgggaagagacgaaggagaagcgcttgaattcgaggaagacgagggggagggggacgagggagaagacgaggaagaggaacagaatgttgtggcagtagaggaagtaatcggacttggcggcggagtagttgaaccagagggtctccgcgaaggtgaggttgcggcccagcgccgccacggcctccgggatggaagcgtaggggagcatcgtcaccggaaacctaggattgccggcggcggaggactatttttctgtttgtga

SEQ ID NO: 17174 - DNA, 249 bp, Glycine max
  Peptide Sequence Number=SeqID_133952
atggaaggcgcaaataatatcaaccaagtgagaggtgactcttttgaaaagaaggacaaaagtattgaaaattccaacatgatagggaagacaattggtcttgcaaaatggagaagaagaagagttgagaggaggcaccaatcactaggggataagccttggaagaaggagcttcatcaccaagaatgtgccttggataagaagcttggagaggatgcttcaatggaggaaaaaaaaagagagagataa

SEQ ID NO: 17175 - DNA, 393 bp, Glycine max
  Peptide Sequence Number=SeqID_133953
atgcagagaaagcatgatgaaaaaatgatctttttacaacaacaagctccaacggccccacgtgatgatggactgcaaaaatcacaccagtataaccacgatcaccaacaccatcaatattttgtgaaaaaagatagagagaccgagagttggagagccatggtgggtggctactttttcgagtttggcggttgtgtgtgggtgctgattcaagttcgatggtggcgtgtgggtcgccccttcaccgtcggcgctgacgtggaccactacaagaccaccctgaccaccgccctcgccgtgttgcctgtcgcctcctcgctaaacaacgaggaagagaaggaattgaacagggaaaagtactcgaaagattggcatacctttatgagcatgtaa

SEQ ID NO: 17176 - DNA, 262 bp, Glycine max
  Peptide Sequence Number=SeqID_133954
atcatgcggtaaagtgtatgccatcatagtgttcatggtggtctacgactgcatcgtggtgaaaccaaagatggtgccttcaaaagaggtggttcatttagcggaattgggtgctgcaaggtgggatcaacaacaaattggctcagatgttgcacaacatatgtgtcgcaatctacccttcggcgggagggcgacgcgtgactcgcgggatgcgtgttccacgaaaggaatacgcgcggagtcgccaccaacgtttatttga

SEQ ID NO: 17177 - DNA, 129 bp, Glycine max
  Peptide Sequence Number=SeqID_133955
atgtgtctaggagcttcagatggagcatacacaaagttaaatgtcccacaagttgataaagctagatatcagactgagaagggtgacatagcaacacatgccttaagagtttgttcacaagatcaatga

SEQ ID NO: 17178 - DNA, 495 bp, Glycine max
  Peptide Sequence Number=SeqID_133956
atgatgcatcaagccaagaaagtggagaaacaacttgagatgaagcattcctacaagaagacctatcactatgactcttctagtggtaaggacaagtctgagaaggagggatcttccccacctaagcagcaaggttcaaaatttccaagtggtaaacatgttcctaaccctagcacttcttctacttctaggagtagttcaattaaatgctttaaatacttgggtaaaggtcatattgcattacactgtccaaacaagaaaaccaaagttttgagggacaatgagattgtcactaatgatggattgatgatgtgtaggaggttgttgggtatccaatgtaaggatagggatgagattcaaaagaataacatatttcaaactagatgcttggttctagggaatgtgtgttctttgattattgatggaggtagttgcataatgtgtccaacacaagctcccatagaagcatgtcacatcttgttgggtaaaccatga

SEQ ID NO: 17179 - DNA, 576 bp, Glycine max
  Peptide Sequence Number=SeqID_133957
atggggcgacatagccaaggaagtcatcgtgaaatacaaaactttgtggtggacgagtccgtgctaatgaacttcatcgactctgacaatggtcgcaatgtcaacaccatgaacgcagatggtcgcaccatgctcctcttcgttgtcgggctcagcttagagccatgcgtgaagctgatggtggagggtttgaggtggctcatttccctacttaagggtggagctataagactttgtggcctttatagccatgggaaacatccttctgaatctacaacaccaaagactcgtccatctttaattattgactccatggtgaacatggtcatcattgccttcatagtcataatgggtcttattaatgccaagcctaaaaactacacaccctttgcaccctttggtgcaagggggaataccatggtgttgttggtgagtgttgtgggccaagctaggtacttgacccacatgataccaccttggttttccctagttgatgagcacatctggacgatagtgaatgtcacgatcgctatggtggtagcctctgttgtgattgcattcttcattgagctttag

SEQ ID NO: 17180 - DNA, 1362 bp, Glycine max
  Peptide Sequence Number=SeqID_133958
atgtggaggacaatgcatgagtcccataaagcccaagcactcatctcccagcatttgagtaacctcagtgataatcataacatgatactaaattcggaatatcatcaccaggctactattcaatttgagactgaggcttcttattggtataatagcttttgcaaacttgtaaaatttcaacgggagtatgtgaggaccctctatgagtggattaagcttgctgaaagcctcaaggatagtaatgaatgtagcaatcattcttctattcttgccatttgtgatcagtgggagcgtgggcttaatgagtcacctgacaaggagacctctgaagcaataaaaagccttgtgtcatgcatccgttccataactggccaacagattcaggaagataacattctgaaaaggttagaaaaactcgataggaaattccaaaaatgcttgaactccttggctgagatgcagcaaagaattgatggagatatggctgatacaagccccaggcatccaatacatcttaagaaaactgaaaccgaagcccttaagaagcaagtggaaagtgcgaaagcaaattatttggatgctgttcagtatagtagggccatgaccctagatcacctccaaaagacacttccccctctcttccagtcactgatggagttttcaaatgcttcagctcaggctattgaggctatcaataccacaggaaagccagtagagtttttttccgtcaatccaaagaactcatcctcttccaaatcctactctaattcgttgcaaaccagcgaagaagattccaaaacagttcatgtgaaactgatgctagagtgcgttgtcatcttagcttcacgaacacacgagtcccatgctttggtcttaaaagtaaaggctccaccaccaccacctcctttgcagagcaatgtggtgctgtcactgcgcgcgccattagatttggtgactttgctggacgtaggtggaaacatgaccagcccgaagtttgaagttggacaagcggttgtcgcggacaaggtagcagttgccattaaggaccttgatcacgatgtagttgatgcgattctcgaggccgaggagaaggttgcgaaggccgacattgacatcaatggcgacgatggagaagccgaggcgggcaagggagaggccgatgttggcagtggtagtggtcttgcccacgctgcccttgctggaggtgatgacggcaacacgcgggatgaaggttttagaggggagaataggggtggaggaggaatgtggagttgggagcggtggtggcactggggagaaagtggagagagggcattgggaatgagagagagagaggcagaagaagaagaagaagatgaatga

SEQ ID NO: 17181 - DNA, 330 bp, Glycine max
  Peptide Sequence Number=SeqID_133959
atggttgttctgacagagaaggtgtctggagcagaggagactgcagcaacacgcaagcaagaagaaacaaacgcattgcgaattggaactcaccgcatagagagagggggggcatttggaacaaagagagagagggagctcgaaacccgagagagagagaagggaagcatccaaagaaataagaagagtggcacaaagaccatcgcagagagagagaagaatagcagttacagtaatacctatgagaggagcacgtggctgaagttccctgcgtggaaggatgggtgtgttgttgataagagtaagatcacgaacttgttgagcatgtga

SEQ ID NO: 17182 - DNA, 498 bp, Glycine max
  Peptide Sequence Number=SeqID_133960
atgggtttaggccggaatggtgatggcacggaaaacttggtgaagttcattgaaaaccgtggaaggttcagtctgggttacaagcctacacatgtggacaagagaagggtcgccttagaaaggaaagaaagaagcctagcccatttacaagggcagggaccacagatggagaggaagaaaccaaccaagattagccaagttgggtgcagccgtgctccccgggactcggatgttgactttgagcagctagtaaatcaagccgaggaggaagaaaatgaggattggggacttcccccggatttgaggagaatggtggagcaagaagaaagggaggatatgcctggtttgagctcggaaatcgtgcagcacaagctgcctctgaatcccgagtgctccccggaggaagtgaaaaagcaatttgatgtcggtttcttggccattgcttggtacccagaatgggttgccaatatcgtgccagtcccgaaaaaggatgggaag

SEQ ID NO: 17183 - DNA, 579 bp, Glycine max
  Peptide Sequence Number=SeqID_133961
atggcaatggcaagcttggctcgacgaaagggttacaccgccattttgtcattgagcatagcattgcagaagcgcttcttacactatataaaggttgctaagggacaagttcccgacagtaataacaagaaaatacacaaatccagggaatattctagcagaatgatattcccttattcaccactacaaaggcattaccagaaagatacgactcctactacatacttcatgtgttggggcttcaaaccattacttccaaaaaataatatcgggatcccaaggtttattccggggaattgcacctggtttagcaattgtgcagaatgcaacggtcattgctggaagcgtgtatccggccatggcagtcccacgaggaggaactctgctgaagagcttggtgaagggcatggtggggcgaacgagatcggacagatgaagaacaggcctaggaagcgggtccgaccaagttgtgggttgcgactgtatgggtaccaaaggcggaagtggtggcggaggtggcggtggaggtgtcgtggctggcggaggtggcacggtcgtgaatgcggtgcgcgtgggtga

SEQ ID NO: 17184 - DNA, 369 bp, Glycine max
  Peptide Sequence Number=SeqID_133962
atggaagtagtcatgagtcaaggacacgaccttgagctcatgttttgttctccaaccaccactaagggtatgtcattgagtttgtggtcgcgtttccatagtgtcaacttgacaacctcgataaatgagatgggtgacttactccatataccattttgttttttagagcaagatgagggacttgatgccaataatgaagatcagatctttaatggaactagcgtagccaccaagattaatgatagggatagtaatatgggattgcaggaagtaagggggtttgcaagaagcaaaaagcatgagacccaaaaggcaggcaacaacatgtggctagctatgacacatgctgcatggatcacacgtacatga

SEQ ID NO: 17185 - DNA, 171 bp, Glycine max
  Peptide Sequence Number=SeqID_133963
atgaaggacatctttgaggttgtattgactaccatgttgaaggacgaggcaaagaattggtggaaagacacgatggagaggatgatgaccttggagattcttgtcatttgggagaacttcaagatcacattcttggacaagtacttttctttacagtgtcagaatccaaag

SEQ ID NO: 17186 - DNA, 318 bp, Glycine max
  Peptide Sequence Number=SeqID_133964
atggcactgaaggatatggaaaaaacaacattcatcactctatgggggaccttctgctacaaggtgatgtcatttgggctgaagaatgctggggcaacataccagcgggccatggtgacattattccacgacatgatgcataaagagatcgaggtctatgtggatgacatgatcgccaaatcaaggatggaggaggaacacctagtcaatttgcggaagttgctcgggcgactgcgtaaatacatgttaaggctgaatcctgcaaagtgtacgttcggggtaaaatctggaaaattgcttggctttgtcgttagctag

SEQ ID NO: 17187 - DNA, 129 bp, Glycine max
  Peptide Sequence Number=SeqID_133965
atgatgcatatggtttttgagattaagcctgagaggatcaatgatttcaataacaagagccatgttaatagctttgatattttggatgacaaggttaaggtttatgccattgtaatggatgatacttga

SEQ ID NO: 17188 - DNA, 708 bp, Glycine max
  Peptide Sequence Number=SeqID_133966
atgggaaagggcaaagctggcagctacattggatcatattgggagattttagtgaactctgcatacatgtcatctggtgcttcaaattcaagaaaatcaattgtggcaactgatgatgaaaagattgctgattgctgtcgacaatttggagctgatgttataatgacatcagaatcttgcagaaatggtactgagcgctgcaatgaagccctacagaagcttgggaaaaaatatgatattgttgtcaacattcagggtgatgagccacttattgaacctgagataatagatggtgttgtgaaagctttgcaggcagctcctgatgcagtgttcagcactgcagtcacatctttaaagcctgaagatgcacatgatccaaatagagtgaaatgtgtggtagataatcgtggttatgccatttatttttcacgaggattaatcccattcaacaagtcaggaatggtcaatcaacagttcccgtatttgcttcatcttgggattcagagctacgatgcaaagtttctgaatatataccctgatcttcaacctactccgttgcaactcgaggaggatttggagcagcttaaagtccttgagaatggctacaagatgaaggtgataaaagttgatcatgaggctcatggtgttgacactcctgaagatgttggaaagatagaatctctaatgcgtgagaggaacttgtcttga

SEQ ID NO: 17189 - DNA, 375 bp, Glycine max
  Peptide Sequence Number=SeqID_133967
atggagtttactgataaggaagaagtggtgattgaggagaaggtagaaagatgggaggaagaagacacagagggtatgccttatggtcaatggctaaaggccttgccatcacgtccaaatgtagtggtcgaggtcaaacaacaagtcatctatgggaaggtcaagcatactagtctgtttgatgataaggagaaggagaaggagaagccaatgtcaaatcataagaaggataagaaggaaattgtggaggttatgggggagaaaagtgagatgcagggtgtagatctaggagagccacaaaaagaagctgaaattgtggtaagaggaaagcgtcaggtggaaggccatgcaagtggatacaatgaagggagatga

SEQ ID NO: 17190 - DNA, 234 bp, Glycine max
  Peptide Sequence Number=SeqID_133968
atgggggacctggatcatgggcttgccaaggatttgaacgagaggcttccctggaagcgcgaggaagcgaatcgggcggcaatcgccactccggccacaatgccatggatgatccacgccttcgcggtgctcgaggaaccaaaggacgatgtagaagaagaagacgatgacgatgacgatgaaagtgaggaacaaattgccatgacccaaacaagaggaataagcgaaggatga

SEQ ID NO: 17191 - DNA, 606 bp, Glycine max
  Peptide Sequence Number=SeqID_133969
atggaatcggcattgatatttctgggaacgggaagttcggggtcggttccttgcatgaggtgtctcattgacccttcggatcctccatgtcctgtatgtgcttactctctctccttcccacctcacctcaatcctaactacaggtgcaatagctctctgttaatcgattattactgtcgaagcgatgccactcacaaatatatactgattgatgctggtaagaccttcagggagactgcacttaggtggtttgttttccatcacattcccagagtagattctgtgaagcttgatttgattgttttgactcatgaacatgctgatgctgtccttggattggatgatgtgcttgctgtgcagccgtttagtcccacaaatgatattgatcccatccccgtttacttaactcagcattcaatggatagcgtcgaaaagaggttcccttatttggttcagaaaaaacacaaagaaggtcaagaaatgagaagggtggctctgctttgctggaacataattgctgatgattgtaatcggccattttttgcatcaggcttaaaattgattcctttgccagttaatcactgcaaaccttgtcattggtggtag

SEQ ID NO: 17192 - DNA, 312 bp, Glycine max
  Peptide Sequence Number=SeqID_133970
atgatactcggagatacgttacggttatccgcccccccctttgccattcagacacagtcgtgttcgatggcaagcagagaccaagtttggtcattctgcacacatgatacgcggagataccttacggttatccgccccccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaagtttggtcattctgcacccatga

SEQ ID NO: 17193 - DNA, 261 bp, Glycine max
  Peptide Sequence Number=SeqID_133971
atggtgggttacacatcttcaagttttacagatttggtcttcgccagcaaaaagatcaaagtgggtctgaagagaggcaaatttaatcatcctgcttggacgaatgagaaaactggggcaaatgaagagggtgaggatgagggagaaacccatgctgtgactaccattcctgtacggccaagtttcccaccaacccaacaatgtcattactcaacccttctcctaacctactgcccatttatccacaaaagccatccctaa

SEQ ID NO: 17194 - DNA, 304 bp, Glycine max
  Peptide Sequence Number=SeqID_133972
caaaatcctcaggaatttaaaatccttgagataggtcctgggcatcctgagtctgggcctcctccttatctatcagatggaaaaataggggaatcagagagagcaacaacatctctagataaggaatcagaaagatcaacagcttctctagttggggattcagggggagcagtagcttctccagatggggaatcagagatgataatcaaaggtggagatgggggaactacttcaagctcaggagaagaaggtggattcaccactagagattgtggatcagctggcactggttcaacccgtgcag

SEQ ID NO: 17195 - DNA, 225 bp, Glycine max
  Peptide Sequence Number=SeqID_133973
atggcgatgatgatggtgatgatgatgataatggtgatgatcatgttcttcaacaataacggacaattacacgtgaacatcctaaaacaagaggaggtagaggtcatagaacaagaggacaacaaatacaggaaaatccggttcaacaagatgagagaccgagacacatatctagaagaactcgttgtgggacatcgtctcattattagtttaacaaatatgtaa

SEQ ID NO: 17196 - DNA, 672 bp, Glycine max
  Peptide Sequence Number=SeqID_133974
atgtcagcgtatgacaatgttgttggtgggaaattgaagttgaagggaaaagcactggatgtggctggtggagtgaagaagaagaaaaagaagaacaagagaaatcaggaacaacttttgcaagtcgccgaagatgaagtttcagcagatggttttcctgtggtcgagagaaatcacgaaaaaacgtatgaattttggaagaataccactgtggtcaaggtgggcaataacagcagtaatcttaatcgtggtaaccccagcaatttatgtgaactttctagtatggaagctctcactggccattggatacctgaccctgataagtttcaacacctccaaacacacctagttcactttcccactgacaagaagagagattttttgttgtcaaaaatgataaggggcaaaggtggaagtaaagaacaagccaaagattcaaatgatgaagatataaatgatgtgagtgaattaagcggggaagggaagacagctcattatgatgatcatcttacaccggtggagaggcgttacatagagcagagggagcaacttgatgttcacagattggctaagatatctaataaatctcaccgtgacagaattcaggatttcaaccaatatcttgcaaacatgagcgagcattatgatattcctaaagttggtcctggatga

SEQ ID NO: 17197 - DNA, 567 bp, Glycine max
  Peptide Sequence Number=SeqID_133975
atggaagtagagagagttgaggattcatttgacagcatagaagaaaaaagaattgaagattcctttgatagcattgacgatgatgctgaatcaggcttgcaagatgacaaaatcatggaagaaactcctggtgatatttgcttgaaagaaagagttgaagactcctttgaaaggatggaactagcgctctcaattttagtagctggcattctttgcatatacatcaactatgattgtgacaggcaaaggcaagaatttcgtaggacaaatggaaaaggcacagtctggggaaaagctccatcaaagatagaggccacatatactactacttctggggaaactaaaagaagccttcttttaacctctggatgctttcttctggacagtcccagctctcttcaatcatgtaagggtccctttctctttgtacaagttgaagtttggagaagaatgttaagctccattttttttcacttgcagtttttgccttacttctacgtgatatttcttaccatccttctctttgatcgagcaaaacgagatgatgatcgatgcagatccaagtaa

SEQ ID NO: 17198 - DNA, 1494 bp, Glycine max
  Peptide Sequence Number=SeqID_133976
atgggttcaagattcccatctcatcagctcagtaatggcctgtatgtatcaggccgccctgaacagccaaaagaaaagactccgacaatgagttcagttgccatgccctataccggtggtgacatcaagaagtctggagaactagggaaaatgtttgatatccccatggatggctctaaatctagaaaatccggtccaataaataatgctccttcaaggacaggatcatttgcaggtgctgcttcacactctggacctatcatgcaaaatgctgcagctcgttctgtttatatcacatctggtaatgtatccgctggaggcatgtctgcttctgcctcaatgaaaaagaccaactctggtccattgaataaacatggggaacctgtcaagaagtcatctggccctcaatctggtggagttacacgccaaaactctggtccaattcctccggttcttcctacgactggtcttattacatctggcccattaaattcatctggagctccaaggaaagtgtctggtcaattagattctacaggatcaatgaagtctcttagttcctttgtagcccacaatcctgctgtaaccactcttagccttgatgatgaatattccttcaggaagaacttcccgaagccaatattgtggtctgtgattctgatttttgtaatgggattcattgctggcggttttattcttggagctgtccacaatgccattctcctcattgttgttgtaattctttttggtgcggttgctgcattattcacttggaatagttgttttggaaggaaagccattgttggtttcatttcccgttatccagatgcagagcttagaactgccaagaatgggcaatttgtgaaggtttctggggtggttacctgcggtaacgttccactagagtcctcctttcagaaggttcctagatgtgtatatacatccacaagcttgtatgaatatcgaggatgggattcaaaagcagcaaacccaaaacatcgccgttttacatggggacttagagcagctgaggtgggtgggcctgttaattatccaagcttgaagcccaaagcgttcttgcttgaggagagacatgtggtggacttttacatctctgatttccaatctggactgagagcattggttaaaacaggctatggtgcaagggtgactccttatgttgatgattccattgttattgatgttaatccagccaataaagacatgtcccctgagtttcttcgatggttgggagagagaaaactttctagcgatgatcgtataatgcaattaaaagaagggtacatcaaagaaggtagcacagttagtgtaatgggagttgttcaaagaaatgacaatgtgcttatgattgtccctccacctgagcctttgagtaccggatgtcaatgggccaaatgtatattccctgctagccttgagggtattgttttgagatgtgaagatacgtcaaagattgatgtcattccagtgtag

SEQ ID NO: 17199 - DNA, 2079 bp, Glycine max
  Peptide Sequence Number=SeqID_133977
atggctcttgtaggagttgaactgaagcatgcggcggagggcgtaccggaggcgaattgctccgccaagcccaccaagcagggcgagggcctccgccactactattctctcaacatccacgagcatcagctccttcttcgccaaaagactcataacctcaaccgtctcgaggctcagagaaacgacctcaattctagggtgaggatgctgcgcgaagaattacagcttctgcaggaacccggctcttatgtcggtgaagttgtcaaagtaatgggcaagaacaaagtccttgtcaaggtccacccagaaggaaaatatgttgttgacattgacaaaaatattgacattacaaagattactccatccactagagttgcactccgcaacgacagttatgttcttcacttagttctgccaagtaaagttgatccattggtcaatctgatgaaagttgagaaagttcccgattctacatatgacatgattggtggtttagaccagcaaattaaagaaataaaagaggtcattgagctaccaatcaaacatcctgagctgtttgaaagtcttggaattgcacaaccaaagggtgtcctgctctatgggccacctggtacaggtaaaacattgttggctagggcagtggctcatcatactgactgtacattcatcagggtgtctggttctgagttagttcagaaatacattggagaaggttctagaatggtcagggaactttttgttatggccagggaacatgctccatcaattatcttcatggatgaaattgacagtattggatctgctcggatggaatctggaagtggcaacggtgatagtgaggtacagcgtactatgctggaacttctcaaccagttggatggatttgaagcttcaaataagatcaaggttttgatggccaccaatcggattgatatcctggatcaagccctccttagaccaggacggatagaccggaaaattgaatttccaaaccctaatgaagagtctcggctggatattttgaaaatccattctagaagaatgaatttaatgcgtggcattgatttgaagaagattgccgagaagatgaatggagcatctggtgctgaacttaaggctgtttgcactgaagctggaatgtttgctttgagggagcggagggtacacgtgactcaggaggattttgagatggccgtggcgaaggtgatgaaaaaggagactgaaaaaaacatgtcattgcggaagttgtggaatggcgtggaaggcgaatcagccactggcactgaacaattaaccattaacaagaacaagaacatttcaagggaggacatagtaatggacatggttctgcattcagccttgtacccaccatctctgtcttgttcctcttctactactggaacaagatggcccaattcccgggttggtgttagtttgagttggaggagcttgtccttggtgccttgtgcactgaaggcatattatgattctgaattggagaataaaaagcatctacttctgacctctgtccaagacacgcaaaggggcctcttaacaactcctgatcaacgctcttgtatcgaggaggctctggtgagtctcgaaggatgcaacattggctctcaccctatcaatctctccaacttggatggaacatggcgcctccagtacacttctgcctctgatgttctcattcttctccaagctgctgctactcttcctttctttcaagttggacagatctttcaaaaatttgaatgtcgtgatcaatctaatggaggtgttatccgcaatgttgttcgatggagcattccaaatttgttagaggaacaagaaggtgctacactgcttgtatccgccaagtttaatgtagtatctgtccgtaatatctaccttcagtttcaagagattttgcaatttctccgcactttcaaagctcaaatccctgtgagggatccaggaaggcaatcagttggaggactatattaccttagctatttggatgataatatgcttttgggtcgtgctgttggtggaggaggggtatttgtgtttacgagagcccaatctctctactga

SEQ ID NO: 17200 - DNA, 1065 bp, Glycine max
  Peptide Sequence Number=SeqID_133978
atggcattggaatcccaaccgcagaagaacaagtatggacacggggtgtttggagacgtctccagcatcatcaaagagatggagattgatcatcccaactctacctttgattttcaatttcaatttcccccaattgcttttcagaattttctgggctctagagaggttcgcgagtttattagcggggcccttgcaggggcgatggcaaaggctatacttgctcctcttgagaccatcaggacaagaatggtagttggtgttgggtcaaaaaatattgctggtagtttcatagacgttatagagcagcagggatggcaaggactgtgggctggaaacatgatcaatatgcttcgtatagttccaacacaggccattgagctaggcacatttgagtgtgtcaaacgggctatgacatccctgcatgagaaatgggaacacaatgaataccccaagttgcagataggttccatcaatttcaacttatctttatcttggatttcaccagttgccattgccggtgcggctgcaggaattgctagcacagttgtatgccatcccctcgaagttttgaaggaccggttaactgtaagtcctgaaacttaccctaatttaggtattgcgattagaaatatttataaagatggtggtgttggcgctttttatgctggtatctcaccaactctggttggcatgcttccatacagtacgtgtttttatttcatgtatgatacgataaaggaatcttactgccgcaccagaaataagaaatctctaagccgtccagagatgattttgatcggagcttttgcaggtttcactgccagtacaattagcttccccttggaggtagcaaggaagcgcctgatggtgggtgctttgcaaggtaagtgcccgccaaacatggcggcagcactttcagaagttattagagaagaaggtctgaagggtctctacagaggatggggtgcaagctgtttgaaggtcatgccatcctctggtatcaccaggatgttttatgaagcttggaaagatatattgcttgtccagaatggtaatcccctttag

SEQ ID NO: 17201 - DNA, 210 bp, Glycine max
  Peptide Sequence Number=SeqID_133979
atggacatgccatcacacaccaccattacccacatccgcactgccagagagaccatcataccaccacatacctccacgcctaatatctactttgtcatgaacgcagccgcaccactacacgcctccacgacccaaatccacttcgccatgaaaaccattgtgatatggtgtggtgtgtattttgggcacaatccagtaaagttgttctaa

SEQ ID NO: 17202 - DNA, 1146 bp, Glycine max
  Peptide Sequence Number=SeqID_133980
atgtcaatcagaagcagcgctttcttttgctttcaaataaattgctccgattcaaagcaaggccgtggttttggagaaaacactaacagtaacaggattaagaccaacaaatctgacaagggattggtgtctcagcaaagcaagggatcagcaaataaacagtctcgccctctatcttctcaggcaccccgtttaagttcacaacttgacggcaaatctaggaacgattttttggatgttgactttgaggaacggctaaaagcagttagaaggtcagcacttgagcagaagaaggcagaggaggaaaaagaatttggagcaattgactatgatgcaccaattccttccgacaatacgacaattggcgttggtactaagattggagttggggtagctgttgcagtctttggtctggtttttgcttttggagattttcttccatcaggaagtgttagtcccactgaagacagtgctgtggtcaatagtaagttgtctgaggaggataaagctactcttcagagtaggctcaaggaatttgaagcaacattaagtaattcctcaagagatccaactgctcttgaaggagctgcaataactttggctgaactaggggaatatgcaagagctgcttctctacttgatgatttgacaaaggaaaaaccaaatgatgctgatgtttttcgtttgcttggagaagttaagtatgaactcaaagattatgaagggagtgttgctgcatataaaagctcagcaagggtgtccaaagatatccaatttgaagttctgcgtggcctttccaattcattacttgctgccaaaaagccagaggaggctgttcaattacttttggcctatcgtgagcatctgagttctgatagcaacccaacagactcacagaagttggatccagttcaagttgaattacttctagggaaagcctactcagattggggccatgtcagggatgctgtagctgtttatgatcagctcatatctactcaccctaatgattttcgtggatacttagctaagggaatcatcctaaaagaaaacaaaaatattggtgatgcagaaaggatgttcatacaagctaggttctttgcaccagataaagccaaagcccttgtggaccgttattcaagatga

SEQ ID NO: 17203 - DNA, 597 bp, Glycine max
  Peptide Sequence Number=SeqID_133981
atgtcgcttccaaggaatatggtgagaacaaatgacaaaaaggaagaggttcctgttgtcgccgtgtttgcggtaagtaaaaaacttttatattgcggctgcaatgacgatcgcgatgtggttgcggacagtcgaaaaactgttatatatgttgtggtcgcatgtggctgcggactgatatttaaaaccatggaaagtagtaagtgcagaacgctgacatgtgctcccactaatgttgctgtgctcgaggttgcaaagcgtgttttagttcaagtgaaaaaatattatcagcctcttggatatggtggttacggccttggtgatattgtcttatttgggaatggaaagcgaatgaacatcgatggccatgttgaacttcatgatgtctttcttgactatcgtgtttgtgcactcgaaaaatgtttgggagcatggaagcatagcttagcttcaatgatatctttgcttgagaacccacaaaagcggtttcttcagtacttgaataaaacaaatgaggatgtgagtgtggattgccattctcaaaacaaggaaacgagaaggacagtgcaaaaccttggacatgagaggaatttgtaa

SEQ ID NO: 17204 - DNA, 231 bp, Glycine max
  Peptide Sequence Number=SeqID_133982
atggagatatttgtggttgggagcttcataaggatcaacacacatttcgaggaaggaagggacaaacaaggtagtgagattatgttaaaattaaagatattgatgtgtcgggagttaggacatgaccctatactcaatgggaatacaccttttaatatatattcacaagtaccaatgcaaccatcgttcatgcttctcatcatgaaggaggagagaggattcattaagtga

SEQ ID NO: 17205 - DNA, 291 bp, Glycine max
  Peptide Sequence Number=SeqID_133983
atggctccaatcgagttattggttattgatgaagcgacgcaacttaaaaaatgtgaagcagccattcctttgcagctttgtggtgtacgctgctccattctcataggggatgaaagccaacttccaaccatggttcaaagcaaggaagcaacaactgcatcgatggttccagaaactgtggggagactgcaattaaggttaatttttgaagaatcaagcagcacggacagaagaaagggacaacagggtcatcaagatggaataattgcatatagcagagctaaacattaa

SEQ ID NO: 17206 - DNA, 210 bp, Glycine max
  Peptide Sequence Number=SeqID_133984
atgcccaaagcctttgaaccatccaagactcttccttcaaagtccagcattgatattgaggtaaatggtgatgcagagaagccggtgcgaaaaaagatcccaagccctctgaagttgggatccagaagctcaagttcagaaggagagaagccattattggatagtagcagtagcaagcatgagcttcttggccatgcgcgcctgacttga

SEQ ID NO: 17207 - DNA, 435 bp, Glycine max
  Peptide Sequence Number=SeqID_133985
atgtcgagcatatcaccaaatcctccatacttcattgatgtcatcgagacacggtggaaacatgatgatacactcgttgtggactgtttctttaggttcctctattgccattgtgcgcccataaacatatcaggttacaaatcttgcatagttgacttctatgtttggtggacccaacccacactgttgtactatcgctttgtcgtgcccatgctagaggttgttattccttctgagtcgcattcaccacctgtggatgatgtgatgtcctcttctagatctgacacttcatctttggatattgagaccatttcccctactatgatgtctcacgaattgatcttacctaagtcttgggtaccacttaggatagacttggtgaatcacgtgttgaaggaggagggtgaagatttggggggaggacatgtcttttga

SEQ ID NO: 17208 - DNA, 1608 bp, Glycine max
  Peptide Sequence Number=SeqID_133986
atggacttccccgaatccgactctgacatatcatttgtaagctctgagaggcccagcagtgtgcgttcatcctctgttttctatgactattttgatcttcatgcccgaaatccacgaacttcaaccagttcagatcatagcttgggatcaacccgtatgagacccaagttctctgacctcagttcaaccgacatttcattttcagaggatagccgccgatcatcagtttcttcttccttgctaaacgttgatgaagccgaagctgacatgaggagcttgaagttggagttaaagcatacattggaaatatacactactgcatgcagagaaacactagcagcacaacagaagttaggggaactgcaaaactggaaaatagaggaagaaaagaaaatggaggagatgcagttgtcccaggaagcagcagaggcaagtgtggagcaagagaaagcaagaagtaaagcagcaagggaaacagctaaagcagcaaagagaatagcaagggtggaatcgagtaaaagagaaagtgtaaaagtgaaagcccttaaagaagcagaggaaatgaggaaacaattggacaatctaacccaaaacgacaaaagatataggagatacacaatagaggagattgaaagagccacagacatgttctcagaagcaaggaagataggggaaggggggtatggacctgtgtacaagtgttacctagatcatacacaagtggcggtgaaggttctgcgtcaagattcagctcaaggggaggcacagtttcagcaagaggtgaacatactggggtgcataagacatccaaacatggtgctgctaataggagcatgtgcagagcacggaatactggtatatgaatatatggcgaaaggaagcttggaagactgtatgtttggaaagaagaaggagaaggagggaaagatgaggagttggaaggtaaggtttggaatagcagcggagatagcaacggggttgctgttcctacatcagacgaagccagaaccattggtgcacagggatctgaaaccggggaacatattgctggaccagaattacgtgagcaagataagtgacgttggattggcgaaactagtaccggcagcaacggcggggaacgggacgcaatgctgcatgacagcagcagcgggaacattctgctatatagatccggagtatcagcagacgggaatgctaggggtgaagtcagacgtatactctctggggataattctactacagttgttgacgggaaggcctgccatgggactggcacaccaggttgaggagtcgatcaagaaggacaggtttggtgaaatgctggacccctctgtcccggactggcctctggaacaagccctctgccttgcaaacttggctctccaatgtgcacagctcaggcgaaaggaccgcccagaccttgccacactcgtattgcctcgcctccaaatcttgcgagactttgcttcccttcattcatccacctcttccgatcaaggtatacaacttacttactgcatttactccctcactcctcaaggatgcatcttcttaacaacttgtttctttttctcacagggcccaatgatcactaatctcttttaa

SEQ ID NO: 17209 - DNA, 296 bp, Glycine max
  Peptide Sequence Number=SeqID_133987
gttctgcacgactgggcttcctagtgatatagttgttgaagttggagagatgtcatttcatcttcacaagttccccttgctctctagaagtggggttctggaaaaaatgattgccaaggcttctgagtcagaggaagaatgtgtcatatccctcggtgacattcctggtggggccaaaacatttgaactcgtggcaaaattttgttatggtgtgaaacttgaacttacagcatcaaatgttgtgtacctctggtgtgctgcggagagtcttgaaatgactgaggaatatggtgaag

SEQ ID NO: 17210 - DNA, 1104 bp, Glycine max
  Peptide Sequence Number=SeqID_133988
atggggtctccactatcagaagacaaccagaagattctactggaagagattgatggattgctcccaatgcagaagggcctggttcaaacaaagctcttgtttggtctactacgaacagccatgattctacgagtgagcccctcttgcatatcaaacttggagaaacggattggcttgcagcttgatcaagctactctggaagatctcttgatgccaaatttctcatattcaatggagacactttacaatgttgactgtgtgcaaagaattcttgatcatttccttgccatggatcaggttactggaggtgcctctccatgctcaattgatgatggtcaattgattggatcgccttcactgactccaatcaccacggtagcaaagctgattgatggttaccttgcagaggttgcacctgatattaatttaaaacttcccaagtttcaaacccttgccgctgctgttccagagtatgccaggcctttggatgatggtttatatcgtgccatagatatttattttaagtctcacccatggttggtggagtcagagagagagcaactatgtaggctgatggattgtcagaagctctcattagaagcatgcactcacgctgcacagaatgagaggctacccatcagaataatagttcaagttctattttttgagcagctccagcttcgcacttctattgccggttgctttctagtttcagataacctcgatggatcgaggcagttgagaagtggttttgtcggatctacggagggtggctgggcgtcagccgtgaaggaaaaccaggttttgaaagtgggaatggataacatgaggatgagggtgtctgagcttgagaaggagtgctcaaacatgaggcaggagattgagaaattgggtcgggtgaagggatcgagcgcttggggaactgtgtctaagaaacttgggtttaagttaaagtctcagatgtgtagtgctcaagaagggtctgttagcaaccagaacaatgcaaataatacggttgagaagttgaaggaaagacatgtaaagcacaagagaagttcttctattagtgacaaagcatcagtctcttcaattgttcattcgtag

SEQ ID NO: 17211 - DNA, 232 bp, Glycine max
  Peptide Sequence Number=SeqID_133989
aaaagtaaatacgagtgtgaatgggagttcggatgctaaagaagagaacctttctcatgaacagaaacctaatggatcccggcagcaggaatctaaactggaattgttcggttttgattctcttgtcaacattcttggtctgaaaagtatgactggtgagcatgttacacaaccatctagtcctagagatggtgaggatatttccatcacagctggcttgcctaagcgatga

SEQ ID NO: 17212 - DNA, 390 bp, Glycine max
  Peptide Sequence Number=SeqID_133990
atgtcttctggtgggcataaattactaggtgtttttcatcagcatgaagttatttttgattatctttcaaagaacaatttatttgatgaatatagagattattctcttaattggctatgtgggcatttgtcttggattcaacaggtgctttcacctgaatatgcaaaggacttctacgacacattaatacctcattatgataaatattcgaagaaagaagttcagaattatttagctggaaagttttatgatcgtaaatcattagagctaatagtcgctgtcataagaaaaaatcgggatgcctttgttaaagcaatgacgggaaaaaaactttccgatatagaacgagttgttgaaacaggctttattctggctgagagtaaaaaataa

SEQ ID NO: 17213 - DNA, 180 bp, Glycine max
  Peptide Sequence Number=SeqID_133991
atgttggcaacgcattcccggtatagcgccacggccaagaagccggacatctcggacttcatcctccgcagctttttcttgactggggaacactcgggattcagaggtaatcattgttgtacgacgttgggacttaagcctggcatatcttggtatgaccaagcgaaaatgtattggtag

SEQ ID NO: 17214 - DNA, 1083 bp, Glycine max
  Peptide Sequence Number=SeqID_133992
atgcaccacaaccacaaccttaaccttgcaaggttgtggattgctttgcttgcggtctcaaccaccgtagttcattgcaaaactgcctcccaagatgtttcagcccttaatgtgatgtatacaagcttaaactccccttcaaagctgagtggctggaaatcaagtggaggcgttccctgtggcgactcctgggaaggaatcaaatgctcaggctcttctgtcacagaaataaatttatctgacatgggactttccggatcaatggtgctaccagttgtccaacttaaaatcagttaccgactttacagtgatttgagcaacaacaaccaaaagggtgatataccatatcgacttcctccaaatgctcgttatataaatcttgcacataatcagctcaaaaaccagttgggcgatatgtttgggaagctcagtaatctcaaacaactgaaacctaccccagaatctcaaatcgctcaaaaacctcaacaagttgtaagaacaagatcactatcactatcagggaataatatatgcacacatcttcacagtaagcttctgtttgtccttatacaggcacctacaaaacaacatttcactggttcagtaaatgtccttgccaaccttccacttgaagatttgaatgttgaaaacaacaaatttactggttgggttcctaaggagttaaaggatataaatagcttgcaaactggaggaaactcttggtcaagtggaccagcacctcctcctcctcctggtactccccctatcaagcattccgagaaaaagaatgataaatctgttattagtggagtagctatagccggcatagcctttggcgtactagcagtaattataattgttgttgctctttctaaaagatcatcaaaacctgcttcacattttatcgatgaagagaggcgtagccagcatagatcttttacaacccttgcatctgaggagttatcaaaagattcggatgtgatttcagcaaagactacaaagaaactgagatttagagagtattatatatctaacaaagggagctcagttccttacagcaaaggagaatcctcgggagactaa

SEQ ID NO: 17215 - DNA, 198 bp, Glycine max
  Peptide Sequence Number=SeqID_133993
atgaaaggaaaagaacttttgtactacgaaaagatgggcttccagatgccgatgagtttaatattatttaaaagctttatgaggttactggaagaacttgattccttgctttttcatgcatcaagaaatgatcctgaagcctcagtcaaatcaatgaaggcaaaaatcaattctgcccttggtgctctggacaggtga

SEQ ID NO: 17216 - DNA, 408 bp, Glycine max
  Peptide Sequence Number=SeqID_133994
atggattccacatcaattgacgtaaaggcttcgcaaaattctccatcaattggtgttaggtcgtcagtctccgattgtgtgcaatcctttaatgacaacgagtttgcaaatcgtctaaattctaggagaagttcatcaatccgtgttactacttttacacaagcagaattgcagtctgctactgctaattttgcttcaggtcgacttcttggtgaaggatccataggatgtgtctatcgggctaaatatgctgatggaaaggatgaccctgagatgatgaatggtagtgccagaatgactggtgaaaggttcgtggtggtgtggatagcacaatatcgtggggcaataattgttgggtctcacgaaggggtgggcagtgatgggatgaagagcggtggcattcaatga

SEQ ID NO: 17217 - DNA, 354 bp, Glycine max
  Peptide Sequence Number=SeqID_133995
atgaagaagatccacatggagctacatcatggacaaggttctttgaagtgcttgaattgtctatccaatgcaaatacaacactgaaggccaccttgaaaggaactaggattttgatcctagaccaactccttgttgatattttgggtgttcttgatgatagttctaggaagattcctctcagtctaccccatctgatcatcaaccacatgatcaaggcaatgaagcccaataagtcaaccttcagtgtgccttatgggttgttgatgaccctggtgtttaggcactttaaagtgatcatggaggataaagccagggatgaagaagtgctgacttgggggagaagaatgttgtag

SEQ ID NO: 17218 - DNA, 225 bp, Glycine max
  Peptide Sequence Number=SeqID_133996
atggaagagttgaagagatttttcatgttctttgtaacatctcggatgaatcacattggaatgagagggatccaaaggatgtacagcccatcacttaagaactccatagttaaaggtgtttggcttagagcaattatagggctagtcaataatcctgagagtagtcaagcggtgtcagaattagttgttgatgtctcagaaagggttatctacggaaggttctga

SEQ ID NO: 17219 - DNA, 372 bp, Glycine max
  Peptide Sequence Number=SeqID_133997
atggccagaaccaaaaccatgggagtaaagaatccctcttattccctcacctcaaaaagtgaaacttctcactcatactctcctaaaacccaccaagataaggggaaagacaaggctatagaagtgtcctcatggtctgattcaaagactaccatgactatcacacctcctcgtgcaaaagttattgtgattgggtcttctaagaagaaaagttttgtaaaagcagaaaagtctaggaagaagatgaaaaggtcagaatacgaagttgttaccttattcaatgacaagaagctgaaggagaagtttgacaagatttgggccaacaaaaaggttgtttatgacaaatatattgatcttctagagatcaaatag

SEQ ID NO: 17220 - DNA, 1452 bp, Glycine max
  Peptide Sequence Number=SeqID_133998
atgggtgctgctcttcagagcctgactggtgccccacgtctgcttgcagcaatagccaatgatgatattttacctattttgaactactttaaagttggagatggcggtgaaccacatgttgctaccttttttactgctttcttatgtattggtgttacattgaaacttgattctgtggtgatccttacctatgcagtgatcatgttcctaatctcttggtcattcaccgtggtgtctttgctccttgcaagcctcatatataagtacgtgagcattaaaggaaaggctggggactggggagatggtttcaaaagtgcatatttccaactagcacttcgtagccttcggtccctaggagcaagccaagtgcacccgaagaattggtatccaattccactggtattttgccgaccctggggcaaactgccagaaaatgttccctgtcatcccaaacttgcagattttgctaactgtatgaagaagaaaggtcggggaatgtccatatttgtctctatactagatggggattaccatgaatgtgctgaagatgccaagactgcttgcaaacaacttagcacctacatcgattacaaaaattgtgaaggtgtggctgagattgttgttgcccctaacatgtctgaaggcttccgtggcattattcagacaatgggccttggcaatctcaagccgaacattgtggtgatgcgttacccagaaatttggcggagggaaaacttgatagaaatccctgccacctttgttgggataattaatgattgcattgttgcaaacaaggctgtggttattgttaagggtcttgatgaatggccaaatgagtaccagaggcagtatggcacaattgatttgtattggattgtgagagatggtggtctcatgctgcttctctctcagctccttcttaccaaggagagctttgagaattgcaagattcaggtcttttgtattgcagaagaggatgcagacgcagaggggctgaaagctgatgtgaaaaaattcctttacgatcttcggatgcaagcagaagtctttgtcataacgatgaaatgggatgcacagatggatggtggtgggtctcctgcacaagatgagtcaatggatgcatttactagtgctcagcaaagaattgatgattacttaacccaaatgaaggcgacggcgaagagagaaggtactcctctaatggcagatggcaagcccgtggttgtgaacgagaagcaggtcgagaagtttctttacacgacacttaagctcaattcgacaattttgagatattcaagaatggctgctgttgtgttggtgagtctacctccacctccagtgagccacccagcatatttctatatggagtacatggatctgttgctggagaaaataccaaggattttgattgtaagaggatatcgtagagacgttgtaaccctattcacatag

SEQ ID NO: 17221 - DNA, 156 bp, Glycine max
  Peptide Sequence Number=SeqID_133999
atgggttcacgatctcttgtgtcggacttgcaggtatcctccacaggattaacgaggggagtacctgtaaaagggactccgacgctcaagcaaaaaggagcaaatttgaagaagtgccaaagtggatgtcgcgctaagcgaggtctgtgcgcttag

SEQ ID NO: 17222 - DNA, 1155 bp, Glycine max
  Peptide Sequence Number=SeqID_134000
atgcccgagaaggtattgccgccacttcttaacggcggtggtaatggcgaacagttctcagacatagcccccatgccaattgcggatgcatcagtctcaactgtgaagggtaaccagaagtcagggagggcgagaaccggtgcggacgtcaaagctgtcttcaaggtctcaaaggcggtctgcgcggcggaggttgaacgccgcggtgagagactaggtgacccaaatattccacctgaggtgatcgctgatggagacactgtagatgaggatatcgtcaaagaagacgatgataaagcgtcgaaggacgaaaggcataactttgaactcaaagtgcccatggtgggttctgaaagctgtcttgggaatgtcctccagttgcatgcgtatctggtgatacccttgcagcaagtccagtttggagaagtaactcgcacctccgagctcatccaagagctcatcaatgtccacgcagaacctccaggtgttgtcggacttcttcaccaacagcaccggatacttgtatgggagaacattgactggggtggcatctggacgcaagtggatctgatgatcagtctctctttccggcgacagcgttgtcgggtcctgaaaaagaatggaaaattgatgaagaagttgctggacctgaagcaccgtaatgtggaagcaaatgctattgggttgatctcggcagacacggcggaattgaggggaggagacgattgggaggacataaagattgacggtgaacgaatgatgttgaatgtcgattgtggtggagtcacaagtggtatggcactgcaaatgttggtcgttgccaacgaggaccttcaatggagtggtgggcctctgggggatgccggaaatgtgaccgacgagcctcagggtctcaggggaaaggtggcctgcaagggagttgcggctaatgtgggctggggtctcgggtatctcaattgggccgggagtcgggggcgcaccgatgccccttatggaacttctcgtcgcaagagaagcagaggccgcgctcgcggcgggaggctagctcctccggggtcagacggcggaccgtgggtggcggtgacggtgatggacgcggaggcaaaggcaagagtggaggaaggggcgaggcgcggggagaggcaaaggtcgtga

SEQ ID NO: 17223 - DNA, 3399 bp, Glycine max
  Peptide Sequence Number=SeqID_134001
atggaaaatcttgagattgacttgatggtagagagtgtgtgcatcccaagtgagcgtgagacacttttgaagattaagaataatctcatagatccttcaaataggctttggtcttggaatcataataataccaactgttgccactggtatggagtcctctgccacaacgtcacttcccatcttcttcagcttcacctcaacactacagttcctgctttcgagtatgatgatggctacgagtatgactactatgatgaagtcttccgtggattgaatgaggaagcttataggagaaggagctttggtggagagataagtccttgtttggctgatttaaagcatttgaattacttggacttgagcggcaatgaattccttggagaaggtatgtcaattccttctttccttgggacaatgacttccttgactcatctcaacctctctcatactggattcagggggaagattcctcctcagattgggaatctctcaaatttggtgtatcttgacctgagttatgttgttgccaacggaacagtaccctctcagatcgggaatctctctaagcttcgatatcttgacttgagcgacaatgattttgaaggtatggcaattccttctttcctttgtgcaatgacctccttgactcacctcgacctctcttattctcgattcatggggaagattccatctcagattgggaatctctccaatttgctctatcttggccttggaggtaattatcatgctgaaaatgtagaatgggtatcaagtatgtggaagcttgaatatcttgatttgagtagtgcaaacctatccaaagcatttcattggctacacactctccaatctcttccttctttgacccacctatatttgtcaggatgcaaactccctcactataatgaaccatccttgctcaacttctcatctttgcaaactcttgatctttccgatactagttattcccctgccatttcttttgtccccaagtggatattcaaattgaagaaacttgtttctcttcaattatcagataattatgaaatccaaggtccgattccttgtggtattcgaaacctcacacatcttcaaaatcttgacttgtctttcaattcattttcatcttctatacctaattgcttatacggtcttcatcgtctcaagttcctcaacctaaggtacaacaacttgcatgggactatttctgatgccctgggaaatttgacttctcttgttgaacttgatttatcagttaatcaacttgaaggaaccattccaacttcttttggaaatttgacttctcttgttgaacttgatttatcacttaatcaacttgaaggaaccattccaatttctttgggaaatttgacttctcttgttgaacttgatttatcagctaatcaacttgaaggaaacattccaacttctttgggtaatctctgcaacttaagggtgatagatttatcatatctcaaactcaaccaacaggttaatgaacttttagaaattcttgctccttgtatttcccatggactcacaagacttgcagttcagagttcacgactttcaggcaatctgacagatcatattggggcatttaaaaatattgagcagctacggttttacaacaactcaattggtggtgctcttcctagatcatttggaaaactttcatcattaagatatctcgatctctctatcaataaattcagtggaaatccatttgaaagtcttcgatcactctctaaattgttatctcttcatattgacggcaatctttttcacggagttgtcaaggaagatgatcttgcaaatcttacaagcttgacggggtttgtcgcatcggggaacaatttcactttaaaagtgggtcccaattggattcctaattttcaacttacctatttggaagtgacatcatggcaattaggtcccagctttccattgtggattcagtcacaaaacaaacttaaatatgttggactatctaacacggggattttcgattctattcccacacagatgtgggaagcactttctcaggttttgtatttaaacctctctcgtaatcacatccatggtgagattgggactacattaaagaatccaatatctatccgaactattgatctaagctcaaatcacttgtgtggtaaattaccctatctttcaagtgatgtgcatcagttagatctttcaagcaattcattctctgaatccatgaatgactttttatgtaacgatcaggacaagccaatactattagaatttctgaatcttgcatcaaataatttgtcaggagagatacctgattgctggatgaattggacatttcttgcggatgtaaatttacaaagcaaccattttgttgggaacttaccccaatccatgggttccttggcagacctgcagtctttacaaattcgtaacaacacactctcaggaatatttccaaccagtttgaagaagaataaccaattgatatccttggaccttggggaaaataatctttcaggaactattccaacatgggttggagaaaacctcttaaatgtgaaaatcctccgccttcgatcaaacagatttggcggccacattccaaatgaaatatgtcagatgagtcttcttcaggttttagaccttgcacaaaacaatctgtctggcaatataccgagctgtttcagtaacttgagtgccatgacactaaagaaccaaagtacagatcctcgtatctattctcaaggaaaatatattgtgtcttactctgccacggaaagtatagttagtgtgctactatggctgaaaggaagaggagatgagtacagaaacattctgggtttggtaacaagcattgatctgtcaagtaacaagttatttggggaaataccaagagaaatcacatatctaaatggattgaattttttaaacatgtcccacaaccaattgattggtcatattccacaaggtataggtaatatgagatcattacagtccattgatttttcgaggaatcaactttttggtgaaatccctccaagcattgcaaatttgagctttctgagcatgctagacttgtcttacaatcatttgaagggaaatattccaacaggaactcaattgcaaacctttgatgcctccagctttatcggcaacaatctatgtggtccaccactgcccataaactgcagctccaatgggaaaacccatagttatgaaggaagtgatgggcatggagtgaattggttttttgtcagtatgacagttggatttattgtgggattctggatagtgattgctcctttgctgatttgtagatcatggcgagggagagtagctgaacgtaacgaggggaaggataggaggtgtggggaaatggaactaaggataaccaagtaa

SEQ ID NO: 17224 - DNA, 222 bp, Glycine max
  Peptide Sequence Number=SeqID_134002
atgggttggtacaagggtccttgtggcagccaacatgcacaacaatgcaaattccctgacttggttaaaaaggctaggaaggaattcgtaataaccactgaatcaaagtcttctgtaacatttggaaatatgcccatatttcttcttggtatcagaacgtatcctagagccattcaaaaggattacgcaccatgcccaaagagtgttaaacgtgagggatga

SEQ ID NO: 17225 - DNA, 3483 bp, Glycine max
  Peptide Sequence Number=SeqID_134003
atgaaaaaccttgagatggatttgatggtgtcagccatgcgtgagacacttttgaagattaagaataatctcaatgatccttcaaataggctttggtcttggaatcataatcataccaactgttgccactggtatggagtcctctgccacaacgtcacttcccatgttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcaggtatggcaattccttctttccttgggacaatgacttccttgactcacctcgacctctctcttactggattcatggggaagattccatctcagattgggaatctctccaatttggtctatcttgacctcggaggttattctgtcgagcctatgttagctgaaaatgtagaatgggtatcaagtatgtggaagcttgaatatcttcatttgagttatgcaaacctatccaaagcatttcattggctacacactctccaatctcttccttctttgacccacctagatttgtcaggatgcacactccctcactataatgaaccatccttgctcaacttctcatctctgcaaactctccatctttccttcactagttattcccctgccatttcttttgtccccaagtggatattcaaattgaagaaacttgtttctcttcaattatggggtaatgaaatccaaggtccgattcctggcggtattcgaaacctcacacttcttcaaaatctttacttgtctggaaattcattctcatcttctatacctgattgcttatatggtcttcatcgtctcaagttcctcaacctaggggacaaccacttgcatgggactatttctgatgccctgggaaatttgacttctcttgttgaacttgatttatcaggtaatcaacttgaaggaaacattccaacttctttgggtaatctctgcaacttaagggacattgatttctcaaatctcaaactcaaccaacaggttaatgaacttttagaaattcttgctccttgtatttcccatggactcacaagacttgcagttcagagttcacgactttcaggccatctgacagattatattggggcatttaaaaatattgagcggctagatttttccaacaactcaattggtggtgctcttcctagatcatttggaaaacattcatcattaagatatcttgatctgtctactaataaattcagtggaaatccatttgaaagtcttggatcactctctaaattgtcatctctttatattggtggcaatctttttcaaactgttgtcaaggaagatgatcttgcaaatcttacaagcttgatggagattcatgcatcagggaacaatttcactttaaaagtaggtcccaattggcttcctaattttcagcttttccatttggatgtgagatcatggcagttaggtcccagctttccatcgtggattaagtcacaaaacaaacttgaatatttagacatgtctaacgcagggattattgattctattcccacacagatgtgggaagcacttcctcaggttttgtatttaaacctctctcataatcacatccatggtgagagtgggactacattaaagaatccaatatctatccccgttattgatctaagctcaaatcacttgtgtggtaaattaccctatctttcaagtgatgtgtctcagttagatctttcaagcaattcattctctgaatccatgaatgactttttatgcaatgatcaggacgagccaatgcaattacaatttctgaatcttgcatcaaataatttgtcaggagagatacctgattgctggatgaattggacatttcttgggaatgtaaatttacaaagcaaccattttgttgggaacttaccccaatccatgggttccttggcagagctgcagtctttacaaattcgtaacaacacattctcaggaatatttccatccagtttgaagaagaataaccaattgatatccttggaccttggggaaaataatctttcaggatgtattccaacatgggttggagaaaagctcttaaaagtgaaaatccttcgccttcgatcaaacagttttgccggccacattccaaatgaaatatgtcagatgagtcatcttcaggttttagaccttgcagaaaacaatctgtctggcaatataccgagctgtttttgtaacttgagtgccatgacactaaagaaccaaagtacatatcctcgtatctattctgaagaacaatatgctggtagctcttactctttcaactatggaatagttagtgtgctactatggctgaaaggaagaggagatgagtacaaaaactttctgggtttggtaacagacattgacctgtcaagtaacaagttattagggaaaataccaagagaaatcacatatctaaatggattgaattttttaaacttgtcccataaccaattgattggtcatattccacaaggtattggtaatatgagatcgatacaaaccattgatttttcgaggaatcaactttctggtgaaatccctccaaccatttcaaatttgagctttctcagcatgctagacttgtcttataatcatttgaagggaaatattccaacaggaactcaattgcaaacatttgatgcctccagctttatcggcaacaatctatgtggtccaccactgcccataaactgcagttccaatgggaaaactcatagttatgaaggaagtgatgggcatggagtgaattggttttttgttagtgcgacaattggatttgttgtgggattctggatagtgattgctcctttactgatttgtagatcatggagggcagagattaatataaagccatggcatattttgttgggagggttgaaagaaggcactacgaggataccatggctgaacagagagccttatgcttactggaaaggtaatccagctgttgctgaaaccagacaagacctcattaaatgcaatgtttctgaaaatcaagattggaatgctcgtttatttgcccaggttctgcttggtcagtcagtcaaaaatacattctgtcatgtgactctaccactctacgtgtacggctacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgaccctccaactttgtatgcaacattagagagaaaggaaagctcaattcaacaagttgaatcatgggagagaagttattgggataatcaaaccataacatcttaa

SEQ ID NO: 17226 - DNA, 231 bp, Glycine max
  Peptide Sequence Number=SeqID_134004
atgaaagctggctacactggttttcaatgggaagagtctgagaaactacttagtattgagggaatggagcaatggcagattcatctgagagctctacatcatcaaaagttttttatttctaaatcacaagttagacaagatcatatcgatgcaagtgaacagtgtgagctaggtttgtatgatggctatgataatgaggaattaagtttggtcactagctactactactag

SEQ ID NO: 17227 - DNA, 426 bp, Glycine max
  Peptide Sequence Number=SeqID_134005
atggggggtaggattgcatcagtcaccccttcccacaacttccagagggaaagagggccttatggtcgtgacagggaaaggttgttcttccaaaggagccgcgagggcttcaccctctcacagagcctgaagctgccctcgccgatgttgctcaagtccgtcaacctttcaaaggaggagaacccgttgttggaagcctcttggggcaacttctccaatgaggaatcaccgatgggaactacttcccgctccaccaaggattcttggatggaacccccagaatcgcttccgcctaaaccccgggggaagaaaccaaatgattctagagagctacagcctagagtcgcaatgattgcagaagtcgtaacaagaaattgtagagataagggtaaggagtgctcaagcttgaagatgacaaaaacctaa

SEQ ID NO: 17228 - DNA, 540 bp, Glycine max
  Peptide Sequence Number=SeqID_134006
atggccgagcccagcaacgatcgtatcgaggctgccttagcccggcttacttcacgcattgaggaccttctgcaacatgttacaccctctgcttctccttcctttccacctcgtagtccgatacctgcacattcacaccgaatgaagttagatgtacccagatttgatggtactgatcctcttgggtggatttttaaaatcacccagttcttcgagtaccacggtaccccggatcacaatcgcatcactatagcagcattttatatggagggaagagcccttgcttggtttcaatggatgtcaagcaacggacaattcaccttctggcccgtctttctgcaggctctgcaaaatcgttttgccccatcccaatatgaggacccctcagggtccttgttcaagcttacacagaggacaacagtcacggagtacttatctgaatttgaggaattggccaacagggtggtcggactcccagctccattcctgcttagctgtttcgtatctggactcgcgccggagattcgccgcgaggtgatg

SEQ ID NO: 17229 - DNA, 399 bp, Glycine max
  Peptide Sequence Number=SeqID_134007
atgttcccggtcgaatctctaaaggctcatcaaacccaaggtccacccttggtgaatctcaccaaagccagctcgccaaacccaagatctgcacctggtgaatccatcaaaacccaagacaaacatgtttctagtcgaatctccaaaggctcatcaagcccaaggtccacccttggtgagtctcacaaaacccagggcgaacatgttcttggtcgaatctccaaaggctcatcaaatcccaagtccacccttggtgagtcttgccaaaccaagtacgaatgtgttcctagtcaaatcttcaaaggctcatcaaacccaaggtctgtccttgataagactctttatgcctatggtctatcctacacgggtattctagaaacccagacacattcttggtaa

SEQ ID NO: 17230 - DNA, 537 bp, Glycine max
  Peptide Sequence Number=SeqID_134008
atgggctcagaaatctatcctaaggttcatgagaaccctaggacattctttagccgctctagcccaatcctcttggagtcttctatccaatatccttggagggaagtttttgttgccctagaagcttgggaaaatccaattggatacaaaaagcttcatgacattctttttgactttgagagctatcttaagagatatgacaataacaacaacgatcttctacctgtggcgagtgcacatgcaggacatagaggaaaaccatcctatcacaagaagcaatacatgtcaacctataggcaatcctcctctacaccaccaaaagttttttgccaatactatgggaaacctagacatatagccaaggatctaaagacaaaggttccttttctcaaaggacggcataaccacagactctatcaaacacatatctccatcaccacaccaccccaaagcacttgtcactacttccaatcatcatcccttttggtcacccctcagatcgcattttcaaatatctcacttccattcatcaaataa

SEQ ID NO: 17231 - DNA, 3351 bp, Glycine max
  Peptide Sequence Number=SeqID_134009
atgaattcctcctccatttatattcttgtctttgtccagctttggttgttgagcttaccatgcagagagagtgtgtgcatcccaagtgagcgtgagacacttttcaagtttaagaataatctgaatgatccttcaaataggctttggtcttggaatcataatcataccaactgttgccactggtatggagtcctctgccacagcgtcacttcccacgttcttcagcttcacctcaactcttcacattctcctttcaatgacgaccacgattgggaatcttatcggagatggagctttggtggagagataagtccttgtttggctgatttaaaacatttgaattacttggacttgagcggcaatatattttttggagctggtatgtcaattccttctttccttgggacaatgacttccttgactcacctcgacctcgctcttactggattcatggggaagattcctcctcagatcgggaatctctctaagcttcgatatcttgacttgagcttcaatgatttacttggagaaggtatggcaatttcttctttcctttgtgcaatgagctccttgactcacctagacctctctgatactggaatccacgggaagattcctcctcagattgggaatctctcaaatttggtgtatcttgacctgagttatgttgttgccaacggaacagtaccctctcagatcgggaatctctctaagcttcgatatcttgacttgagcggcaatgaattccttggagaaggtatgtcaattccttctttcctttgtgcaatgacctccttgactcacctcgacctctctggtaatggattcatggggaagattccatctcagattgggaatctctccaatttggtctatcttggccttggaggtcattctgttgtcgaacctctgtttgctgaaaatgtagaatgggtatcaagtatgtggaagcttgaatatcttcatttgagtaatgcaaacctatccaaagcatttcattggctacacactctccaatctcttccttctttgacccacctatatttgtcacactgcaaactccctcactataatgaaccatccttgctcaacttctcatctctgcaaactctccatctttcctacactagttattcccctgccatttcttttgtccccaagtggatattcaaattgaagaaacttgtttctcttcaattatcaggtaatgaaatcaacggtccgattcctggtggtattcgaaacctcacacttcttcaaaatcttgacttgtctttcaattcattctcatcttctatacctgattgcttatacggtcttcatcgtctcaagttcctgaacctaatgggcaacaacttgcatgggactatttctgatgccctgggaaatttgacttctcttgttgaacttgatttatcaggtaatcaacttgaaggaaccattccaacttctttgggaaatttgacttctcttgttgaacttcttttgtcatacaatcaacttgaaggaaccattccaacttctttgggaaatttgacttctcttgttgaacttgttttgtcatataatcaacttgaaggaacaattccgacttttttgggaaatctccgcaactcaagggagacagatttaacatatctcgatctctctatgaataaattcagtggaaatccatttgaaagtcttggatcactctctaaattgtcacttcttcatattgatggcaataattttcaaggagttgtcaacgaagatgatcttgcaaatcttacaagcttggaggagttcggtgcatcaggaaacaatttcactttaaaagtgggtcccaattggattcctaattttcaacttacctatttggatgtgacatcatggcagataggtcccaactttccatcgtggattcagtcacaaaacaaacttcaatatgttggactgtctaacacggggattttagattctattcccacttggttctggaaagcacactctcaggttttgtatttaaacctctctcataatcatatccatggtgagctggtgactacaataaaaaatccaatatctatccaaactgttgatctaagcacaaatcacttatgtggtaaattaccctatctttcaaatgatgtgtatgagttagacctttcaaccaattcattctctgaatccatgcaagattttttatgtaacaatcaggacaagccaatgcaattagaatttctcaatcttgcatcaaataatctgtcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactagccaattgatatccttggatcttggagaaaataatctttcaggatgtattccaacatgggtgggagaaaagctctcaaatatgaaaatcctccgccttcgatcaaacagtttttccggtcacattccaaatgaaatatgtcagatgagtcatcttcaggttttagaccttgcaaaaaacaatttgtctggcaatataccgagctgtttcaataacttgagtgccatgacactagtgaaccgaagtacagatcccagaatctattcttcagcaccgaattatgcaaaatactcctccaattatgatatagttagtgtgctactatggctgaaaggaagaggagatgagtacaaaaacattctgggtttggtaacaagcattgatctgtcaagtaacaaattattaggagaaatacctagagaaatcacagatataaatggattgaactttttgaacttgtcccacaaccaattgattggtcctattccagaaggtattggtaatatgggatcgttacagtccattgatttttcgaggaatcaactttctggtgaaatccctccaaccattgcaaatttgagctttctgagcatgctagacttgtcttacaatcatttgaagggaaatattccaacaggaactcaattgcaaacctttgatgcctccagctttattggcaacaatctatgtggtccaccactgcccataaactgcagctccaatgggaaaactcatagttatgaaggaagtgatgggcatggagtgaattggttttttgtcagtatggcaattggatttattgtgggattctggatagtgattgctcctttacttatttgtagatcatggaggtatgcctattttcatttccttgatcaagtctggttcaaacttcaatctttttgctcatctagtatcagtgtttag

SEQ ID NO: 17232 - DNA, 1368 bp, Glycine max
  Peptide Sequence Number=SeqID_134010
atggggtctgagttttcttgcatgatcaaagaggctaaggtcttggggatggctcttggcatttcttgtttaaatgggattgaagaagctgaagctcagtgtgctttgttgaattttgaatcattatgcgatgggtgtttcagttcagattcagacatattcctttttggtgcaaggacagtatatagggatatctgccttggagatggtggatatgttgtttgttatgagatgacagatattgaaagaaaacttggatttggaagggactcattgattgctctctccttgcttcttggcagtgactattatcaaggagttcatggtctgggtccagagtcggcttgtcagatagtcaaatcaattggagacaaatatattcttaagaaatttgcttctgaaggacttggatgggtcaaaaaaagaaaaggaggtaagaatgatttacggccggatgataacattttacaagtaattaatgcttatatgaagccaaaatgtcaccaagcagattcagatattgtgcacaaggctcttgctcaatatccatttcaacgtactaaactccagcagatatgtgttggattctttgagtggccttcagagaaaacagatgggtatatccttccaaatatagctgaaagaaatttacgacgatttgccaatttgcgtttaacttcatctgaagttggactgaaccttcctttacatgagatccctgtgaagtgtcctgtgtcagaaatcattaagagccgaagagttcaagggagagaatgctacgaggtttcttgggaaggaatggatggacttgaaacttcaatagtacctgcagatcttatagaaagtgcttgtcgtgagaagattttggagttcgaggaaagaaaagctcaacggaagaaacaaaatattcagaaaagaaaaccaaagaaaaaggaaactaattcatctgtggcagagcttgatctaaaacttcagaatttgttgcttgatattaatttgagagacgaagccaacttcaatgcctctgattcttcaggaaggatatcaagaattacaactgatatggctgaagctgatctgaataccacagacttgttgcccctatcacatgacatagaacacactgggttaattcagaatactagcagtgaggtggtttccagtatagataaaaatgagatcatagatcttctgagcccttccccacctaagaaatccaatttattctcaaaatgtcagcaatcaagtgaccaacatattgaagtgattaatttgagtgattcagaaaatgacatgtccgttgaacgcaagcagaaagcgaaggagctgagattgttcttagctagtattaggaatgaaattcattga

SEQ ID NO: 17233 - DNA, 729 bp, Glycine max
  Peptide Sequence Number=SeqID_134011
atggaggagccgaactccgattgctggctgccaccaggttggactgtggaagtgagggtgagaaagaatggtaagagagacaaggtgtcagagaatttcaaaggagggtttggactttggagaagtttttttaactctgggaagaatgaaactagacactgtgaaatggaaagaggccacagcaggtcaagtgagagtgagagtcatctttctgctttccctcctattatatattacttccccccctcaagtggactaaaattcaattccaaggtggaggttatagttgagaaagctattgcggaagggttaccaccaggatgggtgaaaaagaccagaatcacaacaaatggagattcagttagaagagatacgttctatattgaccctgtaaatggttatacattctgctcaataaaagatgttgattgctatcttgaatctggagagataggaagctacgaattcaagtcaaaagacaatgatggcactgatatggagttaaaagctgacaaatctccttcaacaagtgtaaccgtgaaaccaacattatcaattagcatgggtcaaagctcagacatggacatgatagctaatgaccaacagattccaagatctgcaagttctgaagaatatatgtctgtgcccatctctgaatgtgtcgtgggcgccaaactgaccagttcagttctatcactggctaaaagttcagataaaaaacaagggaag

SEQ ID NO: 17234 - DNA, 285 bp, Glycine max
  Peptide Sequence Number=SeqID_134012
atggcgcccaaacacaaacccaaatcagtctactttgaaccgagttctgtagtggaagtcagaatcaacgatgatggattccgtggctcaggcttttccggcactatcttccgctttgtcgccgcaaaaatcttcaacagctccggccactgcctctgctggaaagccgttagggtttctcttgcttgtgcctggactgtgaggaccatgttcaggtttagggatatggaagttatcggtgagggcaaaagaaacggaggaagagatggtggtgaaaatgaatag

SEQ ID NO: 17235 - DNA, 590 bp, Glycine max
  Peptide Sequence Number=SeqID_134013
ctgtgtctcctgcaaaaccacctcaaaagctggatccggaggtcgatgatctactttatctgatgacattgaccatcccagagcttttcttgaggccttaccaggttacatgggatgccaccgtgtttggggtctttaatccaaacttcctgctctacataaagcacgaagacctctctgaaatcgcactcggtggtcagtgtctcagcatatcagtgttacagttgtggattttgcatttgactgaaacaagtatgcgagcggggaattccgatatctatggattcctcgagccacagtccattcagaggtctgggcactcgcagtttgagactgaaagttacataaagagttggaaaaaaagttcaaaacgcgatgtctaccttagagcctatctaaataggtcagacaactaccttaaggggataattaacagacaaaaaggaagtactaagtgcggctattatgtcatgcactggatgttcaccatcattttaggaagttttaggaataactgggaagcgaccattacagccagagagattaaaggcactgcggatccagtgggcacagtattatctctgagttag

SEQ ID NO: 17236 - DNA, 117 bp, Glycine max
  Peptide Sequence Number=SeqID_134014
atggtgaaaacaccattggggcatttcaccgagcacttggtgggcgcactttggggtaccaacaacaagggaatgggagcaatgtggcttaccccatcattgcagaacacaacctag

SEQ ID NO: 17237 - DNA, 213 bp, Glycine max
  Peptide Sequence Number=SeqID_134015
atggtatcagagcaggttctgcccggtggtgtggatagtgccgctagccttcgcttttttatgtcgagccctgactcgaggtgcttgtggaagaagacgcttgctttgatggacctggcgggaagccagatccaggcgggaataactatctgtgaagagagaaggggatttcggactatcgtgcaagttatagattcaacggctgagatgtaa

SEQ ID NO: 17238 - DNA, 1560 bp, Glycine max
  Peptide Sequence Number=SeqID_134016
atggctgccactgcttccaactctctcctttgcaccaaaacgctagtcccaaccctcccttcttcctccaacaacctcaacaacagcaacctatgctcctcctttcccaggcccaggcccaggcccatccaggccctgaacaactccgtgactgtaataaccgacaagaagtgcgaggcaaagtgggtggtggacagctggaagtccaaaaaggctcttcaactcccggaatacccggagcaagagaagctccagtcggtgctcaagagcctggaagccttccctccgattgtgtttgccggagaggcccgcaacctcgaggagcgcctcgcccaggcttccatgggaaacgcgttcctcctccagggcggagactgcgctgagagcttcaaggagtttcatgcaaataacattcgtgacaccttcagactcctcctccaaatgagtgtcgtcaccatgttcggagcccaagtgcctgtcattaaggtgggaagaatggcgggtcaatttgcgaaaccgagatcggaagcgtttgaggagaaagacggggtgaaactcccaagttacagaggagataatgtgaatggagatgctttcgaggagaaaacgagaattcctgatcctgaaagaatgatcagatcatacagccaatctgctgcgactctcaatcttctgagagcatttgcgacgggaggatatgctgctatgcaaagggttagccaatggaatttggacttcacgcaacacagcgagcaaggagacaggtacctagagcttgctcgccgaattgatgagacccttgggttcatggctgctgctggcctcacaatggatcatcctataatgaaaacaaccgagttttggacttcacatgaatgtttgttattgccctatgaacaatcactcactaggttggattcaacttctggtctctactatgactgctccgcccatatgctttgggttggtgaacggactagacagctcgatggtgctcatgttgaatttctaagagggattgctaatccccttggaattaaggtaagtgataagatcgatccaaaggagcttattagactaatagagatcttgaatccccagaacaagccagggagaataactgtgataacgaggatgggagctgaaaatacgagggcgaaacttccacatctgatcaggggagtacgcaatgcgggactaattgtatgttgggtcagtgatcctatgcatggaaacaccataaaagctccctgtggactcaaaactcgccccttccattccatcatgatctctaaggaggaggtgaaatcattcttcgacgtgcatgaacaagaaggaagccacccaggtggggttcatctagagatgacaggtcagaatgtgactgagtgcattggtgggtcaaagatggtcacctttgatgatctcagctcacgctacaacactcactgtgaccccaggcttaatgcttcacagtctcttgagcttgctttcatcatttctgaacgcctcaaaaagaataggatcgggtcaaatctgaacaatgttttttctctatag

SEQ ID NO: 17239 - DNA, 435 bp, Glycine max
  Peptide Sequence Number=SeqID_134017
gagaaggtgaaaatgactgctagtcagaggcagatgctggaagatgaacaggaaaaggtatcggctctgcagattgaaagggaagcgagagaaggggcagtggctgacatatactatgctcctgatgaagttcacggtcttttcgattactacccacacatggctagaaccatgagcgagatagaggaagttcaagaacagatgaaggctgacatggaggccagcaaagaccaaatgaccactatgatagaggccatgatgagtatgaggaaaatgatggaagttaacgtggctccagtcgctaccacaagtgccacagcagaggaggacccgactcactcatctagtatcaatcaagtaaatcgtctagtcccggatatggtaggtcagggaggtgaagcattgggaagtacgggtggcccccattttgtgcag

SEQ ID NO: 17240 - DNA, 202 bp, Glycine max
  Peptide Sequence Number=SeqID_134018
aaatgtaagggggtacttcaccgaatggagcgataggtcaagtatgggacgttcagtaaacaatcccttagctcaagtcctcggagatacccaactgggagcgcagaaggcggaggcggagacggagccgctttggaagcgtcaacgcaagaaaaagataagccaaaaacgtgaagtagagggatcccatcctgacggatga

SEQ ID NO: 17241 - DNA, 207 bp, Glycine max
  Peptide Sequence Number=SeqID_134019
atgactattgcagatagtattaagacaactcttcctgagaccgataatgctaaagagtttatgaggttagtgagagaacgctctcaaccagctgataagtctcttgctcggacatcaatgagtacactgatcaccatgaaatttgatggttcatggattcctcacaattcaaaccataaagctcaaatgagaagttcgtcttcatag

SEQ ID NO: 17242 - DNA, 960 bp, Glycine max
  Peptide Sequence Number=SeqID_134020
atgattattttaaggttggcacttgttgtggcctcccttgtagtactggtccaatcccatgttccaaacatttgggaagccaagcccttccatcagatgttgtctttggttcagccagacccggttgtcctaaactaccacaaaggtccactccttaagggaaacgtcaccgttcacatccactggtacggtaacttcacccccactcaccgttccatcatcgttgatttcatccaatccctcggttccattcctcattctcgtcaccacccatcaccttttttgtggtggcgaatcaccgccaggtacagaggaggcccctgcaccctcaccgtagggaatcaaaccctcgacaacacctactcactcggtaaatcacttaaaacaagcgacctcctcgcactcgcttccaaaaattcactaacaacaacaacaattcccatatcgactcacaatgaatctatgcacgttctgctaacctctgctgacgtggctgtggatggattctgcatgagtcgatgtgggacccacgggtcgggtagggttcaaaagaagaggtttgcgtttgcgtgggtgggtaacccggccacgcagtgccccggggagtgcgcgtggccgttccaccagcaggtgtacggccctcagactccgccgctcgttccgccgaacggcgatgtcggcgtggacggaatggtgataagtttggccaccgttctcgccggcgcggtaacgaacccgttcgggaacgggtactaccaagggtcggcgacggcgccgttggaggcggtgtcggcgtgtgccgggatattcggaaaaggtgcgtatccgggctacacgggtaacgttttggtggataacgtaacgggagctagctacaacgcgttggatgtgcacggtcgcaagtttctcttaccggcgatgtgggaccccgtcacatctacatgcaaaacgctcgtttga

SEQ ID NO: 17243 - DNA, 1020 bp, Glycine max
  Peptide Sequence Number=SeqID_134021
atggaggaagcatgtgaatttcgaagttgggctgaattgattcctgatgcgctcggggtaatcttcaccaatctttctcttcaggagagggtaacagtgatccccagggtgtgcaaatcatgggctaatgcagtaactggaccttactgctggcaagagatagacatcaaggattggagcaaccgatgccagcccgaccaactcgatcggctacttgagatgcttatcacaagaagttgtggaaccctccgcaaactcagtgtttctggcctccaaactgagagcatcttcactttcattgctgaaaactggatcctattagccatcttttcttatacaaaatccttctactcttttgcaagtgcctgttccctccatacattgcgactgccaaggagcagtatgaatgattccattgtggaacagattgctgggaggctttctatgatttctttcttggatgtgagctactgtattaaaattggtccctatgcgcttgagatgattggcaagaactgcaagcttctagaagggttgtgtcgaaacatgcacccattggatactgcggagaagccgcatcaagacgatgaagcatatgcaattgcctccacaatgcctaagctcaagcatcttgaaatggcttatcatcttatcagcacttcgggtgtccttcaaatacttgcaaactgccctaagcttgaatttttggatcaaagggggtgttggggtgtgacacttgaccacatgtttttaaagcagaaatttccaaaactgaaggttttggggcctttggttcttgacacttatgagagtgatggctgggatgatttctcagatgtgtctgattcatcagagtacttggcctgggactttgtggctggtggcatgggagaatactatgttgatgatagtgatagttacgatggaatgtgggatgatgaagcgaggctagatgagcttcagttcgggttttatgaagggatagaagatgcaggaatgtattggcctccatctccataa

SEQ ID NO: 17244 - DNA, 348 bp, Glycine max
  Peptide Sequence Number=SeqID_134022
atggctcgctgggaaggcttgaagttaccgtaccagatgagattgacggagattttgccactgagaagagggcctttgtggtattggaactgcaattgttgttgttggtccttttcactcagaattcttgctgctgcgcccaaatggagcgcggaaattatgagaaagaggtgtaaaagaacacttgaggatacaagagaggccattgatgatttgtgtagggaagggaattggaaaattgagaaggaaagtgtaaggaaagagccctatatagtaggaagtcaaatgaaggtagagagtcaagcgtggagtgaaagatgccagcttgaaaacgcgttgctcttctag

SEQ ID NO: 17245 - DNA, 324 bp, Glycine max
  Peptide Sequence Number=SeqID_134023
atgccagctcgacgaggttcttgctggttagtgacttccccagcgagaaaccctcgtcgagaaactgatcgcccagtgatagagaaagagaagaagcagccttcttgttcttgggactcaggtggtagtacttctccgtggttttccaccacgtggcaacagatggctggctgctctgagacgatggggatgacagaaaagggaagagagggagtatatataggtcccatggaagggatgaaggaaaggaagagagtgaaagacacgcgcgggaggcgtgagagggatgggattgaaaaagagagaagggatttgtggaaataa

SEQ ID NO: 17246 - DNA, 228 bp, Glycine max
  Peptide Sequence Number=SeqID_134024
atgtctctgtctgcaaaacttggatcagaccaagctctttcaaaaggtgaatgcatcaccacaagcattgagattgtcttcgcgactatcgggagtttaggccattattatgtatttcttaggctgaatagtgacttgtcatccatgtttacaatgacggaattggagagtatcccgttctggtacttagcggagcgcggtcttgacctcgccgacgcaagagagtga

SEQ ID NO: 17247 - DNA, 483 bp, Glycine max
  Peptide Sequence Number=SeqID_134025
atgagtgagacagcgagtcttcatgcaccaactaggacacccatttcttctttggatgcaatggctcatcaccacccgcattatcggtcacccttcggagacacaacgttcactaagttgttcgttggaggactagcctgggagactcctaccgaagaaatgcgcaaatatttcgagcagttcggagatattcttgaagctgtcatcatcactgacaagaacaccggaaaatccaaaggctatggattcgtaacattctgtggacaagaatcagctagaagggcatgtgctgatccaaatccaataatagatggaagaagagctaattgtaatattgcttctcttggaaggactagaccatcaccacctagtgggaggaatacagttcaaggtggagtaggaacagcacagggtgttccaggagcgggaccggcgccgtcactaccgccgccaccacctgttctgtatccaccatatgggtga

SEQ ID NO: 17248 - DNA, 420 bp, Glycine max
  Peptide Sequence Number=SeqID_134026
atgaaaaagtgtagagatgcagacttttcaagttgctatacaacctacactcctgattatgggtaccaccaagccacgatgtacaacccacagattcagcaaccacaatactatcaacaactttatgaagcatcatcttctaccatgggcaccccatattactatggttattctgtgcaagcaccaagaaacacattttcttctccccaagcaaatcgtctatcacctggaccgtcctatctatactaccctacaccaatagaagtctcattctctggatatcgtcctccccaacaatcaccaatgaggcaaacctttccttcccctaaagattcacagagtcagccgcgtacctcctctgaaacaacagccagggtagctataacttcagaaagatcaaatagccaagggaagaactaa

SEQ ID NO: 17249 - DNA, 933 bp, Glycine max
  Peptide Sequence Number=SeqID_134027
atgacaaatggatatttggagactgccatcgattggttacctggcatcaaagaaattttgttgagagatttcccaagcttcttcagaaccatagacccacatgatattatgctgcaagttttgcaggaagagtgtgggagagctaagcatgcttctgcaatcattttgaacacatttgaggctttagagcatgatgttttggaggcactatcgtccatgttgcctcctgtgtaccccattggtcccttaactttactcttgaatcatgtcacggatgaggacttgaaaacaattgggtcgaacctttggaaggaagatagagagtgtctaaaatggcttgacaccaatgaacccaagtcagtaatttatgtgaactttgggagcatcacagtcatgactaatcatcaattgattgagtttgcttggggacttgctaacagtggcaaaacctttctgtgggtcattaggcctgatcttgtggacgaaaacacgattcttccttacgagtttgtgttggagactaaagatagaggtcaattgtcaggttggtgtccccaagaggaagtgctagcacaccctgcaattggagggttcttgacacacagtggttggaattcaacaattgagagtttgtgcaatggagtgccaatgatatgttggcctttctttgcggagcaaccgactaattgtcgattctgttgcaaggaatggggtgttgggatgcagatagaaggtgatgttacgagggatagagttgagaggcttgtgagggagttgatggaggggcagaaggggaaagagttgaccatgaaagccttggaatggaagaaactggcagaagatgccaccattctcaaagagggctcttcatttcttaattatgataatatggttcgtcaagttcttttgagtgacaacttgaaatcaacttaa

SEQ ID NO: 17250 - DNA, 1056 bp, Glycine max
  Peptide Sequence Number=SeqID_134028
atggcattctctagtgctttgattctgtggtcgttgctagcaatcaacatggccctgccaaccctcgcaaccgtctacaccgtgggagatacttcaggttgggcaattggtactgattatagcacttggactggcgacaagatcttttcagtgggtgatagtctcgcgttcaactatggagctgggcacacagtggatgaagttaaagagagcgattacaagtcgtgcaccgcagggaattctattagcacagacagtagtggtgcgaccacaattgcccttaaaagtgcaggcactcattacttcatatgttctgttcctggacattgttctggcggtatgaaacttgccgtcactgtcaaatcaggaaaagcctctgatgccacacccactacttccactactaccgccactaaatcaaactcgtcttcagcgagtagtgtctcaccaattgttgctatgttcattgtttcctcgatctcttactatgttttgccggccgcggcggcgaatgcaacggcggcgacagatccggaggcggagactctgcggaggtgggcgtggctgctggggccaagagcggtgggggcgtcggcgggtccgtcgctgactacggcggggccggaggcgacgggggagtcggagggagacacgggggcgggaggagagtcggtgggggagttagaaggagaggaagcggtggggccggaggaggaggaggaggaaggggtgggggacggaggagaagaggccggagcggtctttgaaacgggagcaggagcgggtggaggaggggtggaggtggtgggtgggggagcggaggaggtggttggaggagaggctttgggagcggcagcctgtggtggcgacggcgaggctttgggagttgcggcgggggaagctgaaggggattgggcgagagaggaggtagcgagtaacatgaagaaaaagaagaaggatgtattggccattgtgagagagaaagggtggaaagttatgagaaagaagaagaagaatatgaaaagggtaaacggtgaaggggtggtatatatatga

SEQ ID NO: 17251 - DNA, 948 bp, Glycine max
  Peptide Sequence Number=SeqID_134029
gattatttgtactccttagttggagcaacacccaactacggtaatttccaagcagcggaagaagagaaagtcctcctaggaatcatcaacaacaacatagaacacaacctttatgcaaattgggattcatcttctacctcaatgttgcaaaatgtcaaggaacaacaatgggattctcactcctcccctgaagcatgcaccgttgaacaatccgtgacaaccccttcttttcctcctcctcctcctccttcttcctccgtggaagccaccgtgaccaccacgagccgccgtaaacgacgccgcaccaagagcgccaagaacaaggaggaaatcgagaaccagaggatgacgcacattgctgttgaacgcaatcgccgaaaacagatgaatgagtacttggccgtgctccgatccttgatgccttcctcttatgttcaaaggggtgaccaagcctctattattggaggggccataaactttgtgaaggagttggagcagcttttgcagtcgatggagggccaaaagagaacgaaccaagggaaagagaatgttgttgggttaaatgggacgtcgagaacaacaacaacaacaccctttgctgagttcttcgcgtttcctcaatacacgacacgtggtacgacgatggcacagaacaaccaggagcagaaacagtgggccgtagcagacattgaagtgaccatggtggataaccatgccaatctaaaggtactatcaaagaaacaacctgggcagattatgaagatcgttgttgggcttcaaagtctcaagctcagcattctccaccttaatgtttccactcttgatgatatggtcctttactcagttagcgtcaaggtagaggacgggtgtctgctgaacacggtggatgaaattgcggctgcagtgaatcaactattacgcacaatccaagaagttactttcagctga

SEQ ID NO: 17252 - DNA, 1161 bp, Glycine max
  Peptide Sequence Number=SeqID_134030
atggaaatcatacatctctttggttttttaggaacaataaaggcattgacaaatagccagcttgaggatattggttgccaaataatacttggaaatacatatcacttggcccttcgacctacttctgagcttcttgatgaagttggtggtcttcataattttatgaattggaaacgggctctgcttacagactctggtggctttcaaatggtttcactgttgcatcttgctgatatcacagaaaaaggtgtgacatttcagtcaccagtagatggaaaaccaatgcttctaacacctgaggaatcgattcaaatccaaaaccgaattggagcagatatcattatggctctcgatgatgttgtaaagaccaccattactggtccacgaatagaggaagccatgtatcgaactcttagatggatagacagatgtatagcagctcacaagagacctcatgatcagaacttgtttggtatcgtgcaaggtggtttagatcccatattgagggatatctgtgtcaaaggtttggtggagcgcaatttgcctggctatgctattggtggtctttcaggcggtgaagataaaaattcattttggcgagttgttgctcagtgcactgctgctttgccagaggacaaaccacgatatgttatgggagttggttatccacttgatattgttgtttgtagtgctttgggtgctgatatgtatgattgtgtgtatcctacccgcacagcacgctttggcactgctcttgttcctgagggagtattgaaactaaaacacaaagcaatggctgatgacacccgtccaattgatcctacttgcccttgtatggtttgcaagacctacagcagggcttacatccattgccttgtgacaaaagatgcaatggggtctcaacttttgtcatatcataatttatactacatgttgcagctcagtaggaatctacactcttcaatagttgaaggaaggtttccagaatttgtatgcgactttctacgcaaaatgttcccgaaaggtgatgttcctgaatgggtctgcgatgctatggaggtggctggaatcgacatttcttcctgctgtgctcagttttcatcatgccaagaacatgattccaaaagtatgcccgaagaagaagttagtttagtgaggtaa

SEQ ID NO: 17253 - DNA, 1617 bp, Glycine max
  Peptide Sequence Number=SeqID_134031
atggatcgtgccaagcatagggcaactactgcttatggtggtcgtgctcaagaaggtgttctcgaggaagaatcctccaaggtgatagagagcagaccatcatggaaagcttttccaggccagtcatttccattgggggtatcagaagttgacagtggcatcaattttgctattttttcacaaaatgcaactgctgtcacactttgtttagtccttcctgagaggggaagcattgacgcattggatggtggcatgatagaaatggttttggatcctgatttgaacaaaactggggacatttggcacatatgtattgaggattggactcttagagtagggagaggtcagggtctcctgaatacccctagtactactgatcttccacgaagcaatgttctgtatggatatcgcatagatggacctcgagactggggtaaggggcatcgatttgatagcagcattgtgcttgtcgatccttatgcgaaactagttgaaggtcgaagatatttcggggatattagcatgaagttgtctaagtttcttggcacatatgattttgacagcttgccttttgactggggagaaaattacaagcttccaaatatttctgagaaagatcttgttatatatgagatgaatgtccgtgcatttacaagtgatgaatctagtggtttggatagcaacattcgtggcagctacctcggtatgattgaaaagattccacaccttctagagcttggtatcaatgcagtagagttgctgcctgtctttgagtttgatgagttagaattccagaggcgtccaaatcccagagatcacatgattaatacatggggttattcgacaataaatttctttgctcctatgagtcgctatgctagtgctggtggaggatcagttaatgcttcccgagagttcaagcaaatggttaaatccttacattctgctggtatagaggttattttggatgttgtctacaatcatactaatgaggctgatgatgcctttccttacactacttcatttcgtggcatagataataaggggagctttgcaactcgtgtagctgggtcttctgatctttacagtgtgaacaatcgtaggccatatcatggtattaactttgttattgcacatgacggattcaccttgcgtgatcttgtttcatacaatttcaagcacaatgaagccaatggggaaggtggaaatgacggaagcaatgataattttagttggaattgtggtttggaaggggaaactgatgatgctagtgtaagagctttgcgatcacggcaaatgaaaaacttccatttggcattaatgatatctcagaacgacataacatggcatgaagacaattgggacaatcatgacagcaaatttcttgcattcacgcttcatgacaagagcgggggagatatctatttggcatttaatgctcacgattactttgtcaaagttctgctgccggcacctccaaaaaagagaaactggtttcgtgtggtggacactaatctcaaatcaccggatgactttgtccttgatggtgtccctaacgtaggaaacacgtacaatatagctccatactcctccattcttcttgaggcgaagttttga

SEQ ID NO: 17254 - DNA, 783 bp, Glycine max
  Peptide Sequence Number=SeqID_134032
atgtcgatgatttataaaactgtagagtggcatttctgggaattcacgaaattcgaccgttggttgcacaaattcaaaaaaaacataccgttatatacaactattcctctctcagaccctgaatccaacccttctcgctctctctctctctctgcaacgctccgaatggccaacaacaccgaagaacaacaacacaactcaattcgatcatcgatcatggagtggaagcagatgcacccactccaccaaatcgcggaaacccccacccacaagctcctcctgaagcagtggctcaaagaagaagaactcatcaacaaccgcatagcgttaaaagagacccaaatagattcaacccgcaaagagatcaccacactctacatcttcttcttcctcttccactccacaaccctcatgctcctcttcaactcctcatcatcttcatcttgtcatagatcatgggtcccatcactctgctctctgttgttctcgctgggcctcatatgggccttgcggtacaagagcgacgtggaggcccacgtggagaagatgctgcagcgggagaaggaggacaaagggttgctggggaggtgcgtggaggagttgaagaagaaagggttggaatttgatttgttgaaggaggttgatgcattgaggagggccaagagtttgagggtggagaacaaagaggttcggaaatggtcctccagggaccttgtttctttgttcttcttctctatggcttgcttctctcttgctctcacacgagtcatcttgtgcacttag

SEQ ID NO: 17255 - DNA, 1518 bp, Glycine max
  Peptide Sequence Number=SeqID_134033
atggatctccctcgagacgttgacgactacatcaaacaaaccctcgacgatacattaggtattcccgtatcgtcgaaaaccctagaatccaaacttcgagcttcccaagactcgcaatggcgcctccgcgaacgcctcctttcccttctcccccaattgaaacagaaagaccaactcatcgatcgcctcaagcagtctgaagcgggaatgaacgcgcgagctctgaagaagttcgttgaggagaatcagagactggcgacggagtgtgagagattgttggctcgctgccatcagttggagaatgagtgcgcgctgtatgataaggacagagaagcgttgatggagtttgggaacgatgccgatgaacgggcacgcgaggctcaaacccgagttcttgatttggaacgggatttgctcttcatggggaatgaattgaacaaatataagcatcagcatcaattggtcaattcttctgtgtgcacacctggggaaaagaatttacttgattctgttttggcaacgccaacacttactagtaaagatgatgattctacatatgcatttttgcaagtaaacagtgagaatgaggcctgtaaacagttgctgagtatgtggaactgcataaacccatcaactcggagtgttttgtcacttgttgccaaagtcaagtcacttgagaaggataaggagcatctaagaactaaccttcacaaagccgaggaggagtcaaacaagagaaagtctagtcccagaacaagtagcccaatgcagaggaagattgattttgacgatcaagaggagcctcttgtctctgaagaagaattttctcgcaccaggttgctcgctcagaacgtgccctggacaagcacccctgaagacattcgcaccctcttcgaaaaacatgggaaagtcctcgaagtcgagctttctatgtataagaaaaaccgaaaccggggtttggcctttgtcgaaatgggttccccagaagaggcactggaagctctcaataatctcgaatcgtatgagtttgagggtcgtgtaattaaagtcaattatgctcggccaaaaaaggagaaaacagcgccgccccctgtgaaaccaaaggtggtgacgtttaacttgtttgttgctaacttatcctatgaagcaagctccaaagatcttaaggagttttttgatttgggaactggtagagttgtctctgctgaggttgtgtatcgtgataatcctagaaggccgtctggatatggatttgtgtccttcaagtctaagaaagaagctgaggctgctcttgctgagttccaaggaaaggtttttatgggaaggccaatcagggtggatcggggtcggcgttttgttcaacaaccaggggacgggagtgcaaagtctgaagatactccttctgagttgagtgtgaatggggcagaagctccacaaccagcagaggggagtgcaaagtctgaagatactccttctgagttgagtgtgaatggggaagaagctgacaaagctgattga

SEQ ID NO: 17256 - DNA, 219 bp, Glycine max
  Peptide Sequence Number=SeqID_134034
atgcctctgggactcatcttgggaataggaagggcatttcgaaggaagcggccatcttctcttgacattctatcatcaaaacgtgctcctcgtggttattacaagggaaagaattgcaagcctactggtttccacactcgcaaagacaatcaacatgttcggcagcttcaggaagaggctttttctgcgttaatggtgtttactgattacacttgctga

SEQ ID NO: 17257 - DNA, 282 bp, Glycine max
  Peptide Sequence Number=SeqID_134035
atggcatgcccgaaaccagcgatggtcctagatctgaagccttcgtcggaggcaccgccattcctcccgttgacgaattcgctacgctgcccaccacccaccaccatccctaacgtcactccggcgcgatcccaaccaatatccaaccgcgccgctgtggccatcaatcacggatttagatctgggttttctcacaaaggttttgagaatttgttttatggggttgaatggtgttcgaagaagacgaagacgacaaggaaagaaagattcaaaaatttgtga

SEQ ID NO: 17258 - DNA, 435 bp, Glycine max
  Peptide Sequence Number=SeqID_134036
atgcataggcgcaacaagacggttgttccattgggcatgctcagaaggtttctcgccgcgtccatattctcaatagtcgtcacttctttcttctttgttcacgttcacgtttctccttcacccactgatcacaagttcaatgataagatcccctcgtttcgtgacccgcaaagctggactagagaactcgctccgcctcatctatccaaggctccactctctgttcccaagttgaaggattcaagaaaggattcagactacgagaaactgtggaagcctccatcaaatcatgggtttataccctgtacaaagcctactcctaattactcaactcctggaaggtcacgtggttacctttctgttcatacaaatggagggctaaaccaaatgcgtactgggatgttagaaagttcttccattagtttagtttcttga

SEQ ID NO: 17259 - DNA, 1215 bp, Glycine max
  Peptide Sequence Number=SeqID_134037
atatgtgatatggtagctatagctcgtatcataaatgccactcttgtaattccagaacttgataaaaagtcattttggcatgatactagcattttctctgatatctttgatgaagagtggtttattagttctctagctaatgatataaaaatcattaagaagcttcccaaaaaactggttaatgcaaccaaaattgtcatgcaattcagaagctggtctggtatggattactatgagaatgagattgctgccttgtgggataatttcaatgtaattcgagcttccaaatctgattctcggttagcaaataacaacctacctccagagattcagaaacttcgctgccgtgcttgttatgaagctcttcgcttctctccgcacattgaaaaaatgggaaaaatattggtggagagaatgaagtcattcggcccttatattgcattacatttacgttatgagaaggatatgcttgcatttagtgggtgcacacatgaattatctacagctgaggctgaagagctacggattatcagagagaatactacttattggaaaagaaagtatattaaccccatagaagaaaggtccaaaggtttttgccccttaactccaaaggaagttggaatttttcttactgctcttggatacccatcaaagactccaatatatattgctgctggggagatatatgggggtgagtcccatatgactgacctgcaatcccgctatccattgttaatgagcaaggaaaagttagcatccattgaggagcttgaacccttttctagtcatgcgtctcaaatggctgctcttgactatattgtatcggttgaaagtgatgtatttgtacattcttaccctggaaacatggcaaaggctgttgaaggccatcgtcgttttcttgggagtggaagaacaatatctcctgatagagctgttcagcatgatcccatttcttttatcaggaaagcgcttgttcatctgtttgataaactggcaaatggatcaatgactgaggggagaacactttctaataaaatcattgatctccacaaaaaacggcttggcttcttcagaaagagaaaaggacccgtttctggaacaaagggcttggacaggtttcgctcagaagaaacattttatgcaaaccctttacctggttgtttatgtcggacagaatcactcaatataaacgcttctcacttctcagtatag

SEQ ID NO: 17260 - DNA, 447 bp, Glycine max
  Peptide Sequence Number=SeqID_134038
atgtttattttctgccgcccagaagagagtgaacactatcaccaagagcttattaaaattgaagaagacctcttctcatccctgggattgcattttaaattaggtgcagctgcttatcataaattcgatgtggaggcatggatgcctggtttagaacggtttggtgagatctcaagcgcctcaaattgcacagactatcagagccgtcgtttgggaataaggtattgtcctgcatcagaagcacaagccacaagtgcaaaaaaatctaaaggcaatcttgctccaccacagtttgttcacacattaaatgcaacagcctgtgcagtaccacgaatgattatatgtttgcttgagaatcatcaacaagaagatggatctgtccttatccctgagcccttgaggcctttcatgggtggccttagtgtcatcgctataaaatctttatga

SEQ ID NO: 17261 - DNA, 1674 bp, Glycine max
  Peptide Sequence Number=SeqID_134039
atggagtctcagagtcagagagatcgcagggcagatgctcttggagaccttcgagtccttcccgacgaaatcctctgctctattttggaacgtctcactccccgagatgctgctcgcgtctcttgcgttagcagtgtgatgtacatactgtgcaatgaagatccactgtggatgagtctatgcctaaaaggagcatctggtttccttcaatacaaaggctcttggaagaaaactgccctgcataatgagaatctgctagacaaatacaaagagtacagtcaaggacctttacattttgacgatactggaaatgtgaaaagaataaaagacatcccgctgaaggacttttataatgagtatgatgcaaagaaaccggttatgctcactggattggctgatacatggcctgccaggcataaatggacaactgatcagctgttgctaaactatggagatgtagcatttaaaatttctcaaaggagttcccggaagatctccatgaagttaaaggattatgtctcttatatgaaagttcagcatgatgaagatcccttgtatatttttgatgaaaagtttggtgaagctgtacctagcttattgaaggattattgtgtgcctcatctttttcaagaagacttctttgatatcttagatacagaaaaacgaccatcctataggtggctcataattggaccagagagatctggtgcctcttggcatgttgatccagctcttaccagtgcatggaatactcttctttgtggccgtaaaagtggtaatgtttcacttgcatttgatagatgggcattatatcctccaggaaaagtgcctttgggtgtgacagtgcatgtcaatgaagaagatggtgatgtcaatgttgagactccatcatcacttcagtggtggctagacttttatcctcttcttgctgatgaagacaagccaattgagtgtacacaactacctggagaaacaatttatgttccaagtggatggtggcactgtgtgctaaatttggaaacaactattgctgtcacgcagaattttgtgaattccaacaactttgaatatgtatgtttggatatggcacctggttattgtcataaaggagtttgccgtgttgggttacttgctcttgatgaagttagttatgaaaatgtcagacagaatgtgtcatgtaatgaaacggactcaagttactctgctttgtcaaggaaagagaaaagagccaaaactcagaaagatgtagatgatctatattacaaaagagccatggatggtagaccattacagttccctgtggagctcaggcaacagcatgggccagcgagaactaagagaatggttatccaagctctggattcaaaaaccaaaattgagagagctaatatggaagcatgtattgcactaaatgccgacaagtggttagaatgcctatcaaaaatttgtgcctttcataatttgccacttcccactgacgatgaaaggcttccagtcggtacgggtagcaatccttttgggtcactcttggattggcatttggcactcatgaggtgctccacagtgcaccagagaaggtatcttactgaaggtggtggtgaacttttatttattgatgaaaatgatgatggcagtggtgacaacaatgatggtggtggtggtagcagtggttag

SEQ ID NO: 17262 - DNA, 1074 bp, Glycine max
  Peptide Sequence Number=SeqID_134040
atggcggccgctccctcgcctcgcgaagagaacgtctacatggcgaagctcgccgagcaggccgagcgctacgaagagatggtggagttcatggagaaggtctccgccgccgccgacaacgaggaacttaccgtggaggagaggaacctcctctccgtcgcctacaagaacgtgatcggagcgcgccgcgcctcgtggcgcatcatctcctcgatcgagcagaaggaggagagccgcggcaacgaggatcacgtctccgtcatccgcgactaccgatccaagatcgagtccgagctctccaacatctgcgacggtatcctcaagctcctcgactctcgcctcattccatccgcttcctccggcgattccaaggtcttctacctcaagatgaagggagattaccacagataccttgccgagttcaagaccggcgccgagcgtaaggaggctgccgagagcactctctctgcatacaaagccgcacaggacattgcgaatgccgaactgcctcctactcatccaattaggcttggccttgctcttaacttttctgtattttactacgaaatccttaattctccggatcgtgcctgcaaccttgcaaaacaggcttttgatgaagctattgctgaattggatacactgggagaggagtcatacaaggatagcactttgatcatgcaactccttcgtgataacctcacactttggacctctgacatgcaggacgatggagcagatgaaattaaagaagcagcaccgaaaccggatgaccacttgattggaattggaattgggttgtgctcgttgaactattttgaggattgtgcacttcattctgatagtaggtctgctgttcgagatcgctaccctgaggttgttgagatagtcaagaaccaccttgcaaaaattgatgcagcaaatgtttttcacggtatcgatgactatgcgcgaactcacttttcctccgttgccattatctccggtgcaccagtcagcctccaagtcactggaaaaaatcaaagagataaggttgcaaaagatgaggttggggatgatgaactcatggattga

SEQ ID NO: 17263 - DNA, 291 bp, Glycine max
  Peptide Sequence Number=SeqID_134041
atggcagacatatataaggacgatggatggattaagggaaagttggaagctgccaggggttcacaattccctttatgtgggttccctttgtcttcaaaaggtttgtcacctcctcgtaactatcctactccttcaccgcacttgattctgcctccacagctaaattcacagcttgtgagttcacctaattccgatttgaggatgacagctcagcagctttcaagcaaccgacttgtcaacttcagcgtgtttattggagtgaagatgaagataatggtttttattaagtaa

SEQ ID NO: 17264 - DNA, 768 bp, Glycine max
  Peptide Sequence Number=SeqID_134042
atgcctaagctgcatggtatgacattatgttgcagatggcgtccatctccagtggacgtgcattcaaacacacgtgtagagtgtagtagcaagtgtttgggtaggcttggaaggcatcaaacaggggatagccagccacaatccctcataagggaagggaccatgatctacccaattgaagtgtcaataggaattggcaattatcatcagctaggaccggcacagtgggcgaaagcggaagctgcggaaaccctaactgaccagaagttggggaaaacagaagccccggcgacagcagagggtaggacgccagctgcgaattcaaacacccaaacggcacaggcgaagacggcatctgaaacgacgacggcgcttgcgacggaaccatcccttgctgctgctgctgtggctgttgttcttgctgaggctgaggctgaggttgaggttgaggttgaggttgaaccagaggcggcggagataggtgactcagcgggggcgtggacggtggggaacggcggcagaggagataacggcgcggggggtctcgaaaaaacggagaagttgttgttgaaggcaggggaggagggcgaatcctctgaaggcgagagctcgggggcttgggtggctgaatgggaggcggcgttgagatgcggtcgtgcgcaggtgagcccgaggatcaaagacgggtttcttaatgatgggtttggagatcttttgagagagcttgttgagatggcgaagatattgatccctgctattgttgttggg

SEQ ID NO: 17265 - DNA, 240 bp, Glycine max
  Peptide Sequence Number=SeqID_134043
atgggatgttacaccactactgctggccaccaccgccaaggaacctctggaaacccacccgcactaattcctccttctctttcatctcctagatcatccacattagtcattctagaccctaaataccttgaccttgaattctttgatggagaaacatttgattgttatcaagtgtttcaaaattctggtttgattgatttcatgtctctgaaactgtcttactttcctgaattagttaag

SEQ ID NO: 17266 - DNA, 163 bp, Glycine max
  Peptide Sequence Number=SeqID_134044
atgcaggaacagcgccttacagtcagatgcggtgaggattttaggtctgacagggctggaagtgcaggtgctgaacggcgcgctgatactgacagcgaaagagagcagatagcgccgtttatccccgccgtcagcacaccgcagaagcggccatggcgcaacg

SEQ ID NO: 17267 - DNA, 174 bp, Glycine max
  Peptide Sequence Number=SeqID_134045
atgaaagctaagtgcctaagaaacaagtgcaagtatagggaaggaatgaatgaaaaagtgaaggtgaaaaagaggctaagtcatgaaatgccaaaagtgacaattgagcttagctcaacagttgggctaagcgcgcatccaccactaagcgcagcttcaacacgcttagcatga

SEQ ID NO: 17268 - DNA, 234 bp, Glycine max
  Peptide Sequence Number=SeqID_134046
atggatgcaacagaggctgcatacgatgccattgttaatgaggtccttaacaatctcactaaaaatgtagcgaaaaaatccatagtggagaaacttgatgagtcagaaacctcacatgaagctacgtccaaggcacaagtgttaccaaatattgtagtcttctgctccattaactctggtctgactcctctcaaatatgcacctccagttgccttgattgaagatcatgtttag

SEQ ID NO: 17269 - DNA, 168 bp, Glycine max
  Peptide Sequence Number=SeqID_134047
atgaagaggatgacaaagaatatggaggcattaaatcttggtgaaaatcttggtttgtatgagctaaaagtggtagtggctagtacttgtaactttgtgaagctagtggaacttggtgatttgccaagaactggacatagtctaggtagaagagacgaaccggtataa

SEQ ID NO: 17270 - DNA, 483 bp, Glycine max
  Peptide Sequence Number=SeqID_134048
atgtcatggaacttcacagattgtgcaagaatgcttccttttgacttcaggcatgtcacagaacttcacgaattgcctaacgatgggtgccaagtacctcaaagtggtcaaacgagggtcgcatcccaacaaacgaatggtccccagacgaaattaggcgaaacaccatttggccggtcaatctccctgccagcggaacatgcaaaaattttgaaaattgtagaagcaaggctttatggtgaatgtgattcaaaggtgatgaacaaaaagctcaaagatcaaagaacaactcaagtgaatcaagaacaagtcaagagttcaagaatcaagaacaagtcaagagttcaagaatcaagaagaattcaagactcaagaagaaagcctagaatcaagaatcaagattcaagattcaagatctcaagaatcaagatcaagattcaagactcaagattcaataatgaagaaaagactcaatcaagataa

SEQ ID NO: 17271 - DNA, 315 bp, Glycine max
  Peptide Sequence Number=SeqID_134049
atgaactttgttttctgcatttttctggaaaacgtgatgaactcgctaagcgcgcttgctgcgttaagcaagatggcctccaggaaacgtaagagcattggggcaaggccaactgctcaatatgatactagacggttcctttcgcttgatgcttggaaccgttatacagataatgtcttgggaaggagcattttgtcagagaggaaggttgtgatataccacaccgagtttgatgacttcaagacagagttggagaggggtaatcttcacaaacgcctcaccaacctggctgatgggtctattgatcttgctttg

SEQ ID NO: 17272 - DNA, 216 bp, Glycine max
  Peptide Sequence Number=SeqID_134050
acacgatcgcctctggacggcgaaaaggtgtgggggaatgaccataatttgtctccgcccacctctcgactcacgtccctgaatgacaaagggcgcataatgaccataatttgtctctacgcgattattactcgacttgctgctcctgaaggacaaagggcgcaaaatgaccataatttgtctctacgcgtttatcactcgacttgctgctcttga

SEQ ID NO: 17273 - DNA, 234 bp, Glycine max
  Peptide Sequence Number=SeqID_134051
atggggcaaaccatatttcggacaaaaaccggggccaaatcacatctgggacaaaaaactggtggggctcaaaccgtgtctgggacaagtgggcagtggctaaggcaacaaaggccacaggtcagcaataggagagaaatgacgcaaaacgccgaaaatgcaggaggcacaagacccaaaactgatggagggcagattggggacaaggacagtagtgcaaggttgatgttgtag

SEQ ID NO: 17274 - DNA, 1482 bp, Glycine max
  Peptide Sequence Number=SeqID_134052
atgcctgcgatacacctttctttgaaaaaactactgcaatgtgaagttcatattcatattgatgacagagtaaatgtagagatttatcctcttaagattcatttaacagagatgatgtacagaatgatgtgggaatatttcttcccagaagaagaacaagattcccaacgtcgtcaggaggtttggaaggtttcaaccactgctggtgcaaggcgtgtaaagaaaggttcgtcagttcttgaagcttctgcttcaaatagtcactcaacaaaagagtccgaggcctcatccaaatctggcatatctgctatactatttcccacatcaagtcagcctccatcccatgttgacttggctcaagcatccaaaacacaaaatgtcaaagcaaaccctggtaatggtgcaacccttgagttgagaaggacatcatcttttgacagaacttgggaagagactgtggcagaatctgtagctaatgaacttgtgttacaaagcttttcttcctcaaaaaatggccaatttggttctactgagcaacaagatgaagctgctaagaataaatcaaaagattcaaaaggtgtgaaaggtggtcgttcatctcatgaagaaaaaaaggtggctaagtcacatgaagagaagagatctaggccacggaagatgatggagtttcacaacatcaaaattagtcaggttgagttactggttacatatgaagggcaaagatttgttgttaatgatctcaaattactgatggatcaatttcatcgaaccgagtttactggaacttggcgaagactcttctcgcgagttaagaagcacatcatctggggagtcctaaagtctgtaactggaatgcagggtcggaaatttaaagacaaaggtcagagtcagccccctggtgctggtgttcctgaaattgatcttattttaagtgacaatgaaggccaggcaggaaaatctgatcaatatccaccatcttggcctaagcgtccaagtgacggtgcaggtgatggatttgtaacatccattagaggactgttcagtactcaacgtcgcaaggcaaaggcatttgtgctccgaactatgaggggagaagcagagaatgattttcaaggtgattggagtgaaagtgatatggatttctctccttttgctcggcagctcacgattacaagagctaaaaagcttattaggaggcacactaagaagttccgttccagaggacaaaaagcaccaaagagaagccataaacacaatcctatcccaaatctaacaaaattgagaaagacatttggaagtaccggcattctccaaaagtcaagcaccaaacaataccagcccatgcccaaaagccagaccgattggaaagccatttcaaaaccatctgaacagagttcagctagtcagctatccagacagaaggcatgctatggaggtaggtttgaacttccacatgggtttgttgaggaggaactccaatga

SEQ ID NO: 17275 - DNA, 393 bp, Glycine max
  Peptide Sequence Number=SeqID_134053
atggagtttgaatgttcctttttatttgctttgggaacttactgttatttgttgtcggggatgcttcctctgaatcagccaatatcacctgttagagctgaatctgaaatcaagctaggaggtactcagtgcaacatcataatgagcaggttaaagccttggttggtcctccactcgtctaagaagaaaaaaatggtacttcgacaagaagcttctgtggttgcaaggcctcaatcaaccgatggcaagaccatcatgtggacatgcaatgtctcagctcctgagatgacaatagtgcttttcaatatggctggttctccggtgtatcatcttttgaatgtttcccttgcagattttattcgtctgttcaaggatccatttgtagggctgtaa

SEQ ID NO: 17276 - DNA, 4604 bp, Glycine max
  Peptide Sequence Number=SeqID_134054
atggggactacagtacacactgaacttggagagttaaatctccacttggctgacgaatatcaagaatgcttgaaagaaagtgtttttggtgtggaatcaaattgtggctccattatgcatgttgcaaaggttaatttggattggggaaaaaaggatgtggaatcatctgaagaagatggtcctaggtgtagactaggtttatcagttgatgttactggtatgggagtatatttaactttcaagcgtgtagaatcacttgtatcaacggccatatcttttcaagctctattgaaaagcctatctgcttcaaagaaaaaatctactcatagtcaggggagtttaacaaaatcttctgggaaaggaactcagtttttgaaattcaatcttcaaaggtgttcaatacatgtatggggtgagacaggtttggaaaatacaattgttccagatcccaagcgagttaattacggctcacaggggggtagagttatgataaatgtgttggcagatggtaccccacgcaatgcaaatataatgtccactatttccgatgaataccagaagctgaagtactctgtctctcttgaaatatttcaatttagtttgtgtgtgaacaaagagaaacagtccacacagatggaacttgaaagagccagatctgtctatcaggaatatatggaggaaaataggccagtaacaaatgtggcattgtttgatatgcaaaatgctaaatttgtacagcgttcaggtgggcttaaagacattgctgtctgttctcttttcagtgctactgacattactgtaaggtgggagcctgatgtgcatctatcactagttgaacttgttctccagctgaagttacttgtacacaacagcaagcttcaggagcatggtaatgaacacatggtagatgtgtctcatgtgcaagatgctagttggaaaaaagaagttaccactgaatcagggcaccttgaaaagcagaagaagaaagaatctatttttgctgttgatgtagaaatgttaagtatttcggctgggctaggagatggagttgatgctatggttcaggtgcagtcaattttctcagagaatgctcgcataggagtgctccttgaaggtcttatgcttagttttaatggagctagaattttcaagagtagtcggatgcaaatttcacgaattcctagtgtttctgcaagtgcatctgatacaaaaggacatgtagttacaacatgggattgggtagtccaaggtcttgattttcacatttgcatgccatacagattgcaattgcgcgccattgatgatgtcattgaggatatgttgcgaggtttgaagctcataattgcttccaagacaaattcgatttttcctgtgaagaaagagagctctaaagttaagaaacctagtacagtacaatttggatgcataaaattttgcatacgcaagctaactgctgatattgaagaggaaccaatccagggatggcttgatgaacaccatcagctgctgaagaaggaggctgctgagttagctgcacggttgaactttctagatgaatttatatcgaaggcgaagcaaggttccaaatcaactgacactgttagttcttctcaagaaagaaaaatttcttttaataatgttgaggttgatgtaaaagattcttctactactgaatccatgagagaagaaatttataaacgatcatttcgatcatattatcaggcatgccagaatctagtgttgtctgaagggtctggtgcttgtgtagaagattttcaagctggtttcagacctagtactacaaggacatctcttctttcaatatctgcattagatttagatgtaagcttgaaaaaaattgatggcggagattttgggatgattgaggttctgaagaagcttgatcctgtctgtcttgaaaatgatataccattttcccgactgtatgggacaaatattctcttaaatacaggttctcttgtagtccagcttcgggattactcatttcctcttttctctggaagttctggtaaatgtgaaggccgtcttgtattggctcagcagcctcaaatgtatcaagatgtctatgttgggagatggagaaaggttcgcatgcttcgatcagctagtggtactactccaccattgaagacatactcagatttgctgatacatttccagaaaggtgaggtgtcatatggagtgggttatgaaccagcttttgctgatgttagttatgctttcaccgtagcacttcggagggctaatctaagtgttaggaatcctggtccacttattctgccaccaaaaaaggagcggagtttgccatggtgggatgacatgagaaattacatccatggaaaaatttccttacgcttttctgaatcaaaatggaatgttttagcaagtacagatccttatgaaaaggttgacaagcttcaaattgtgaccaactctatggatcttcatcagtctgatggtcgtgtttttgtttctgccaaagattttaagattttgttgagtagtttggagagtttggccaacagatgcggttttataattccaacaggtgtatcaggtgcattcctggaagctcctgtcttcactcttgaagttacaatggactgggattgtgaatctggagatcctatgaatcattatttatttgcacttccagttgagggcaaaccacgtgataaagtatttgatcccttcagatccacttcactttcccttcgatggaacttctctcttagaccctttccttccccatcacaaaaacagtcttcgtcttccattactagacgagatattgaaggagatgctactgcatttgatccttctcacatatcccataatgtttcacctgtgtccccaacatttaactttggagctcatgatctagcatggattctaaaattttggagcttgaactacattcctccgcataagctgcgcagcttctctcgttggccacgttttggtattccaagagttgccaggtcaggcaatctttcactggataaagtgatgactgaatttatgctccgtcttgatgccacaccggcttgtataaagaacatgcctctagatgacaatgatccagccagaggactgacctttgcaatgacaaaacttaaatatgaactgtgttacagtaggggcaagcaaaagtatacttttgaaagtaagcgtgacattcttgatcttgtttaccaaggtcttgatcttcatatgatcaaggctttcctaaataaagaaaaatgtgctagtgttgccaaagtagttaacatgatactgaaaagttcacaatctgtatccatggacaaagtctcctgcgaaaagggttacatgactgagaaaaattgtgatgatggatttctgttatcctctgattacttcaccatcagaagacaatctccgaaggctgatcctgctaggttactagcatggcaagaagcaggaagaagaactattgagatggcatatgtgcggtctgagtatgataatgggagtgaaactgatgaccatatgcggtctgacccaagtgatgacgaaggttacaatgtggtagtagcagatgattgtcaaagtgtgtttgtctatggtctcaagcttttgtggactattggaaacagagatgctgtttgggcttgggttggtggcctatccaaagcctttgaacctcccaagccttctccttcccagcagtatgcacagagaaaattacttgaggaaaacaaacagcgtgatcgagctgatttccatcaagacgatgtttctaagtgccctcccactggtaaaatttccaagtctccttcttttcaacagttaagtactcctggatcagtctcatcttcaccaaattcagttaaagtggacaacttgccatctgtcaaaaaagagaacatggatgattctggtgggactcgacgtttgatggtgaatgttattgagccacagtttaatcttcactcagaggatgcaaatggtagatttttgcttgctgccgtaagcggccgagttttagcccggtcatttcattcaatccttcatgtcggttatgagatgattgagcaagcacttgttactaaagatgtacatattaacgaataccaacctgaaatgacatggaaaagaatggaattctctgttatgttggaggatgtgcaggctcatgttgcacctacagatgttgatccaggagctggattgcagtggcttccaaaaattctcaaaagctctccaaaagtattgcgtacaggtgctcttcttgaaagagtttttatgccttgtgatatgtactttcggtatacaaggcacaaagggggcactccagaactgaaggtgaagcccttgaaggagctcacattcaattctgataatataacggcaacaatgacatcacgccagtttcaggtcatgctggatgtattgaccaatcttttatttgcacgcctgccaaagcctcgaaaaagtagcttatcctttcctgtcgaagatgatgaagatgttgaagaggaagcagatgaggtggttcctgatggtgtcgaagaggtggaactagcaaaaatcaacctcgaaaaaagagagagggaacaaag

SEQ ID NO: 17277 - DNA, 306 bp, Glycine max
  Peptide Sequence Number=SeqID_134055
ggtcgaaagtatgaacttgttgctacaattactcaccatggaatggagccttcaaaggggcactacacagctgatgcccaatatcccaatggtcggtggctacgatttgatgaccaatctgtctttgctattggaacaaataagaaaaaacactactcccctataagaaaggattgctggtcgattaatgtgggtgattatttattagctggtcaagctcaatatctattgttcatggctcagattgttaagaggccttattacaaatcccatgggacaaaaattcagacgttcaaaccggtgtaa

SEQ ID NO: 17278 - DNA, 807 bp, Glycine max
  Peptide Sequence Number=SeqID_134056
atgttgtgctggggaatccctttacatgcatgggatttggaatacattaagcagatcacgtcggctgtaggagaagcggtggaggtggacaatgacgtggaagaactccagagactggatagggcatttgcttctgggttgctggcttggattctgagccggattttgggagcatctgttggatttcgtgttggtggatggaaatgtttaagggatgtggtggtgaagtttaaaaagggtgccattgaatctgtttctgttggtgaaattaaactcagcttacgacagtccctggttaaacttggtgtgggtttcatatctcgggatcccaagctacaagtgttaatatgcgacctagaagttgttatgaggccttcaaataaaagcccagggaagaagaaaactaggaaatctcgtgcttcaggcaggggaaagtggatgattgtgggcaatattgcaagatatttgtcagtttgtgtgactgatctggttctgaagacaccaaaatttacagttgagatcaaggaattgaatgtggatatatctaaagatggaggatccaagtcaaatttattagttagactgcaaatattacctatttttgttcacattggtgaaccacgagctagctgcgactttttatctaatttaagtggtggaggatgcagttcttcaggccaggcatccattactgctttagaaaggtcttcagctccttttatctgcgaaacgttctctgtctcgtgtgaatttggtcataatagcaaaaatagatattatatattgatagagtaccagaggtactaa

SEQ ID NO: 17279 - DNA, 1416 bp, Glycine max
  Peptide Sequence Number=SeqID_134057
atggccaaaaagaagagctggtttagtctggtgaagaggctctttatatgggacacacattccacacaagataagaaggagaaaagaaggaaatggatatttggaaggctaaagagcaagagattgccttcaattaaagctccactaccctcaaaaggaacaacactaagtgaggcagagcaagaacagagcaagcatgctttaacagtggccattgcctcagcagcagctgctgaagctgctgttactgctgctcatgctgctgctgaggttgttcgcctcactgggcaacgcaacgaaaactcagaagaatctcaacctgttaaaactaggaatggtgctccacaatccacataccagtgccagagggagattaaagaatctgctgcagccatcaaaattcaaactgcatttcggggttacctggcaaggaaggctttgagggcgttgaagggaatagtgaagcttcaagctatcattcgtggcagagccgtaagacgccaagctatgagtagtcttaagtgcttacagtccattgtgagcatccagtcacaggtctgtgcaaggaggctccaaatggttgaagggagatgtgattactctgaaaatgaagagatgcaagattctaaagacaaaataattaggatggactcaaacagtgaaagaaagtgggatgaaagcactgtattgaaggaagaggtagacacctcttgcacaagcaagagagaaagaacaaaagaatactcatttaaccacagagttctaaaactaacatacataaacccctctcagaggtcagcagagtcagaaagaagtaaagtaaatggaagatggaggtactggctagagcagtgggtagatacacaactttcaaagagtaaagagcttgaagatttagactcagtttttagctcacattctagagctggggaggaatatggaggaaggcaacttaagctgagaagtaatattcagagacaaaatccagttgaaggattggattctccaatacttggttcaagaagatcttttcctcataggaggcagtgttcagtgggagaggaccactcatttttaagctctcctgcaactccagcatacatggctgcaacagaatcagcaaaagcaaaagcaagatcaacaagctccccaaaaataaggactggggggaatgtggacatgaactctgatagctattcaccatgcaagaaaaagctatccattgcatcttctattaacagtgaaatgcttagtaatggtagggtgggcaagctcagtgttaaccagcagcaaagatcaccaagctttaagggactttcagtgcctataaaatcaagccgaacaactatcaaggatctcagtattaattcagattgctcactccctaattgggatcgacaggctttcttcaaatga

SEQ ID NO: 17280 - DNA, 2655 bp, Glycine max
  Peptide Sequence Number=SeqID_134058
atggcggacagcgtggtttcctttgttttagatcacttgtcccagctattggcacgtgaagctaagttgttgtgtggcgtggaagacaggatcttgtccctccaaaatgagctcgaaatgatcaacgagttcctcaacacctcaaagagcaagaaggggatcgaaaaaatagtggtgagccaaatcagagatgtggcccacttagctgaggatgtcatcgacacattccttgccaaagttgttgtgcacaagaggagaagcatgttgggaaggatgctccatggcgtggaccatgcaaagttgctccacgatctatccgagaaaatagacaagatcaaaatcaccctgaacgagatacgcgacaacaagatcaaatacgtcgagttccaagaaagcaacaatcaatccacaataaaagaggaggaaaaggcggagtcattgcacgagcgtaaaagaaatgtcgaggtagagaatgtagtgggttttgtccatgactccaaagtagtcatcaagcagcttgtggaaggaggttcattgcgtaacgccgtctccatcattggcatgggtggattgggcaagacccactcttgctcgaaaggcaaaaagaaaggcaagaaacacactcaagacgtttctaacttgagcgaggaagagctgaagaaattggtgtggaaacgcttagagaggaaaaggtatctggtggtcctagatgacatgtggaaaagacgagattgggatgaggtgcaagatgcttttccagacaacaacgaaggcagcagaatattgatcactagtcgtttgaaagagttggcctcacatactagccatcatcctccttactatcttaaattcctcaacgaagaagaaagttgggagctcttttgcaggaaagtgtttagaggtgaagaatacccttttgatttggagcctctgggcaaacaaatagttcaaagctgtcgcggtttgcccctctcaatcattgtcttggcagggctgctagccaacaaggaaaagtcatacaaagaatggtctaaagtggttggtcatgtcaattggtatcttacccaagatgagacccaagtaaaggatatagttctcaaactcagttacaacaacttgccaaggagattgaaaccatgctttctgtaccttgggatattccctgaagactttgaaatcccagttaggccattattgcaacgttgggttgccgaaggatttatacaagaaacagggaatagagacccagatgatgtggcagaagactacttgtacgagctcattgatcgtagtttagtccaagtagcaagagtgaaggctagtggaggtgtcaaaatgtgtcgcatacatgatcttctccgagatctttgtatatcagagagcaaagaggacaaagtgtttgaagtttgcacagataacaacattctaatctcaacaaaacctcgtagactgtccatccattgtaacatgggtcactacgtttcttcaagcaacaacgaccattcatgtgcccgttctttgttcatagttggctcaggtaactttttcagtccaagtgaattgaaattgcttttaaaaggtttcaaattggttcgggtgttagacattggaacagaccgtcttgtacgaaagatccctttcaatttagggaactttatccacttaaggtacttgagaatggacacctggggtgttaaatttattccagcttctatacttacccttgaaaatctacaaatcatagacttaggtcattttcgggtttttcatttcccaatttcgttctctgatccaatttctttccctgctggaatatggaaactcaatcatttaagacatttgtatgcatttggacctatcatgctacgaggccactgttcaggttcaaatgaggttatgttgaatcttcaaaccatctctgccattgtactcgatcgacaaacaatatctctgataaagaaaggaaggtttcccaatcttaaaaaattagggttgcaagtgtcttcaaggtgcaaagaccaagtacctgagttgttgcagagcctacaccaattatgtcatttgaagaacttacgcatttacctcgaaggtaagggtgcttcaggtaccccaaaccatgagagcatggaatggaacattggttgtaagccacaagaactattacaaagcctaggtcaattgagttgtctaactattttaagaattatgaatgtcttcgaccttctaacctgtggggttgtcacatttcctccaaatgttacaaaattaacgttggcaggtattaagtgcatcactgacgaggggatgaaagcgttgggaaatctcaccaaacttggaattttgaaacttctaggatcttcagatgattctttcgacctaaattgcgttgaaggtgggttcccacaattgcaagtgcttgagatgagttttttgggagttggaaattggaaattaggcaatggtacaatgttacgccttcaaagtttggaaatcaactactgtgaagggttaaatgatctcccaaatgaactgtggtcgttgactgacttaagagaagtgcgagtacggcgaccctcggaaccaatggctcacatgctaaggaatttgaaaataaagaatgcggttgaactcgtaatcggggacattagaacttga

SEQ ID NO: 17281 - DNA, 426 bp, Glycine max
  Peptide Sequence Number=SeqID_134059
atgaccactccgcatacaaggcaagaatccgaagaggaagttgacaggagaagccgccatttccgaaggggaaagcgactcgttcgcggaagacggctgaatatcaatcgaactctcgaaattccgcgagcaggaacacgaacagggctctgtcgcgagactccatcgcagagaacgcgagaagaatcacggagaaaaagaaagaaccctagaaaagaagaaaagggagcgatgaagaagaagggtttgggggttgaaagcgtggcgatcggaagtggtgtttttatagttgattgctcagatccgatccgatccgtgagatgctcgctcggtgatccaaggcggattgggttagtgagagaaagtggggggagtcatcgaatgcgacgcgggtgcaggagaggctgcgtggggagtcactgttag

SEQ ID NO: 17282 - DNA, 621 bp, Glycine max
  Peptide Sequence Number=SeqID_134060
atgaagaattatctgattctgttgtggagtttgaagaagactgtgatcgatgatgaatgtggtgaaacagattccgaagaggattcaattgaaatagaaagtgaagaagaatcatttgaaatggagattgaagaagattatgttgaaagtgaagatcaggaagattctgctggaaatgaagaagagtctaatgaatatgaaggttatcgtgaagataaaggtttaacagcaaagaaacaaaagcgaagacctgaaactaggtgtggttgtaaagcaagattccaagtgcacatcgtccttaggtcacacctatggcatgcgacaaagtttaaagattttcacaatcatgaattacaaattggtatgcattcagttctagtagcaagtcatagaaagatggatgagtgtgatataatgcaaatgaacaggttgaggaaggcagggattgacacactagatatctataattcttttgcaagtaagttaggaggttacttaaatgttcaatttggaaagaaaaaaaacatgtataatcaaatcagtaggcaaagacggctaggaggctcggacggtgcaagtgcgattgaatttttgcgtgtcttgacattgaatgacctatag

SEQ ID NO: 17283 - DNA, 1617 bp, Glycine max
  Peptide Sequence Number=SeqID_134061
atgagataccattacccacctcgtaataacattcttggagaacacaacattctgttcctcaaaagcttcacgatattgttccttagttgcatagccattcggcttaacttgtgtctttccagcatcccctcttcactgaaatcacttcccctaggagggcatttaaattttgatgaagttagcctaagccatgcagcaagggacttcggcaacaggtaccaatatcatccaatggcagtgctgcaaccagaatcagtttctgatatcgcatccaccataaagcatatctggctgatgggtcctagctcgcacctcacggttgcagcgaggggccacggccactcgctgcagggacaggctcaagcccatggaggagttgtgataaacatggaatcactcaaggtcccagaaatgcaggtacatgttgatgtgggaaactctcctccatacgtggatgtctcaggtggcgaattgtggataaacatattgcatgagactctaaggtacgggttggcgccaagatcgtggacagactacctgcatctgacagttggaggcactctctccaacgctggtgtcagtggccaggcatttaggcatggtccccaaataagtaatgttcagcagctcgagattgttacaggaacaggggaggtggtgaactgttccgcagagaataatggggatctctttcacagcgttcttggggggcttggccaatttggcattataacccgggcaagaattgtcctggagccagcacctgccatggtaaaatggattagagtgctgtactcagatttcacagcattcacaagagaccaagaaaggttaatatctgcagaaaacacctttgactacattgaaggatttgtgataataaacagaactggtctgttaaataactggagattatccttcaacccacaagacccggttcaagctagtcatttcaagtcggatggaagaactctcttctgtcttgaaatggccaaatacttcaacgtggaagaaatcgatgcagcaaatcaggaagttgaggaacatttgtcccgattaagctacatcccgtcgacccttttttcaacagaagtcacatttgttgatttcttagacagggtgcacatatcagaggtcaagttgcgttcaaaaggcttgtgggatgttccacatccgtggctcaatcttctaatacccaaaagccaaatacacaacttcgcagaagtcgtcttcgggaatatccttacagaaactagcaatggccccgtccttatctacccagtaaacaaatcaaagtgggacaacagaacttctgttgtgattccagaggaagctattttctacttagtggcatttcttacatctgcagttccatcttcaactggaactgacggcctagagcacatactaagtcagaacaaaagaattttagaattctgtgaaagtgcacaacttggagtgaagcagtatttgcctcactacaacacacagcaagaatggagggcccattttggtcctcactgggagacttttctgcagagaaagtctgtttatgatccattagcaatactcgctcctggccaacgtatttttcaaaaagcaataaccttctcatga

SEQ ID NO: 17284 - DNA, 178 bp, Glycine max
  Peptide Sequence Number=SeqID_134062
atggagaagtacctgagagaaaactttagcgtgcagccgaagaacccttctgaggatgctcttctccgatggagatccgccgtctccgtcgtcaagaatccccgccgccgcttccgcatggtggccaatctcgcccaacgcgctgacgccgaacaaaagcgcaagaagctccaggcac

SEQ ID NO: 17285 - DNA, 915 bp, Glycine max
  Peptide Sequence Number=SeqID_134063
atgtttggaaacggtgaagccgtgactcacagtgcatgctccaatggttctgtccaaactgtaaatggcaatttggaagagaagcttgatgaacttcgtctgctaatggggaaagtggatggtgatccactgagaatagttggtgttggagctggggcttggggtagtgtattcacagctatgttgcaggaggcttatggtggtttaagagaaaaggttctgattaggatatggagaagacccggaagaacggttgatagagccttggctaagcatttgtttgaggttatcaattcgagggaggatgtattgagaaggctgattaggcgatgtgcgtatttgaaatatgttgagggaagattgggtgatcgtgtcctttatgcagatgagattttgaaagatggattttgcttgaacatgattgacacccctctttgccctctcaaggttgtcacaaacctgcaggaggctgtgtgggacgcagatattgtgattaatggcttgccatcaacggaaacccgtgaggtatttgaagaaattagcaagtactggaaagagagaatcacagtgcctgccatcatttccttagcaaagggtgtggaggcagaattggggcctgaaccacggataataactcccacgctaatgatcaatcaagcaactggagtccccattgagaacatcctttaccttggaggtcctaacattgcctcagaaatttacaacaaggaatatgcaaacgctaggatatgtggggcagaaaagtggaggaaaccactggcaaaatttttgaggcagccccactttatagtgtgggataatggtgaccttgttactcatgaagttatgggtggattaaagaatgtatatgctattggagcagatatcattcagagcccttgggttggagattag

SEQ ID NO: 17286 - DNA, 192 bp, Glycine max
  Peptide Sequence Number=SeqID_134064
atgtacatgccaaattctgaggtactactcctctgggcgagcggatccggtgaaagggaggttggtggtgactggcacaatggtggttgggtgcggtgtttctacaccactctttcttccttagtcatgtcggattcttgtcctgcagatattagttctcttttgctaacagatgccacgccatgggtatag

SEQ ID NO: 17287 - DNA, 2604 bp, Glycine max
  Peptide Sequence Number=SeqID_134065
atgagagcagctgggaaccgtggtggtggttccatgctctccaaagagattcaggaagcaggctttggaattgagcctgacgaattagcctccattgttcgatcccatgacaccaaatgtttagaacatcatgaaggagttgaaggactagcaagagctgttcgtgtgtcattgcaacagggcgttaacacactagatgttcagcacagacaaaacgtctatggttttaaccgccatgccgagaatccccccagaagcttttggatgttcgtttgggatgcaatgcaggacttaactctaatcatccttatggtatgttcttttgtttcagtaggtgttggaatcttaacagaaggttggccaaaaggtatgtacgatggagtgggaatcatactatgtatccttttagtggtctttgtcacttcaatctgtgactataaacagtctttgcaatttaaggatttggacaaagaaaagaaaaatgtgagcattcaagttacaagagacagcaaaagacaaaaagtttcaattcatgatctagtggtaggagacatagtccatctgtcaataggggacatagttcctgcagatgggttattcacatcaggtttcggtttattaatagatgaatcaagtctatcaggtgagagtgaggctgtgaatgttgatcaagagaagccttttcttctatcagggacgatggtgcaagatggttctgctaagatgctggtgacatccgttggtgtgaggactgaatggggaagattgatggatactctgaacgaagggggagatgatgagacaccacttcaggtcaaactaaatggggttgccaccattattggaaagataggtttgtgttttgcaatagtcacattcatggttctcacgggaaggtttctctgcgggaaaatagctcaccatgagatcacaaaatggtcactaaatgatgcatctagccttctcaatttctttgccactgctgtcattataatagttgtggcagttcctgagggactgcctttggcagtcacactaagccttgcatttgcaatgaagaaattgatgaatgacaaggcactagtaaggcacctctccgcatgcgagacaatgggttcagctagttgcatttgcactgataaaaccgggactttgactacaaaccacatggttgtggacaaaatatggatttgccaacaaactaaggccattaaaatcggcaacagtgaaaatgtgttgaagtcctcaatttctgagcatatatctgatctccttttgcaatccatattccagaacactggctcagagatagtcaaagggcaagatggaaggaacaagatcatgggtactcccacagagtccgcattgctggagtttggcttgcttttgggaggtgattccaagttttataacgacaagtataaaatagtgaaggttgagcctttcaattcaatcaggaaaaagatgtcagtgctggtggctcttcccgatggcaccaacaagtatcgagcattctgcaaaggagcatcagaaatagttgtcaaaatgtgtgaaaaagttgttaatgcagacggcaaagtcgtccaattgaacgaacaacaaaggaatagcgtcacagaagttatcaatggttttgcttctcaggctctgagaacgctctgcattgccttcaaggatattgaaggatcttctggaagtgatagtattcctgaggataagtacacgttgatagctattattgggatcaaggatccagtgaggcctggagtcaaagaagctgttaagacttgtttagaagctggcattgtcgttcgaatggtgactggcgacaacataaatactgctaaagcaatagctagagaatgcggcatattgacagatggaatagcaatagagggaccagatttcaggaacaagagccctcaagaactgatgaacataataccaaaaatacaggtaatggcccgatccttgcctcttgacaagcacaccttagtgaaacatttgagggatgatttttatgaggttgtggcagtaactggtgatgggaccaatgatgctccagcgttgcatgaggctgatattggacttgctatgggtattgcagggacagaggtagccaaagagaacgcggatgtgattgtaatggatgataacttcgcaaccatagtgaatgttaccagatggggccgtgctgtttatattaatatacaaaagtttgtccagtttcagttaacagttaatgttgtggctctcatgctgaattttgtttcagcatgcgtgtcagcagaatccatttcaggttctgctcctcttactgctgttcaaatgctttgggtaaacatgatcatggacaccctgggcgcattggcactggctacagaacctcctcatgatgggcttatgaagatgccaccagttggaaggaacgccaaaatcatcaccagggtcatgtggaggaatataattggtcagagcatctatcaaattattgtccttttggttctcaaatttcgtggcaaacagattctcaagctcaatggacctgatgatgctaccttacttctcaataccgtcatattcaacacctttgtattttgccag

SEQ ID NO: 17288 - DNA, 174 bp, Glycine max
  Peptide Sequence Number=SeqID_134066
atgatggcgtcaatcagattgactctagatccctccatccttccctgtccagagctttttttgccagatctagaaggcgtcactcacactgtcttggaagaggaagctctggacatggaaggagagaagaatctaggacattcggaaaaaagttgtatgggtttaatgagttaa

SEQ ID NO: 17289 - DNA, 231 bp, Glycine max
  Peptide Sequence Number=SeqID_134067
atggtcatggccgcaactatagggtttcaagccataatagttcaatatcttggtgcttttgctcaaacagtgccactgagccaggagttgtggttaacaagcgtgatgattggtgcagtaagcatagttgtaggtgttgtcctaaagtgcattcctgttccatccagtaactacattgccacgcaccatgatggctacgagcagcttccaagtggaccagagctggcatga

SEQ ID NO: 17290 - DNA, 321 bp, Glycine max
  Peptide Sequence Number=SeqID_134068
atgacgggtcgcgacaatgcagttagatattggttaggttcatgtcggagtgagaacactaggggtctgcaattagcaaaggaggtgcacgaaggaagtgaagcaaggcccaggcggaagaaggcaacaccaacattacttggaggactacgtacggagtggatagagagccataagatacttggtcctcaaaacccaagtgtaacaaaatgccaaacgagagaaagtatccaagacttgggacaatgttgtgctacctttagaaaaattgctttgccaacccccaacccccaacccaagtgcttggcatacctcaattaa

SEQ ID NO: 17291 - DNA, 288 bp, Glycine max
  Peptide Sequence Number=SeqID_134069
atgttgttacagtttatcaacaaccctgacagaaaagagaaacaagaattagaaagaatcaaaagaaaggacatgcacagatctaaaagtagggtagatgcccacacgtatgacaaaagtggccagttactcgaatcttttggggtctgtggatgtggccttgtgaattggcataggattctagaaatatggtcaatggggaaacagatggtaactcctgatagcaattccaaatgcagtgtttgtggtcggattgtatacctcgtttcacaggaaaattatttttaa

SEQ ID NO: 17292 - DNA, 339 bp, Glycine max
  Peptide Sequence Number=SeqID_134070
atgcagtcgcaaatgcaatcacagggactcacactacctcctaaggctaaggttggtccttctgctgctcgtgtcagcacaaaggacatctatgggttgtatgtcgatgacagttcttctcgactgtttgctcttagaagagcttatgaggagtcgattactgtccacaatgttgctttgggcaatgatcaagtgaaggataaacaggtaggtgagggaccgacgaaacctgtagatatgttagatcctgacgtcgatcccctgtatctgatgacattgaccattccgcaactttttctcaagtcgttgcaggtgtcgtgggatgctagtgtgtttggg

SEQ ID NO: 17293 - DNA, 363 bp, Glycine max
  Peptide Sequence Number=SeqID_134071
atgagcaagttaaagagtaggattaactcagaatatgacccctcagatgaggatgtggctaaccaagaccaaatggtagaactgaacttgggcctaaaatatactgggcctcaatcagaattgaaagtttacaagaggacaagaaaatccaaagggggaactgggcctggtgtggtagaaggagaaaaagaaaccaatgaagacaccaacctttgtaaagacacttggattactgatgctagaccaacaaactttttaaggccagattctcctactctggatggaggaagtggcctaaaagaagctgcaagtactggggaattggctaaaaacatgggaatcagttttgggaaggaagaatga

SEQ ID NO: 17294 - DNA, 423 bp, Glycine max
  Peptide Sequence Number=SeqID_134072
atgattacagtggaaatcaaattttcagttgtcgtggtggtcggaattttggccagaacaaccgtggtggttgtggttcaggccgtggtggtggtagagacttctcagcaagttcagtatgctcaacccattcagtgtgtgcttgcatcacctcagcagccacttttggcatatgctcaacctcgggcctcaccattaactcctcaggtgtttccaccttttcctcccccctcaatcctcagttttctcttactcttggatgctaaatttgttctacgaaaaggatttgtggggagcgatggtctctatcagttccctcaacttcctgattctatgcccaagtgcaagcttccttcaaatgtttgcaattctgttaaagcttctgtacaaagtcctattgtaaatacaatcactagtgactga

SEQ ID NO: 17295 - DNA, 372 bp, Glycine max
  Peptide Sequence Number=SeqID_134073
atgggcaaggagaacaacaatgttaatggaccttacattgcttctaacctttccagtaatatttgttgcacatatagttttaatggctcaaatacaggtcagatgctctctgaagttcagttcttttggccagctttgatgataatctcatgttcctttcaagctttggcttctgtaatcaaggagtatattttcattgattctgctactcgattaaagcacaagtcactggacatatttgtggtcaattctttcggatctgggtttcagctcacgctaagcccagtttctcctcgggttagaattgggctaagtcagacagctcgcgctaagccactaaaggtgtgcgctaaggcagacagctcgcgctaa

SEQ ID NO: 17296 - DNA, 198 bp, Glycine max
  Peptide Sequence Number=SeqID_134074
atgtgtatggaagacagtttgggaatgttggagagagagctcagtacaagggtggggaggctttgtattaaaagaaaaattgaagttgctgaaacagagattaaaagtgtggagctaagagcagtttggggatattcagcagaagttaaagagggcagagcaaaaactcaattagctggaaaagaaaggggaggatag

SEQ ID NO: 17297 - DNA, 273 bp, Glycine max
  Peptide Sequence Number=SeqID_134075
atgggaagcaaatggacaaaattgaagctggctcttggtttggattcctgtgtacacattcctagatcctttgataattcctcctccgccgcaacaaggttttccggcggcgtctcacccaccgtcgtttcgccggccggcgactcctccagttatcgcccctccactccgacaccatcgtcttctggcctccggttacccaaatccggacccaaatcccctaagtttctcttttgcttctccttcaccactgaatctccatctccatggtag

SEQ ID NO: 17298 - DNA, 1488 bp, Glycine max
  Peptide Sequence Number=SeqID_134076
atgaggaagaaaaggaaaggaagcgagactgatgggtctgcggatctggctgttattttggctcctaatcatggctctgcttcatcgaatttaaagtcccattactcgctagaggattgttgtaggctgaagaagaggtgttgtaaggaggaggatgttgacactgagccagctacatcctttaagaggaggcttgctggcattgctactgccccgccttgcgggacgtcgtctttgatcacgccggggagagggctcaagaggaagataggttgcattgatgtcgctacccagatgggcaggaagaaaaagatcgaggatgattatgtgtctggggagacaattggccaaggcaagttcgggtctgtttggttgtgtaggtcaaaggttagtggagcagaatatgcatgtaagaccctgaagaagggggaggaaacggttcatcgagaggttgagatcatgcaacacttgtctggacattctggggttgttacactgcaagctgtttatgaagaagctgaatgctttcatcttgtgatggaactttgctctgggggacggctcattgatcggatggttgaggatggtccgtattcggaacagagggctgctaatgtactcaaggaagtgatgttggtcatcaagtattgtcatgacatgggagttgtgcacagagatatcaaacctgagaatattctgctcacggcatctggaaaaattaagcttgcagattttggcttggccatgagaatttcagaagtcaggctccattcttcacacaattatacatcagacaatattatcattaaagcaatgtcttattacctaaaaatttgtatctcaggtcagaacttaactggtttggctggaagtcctgcctatgttgccccagaagtattgttaggcagatactctgagaaggtggatatatggagtgctggagtgctcctgcatgctctgttggttggcagtcttccatttcaaggagattcattggaagcagtttttgaggctattaagaccgtcaaattagatttccaaaatgggatgtgggaatcaatatctaaacctgcacgagaccttattgggagaatgctgacaagggatatttcagcaaggatatcagctgacgaagtacttagacatccatggatattgttctacacggcaaatacattgaaaatgctgcccatcaaaacaaaattcaagaaccaaattggtgcctcatgccaacagcttgttgcggtacctgaaccaaggttaggaggaaacaggatagatacttactcacttagggagggttcatcctctgaaagttgcaattcagatgatcaggatgaatgtgtgttgattgatgtgcttgcctctgcaatttcacacgtgaggatatctgaaccaaagaggagcagggtgtgtggtcccacaggcccgatagttcaacaaggttcatctaacatgaagcctaacaacctctgtaaagcattttga

SEQ ID NO: 17299 - DNA, 1455 bp, Glycine max
  Peptide Sequence Number=SeqID_134077
atggcatttcttgtctcacttatatgccatgtctaccgaaaggacagatgtacaattcactcaccaatattctcaatggataaggaaaccagtagtggtagtaccaccaacttaattagtcatagatcagggacttcttcagtgccagaaacaaaatatgcaatgaattctccaatttatcatatcacaggttgttttcagaaagcctctttcttttttgggaacccaaaagaaacttatcatgggaatatttttccattttcgttagccgaactggaaaatgcaacagaaaacttttcatcttccaacctaattggggtaggtggaagtagttatgtataccttggtaggctgaaagatggtagcaatgtggcagttaaacgactaaaagatcaaggagggtcagaagcagactccgcatttttcaaggagattgaactattagctagacttcaccattgtcatttggttcctttgcttggatactgctcggagttaaaaggaaaacatgttcagaggttactagtatttgactacatggcaaatggaaatttgagggactgtttagatggagtttctggaaaacatgtcgattgggcgactcgtgttatgattgcaataggagctgcaaggggcttggagtatctccatgaagcagctgctccaagaattcttcatagagatgtcaaatcaactaacattcttctggatgaaaattggcaagcaaaaataactgatcttggcatggctaaaaacttgagatctgatgacctccccagctgttcaaattctccagcaagaatgcagggaacatttggctattttgcacctgagtatgccattgttggtagagcttctcttgagtcagatgtcttcagttttggggtggttcttcttgaacttatcagtggtcgccatcccatccataaatctactggcaaagaagaaagccttgttatatgggctactcctcgcttacaggatagtaggcgagtaataagggagttggttgatccacaattgaaaggaaacttcccagaagaagaggtgcagataatggcatacttagcgaaggagtgtttgctgctggatcctgacactcgaccaaccatgagcgaggtcgttcagattcttttgagtatttccccgggaaaatctaggaggagaagaaacattccagccagcctctttcaggaaccagaggatgcagaaaagcaaaggcaatctacacccagtaaatttccaacacatagttcattgccaatatataatgatcacaatctttctgttgagaacaaaaacaaagcagaagatgcagtttcagctgagaatatggagagtttgatcctcttgacttcgaaatctgacggttctcgtgcatcagaagaggaaatagtagacctgactgagcctaggtttgaatcattttgcatcacaaatggcaatgccccatga

SEQ ID NO: 17300 - DNA, 570 bp, Glycine max
  Peptide Sequence Number=SeqID_134078
atgtcgttcgcagtggcattgtgtacaacgtcgtcgttcttcccttcccgttttgaaattcgcaatccaaagcagcttcagcttccacctctcctttcaatgtcactgtcgtcgaagctaccgttgcatttctccggcaatgccatattcaaccgcaaccacccaaccatgttcaaaattcgagcctcaaactcttcatccaaactcgtcttattgagctccactatcgtcgtcacaacagcggtagcgaatcgcgtgctctacaaattggcccttgttcccatgaaagagtaccccttttttctcgctcagttcataacttttgggtatgttgttatatatttctcgatcttgtatttccggtaccgggcgagaattgtgaccgatgagatgctggcaattccgaaattgcgttttgtggccattgggtttctagaagccttgggcttggtttccggaatgtcagctgcagcttatgagctagcggaaactgacaagctagccgaagcatataagcaagctgaaaagctggaaacttataagctagaagctagtcaaaggagcttataa

SEQ ID NO: 17301 - DNA, 294 bp, Glycine max
  Peptide Sequence Number=SeqID_134079
atgtcttccaattctcacagaggtgcctccttttacggcaatgctgctccttaccgatccagagaggggcttagcacccgacccgttgcatcctccgatgaaatccaattgcatatcgatcccggcgtcgacttcgacgacgaaatcaccggtcttcgtggccaagttagaaaattgaaaaatgttgctgaagagataggttcagaagtcaagtttcagagagattttctggaacaagtgatcgtaagacttaaaatggaaaaccatgctgttaatgctgctactatattttga

SEQ ID NO: 17302 - DNA, 1665 bp, Glycine max
  Peptide Sequence Number=SeqID_134080
atggcgaaccgcttcatttccgccggaatcagacggtacgcacaaccccgtcttctctctccgctttctgattatcaacctaatcaactcagcaaattttgcttcatcagttttgtgttcggtgcacgaactctgtgtagctccgtagattctcgcgcttccgcgttccacgtgccgctcgcgcgaaaactcaaatcccgtaagcagagtccattgccggcgcttaaaaattgggtggacgaaggcaacgatgtttcacactctgagctcagacgcatcgccagaaccctcgtcaaatcgaagtgctaccaccacgccctcgaggtagttaaatggatagaaaaccagaagaatttccatatgatcccagctgattatgctatgaaattggaattaatcattgagaattatgatctaatggaagctgaagaatattttatgaatctacctgactcagctgcaaagaaggctgcctgtctcacacttctacgtggctatataagagttagggacactaataaagccgagactttcatggtgaagctctatgaactggggctagtgctgagcccacacccttttaatgagatgatgaaactatatctagcaacatgtgagtacaggaaagtaccccttgttatgcagcaaatgaagcgaaataaagtaccctgcaatgttctgtcctacaacctttggatgaatgcttgtactgaggaagaaggatatggggttgcagcagttgagacagttttcagacaaatgcaaaatgataggaatgttgaagtgggatggagcagtcttgctacattagccaatgcttataagaaagcaggacaatctaagaaggccattctggttctcaaagatgctgaaaggaaactatctacctgtaaccgtcttggttacttcttcctcataacactatatgcttctttgaaggaaaaggaaggagtcttgcggttatgggaagctagtaaggcagttggtggaagaatcagttgtgccaactacatttgcatactgatatgcttggtgaagcttggggacattgtacaggccaagagaatcttcttagaatgggaatctaattgtcagaagtacgatatcagagtgtctaatgttcttttgggtgcatatgcgcgcaatggatcaatggaagaagctgaatcattacatcttcacacattgcagaagggtggttgtccaaactataagacattggaaattctcatggaaggatatgtgaattggcaaaaaatggatgaggctattattaccatgaaaagagctttggctatgatgaaagattgccattggaggccgccacatggacttgtgttagccattgcagagtatttggagaaagatgggaatctcaaatatgcaaacaaaatgcacctttctgccaacaaaccacctttccatatccttaaaatgatggatgaagataaaattgagatggataacgagacactttccattcttaaagctttcactggatgtgttcaagctgaagtgtttggaggtgaagcagtaacctggaactcagtttcattcttaggctttttcaaggaaaatttcaattcttacatcagtatgtacgtgtttaggttaaaacaagtggagctcaaatcaacaggtgctgaaagattttgtgggatctga

SEQ ID NO: 17303 - DNA, 1140 bp, Glycine max
  Peptide Sequence Number=SeqID_134081
aaggtccattattggcaacaagctagcagcagaggagaagaatcagaattcagaactgaagcagacatggccgaaggaagaaacgaagacaaagacagaaccatgaagcgccttcttctcataacaaactgtctcttactcaccatcggcacctccggtgggcccctcgtgatgcgtctctacttccttcacggcggccaccgcgtctggctctccagcttcctcgaaaccgccggcttccccctcatgctcctacccctcgccgtatcgtacttccgtcgccgccgcaccgccgccgccggaacctccaaaccgaaattaatctctatgaagccccctctcctcgccgcctccgccttcatcggaatcctcaccggcctcgacgactacctttacgcctacggcgtggcgaggcttccggtctccacttccgccctcatcatcgcaacgcaactcggcttcaccgcgttcttcgcgttccttctcgtgaggcagaagttcacggcgtactccgtaaacgccgtcgttttgctcactgtcggcgccggcgttttggcgcttcacaccagcggagaccgtccccctggcgagtccgttaaggaatatgttatgggctttgtgatgacagtgatcgctgcggcattgtatggattcattttacccttggtggagttggtgtacaaaaaaatcaaacagcctcttacttactctcttgtcatggagattcagttcgttatgtgcttctccgccactctcttttgcctccttggaatgatcatcaacaatgactttaaggtgattccgagggaagccaaaaaatttgagcacggagaaggaagttactatgctgttttggtggggagtgcaatattatggcaggcttttttcttgggggcgattggggttatattttgtgcctcgtctttgttttctggtattttgattgcggtgttgctacccgtaacggaagtgttggcggttattttctacaaagaaaagtttcaagccgaaaaaggggtttctctgttgctctcgctttggggcatggtgtcctacttctatggggagattaaacactcaaagaaaatgaagatgaagaacagtgatactgaagcagaactggcacaacagtattcgtga

SEQ ID NO: 17304 - DNA, 534 bp, Glycine max
  Peptide Sequence Number=SeqID_134082
gcatgggaagtggatggctcaacatggaaaagtctacatgaactctatgagaaagagttaagatatcagatattcaaggaaaacgtgcaacgcatagaagcctttaacaatgctggaaacaaaccttacaagctaggcatcaaccaatttgctgatctctcaaatgaggaattcaaagccagaaatagattcaaaggtcatatgtgctccataataacaaggacacccacatttaagtatgaacatgtgacagcagtgccagcttcattggattgtagacagaaaggagctgcattaattaaggggtacgaggatgtccctgccaacaatgagactgcacttctcaatgctgttgcgaatcaaccagtttctgtatctattgatgctagcggatatgagtttcaattttattcaggtggtgtcttaactggatcatggtgtcatgcacgtgcactgttgtgggggtatggagtgagtgatgatggaactaagtattggttgatcaagaaattcatggggagcaaactggagtga

SEQ ID NO: 17305 - DNA, 875 bp, Glycine max
  Peptide Sequence Number=SeqID_134083
ccctgttcgcgccgtggcttgcgccggtggacccgaactggcaggacgccgccgcgcgcctgcaggcaccaaacgctcagcacgggctgggcaccgacagctacgggcgcgatctgctctcgcgcctgatttacggcacccgcccggcgctcgggctggtcgctttagtgaccgttatcaccctccccgccggtctgctggtgggcatattatccggttactacggcggctggctggagcgcatcctgatgcgctttaccgacgtggtgatgtcgatgccgcgcctgatcctcgccttcgcgtttgtggcgatgctcggcccggggctggtcaacggtgcgctggcgctggccttaaccacctggccggcctatgcgcgtcaggcccggagtgaaattcagcgcctgcgccacagcgattacctggccgccgcggagatgatgggtattcgcggcctgcgcctgctggtcggccatattctgcccctgtgtctgccctccgcgattgtgcgcttagcgctggatctggcaggcattattctggctgccgccgggcttggcttcctcggcctcggcgcacgtccgccgatggctgaatggggagcgatgatagctgacggcatgcaggtgattttcgaccagtggtggattgccgccattccggtctggcctttaacctgctgggcgatggcctgcgcgacgtactggagccacagcatgactgaacaccgcgttatcgtcgatgcgctgaatatcgactacccttccgcccgcgtggtcaacggcctgagctttacattaggcaacgagcggctggcgctggtgggtgaatccggctcggggaaatccatgtctgcccgcgccctgatggggctg

SEQ ID NO: 17306 - DNA, 282 bp, Glycine max
  Peptide Sequence Number=SeqID_134084
atgataagaacgaagaacaaacaagctaagagtgcatcaagctcattcacctttggaattggaagcatcaacaaaaccaatattggaatattaaagatcacaaagagggtggaaaacaacaaggatgaaaggtttgagaagaaggtgcagcaaatgtgcacaaaagttgcacggtgcaataacactaggcaaacacatgaaatctacaagtcctttaatggcaagcccaccattgtattctatcgcaagggatccttacttaatgtatgcattcaagaatga

SEQ ID NO: 17307 - DNA, 438 bp, Glycine max
  Peptide Sequence Number=SeqID_134085
atggcgtcttttggaactcctgtgatctttaccatgttgcaggtctcaatgtatgtggacgagtgtgcatacggatcttcattcagtaggccatggaatagattcccttggatcagttggatgagggaattgaatgtgggtatgtggtcaataaagcttaatgatgttgttgacatgatgaataccagtgggtttggatgggatgacacaagaaaaaacatcctaaagttggcaaccatgttaataaaagagtttgagaagttacaaggtatttttggtaaagatcgtgcaaatggtcgtggggccgagcgttgtgaagatgcaatggaaaatcaaattggtgagaaccaagttagtgatgatgatgagtggctacaccaacatgataattcaccttcttttattggaaatacttttgttggaccaccttctaaatga

SEQ ID NO: 17308 - DNA, 411 bp, Glycine max
  Peptide Sequence Number=SeqID_134086
atgcctcctaaggtgtctagctcctctggcagaggaggaaaatccgatactaaaggaaaagatgttatattggctctaccagagccaataaccaagaaggcaactacatcatcatcttctgggtcacctactcagattgggtcatcaacccagaaaggaaagcttgaagggtcattgacccatataactaccgttaaacctgagtcatcaactcaggaatccccaaaaccaacaacaacaaaacagaccgtggctgactatgcctggttaatacaaactctcttggccttagaagacattggcctcaccagagtaccaaaattggccaaaaagacctgggcagaaatggcctcagaatcagacgatgattctgaaacagacctgcaaaaacaaatccaaagatccaaatag

SEQ ID NO: 17309 - DNA, 303 bp, Glycine max
  Peptide Sequence Number=SeqID_134087
atgaggggcatcgtgcatgagcctcaagtgaacataggggcagaccaaaataccctcgtctccagaggactatacgtcctcgccttgagaggactacacgtcctcaccatcagagggctgcacgccttcacctccagaggactacacatcctcgccttgagaggactacatgtcctcgccttgagagggctacacgccctcaccttgggtactagttaccctcaccgtcagaggactacacgtcctcgccttgagaggactacacgtcctcaccatcagagggttgcacgccctcacctctag

SEQ ID NO: 17310 - DNA, 262 bp, Glycine max
  Peptide Sequence Number=SeqID_134088
gttaattaggcaaattggcaaaagtgttgttttcaccttctcgataagccaatttgttggcttagcaagcattcctaagcgcgacactcagtggttaagcgcgaggaagaagctagaagaagatgagctatcaggttcgctgagtgcaccactccaggtcatcaagcgcacacctttagctcatccgctaagcgagacaagcgcgctaagccaaaatacagttatgcaccctaagcaattcagatttgagctaagcgtgtga

SEQ ID NO: 17311 - DNA, 222 bp, Glycine max
  Peptide Sequence Number=SeqID_134089
ggggacctcgtgctgaaaaagatgtcccacgctgttaaggatagtcgaggcaagtgggccccgaattatgaaggacctttcgtggtgaaaagagctttttctgggggtgctctgatactcaccaacatggatggagcagagtcgtctcaggccatggtcagaagtcaagacgagtcaatggcagaaatcaaccaaggtaagacgatgaccggccacgattag

SEQ ID NO: 17312 - DNA, 798 bp, Glycine max
  Peptide Sequence Number=SeqID_134090
aaatgggcacttgcagccggcaaggatagtgtcgatgacgttgtttgcaaaaagtacgacattagcaaggaaaagtggacccaattttgtcagagtcgcagagaccctttgtgggaggatgtgcaaaagaaggcacaagccattcaaaaacaaaacactgcccctcacgtgttgtgttgtgggagttatgaatttttagaaaacaagttgatggaggagaagaaaaagaaacaactggaggaagctgctaagtttggtagcactgacacccttattgatcctccatctcccgtcagacgacacgtgaagtggaagatgacccgcaccaagaaaattggccaaatgatatctgaggcagcaaaggaaattgctgacaagattgatgtattgacagctgccattgggcgaccagaacaccctggtcgtgtgtgtgttgctagagccgatgtcacgattaaacaatactttggactgactccaaggacctcccgcacgtcttcgtccatagcttctgaagacctggagcaattgatgcaaaaaataagggaccagctggaggattcgatcatagaaaaaggacttgcactgcctcctgagcctgaggttggtctttcaactgctcgtgtcagcacaaaggagagttgtatgtatccctcagggaacgatccagacacgggtgactcagagaaatgggggttgtacatcaaagaaaatcctccccgcctggttgccctaggaagactttatgaggggtcgacaaccattcacgacatccatttgcgcaatgatcaagtcaag

SEQ ID NO: 17313 - DNA, 159 bp, Glycine max
  Peptide Sequence Number=SeqID_134091
atgccacggcaaaacgacttaatgggttactcgttcgcaggaaaaaatcctaaaaggtttgacatgccttcgggatgtagcatagacggactcaaggatgtgatcaagcaagttgcacctcaagtgattcccccttatggtattcatgaatcacaaacg

SEQ ID NO: 17314 - DNA, 234 bp, Glycine max
  Peptide Sequence Number=SeqID_134092
atgtcacatcctatcagagcgttgtgtcttgacgtccttcagtacaagggagaccagtcagggtcacaatgttttgcgagaatgctcgaaccatgtgggatcagcatagacttaaaggagcactcaaacctggtgacccccaagacctacactccgaagagtccgttagggcctctccctcctgattcaggcccaacccctaaaatcattttagcacacagacactgctcgtga

SEQ ID NO: 17315 - DNA, 1098 bp, Glycine max
  Peptide Sequence Number=SeqID_134093
atggcagaatcatccaagaagcacaagggttcatcctcctccgctgcggcacatcgaacatcacgtttcggagccaccgaagcatcctcggctccaattccaccatccttgtcatcctctacactgttttcatctgataaacagcatattcggtattcctctctctttcaatctcgtcaaattcttgatcccaaatatcttgaccttgaattttttgatggggaaacatttgattgctatcaagtgtttcaaaacactggtctgattctttttatgtcattaaaattaccatattatcatgagttagtacgattcttttactcaaacttgaaaattcaggatggaactttaatttctgaggtgcatggtatccctatgattattgatgagtctcttttcttttctctgacacaactacctagtcagggtgcaccttttgatggtacccttgttgatgactggaagtttgattactctagtcatgatgctcgccgcatggtctgcattgaccaggcggatatgactggcagactgcttgccgggtcattgacatttgattgtcgcatcatgcattatattattgttagaattttgatgcctcgttcttctgatctcgctcaagcctctgaggaggacttgattctgatgtgggctttcttgaccagtcgtccaatcgactgggcccatttggttcgttaccgcatgcataaggcattgcagtttggtgcacccctcccttaccttcaacttgtgactttatttcttcgacattttgaaattcctttggattctgagccttttgtgatagttaaacgctcctttgctattggtgtcggtgcagtaacctcctttggctaccgtaaggacatagataggcagtggttgaagaaggacgcacaacctctgcaagacgagcgtactccctctcctccgcctcaacgagatgattcctcagccctcatgaatgcagttctttcagaatcacgaggcctctgcacctatgttggtgaacgctttgattccttggatggttgtatcgatgccattgatgctcgctttgaaggaatggatactcgcatcactcaccttgaggaggat

SEQ ID NO: 17316 - DNA, 678 bp, Glycine max
  Peptide Sequence Number=SeqID_134094
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 17317 - DNA, 846 bp, Glycine max
  Peptide Sequence Number=SeqID_134095
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgtagttcttttcctccgcttattgatatgcttaaactcagcgggtagccccgccgaccgaggtctcgttgggagcgtgcgtgcacgcaaagggtcgtcgatgggtccagactga

SEQ ID NO: 17318 - DNA, 168 bp, Glycine max
  Peptide Sequence Number=SeqID_134096
atgacccagagggatgaagggaggaatggagcttcctgtgaccccagaatgccgctgactacgctcgaagttcctttgcgctttttcgatgggacacgtcgtaatcgattacacaaatatggtaatcgattaccagagagcaactttgccagaaataactgcttgtaa

SEQ ID NO: 17319 - DNA, 648 bp, Glycine max
  Peptide Sequence Number=SeqID_134097
atggccaaatccacattagatcaactttcctaccgggggcctcccatgagaagaagcggggtggttgtcaaagcgtttgatggatcaagaaagtctgttatcggggaggttgatttgcccattacaattgggccgtttgttttccaaattacattccaggtgatggatatccaagccgcatacagttgccttttgggtaggccgtggatccatgaagcgggggccgtgacatccaccttgcatcaaaagctgaagtttgtcagaaatgggaaattgatcactgtgagtggagaggaagccttgttggttagtcatttgtcagctttttcctttattggtgctgatgaaacagaaggaacctctttccaaggcctgactttagagggtaaaaagccagagaaaaatgaagtatcttttgctacttggaagagcgcacagaaagtggtgcaggaaggaacaggtgtaggatggggaaaagttgtgcagttgctggagagtaaaaaccgtgaaggactgggatttgcttctttctgcaggatccgcaacgaacagtgtttggatcaagctccattactagcacctttttgtagcgccggggttcatcaacaactcgccagaagccaatgctgtcttggaagatgctcctga

SEQ ID NO: 17320 - DNA, 111 bp, Glycine max
  Peptide Sequence Number=SeqID_134098
atgtcctctcccctcggcggggatttccacttcagcgaaggtgaggtaattgttggctatgatgttattgacgatcccctcaaagccttctacgaagatgtcttgggctac

SEQ ID NO: 17321 - DNA, 204 bp, Glycine max
  Peptide Sequence Number=SeqID_134099
atggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagtga

SEQ ID NO: 17322 - DNA, 447 bp, Glycine max
  Peptide Sequence Number=SeqID_134100
atgaccatgattacgaattcgagctcggagaggctgaaggagattcccacatccactcctactgaccctgcttcccaattttactccacagctctccccgccaatcagcttcccggctccgaattcgataagcctctattgaatttaaactcccaggcttcggagtttttgcataggttccgtggctccactggccttgaggagacatgggatgagatacagcgtgatggggcggctgcccaaatgcgccaactgccaccggggattcaacagccgccgttggatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17323 - DNA, 912 bp, Glycine max
  Peptide Sequence Number=SeqID_134101
cgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 17324 - DNA, 204 bp, Glycine max
  Peptide Sequence Number=SeqID_134102
atgagttctggatgtttgctagtagatcccaacggtcaaaatcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgtccgaccgccccttag

SEQ ID NO: 17325 - DNA, 763 bp, Glycine max
  Peptide Sequence Number=SeqID_134103
atggaagagtctgaggggagtggaagtgggaataatcagagttacagcagcagcagcagcagcagtggatcagcaatcagcaacatggctcaagactacctctttactattctcctcctcctccccatagatgcaatcctctccctatccatgacttgcaagagattcagggctctcagttcctcacacacactatggagatctttgtgcaaaagggactttggttccacttgtgttgactcactactcaactcttccaataacaaccagcatcatcacttcccatggatgaggctctacaagcaagtctctttgatggattctgtttgctgtcataaactattggtgtcagatttggatttccctgcagccagagcttctcactctctcaactttgtctccgactgtcttgtcttgtttggtggcggctgtgagggaggacgacatcttgatgacacatgggtggcatacattggcaatgatttccgaagaatgttgaaatggcagacagtccattcaggcattccaagtgggagatttgggcatacatgtgtggagatgggtgattgtcttgttctctttggaggaatcgacgaccgtggcaaccgtcaaaacgatacatggttggggcatgtcatgttcagtgagaacaacggtgtaacattttcatggaaaatgcttgctgtggggaatgttgcaccacctcctagaggggctcatgctgcatgttccattgatgaaaagaggatgataatccatggtg

SEQ ID NO: 17326 - DNA, 294 bp, Glycine max
  Peptide Sequence Number=SeqID_134104
atgtgggctttccttaccggtcgtcagaacgactgggctcactttcttaggtatcgaatgaataaggcattaggggccaatgcacctcttccgtatcctcaattggtcaccctttttctcagtcattttcaaattcctcttgatgatgaaccttttgttcaagtcaagcgatcttttgccattggtgctggtgcagtaacttcatttggttaccgaatagatacccgcattacccagcttgaagaggatgtgagttatcttcgtcggtgcttcgaccttccaccaccttcctag

SEQ ID NO: 17327 - DNA, 107 bp, Glycine max
  Peptide Sequence Number=SeqID_134105
atgccctttttgactttcagaatgttgcagaactttacggattgcgcaacaatgcttcttttcgacttccagaatgtcgcggaactttacggattacctaacgatgg

SEQ ID NO: 17328 - DNA, 204 bp, Glycine max
  Peptide Sequence Number=SeqID_134106
atgaacatcaaacatcagcaaacaaacaacatcaagcattcaacaaaacaaccagagaatgcacaaaaaaacatagcagactcacaactcactggccgaaaggttcaacctgctctgataccactaaatgtaacgacccgcctcgtcgctacgaaagtgattttgtcacaacataaattcatccaacaacacgccattacttaa

SEQ ID NO: 17329 - DNA, 357 bp, Glycine max
  Peptide Sequence Number=SeqID_134107
atgttatgtgtcgcaacgtgcccttcgcgggcgagcgagaggcgaggctcacgggtgcgctttccaaaggaggaaaggtgcgcggagtcgccaccaacgtttatttgtggaaaacgttgggaaaaccgaaggaaactggtcaaaatgagaattctaagttcgggagttgtatttacgcttgaggaagtttttgaggtcgacaaaagcggggcttttgctcctacgtaccctcctttggagaggaaatcagacctatgtagttcttccttatgcatggatcaagtgattctcttgaggggtgatcattttaaggcgttggaccttaagaatgatcctttttacttagcaagaaactaa

SEQ ID NO: 17330 - DNA, 789 bp, Glycine max
  Peptide Sequence Number=SeqID_134108
atggatagtggcaagtatcagctccatccgcaatatgcaagcctattcaattatcaagccgataagacaaacaaggagtttatcatcaagtttgacatggaaagtcacaataattcggcgacaaattcctttcagcatcttgcaccacaatataagaccggaaatgggcaatcgtatgtggttcctttaaaatctttggtcgatagttactggacactccaagggcgacctattgaacaatgtcctttgcatagtaagcaggaatatgagctcaatccaaaactaaatcgggatccacgctacgcagctagcatctttggacagagcgatctattcaacaaggagaaaatagatatttatgattcaaagagtcttttctattatcagaacttacgaagcagccgatcgggttattggtttaagaagtttgttgatgaagctgatgcatttcgaacaggcggcaatatgcactttcctttggcgcgttatgccgaggtattactgacgtatgctgaagccaaaatcatgctgaataatgtagatgatttggcaaaaagctgtatcaaccagattcggcaacgtgccggacttgatatgagtgtggcgaatgtcaatctaacggtaaaatctcaacaggaatggattgacttaattcgcaatgagagaaggatcgaatttgctggtgaggggctgcgttatagtgacatccttcgctggaaaactgccgaagtggtccttaatcaacctgcattgggtcatatgcggcaaggtgcagacggaaaatctgaa

SEQ ID NO: 17331 - DNA, 363 bp, Glycine max
  Peptide Sequence Number=SeqID_134109
atggacgggcacattgatgtgaccctaatcaaggagttctacttgaacctctatgacccagaagataaatctcccaaatatgttcgaggcgaggttggtattcgacttagtgatgaagatgaacatggacgagcctcagccacagccggaggccactccagagaccactctgtggacttcaccggccactacaccagttttagaggtctcagaggaggaggatggtgttgcagatacagattatgcaacagatatggcagcagcgcaaagcacctaggatccatggcccacagcagctcaggacaccctcagccagcccaggatgctccctcctcacctctggacgagcctacaatagcatag

SEQ ID NO: 17332 - DNA, 768 bp, Glycine max
  Peptide Sequence Number=SeqID_134110
atgttcacagcctggatgcattctaacaaaatatgttcttatggacgggatcttacatatcatcaatatatctcaagatttgtttatgtcgcccgcaaaagatgctggcaaccaagaaaacaagggaatacaataggcagactcatatgggtcccaccttcagctggtgaactgttttaccttagagtgatgctatccactgccaaaggtgcacagtcttacaatgacatcagaacagtcaatggtctggtatatcctacatttagggaaccatgttttgcaaaattctttctaggtaatgatcaagaatttattagtgctttacgggaagctaataattggggtactgcacactacctaagaaaattatttgtcaagcttttatttatgaacaccatggacaaaccagaatatgtttggcaacagacatggcaatggatggcagatgatatcatattcaatcatagaaaacaagatgagcaaaaaactattgtcgataccattatgtctgtggttaacactcaatcagctgcagtttactttctctatggatatggtggaactggcaaaacatttgtttggacaaccttatcatctggtatacgctccaatggtggaattgtttgtacagttgcttcaagtggaattgcttcattactattgcctggtggtcggaccgcacattccaaatttgctataccagtccctgcaacaaaaaattcaacatgcaatattcatcaaggcagtgagttagctgaattattaaag

SEQ ID NO: 17333 - DNA, 714 bp, Glycine max
  Peptide Sequence Number=SeqID_134111
gaacgacccgatctgaagttagtctcccatggtagaaaagtagataaaattgggagaccagcgcctgagatcgaaggcatgattgctgccaccggattgagtccactgatcaggtgttctgttatcaccactgatcctggactcatattcgccttcgtcgagaggtggcatcgtgagactagcacgttccacctgccagttggcgagttgacgatcacgctggatgatgtggcgtcactcctacacgttcccatcactggcgcgttgcataagttcgagccgctgattacttcatacgcgattggtctactgacgaagcttcttaagggccagacgatgggttgtagcagcccgcacgtatctgctccacttggtggggggattcgcctagggagcggctgcattggtccacacgtacaagcatatgaacgacgcgtcgcaagcctctacacgacaggtgggctgttacattacacttcttcagtgcatacatgcgttgtgcatgatgcttatgatgaggggagcccacgggcctacaggtggcttatgggtaaggctcatatgacggggatcaagggagccccgtattggagacgtatggatgccctgactatgactgaccgggttcttcgacagtttggcttcattcagaccgtccctccaccgccggtttgtgattctttgacgggtggagccaaactggggatcctctag

SEQ ID NO: 17334 - DNA, 1055 bp, Glycine max
  Peptide Sequence Number=SeqID_134112
atgacagggcataagttaagacacacctggaattatgaattttcttcaaagatggaccgtatggagagtccacctaatcaatatgagcaagagcaaataaggtctttactcatgggctggaaagaggggtcggggactgcttctacttataacagaagattcatcgaaagcaaggccgcagagttagctctgaatatgcagaaagatatgatcaatagaggagataatgagagcgcttatgaagctaaaacgaaaggttattactttttcctaaatgatgaggcatggagactaagccgaaatgtgacggtaaatatcaaaatggttaaagatgtaattgataaagaattaatggaaggatatttaaaggtgcttaaatatctggcttgtgaattaagtcctgcttcagttaaagtaataaataataatttcaggagatttattgtaagtgtagagccaaagcgagttgatgagttttcccttgtgaggtttagaggatctgatggcaagaacaataatattatgtcatcggtaagaatactcataaaaaaatggtatgaattgggctactctggaatagatgaagatgcatatgatttcttgtgtaaattgataatcactgacaacaaaaaaggagaagttgtaagaagaagagataaagttaaaggcccacttactgatatagaattacaatcttttcttgaagcttgctatagagcatatgaaaaaggaaacatagatattactcaattagcgatggctttgctgacaagcgcaaccggaagaaggccactacagatttcacagatgaaggtatctgatataagaaggctaaaagtaaatgagaatagctattcttatgccattagcatcccaaggataaagcaaggcttgggattcagagaagcttgcagaaattttcaagtgacaaaagaattatacgatttactccgtaagcagtgcgatttgagcatcgagcaaactcgtagcatacttaaaagagagctaattaacaaagagattgaaaatacaccgctatttatatcaatgcaaaa

SEQ ID NO: 17335 - DNA, 699 bp, Glycine max
  Peptide Sequence Number=SeqID_134113
atggactggcgaacgaagcacggaacggtggccacggtcagcgcaaaccgcgaaaaggccctgctgagccacatgtggaacaagtgtagggaatggggcttcaccgacgcggagaacccttgcaagggcgtgcgaggttacggtgaagcgggccgcgatgtgtacgtggaagacgacgtataccgggcagtgtgggatgcagcagatcaaccgctgcgtgatgcattggatctggcctatctgactggccagcggccgtccgatgcgctcagcatggaccggcgtgacgtgcgcgatgggttcctgcacatcagccagagcaagaccaagcacaagctgcgcattgccatcgaaggtgagctggcggcgcttctggcgcgctttgccgccaggacgttcaagcgccgcggcaagcacacgggagccgtcatcgtgcacaccgcgctgctactggatgagcatggtcagcccttgagcaaggggcagctacggagcaggttcgatgcagcgcgcgcccgcgctggcgtcgaaaagtcggccttccagttccgcgatctgcgagccaaggccggcaccgacaaggccgatgcatccgcagatattcgccaggcgcagcgccagctcggtcactcgtcggtggtaatgaccgagacctacacacgaaagcgcaagggcgaccgcgtaaccccgacgaagtag

SEQ ID NO: 17336 - DNA, 642 bp, Glycine max
  Peptide Sequence Number=SeqID_134114
atgggtgcggaccttggtccgcacgatggtcgaagatcatccacgcatggcgtggatctaccgggcttcgccgagcagctgttcgaggccggcggtttccgcagcgtcgctgaagtggccgccctcaagccgtgcacgcacaaatgccaggccatccgccgccgccgcatccagcgtgccgcggtggtcgaccgggtagcgtcggaacgcgaccggctcgcctcgcagggccaggcctgcggcgtacagcagcgtggtcagatagggcacatcgcggtccgcgctgccatggcccagcatcagtggttggctgaagccgcggcgcggtacgccgagatagtcgtacagcaccgcccagatgcccggcacgctggtcagcggtgcagtgaacatgctgccgatatccgcaccgtccagggtggcggccagttcgcccaggcactgctcacgtgccgctgccacgcgggcgcggccggtgtcgctgaggacgcggtcgatctgcggcgcgacctgcagcaggccgtcgagcagatacgcgtgatacgcgttgactgcaccgggattggggctgcggttgtccggtttcatcaccagcgcggtcaactccactgccgtgggcgtaccggtggtgaagctgccacg

SEQ ID NO: 17337 - DNA, 192 bp, Glycine max
  Peptide Sequence Number=SeqID_134115
gcaactgctgtttacaaggtctcgtccattgcttataaaagtggtgttcctgtgattgctgatggtggcatctcaaactctggtcatattgttaaggctttgtcattgggagcgtcaactgttatgatgggaagcttcttagctggtagtcttgaggctcctggggcttatgtgtatcagtttatatggtag

SEQ ID NO: 17338 - DNA, 138 bp, Glycine max
  Peptide Sequence Number=SeqID_134116
atgtatcgtgggccccgtggctcgttcggtgtagaaggtcgatcgaaagtcggcccgtccgggcaggcagaaggaatatacactgatgcaccggatcccatcagaactccgcagttaagcgtgcttgggcgagagtag

SEQ ID NO: 17339 - DNA, 201 bp, Glycine max
  Peptide Sequence Number=SeqID_134117
atgataggaagagccgacatcgaaggatcaaaaagcaacgtcgctatgaacgcttggctgccacaagccagttatccctgtgatgtgccgccccagccaaactccccacctgacaatgtcttccgcccggatcgaccggccgaagccgacccttgggtccaaaaaagaggggcagtgccccgcttccgattcacggaataa

SEQ ID NO: 17340 - DNA, 278 bp, Glycine max
  Peptide Sequence Number=SeqID_134118
tccccgaacccgtcggctgtcggtggactgctcgagctgcttccgcggcgagagcggggtcgtcgcgtgccggtcgggggacggattgggaacgggcccttcgggggcctcttcccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 17341 - DNA, 282 bp, Glycine max
  Peptide Sequence Number=SeqID_134119
atgctgggcaaacgcatcatgtacgatcgcgtgccgttcttctggactgcgcattacggcacccgctatgagtatctggggcatgcagaggagtgggacgattatcgcctgctgggatcgctgcaggacaaacgcttcatcgctttttactgccagcagggcatgattgcggcagtgtgttcagccggcatgtacacgctcaccgccgcgctggtgcacgagatgcagcagccaatgacgctggaacaaggcctggcgctgtttgaagcgtatcagggttaa

SEQ ID NO: 17342 - DNA, 294 bp, Glycine max
  Peptide Sequence Number=SeqID_134120
atggcacaggagcgtgtttgctctttgcctctatttgggaacctatgggataataactatgggtgtctaataactacttcccaaccatttataactcacatggctgttttctacaggcctaactcacaaaaaaagtccccagtggagtcgccaactgtcgcaacgtgcccttcgcgggcgagcgagggcgaggctcatgggtgcgctttccaaaggaggaaaggtgcgcggagtcgccaccaacgtttatttgtgggaaacgtcgtaaaaaccgaaggaaaccggtcaaagtga

SEQ ID NO: 17343 - DNA, 264 bp, Glycine max
  Peptide Sequence Number=SeqID_134121
atggatgtcgccagtagcactggcgagaaacgcgtgtcgccattgtcaatggctagaagcttggtgacgtggagggtgccgccattgacgatggcgagaaggcgagatgcattccacgtaggaaccgccaacaacattggcgagaagcacgctgactcagcaggtctcgcctatcccattggcgagacacctgctacccagcgttttgcaggagctagggttgcagtgttccaggatctaggcttgcagtgttctaggagctag

SEQ ID NO: 17344 - DNA, 1077 bp, Glycine max
  Peptide Sequence Number=SeqID_134122
cagcaggacgcgctcgaagcccgccagcagcagcagttgcaggcgcgtgaacaggcggccgtcacgttgcagcaggccaaagacgcgcatctgcaccagcagcagcgctggcagcaacatcagcagcagcaacagctggcacagcagcagctggccagcgcccggcagcagcgggatgagatcgatcagcgcgtcagcggtgaacgtcaggcatggcagcagcaattgcagcagctggaacagcagctggctgcccatcagcttagcctgccggcagcgcccgagcgcgccggctggctgcaaacgctgcagcagcgctggcagcagtggcaggaaagtgagcggttacttgccgggctacagccgcagctggcgaaaagcgaaacggaatgcagcagcctgcagcacacgctggcgcgtgaacagcagcaggtcgccagcctgcagcaagcccttaaccacctgcaacagcagcagcaggcccagcagcagcagcgccagcagctgtttggcgaccggtgcgtggcggacgcgcgtcagcagcagcacgccacgctgcaacagcatgaccaggcgctggcgcaacagctgcagcgctggcagcaggcgcaaagcgagctgcacggcctgaaaggtcagtatgaacagattgtcagccagcagcaggcgctggcgcagcgcgcagcggacgccgaaagcgccttccggcaggcattgctgctcagtgatttcgctgacgaaagcgccctgcgcgccgcgctgctggcggaagatgaggtgcagacgctgcgccagcggctgcaaacgctggagcagcagcatcagcagcacaccgcgctgcatgccagactggcgcagcggctgagcgatcatcagcagcagcgcccggccgcgctcagcgatgccgatgctggctccatcgccatccggctggagcagctgcgcgtggcgctgcgtgacacgcacgccagcagggtgaagcgcagcagcagctgcacagcgatacccggcagcgtcagcagcagcaaacgctgctggcgcagatcgccgctgacgaagcggaactggcacagctaa

SEQ ID NO: 17345 - DNA, 258 bp, Glycine max
  Peptide Sequence Number=SeqID_134123
atggaatcaagcaatgtgaagaacaagtcaagtggaaaaagaaagatgtctagtgaggacacaagaagttacttcacatggaacttggaaatggatcgtgtgctagctgattcacatgaaaaggccaaacgatttcgattcaaagtcattcctaattgggatgatattgttgacctatgtgcaaaggatagagctattggactcggagcagaaaatgcattagatgcagatgatatcatgagcaaagaaaacaaatga

SEQ ID NO: 17346 - DNA, 336 bp, Glycine max
  Peptide Sequence Number=SeqID_134124
atggtgaggacgtgtagtcctctcaaggcgaggacatgtaatcctctcaacggtgaggtacccaaggtgagggcgtgcagccctctcaaggcgaggacgtgtagtcctctggaggtgaaggcgtgcagccctcagatggtgaggacgtgtagtcctctcaaggcgaggacgtgtagtcctctcaacggtgaggtacccaaggtgagggcgtgtagctctctcaaggcgaggacatgtagtcctctggaggtaagggcgtgcaggcctctgatggtgaggacgtgtagtcctctcaaggcgaggacgtgtaatcctctcaacggtgagggtaactag

SEQ ID NO: 17347 - DNA, 237 bp, Glycine max
  Peptide Sequence Number=SeqID_134125
atggcttcctttcttctagtgggcatcccaggatttcttcaaactcttcaacagtcagaactagctggaagtcctcaaagcacaatgccccatgtatgcacttcagaaggtgatatggaccttccggcttcccgtgacaaaatgacgagaccaaaatacaacgcatgcatgatgacgcaatgcagacataaacgcgcatggtttatagcgcaacagggggacataccagcatggtaa

SEQ ID NO: 17348 - DNA, 490 bp, Glycine max
  Peptide Sequence Number=SeqID_134126
atggacgttgataagatccttccatctagcagcaccttaggatggcatagccttaaagttaagggcgagatccggggattccccgatataggtcaacctttcgaactgctgctgaatccacgggcaggcaagagacaacctgagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 17349 - DNA, 630 bp, Glycine max
  Peptide Sequence Number=SeqID_134127
gaggtgcaagagcagatgaaggccgatatggagcccatgaaagagcagatgaccacaatgatggaagccatgatgagtatgagaaaaatgatggaggtcaacatgtctacagtcgttaccgcaagtaccgccactgaggttgacccaactcacccatctagcctcaatcaagtaaattatctagccttggatatggtaggtcagggaggcaaagcgttaggaagtgcaggaggcccccattttgtgcaggttcagaacaaacatttcttcccactatatggcttgcctcccaactatacaccacccaatgttgcacacactcccgatgagaatgtcgacaactttgcatccatacccattgagagccaacaaccccaatctgatcatgcacacgggcaagcagttggtggtgtaccccttccaaacactttggagggccctcagtttcacccacaaccacaacccttgcagtttgcggtgggaagagtcccttctgctatggtggaaaagggaaaattttatcatatagaggaaaggctaagggccattgaaggaggcagagattatgcttttgctgacatcacagagttatgcctagtgcctgacgtcgtcatccctccgaagttgaag

SEQ ID NO: 17350 - DNA, 117 bp, Glycine max
  Peptide Sequence Number=SeqID_134128
atggtgaaaacaccattgaggcatttcaccgagcacttggtgggcgcacttttgggtaccaacaacaagggaatgggggcaatgtggcttgccccatcatttcagaacacaacctag

SEQ ID NO: 17351 - DNA, 996 bp, Glycine max
  Peptide Sequence Number=SeqID_134129
atgcatgccctcgccttcatagggctacacgccctcaccttcagaggactacacgtcccttcagaggactacgcgtcctcgccttcagagggctacacgccttcgccttcagaggactacacgccctcgccttcagaaggctacacgctgccaccttcagagggctacacgccctcaccttcagaggactacacgtcctcacctacagacgactacacgtcctcgccttcagagggctacacgccctcgccttcagagcaatataggtccttgcctacagaggcctacacaaggttgtacatcctcgccatcagaggactacacgtcctcgacttcagagggctacacgtccttgacttcagagggctacacgccctcgccttcagagggctgtacgtcctcgccttcagagggatgcacgtcctcacctttagtgggttgcacgtccttgcctttagaggaccatacatcctcgccttcagagggctacacatcctcgccttcaaaggactacacgccctcgcctttagaggactacgcctcttcgctttcagagggctacacgccctcaccttcggaggactacacgttctcacctttagaggacaacacgccctcgccttcagaagactacacgtcctcgccttcagaggactacacgtcctcacctttagagcactacacgtcctcaccttcagagggctacacaccctcgccttcagaggactacatgtcctcgctttcagagggctacactccctcgcctttagagggctacacgcccttgccgtcagagggatacacaccctcaccttcggaggactgcacatcctcaccttcagaggacaacacatcctcgccttcagaggaatacacgtcctcgccttcagagcactacacgtcctcaccttcagagggctacacaccctcgccatcagagggctacacactctcaccttcggaggattacacgtcctcgcctttagaggactacac

SEQ ID NO: 17352 - DNA, 342 bp, Glycine max
  Peptide Sequence Number=SeqID_134130
attccattaggagcgattttagccattgttgatcctgtggtcattgctgtttcgaaattcaaactggtcatgcggtcattgctagaaaggaaatcagtgttagggacttatcagcagaaactgaactcttgttcttctttactgattcaacaacagctcagcagtggtagtacccatgagcctgcagaatgtgcactttttttgccttggcttctattctctcctcactttgaatcgggagatatcctttccattcaaggcagcatgcagaagtttcaacgaaagtctcctctcccacatagctactaccttctcaacactattggaatcaccatcatctga

SEQ ID NO: 17353 - DNA, 240 bp, Glycine max
  Peptide Sequence Number=SeqID_134131
atgggaaatcctttgtgtaggaccaagagtgtgagaatagcttttaggagcttaaagggagattggtcaactcaccaaatttggctataccaaacccccttagtgagatttgtagtttattgtggtgctttaaagaattgcctaggttgtgtcttaatgcaagagggcaaagtggtgggttatttgtctaggaaacttaggattcatggagcaattactttactcatgacctggagttaa

SEQ ID NO: 17354 - DNA, 363 bp, Glycine max
  Peptide Sequence Number=SeqID_134132
atggtgatcatctctctttctaccatgggaggagccacttgtgccgctaggtctctccaccactatagagacctagccctcatgaatgcactgaaaattgtgtttccagagtgtacaaacttgttgtgcaggtttcacatagacaaaaatgtgaaggcaaagtgcaaatcgctaattggtcaaaaaaatgcctgggagtatgtaatggatagctggtgtactctggtagattgtctttcagaacagcagttcgttgagcaccttcaaaagtttcgagtagcgtgttacccatggccaatgttcgttgactatgtatgcgagacatggattgtctcacacaaggagaaatttatcatggcctga

SEQ ID NO: 17355 - DNA, 197 bp, Glycine max
  Peptide Sequence Number=SeqID_134133
atgactgacctttgcttagtgccggacgtcgtcatccctccaaaattcaaggtacctgatttcgataggtacaaagggacgacttgtcctaagaaccatctcaaaatgtattgtcgcaaaatgggcgcgtattccagggacgagaagctgttgatgcatttcttccaaaatagcttggctggggcagtggtcatctg

SEQ ID NO: 17356 - DNA, 306 bp, Glycine max
  Peptide Sequence Number=SeqID_134134
atggcattcttaggagaaacttcctctcagacgatcatcaactcaaggtggaacatgtcacgtcaaaacaactttgtaggttacgcgttcacaggaaaaaatccccaaaaatttgatattccaaaaggatgtaccatagatgaactaaaggatttgatcaagcaagtagcacctaaagggaatcctcctcatgggattcatgaagcccaacttgtgttggtagagtccaattacaggaaacaatttgtgccaatagaaattttggctctttttagtaaaccggttatggaaaatgaggacgaggtg

SEQ ID NO: 17357 - DNA, 279 bp, Glycine max
  Peptide Sequence Number=SeqID_134135
atggtttacaaaggattggaagactttgaagatcctaatgagtctttggagaacaaccctgtattgaaccttttagctgccccaactcatcaatggtctaagcacgcatccaccgctaagcgcagcttcggtgtgcttagtgcaacagaagaatctggcagagcatcaatatcaaggttgcacgctaagcacgagatcagtgcgctaagtgtagcaattgtcttcagccaggctcagcgcacgactggtgctaagctcaaatccacttactcgcgctaa

SEQ ID NO: 17358 - DNA, 930 bp, Glycine max
  Peptide Sequence Number=SeqID_134136
atggctcagaagaagcttccaaccaagaggttgagaaaagatgccgctagagagggttccagtgtggccccacaggtagatgtggagtttgatggacaccgggatggggagtatgccgagttccaggaggaaattgctcgaaggcaatgggctcagcttgtatcacccacgactaagtacaatcttgagatagtcatggtgttttatgccaacgcttggcctacggaggagggagtcaaagacaaacgctcctgggcttcaggctttgatgaggaggccataagccaattgttgtgcattctggggcaggattttgcccggagtgtgacgaggagacgaatgcggatcatgcgcactagcatgaccacccttacacaaatttggataacgctgctgctcagcaacattctccctagcgaccataattcagacctccccctgtcgaagtgtcagctggtctacgccatcctgactcagggtacatcctttgtggtacaagtagagggtacatctacttgggttgttgtaactgagaacaagaaagggtacatccacttggttgttcaaagagaacaagggagggtacatcccttgtggatctttgcttgtaaagggatcacgccttctagacacccagtggacccagagaagtccaacaaggccctaatatttcctgctttgatcttgggcctttgccaattctatggagtgttggcaggcacaacagcaagaggagggccagtagtagccagccacaggcgcactgccgctacctctacaggagacgccatccttggaggccaacaccctaatcctttcctatggcctaccctcgagcagttcagggccatagttgcatggcctggagatgagcccgattttgagacaggggcaacatggctgatgtgctggatttctttacttgacgag

SEQ ID NO: 17359 - DNA, 831 bp, Glycine max
  Peptide Sequence Number=SeqID_134137
atgggtttttcaagattaaattcaagacaatacttcaagattacaagtcacaacatcaagatgatcactagtatattaggaagggaattcctaattgaattagcaaaaggtttggccaagtttggccttgttgatttcatgtcattaaaattgccatattatcctgaacttgtaaaggtcttctactgcaatttaaaaattcaggatggcattattatttctgaggtgcatggtattcctatggtcattgatcagtcactgttattttctttaactaatttacccaatcaaggtgcaccttttaagggcaccattgttgatgactggaaatttgattattcgagtcatgatgctcgtcgtatggtctgcaatgatcaagctgaaatgaccggtagattgctggtcgggtcattaacatttgataatcgcatcatgcactatataattgttaggattttgcttcctcggtcttcaaatttagcacaagcctttgaggaggatttgattcttatgtgggcttttcttaccggtcgtcagatcgactgggcccatttggttcggtaccgaatgcataaggcattacgggccaatgcacctctcccttatccacatttgattactctgtttctgcatcattttcaaattccgtttgatgatgaaccatttgttcaagtcaagcgttcctttgcaattggtgctggtgccgtgacttcctttgggtaccgtaaagatcggaatggtcaatggctgaagaaggatgcactccctcctcaagatgaacgtactccttcacctcctcctcagcgcgatgattcagcactcatgaatgaa

SEQ ID NO: 17360 - DNA, 447 bp, Glycine max
  Peptide Sequence Number=SeqID_134138
atgcccataccttcaaaggataccttcataggactacacgcccttggcatcgtaaggcttcactccctcaccttcagaggactacacatgctcgcctatagaggactacacgcctttgccttcgtagggctacacgccctcaccttcagaggactacacatcctcgactacatgtcctccacttcagaggactacatgtcctccacatcagaggactacacgttctcccctttggaggactacatgtccttgccttacgagggctacacagcttcaccttttgaggactacacgccctcaccatcagaggattacacaggactacacgtcctcaccttcaaagggctacacatcctcgccttcagggggctacaagctctcgccttcgtagggctacacgcccccaccttaaaaggactactcatcctcaccttcagaggactacac

SEQ ID NO: 17361 - DNA, 132 bp, Glycine max
  Peptide Sequence Number=SeqID_134139
atggatgacatggggttgaatcaatttagatttttcaacatggttcatgacatcttggtcaagaaatgggtttatgatcccaacatggttggctcatggtgcctaacacatgcaactaagaatgtagtgtga

SEQ ID NO: 17362 - DNA, 342 bp, Glycine max
  Peptide Sequence Number=SeqID_134140
atggctcttgtaactggtcccttcctagggaggattgcatcaagtgactccaacaaaaagatgccaaagaaaaattggaacagaggaagaccaagaaagacattgaagagacggtacatctcttgtggatcagttcaagtggagggtacatccacttggttgttgaaagagaacaagggagggtacatcccttgtgggtctttgcttgtaatggattttacaagattattggaaatctcaagaaccggtggttgcttggagactggatgtaggcacgggttgtggccgaaccagtatttgcatggagttgagactagactgaatagatatggaagaaattaa

SEQ ID NO: 17363 - DNA, 237 bp, Glycine max
  Peptide Sequence Number=SeqID_134141
atgacaaaaggtgcagaagacgacgttagtctctgcgcgtcaacgggctcgtttgcccctggattaacacaaatcgtttgtacggataaccacttgggtatcttcgcatgtcattggactccccgtctctggatgacaaaggtgcagaagacgatgcttgcttgcccttggttgacaaaggttgcagatgacgacgttggtctccgcatgctaccggactttgagtctgacggatag

SEQ ID NO: 17364 - DNA, 201 bp, Glycine max
  Peptide Sequence Number=SeqID_134142
atgctacatgggggagtgagggagaaacgaacaacgaggagaagagaggtaggtgatgacaacaatgagggagagaaggaagagacaaatatggagacaaagtccaactgctttcggtgctcgtcatttagaatcgatgttcttgatcaaaatgaggtagtgacgacgatgatggagtatccacagagcgaggaagcgtga

SEQ ID NO: 17365 - DNA, 306 bp, Glycine max
  Peptide Sequence Number=SeqID_134143
tcatttggttttgacattgctgttgaagaggcacaaggagccataaactttgctcatgtggaagcagaaagcactgagaatggtatcgatattgtcaagcttatgggtcgttacagtggtgctgagctgtcaggaggatactggttcataggaaatatgctgttggcgtgttgcttcccatcgtgcagcactgcattgtcgccattttccacttttctgttattttctttttgcattctagcaccttctgtttttgtagcggcacccttggctagtgcctctacattagggatgcttagtatgtaa

SEQ ID NO: 17366 - DNA, 399 bp, Glycine max
  Peptide Sequence Number=SeqID_134144
atgtccttcatgtccttctctaacaatacaaatttaagttgtacgagggaagaggctctgaatttcggtgccttgagcgattctgatggagggaagcagttacttgataacatattgtgcattaatatgagtggattgactggacctattcaatttggtttagatagatctcctctaaatccatcatatgacattcttaatgtaattgttcaatacaagttcattctgtttggagatggacacaagaacccaagctactgtgatcttgtcaaaatgattacttctgatgtttttgatactgccataggtgacattgcgattgtctctgtccgaacaaagattgtggattttactcgaccatacatagagtcggggctagttgtggttgctacagtttag

SEQ ID NO: 17367 - DNA, 174 bp, Glycine max
  Peptide Sequence Number=SeqID_134145
atgagagcagaagatgcggaggggcaccgagccgccagtgaagaagcggacggagagcgcccgtacgagaaacctatgaatgaggaagagtggggaagagcgggtggcgatgctgctgagaaccacggttggtgcagtgaagggaatgacggggtgttgcgtggtgactggtga

SEQ ID NO: 17368 - DNA, 222 bp, Glycine max
  Peptide Sequence Number=SeqID_134146
atggatgaagacagacccgagacccacgatggaaggcccaagagaaaattccagctcatcacctttagtgtagaacggaggttcccttgccctcaaaatgaaggaccattgtcctctgcttgtatcaggaagccatcagagctgaagcccaatgtttcgctgtctggcgttaaggtcgtgactgattcggtagtggtctctgatgatggtgatatcccttaa

SEQ ID NO: 17369 - DNA, 670 bp, Glycine max
  Peptide Sequence Number=SeqID_134147
tgccgccgatccggacggtgtcgaggacactgtctgtgagaaatacgacatcagcaaggaaaagtggacccagttttgccagactcgcagagacccttcttgggagcatgtgcgcaagaaggcacaggccatccagaagcagaatactgccccccacgttttgtctcgtggggcttatgattatttggagcagaagctcctggttgagaagacgaagaagaagctggaggaagctgcacagtcaggaagcgttgatggcgtcatcgaccctccatccccgatcagacgccacgtgaagtggaagatggcctgcacgaagaagacaggggagatgacgactgaggccgcaaaggaaatcactgagaagattggatcgttcgtcccccatggacgtcaggatgttctcgccgctgctattggacgtccagagcaccctagacgtgtccgtgctgctggagccagtgtcaccatcaagcaatactttggattggctccacggacgtcccgcagcgcttcctccctgcctcataacgaattacagtttgagtctgaaagttacataaagagttcacaacgcgatgtctatcttggagcctacctaaatgggttccactgcagcggacactggcagatggtggtcatcctgcccaaaggaacacctagttgtctg

SEQ ID NO: 17370 - DNA, 3314 bp, Glycine max
  Peptide Sequence Number=SeqID_134148
gaaggggtggtaatcgaggaagagggaggaatggtggtagaggaaggggtaggggaagacagagtaaagaacttgttgaatgctatagatgtcacaagcttgggcattatcaaaatgaatgtccaacttgggaagaaggagccaattatgctgaattcaatgagaaagaagaggtgttgcttatggcacaagaaagctcgaaagaagaggtgtatgatgagtcaaatgtggaaatgtggtttcttgactctgggtgcagtaaccatatggttggaagaaaagattggttattcaattttgatgatagttttagagattttgtaaaattgggtgataactccaagatgcctgtcatgggaaagggaaatctgaagctgtatattggtggattagttcaggtggtaactgaggtttactaccttccaggattgatgaacaacttgctcagcattggtcagcttcagcaaaagaatctcaccattgtcttctccaatgatttgtgcaaagtctatcatgagaatagaggcttaataatgtcaactcaaatgtctgtcaacagaatgtacatcatacatgcatctgtcctaactcccatgtgcatgaaagtcgcaaatatgagtcaatctcaattgtggcatcatagatatggacacttgaattacaaaggattgcgtgtactggctaaaaaggagatggtcaaggggttgcctgaaatagaagaaacagaagaaatatgtgaagattgcatcattggcaaacagcacagagattctataccaaaaactgtgaattggagggcaaatgagaagctacaactggttcattctgacatttgtggaccaatcaaccctacatcaaatggaggcagcaggtatttcatgacattaactgatgactttagtaggaaaacttggacttatgtgttaacaaaaaaaacaaatgctctagctattttcaaacaattcaaggctgttgctgaaaaagagaccaactgtcaaattaagtgtttaagaactgatagaggtggtgagttcacttcaactgcatttaatgatttctgcagtaaaaatgggatcaagagacagttgactgcagcatatactccacagcagaatggagtatctgagaggaaaaacagaacaattatgaacatggttaggagcatgcttgcagggatgaaagttcctaagaggttctggccagaagcagtgttatgggctacatatgtattaaacagaagtccaacaatgtctgtcaaagatatcactcctgaagaggcatggagcaatgtgaagccttctgttcatcatttcaaagtgtttggatgtttagcttatgctcatgttactgatactcaaagaaagaaattagatcccaagagtatcaagtgtgtgaacttgggaatcagtgaggagtcaaaggcctacaagctctatgatcctgttgctaagaagatcatagtgagcagggatgtaatatttgatgaaacaaagggttgggaatgggatggcaaatctcaaaaattgcaaagtattgatgtagaagagagtgtagatccatctgtagcagaagatgtaaatgcacatggtgactcaagtgataatgaatctccactgcagcatgctagtgaaactgaaagtgaagagcatgatgctgaaccagtagttactcctagaagcagaagaccaccagcttgggtcagagattttgtgacagacattgaaaatgtagaagatgcagaattgcataaccttgctgtgtttagcagtaatcatgatccaaccacctatgaagaagctgctaagtttgaaatatggagaaaagctatggatcaagagattgaatccatagaaagaaatgatacctgggaattgactgatctaccaaagggaagcaagaaaataggggtgaaatggatctataaaaccaaatacaatgaagatggtaaggtagagaagtataaagccagattagttgcaaaggggtatagtcaacagcatggaattgattataatgaggtttttgcaccagttgctagatgggatacaatcagaactatacttgctttggctgcaagcaatggctggaatgtgtatcaacttgatgtgaaaagtgcttttctacatggtgagctagtggaaaatgtgtatgtagaacaacctcttggctatcaaaagcaaggaaagaacagtgtgtataagctgaagaaggctttgtatggtttgaaacaagctcctagagcttggtatagcaagattgagtcatattttgtgcaggaaggattcacaaaatgcccctatgaacacacactgtttgttaagcaagacaataaagggaaggttctgattataagtctgtatgtggatgacttaatatacactgggaatgatgagggaatgttctgtgaattcagaaaatctatgaggagcaactttgcaatgactgatctgggaaggatgagatatttcttgggagtagaagtcaagcaagtggatgatggcattctaatctgtcaacacaaatatgctcaagacatattggcaagatttggcatggagaattgtaatgcagtgtgcaatcctatggtaccaggcaacaagttaaccaaagatgaaggaggaaaatcagtagatgctactaaatatagacaaatgattggaagcctcatgtatcttttggccacaagacctgatcttactttttctgtttgtctcattgcaagatacatggatagacccactgaacttcacttagctgcagcaaaaagagttttgaggtatttgaagggcactatggagtttggagtgtggtacaagaaacagaatggaagagtaaatttgcaagggtggactgactcggattatgcaggtgatttagatgacagaaaatccacttctggatatgttttcacctttggatctggaccaatctcttggtcatctaagaagcaggccattgtgaccttatccaccactgaggcagaatttgtagcagcagcatcgtgtgcttgtcaagctgtttggctcaaaagaatccttgatcaacttggcaaacctcaagacagtggagttgtgatctggtgtgataatagttcttcagtcaagttgtctaaaaacccagtcatgcatgggagatgcaagcatatcgatgtaaggtttcacttcttaagagatcttgcaaaagaaggagttgtaaaactgaagcattgcagcactcaagagcaactggctgacataatgaccaaagccttgaaacttgacagtttttgcaaactaagggaggagttgagcatgtgtgatgttaaagatgtatag

SEQ ID NO: 17371 - DNA, 474 bp, Glycine max
  Peptide Sequence Number=SeqID_134149
gcatttaaaaatgtctttcctaaggagattcctcatggactgccaccttcaagcggcataaaacatcaagttgatctcctccccggagcttctttgcctaacaggccaacttacaaaagcaatccccaagagactcaacgtaaggatgcacatgccaaagttcagtatgtgaaaagattgtatgaccaagtgaaggtgcaaattgcaaagaagaatgaaagctatgtcaagcaagcccacaaggaaaggaaggaagtggagggaatgatgagaatcatgaaactggccaaatacaagctaaaggccccaagtggagaaggacgaaggcctaagtggagaaaggacaaagccccccgagtggagaaggatgaaggcccaagtggagaaaggatgaaggctcaagtggagaaggatgaaggcccagaggcagagacactatcaagacaattaatttttgctgaaggctcaaactaa

SEQ ID NO: 17372 - DNA, 201 bp, Glycine max
  Peptide Sequence Number=SeqID_134150
atggtggcactcgcagtggcgaccgcagccgcattgctttacattattttcttcatgctcaacatggcctccatcatggcgaccatttggtctttcatggcctccatgtcagcctccatttgttcttgcacctcttctacctcactcatgactctagctctggcacgcgttcgttctgatttcaaggaaagaatgcaataa

SEQ ID NO: 17373 - DNA, 252 bp, Glycine max
  Peptide Sequence Number=SeqID_134151
atggtggccaaagatcaactaactatgaaagataagagggatgaggaagaaaaactagaaaaacaaaagaaaaagaatgatagtaaggccttggaaatatcccttagcactgccatacctcttgagcttgaggttattcctcaagtagagaaagattccattctcaatagacaagggatcacaaaccagaaaagagggtgtataaatcctgttgattctgaaccagattctttccttttgaagtgccgctga

SEQ ID NO: 17374 - DNA, 755 bp, Glycine max
  Peptide Sequence Number=SeqID_134152
atgggctgcacaccctctccttcagagggctgcacgccatcaccttcagagggctacacgccctcgccttcagaggactacacatcctcaccttcaaaggactacacgtcctcgccttcagagggctacacgcgctcgccttcagagggctacacgcgctcgccttcagaggactacacgtcctcaccttcagcgagctgcacgccctcgcctgcagaggtctacacgtcctcgccttcagaggactacacgtcctcgcctttagagggctacacgccctcgccttcagaggactctacgtcctcgtctttagaggactgcatgtcctcgccttcagagggctgcacgcccttgccttcagaggactacacgttctcgccttcaaaaggctacatgccctcgccttcagaggactacatgccctcgccttcagaggactacatctcctcgccttcagaggactacacgtcctcgcgttcagagggttgcatgccctcgccttcagaggactacacgccctcgcctttagatggctacacgccctcgccttcagatgactacatgtcctcgtctttagaggactccacatcctcgccttcacaagactccacgtcctcgcctttagagggctgcaagcccttgccttcaaagaactacacgtcctcacctttagagggctccacaccctcgccttcacaggactacacgtcctcacctttagagggttgcacacccttgcctttagaggactacat

SEQ ID NO: 17375 - DNA, 812 bp, Glycine max
  Peptide Sequence Number=SeqID_134153
atggcatttacacatccatggctgctgtggacactgcctctggctctgctgccgttattgctggaacgctcccacagcaagcactattcctgggtaggcctgctgccaccagatccgttgtctaaaaccatagggttcttactcaaggtattagccgttatcagcatcgttttcattattcttggcctggccggaccacatagtctggagcaacaagtggagcgtacaggtatcggtgcacagatcggcctggtgctggaccgcagtgccagtatggatgacccgtttgccggcgacaaagatggcaatgtgggtgaaaccaagtccgtggccgccgctcgcctgatgaccaagtttgtgcaaagccgccagaacgacatgatgggcctaatcactttcagtaattcggcaatgtatgtgttacctctgacagaaaataaagaagccatcttgtcagccattcaggccaccgccgggaactcgctttttcaaaccaatattggtgggggattaacgggtgcagtggaactgttcaaggatatgcctgactctggctcacgcgcgattatcctgatttctgacggtgctggccgtgtcagtgacatggtgcaacaaaaactgcgtgactggctgcaacgctacaacattggcctgtactggattgtgctgcgccaacctgggggcattaccattttcgaccccaaatacaccgagagcggctacgatggccctatgcccaccgaagtgttgctttaccagtttttccagacactacgcaccccttttaatgcttacgaggcctcagatcccaa

SEQ ID NO: 17376 - DNA, 930 bp, Glycine max
  Peptide Sequence Number=SeqID_134154
atgtctgacctttacgcgctgtttggcggcactttcgatccaattcattacggccatctgcgtccggtcaccgcgctggcgcagcaggttggcctgcaaaaagtgacgctgctgccgaataacgtgccgccgcaccggccgcagccggaagccagcgcccaacagcgcgtggcgatgctgcgctgcgccattgccgatcgtccgctgtttgatatcgacacgcgcgagctgacgcgcaccacgccgtcatggacggtggacacgctggaaaccctgcgcgccgagcgcggtgcacaacagcccctcggatttatcatcggtcaggattctctgctaacgttaggaaaatggcatcgctggcaggagttgctgtcgctgtgtcacctgctggtctgtcagcgtccaggctacgccgcgcagatggctacgccagagatgcagcagtggctggatgcgcaccgcgcgcatgaggtgcagcagctgcatcgcgcgccggcaggccacatctggctggccgatacgccgctgttcgacatttctgccactgagattcgccagcgccgccatcatggccaggactgcgccgatctgctgccagcggcggggaaccttttgcaaggcaaagcactccaagagttcgttattgataagattgatgatctcaaaggccaggacatcgttgcgattgatgtgcagggcaaatccagtatcaccgattgcatgattatctgtaccgggacctccaaccgtcacgtctcctccatcgctgaccatgtgatgcaggaatcgcgcgcggctggcctgaaaccgctcggcgtcgacggcaaagcggctgctgactgggttgtggtcgatctcggtgaagtgatcgtgcacgtgatgcaggaagagagccgccagctgtatgagctggaaaagctctggagctaa

SEQ ID NO: 17377 - DNA, 780 bp, Glycine max
  Peptide Sequence Number=SeqID_134155
atgttactgagagcctcctcccgtttctggcgttatttgatgaagaaccttctgacgtatgctgccattctgcttgccggcgggttagccaccgcgaatatggccagtgctgccgtcacccatgtcgctatctatcgcggcggtgccggctgtccgggctgctcagaaatggtccgtaaagcgctggaacagagcggtctgccgctggacatcgcgtatgtcggagagcaggaaaaaataaaggtcacgcaggataacctcgccagttttgatgtgtacatccagcccggaggcgggcaggacatccccggcgcctttgctgcgctgggcgacgaaggggctgaggccatacgcaaatttgtccgcaatggaaaaagctttctcggattgtgcatgggcgcgtatctggccgatgaaaactggctggggctgatcccctcatcgctggactctgaagtcatgcgcaaggggactaacatacccgacgaaggcgattacgttgtcgatgttgtctggcaggggaaaaccgaaaaattttattatcaggatggtccttacctgaatgccgaagacgcgcacggcttcgtcgctctggcgcgctatgccaacggtgatatcgcgctggcgaaatatacttacggtaaaggcacggtgctcctgagcggaccgcatccggaagcggatgaaagctggatggcgccggagaaaaacaatccggcctacacctcagccggcagcaagatggccagactgattaatgatttaaagcccgggaggtaa

SEQ ID NO: 17378 - DNA, 399 bp, Glycine max
  Peptide Sequence Number=SeqID_134156
atgctggatgaggacgttgccgctttctctgtagagagtgaaaagagggatgattcacagcatgacgctttttttcgtgcgctggtggattatctcctgccagacggaccggcttctcactggttgatctacctcgagttgtggccgctggcggcaagggatacgcaatttgagcagctgctgctctccagcacgcagacgtggacagcgatcatccgtcagggcttatccggccaggcatttggccacctcagcgaagcaggtaaagacgaggtggcgcgtaatcttcacgccctgattgacggttactcaagcgcgcttattcttaactactctgcggataagcggacacatttttttcttgagataatggccgccttgcagaaactttgtcgctag

SEQ ID NO: 17379 - DNA, 147 bp, Glycine max
  Peptide Sequence Number=SeqID_134157
atgtatacagacattcacattttgcgccatgttctaccagtttgtggcaccctttgtatcttctgcccttccctgatggcaaggtccagacaacctgtgaagaggtacaagaagctcattgtagatatttttcctcgtaaccaccag

SEQ ID NO: 17380 - DNA, 429 bp, Glycine max
  Peptide Sequence Number=SeqID_134158
atgaaggagatcctaggcctacaagctccaatggagcttacaccagagaccaaaacctttctgcaatgtgtcacaagcagaattgacataaatttgagggttgatcttcctatggatattgagcttgttgtgtaccattacaagaatcctatatatggtatcaagcaagagagtggccttgcacaacagtggtatgatgaattagatgatcttgctgctccagaacctgaatctaaaataaatgttcaagatgataatctggataaaaaattggtagtggaagatgagaaagttccctttagcgttggagtctttactagccctagaacaagtgagctaactcaagttaatcactcatatacacttacaccctcctgcaaactcaatggggctgagaaaccaaaggaagctcagcaacatttagtttag

SEQ ID NO: 17381 - DNA, 1098 bp, Glycine max
  Peptide Sequence Number=SeqID_134159
atgagtgtttttgggatactcaccatctctattcatgacacagtggcttctcatgatcctcaacagtctttcattaatgataaagcaacctctactactactggaaatgccaattctggtactgtacagtctagtgatcatcctcaatcatctgcaactgaatcaccgaattcatcagaacaacttcttgctagaccagataatattcatcctatgatcacaagagctaaagatatcaaacaagcccttcaagattctaagtggcattctgccatgaatgatgagtttgatgctcttcagagaaacaaggcacggactgtggttcctcttactccaaatagaaatgccattggtcataaatgggtgttcggagttaaagaaaactttgatggaagtgtaaacaaatacaaagttggattggtggctaaagagcaattagatgtgaataatgccttccttaatggctttctagaagaggaagtttatatgattcaaccttcaggttttgagacatctgataaatcacttgtacattctttgtccagtggagctcctttaatgacccaatacacgtacatcagggatctgttaaccaaaacaaatatgttggaggcaaaaccaatttcatcacctatgacttctagttgcaagctgtcaaaggatggttctgatctgttacaagatgcatctttctacagatctgttgttggagctcttcagtatgtgactatcactcatctagagttaagttttgttgttaataaagtttgccagttcatgtctgcacctcttgaatcccactggacaacagtaaaaagaattttaaggtatcttaaggaccctattgataggcactctaactctggtgcagcagtgtatgttgctgatattctatggattcagactatttttaaggaacttgcagttcctcatattacacctcttgtgctttgtgacaattccacaatggttcaacatattcctggaatagatcaatgggcagatctacttactaagcctttgtcttctactcgttttgcttatccgagttctaaactaaatgttgctgagcttcctttggtttctcagccccattga

SEQ ID NO: 17382 - DNA, 831 bp, Glycine max
  Peptide Sequence Number=SeqID_134160
atgggtgaagtagaggaggtgcaagagcaaatgaaggccgacacggaggccttgaaagagaaaatggccacaatgatggaggtcatgatgaccataatggaggtcagtgcggcctaccaaacccatgctagagctagagtaatgggtgaagtagaggaggtgcaagagcagataaaggccgacatggaagagaaaatggccacgatggtggaggccatgatgagcatgaagaagataatggaagccaatacggttgcagttgccgctaccagtgctgttgctaaggtgaaccagatgcccccatctgatctcaaaccaaatgaatcatccaacctcagatatggtgggcaaagatttgggaagtacggacgaccccatgatgtgcaaattcgaaacaagcacgccttcccgccatatggctcgcctcccaaggaggatgtcaataactccgctcccatactcattgaaagccaacaacctcaagttgatcatgcacatgtctctcaacccatgggggagacacatgaaattccccaccacaatctagccgacttcgagccttgcctcggatatgccactggagggcaagcagttggtggtatacccatgccaaacactttggagggccctcagtatcacccacaaccacaccccttgcattccacagcgattaaaaaccttcatgctatgacggaaatgggaaagttggatcatatagaggaaaggctcaaggacattgaaggaggcgaagattgtgcctttgctaacctagaagagttgttcccagtacccgaacatggtcattcccaagttcaaggtgccggactttga

SEQ ID NO: 17383 - DNA, 637 bp, Glycine max
  Peptide Sequence Number=SeqID_134161
atgtgtcacagatacagtattgaggcccttgacaaaagtttacaggacatcatgcacaacatcaatccttttggaggaaaggtcattgtttttggtggtaatttccgtcaaattctacctgttgtgccaagagacataggtgatggtaaacttgcagaacctaatgatggttatggtgaaatcaccatcccagatgagtttcttatcaaggactttcaagatcctatccaggcaattgttgaagcaacatatcaagacttattacacaactacagcaatgacgatttcttgcaaaaaagagatgtccttgcctctacaaaagatgttgttgataaaataaatgactatgtcctgtctttgatttctggtgaggagaaagagtattgtagtgctgattctgttgacaaatcagatgaactactcagtcctgcatttggagtactaacagctgaatttctaaactcattgaagacatctggcataccaaatcacaagctcataatcaaggttggtacgcctatcatcctactacgaaatctggaccaagctgatgggttatgcaacggaactaggcttattgttacaagacttggttcaagtgttgttgaagcggagattattactgggcctaacatag

SEQ ID NO: 17384 - DNA, 848 bp, Glycine max
  Peptide Sequence Number=SeqID_134162
gaaccattcgaacttctttgggaaatttgacttgtcttgttgaacttgatttatcagctaatcaacttgaaggaaccattccaacttctttgggaaatttgacttctcttgttaaacttcaattatcacgtaatcaacttgaaggaaccattccaacttctttgggaaatttgacttctctggttagacttgatttgtcatataatcaacttgaaggaacaattccaacttctttggctaatctctgcaacttaatggagattgatttctcatatctcaaactcaaccaacaggttaatgaacttttagaaattctagctccttgtatttcccatggactcacagcacttgcagttcagagttcacgactttcaggcaatctgacagatcatattggggcatttaaaaatattgacacgttacttttttccaacaactcaattggtggtgctcttcctagatcatttggaaaactttcatcattaacatatctcgatctgtctattaataaattcagtggaaatccatttgaaagtcttagatcgctttctaagatgtcatctcttcagattgatggcaataattttcaaggagttgtcaaggaagatgatcttgcaaatcttacaagtttgatggagtttcatgcatcagggaacaatttcactttaaaagttggtcccaaatggcttcctaattttcagctttcctatttggatgtgacatcatggcagttaggtcccaactttccatcatggattcagtcacaaaaccaacttcaacactttggactgtctaacacggggattttagattctattcccacctggttctgggaagcactttctcag

SEQ ID NO: 17385 - DNA, 423 bp, Glycine max
  Peptide Sequence Number=SeqID_134163
atggcttcttcgatctcacaaggtctcgtgttcaccacagccatgctcgtctccaccactgttctttaccttgcattctcgaggcaaaagacttccccgccattccaaatttcccaaaattcaaattctctccactctaacaaaaaaattcttcgctcttgcatatactcagaggagaagaaacgggaaaggaagaagaataagaagaaagtgaaatttgcagaaaatgtgatggtgaaggaagtagaaagagttagtaacgagaaaaacagagaaaaacaggggaggcaaaacagagtatcattatcaagcaacgagtgcagaagtgaaattccgaaaaaacatgaaatgccagcgaatcgaattgctctgtataatggcaacgatcatttcttcataaaatctgacatacaaggctattaa

SEQ ID NO: 17386 - DNA, 126 bp, Glycine max
  Peptide Sequence Number=SeqID_134164
atggggacaaatgtctcaaactatggaaacaagaagggaaaatgttggggtccgcaactgtgtggttctctcatattgcccttagagccttcaactcggcatgatgatggatgtgatttgctttaa

SEQ ID NO: 17387 - DNA, 564 bp, Glycine max
  Peptide Sequence Number=SeqID_134165
atggcttctgcaaactctgatgcgattccgattaacaccgctaatcctcatatccctccacgatatctttctgatgcaaatcatgatcttgatcatgtcaatcctctgtttttgatgtggtgttcatcgataagcttgtgtctatcagagatgctgctacttatcatgaacagatggattattgctctcattgaaagtcgtctccctcatataaccatcgaagaggcggaaggtctcattcttgcacaggaactaagactcaggaaatacaataaacttgattcttcaagtaacacctttgcgccttctgtgaatcttactcaagcaaattctagaggttctggtggtcataatggccgcgaagaaggaagtttcaactgtggtggtggtcgtggtgttcgaagctcagttcaatgccaggtctgtttcaagtataaccacaggctcttacttgttacaataggttcaatccataatatcaagcttccaatagtggaaattatggattcaatggaaatagtggcaatcgctctaactggtctcagaatcagaatcaaaaactag

SEQ ID NO: 17388 - DNA, 807 bp, Glycine max
  Peptide Sequence Number=SeqID_134166
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaaaccgatcttcgagccgaattcctctgaagtcgagtccggtctcttcgctctccaggcagctttgggtgctggcatagttggatatgccttgggtcgcatgagtggccgtacgaagggtcgtgaggaggctgagcgcgcctccgacctcaacagtgtcgacgacgtgccgcaggccgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17389 - DNA, 1238 bp, Glycine max
  Peptide Sequence Number=SeqID_134167
gaggggagtttggccacaatctgctcaggggtcagttcgcgaccgtcgtcggcgataagcgccagttttcgcaggggtttgcgcttttcgctatcgacaaggaccggcaaccagcaccgtctgcagggcgcgtcctttctcggtcaggacatactcctgccaggcgctgccgtcggaggcgggctgaagccgaaggataccttcgtcaaccagcttttctgaaactcgccaaagcgcgtaaccccgcggagcgcgtcgcgaacaatcagcagcgaccaccagtcaccgatgatatccagcgaacgggcgacggggcaggggctctcttcaagacgggtacgtttcacagcacattctccggtggggaattagggatgagaaaagcactactcgcgctggcagtcgccggttccatttcagcaacgtttggcgtgcaggcgcaagagacgccggaagggtatcagctggagcaagttttaatcatgagtcgtcataacctgcgcgctccgcttgccaacaacggcagcgtgctggagcagtcgacgccaaagcagtggcctgagtgggaagtgccgggcggtcaactcaccaccaaaggcggcgtgctggaagtctatatgggtcattttatgcgcgagtggctggcacagcaggggatgatcaagaccggcgagtgcccaccagcggatgcggtgtatgcctatgccaacagcctgcagcgtaccgtcgccaccgcgcagttctttatcaccggcgccttcccgggctgtgatgtgcctgttcatcaccaggaaaaaatgggcaccatggacccgacctttaacccggtgattaccgataactcccctgaattccgtgacaaagcgctgaaggcgatggaggccgagcgggagaaaatgcagcttgcggaaagctacaagctgctggagcagatgacgaactacgctgagtcgccgtcgtgcaaagagaaaaaggtctgctcgctggcagatgcgaaagataccttcagcgctgattacgaaaaagagccaggcgtttccgggccgctgaaggtgggtaactcgctggttgacgcctttacgctgcagtattacgaaggtttcccggcagaccaggtggcctggggagagatcaaaaccgaccagcagtggcgcgtactgtcgaagctgaaaaacggttatcaggactcgctgtttacctctaccgagtggcgcaaaacgtcaccggggatcctctag

SEQ ID NO: 17390 - DNA, 259 bp, Glycine max
  Peptide Sequence Number=SeqID_134168
gcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 17391 - DNA, 372 bp, Glycine max
  Peptide Sequence Number=SeqID_134169
ggagttgggacggttgatgggacccctccaaaggcaagccttccacaaaatgtaccgaaagattttagatttgaccacggcggaggagatattaggatgccctcttgggggaagaaaaccgtatcttttctccggctttcttccctccttgagcaagattgcagctgtggttggagattcggtgagagagttggattgtatgaagcaaactcgaaacagcgtagtagcctaccacagaaatacttggaaggcaaggcaagggatatggcgaatcagaggataggtcccgtttgcggatatactagctttgctgatctttggggttgtcctctttccaaacgtggacagtttggtggacctagcctcaattga

SEQ ID NO: 17392 - DNA, 953 bp, Glycine max
  Peptide Sequence Number=SeqID_134170
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttagtgatctccggagtgtggacaaagttgaacccagcctccatgtgacgagcgatgacgtgttcctcgatgagatgacgcagcatcgcgcccttagggtggaacaccaccaggcccgggccgatttcctcagggaaggagaacagatcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17393 - DNA, 271 bp, Glycine max
  Peptide Sequence Number=SeqID_134171
atggctgagaagacaaagaaaaaattggaggaagctactcaatccggaagcactgaggccgtgattgacccttcatctcccattagacgccacatgaagtggaagatggcccgcaccaagaaaactgggcaaatgatgtctgaggcagcaaaggaaattgttgagaagattgcgtcacaaggttcctttgtccctcatggacatcaggatgtcctgacggctaccattgggcgaccagaacaccctgatcgtgtgcatgctgttagagccg

SEQ ID NO: 17394 - DNA, 446 bp, Glycine max
  Peptide Sequence Number=SeqID_134172
atggaaatgttcctgctgcagcaaaaatttggtgggaagataattgacattgtctcaagggaaatgcaaactccagaggagaaagatgaagctttgaatgctgttaagaacaccatactagaaatttttctgatcgttgtctttgggtatgatccttgcttgagtaccttccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 17395 - DNA, 230 bp, Glycine max
  Peptide Sequence Number=SeqID_134173
caccactcattgagttggtgaggaactatgttctctcatgggaagatggtgttgagaaaagaagcctagagtatcaagaacctatggatttgaggttaaatcctttccaagagggaggggatgatgcaatcctacccccaatggtattggttagaagactccaagagaattgggctagaacgactaaagaaggccctaggattctcataaacctcatggtagatttctga

SEQ ID NO: 17396 - DNA, 660 bp, Glycine max
  Peptide Sequence Number=SeqID_134174
atggccactagatggaggcaatttaagtcttccttgaccactaaatttgtgtatgctgatattgagggtcaagataaacaggatccttttgtaaaatatggtctatatccattaacttggaaggaatttgttgcaacccgtaagacccctaactggcagatgacacatggtagctttgttccccatgatcgtgacgacatacttaatactgccattggaggaccggagctggagcacgtaggtcatgttcgtgcaatggggtctagtgtgacaatcagtcacaactatggaagggcatcacgtggcttcaacaattcctctacatccatcacccaacaacacttggctgaaataattggaatccttaaagaagattggaagaatgagataatcggaaaccttaaggaagacacaaaggagagcaatgctgaaactgttgtcaatccattagggggagaatatgttgttcatgtgatactgactatggggttaggtgagaggaggcgccatccactagggaataagccatggaaggaggagcttcaccaccaagagagttcattggataagaagcttagagaggaagcttcaatggaggaaaagaatgagaaagataggggaggcacaaaattgaaggagaaaaagagtgagagaagctga

SEQ ID NO: 17397 - DNA, 399 bp, Glycine max
  Peptide Sequence Number=SeqID_134175
atggaagttggaagttggaagtggaagttactggaagttgaagttggaaatggaagttattggaagttgaaagttgaaaatggaagttggaagttggaaggggaagtggttgtcatcatcaaaaaggaggagaatgtaaatcatgcaggttttgatgatgtcaaaaagaatttgcttgataatgagcgtcttcatcaaaaagggggagaatgtggatcatgccttgttttgatgatgtcaaaaagaaatcacttgattgtcatcatcataaagggggagaatgtgaatatcaagcctttcctcaaaacaaagggtttcaaagtcatgcaaggctctggtaatcgattaccaggaagtgtaatcgattaccagaagggaagaatgaaaaagagctattga

SEQ ID NO: 17398 - DNA, 714 bp, Glycine max
  Peptide Sequence Number=SeqID_134176
atgtatgtgagagataaagccattagctacccttttagactgcacatctcaagggtcaccagtgtcaagataattgttgataagaaagggttcaaggtgtactacactgaagaaatgctctcaaggcagatgaaggtggaagtagtcaactacccccgcaattggagttccttgtttagtgggaagaagcttattcatgctcttgatgattacgatgccaagaccctctggaatcaaattgtgtcgacagacactctgaaggcctccacttctggttatgatagaagttacaacactaagaactacgacttcattgaagtgctacgtccaattcggaactattacttcgttgatgcttgtgttttcttcaccaaggatgctaacaactactcattcattcaacatctcctacaacttcccactattcaatctgaagggacttacaatcttctgaaaataagtgaagctcaaatgatagctcatgcatccaatgcagccatagctaatgaggttgtacatcacatccaagaacctgcatccaagcagtcaataacctcaaatgaagctacctcaagagataagggagaaccagatgtcgtcattgtctactccactagtttaggacctgctcctttgaactatgcacaacctgcgattgttacaagggatcaagtgcaagacatgattaggaaagaaatggaatcattcgcttaa

SEQ ID NO: 17399 - DNA, 201 bp, Glycine max
  Peptide Sequence Number=SeqID_134177
atggctactacggtcatcaaaatcggagacatgactactgtggccatcaagatcggagatacggttattgcagccaacaaattcaaggaaatggttactgcagccaaggagaaaagaaagatggatattgatgtcattgaaaacaagaagaaacccactaatccaagatcaattccaagattctccactaagtgtgcttag

SEQ ID NO: 17400 - DNA, 465 bp, Glycine max
  Peptide Sequence Number=SeqID_134178
atgtcaagggagtcgcgccccctacgagtttggcgtattaggaaaatagaaagagtatggctatgtcgggagacatgcatgtcagtttacgcatgtcacactttggtgcacatggtgccgactcatcttctccttgaagtggcgtctcctctctctcttcctttttccattccgctgccattcatcttccaagaagcaaaggaatccattgatgaagaagatcctaggcctacaagctcaaatggagcttacatcaatcggtactactacattccttggggatttatgtctcactggaaactagaatggtttgaagacattagtttttatctaggtatggaagtgccttatgatgctcaagaatgcaacgtgaccctaatgaggtttgatgcgaaagtcattgaggaccggggagatcacatcgacatgatgccagaggaggaggaagtgtattcatctgagtag

SEQ ID NO: 17401 - DNA, 144 bp, Glycine max
  Peptide Sequence Number=SeqID_134179
atgaccaaattaaggagtaagaacgaaaaggttttgttcttcgaaaattttgcgagaaacgtactaagcaggaccaaattgagggacttaccaggctgcaaagtgacgagaaacaagaaagggattgaggagacgaatgtctag

SEQ ID NO: 17402 - DNA, 267 bp, Glycine max
  Peptide Sequence Number=SeqID_134180
agtctctgtcagttctacggagtgtctgtcacctccagcaagggcatcaggccccttactaatcgagctttcatcaagaagtactgcgtccccaggcaggcgcagggtgaaacaccacagcagcctggggatggccgacagcgggcaacagacacaccgccatcacctctagagtttacctcagctcatccacaaaaagctcaagatgttaaagaagcgctactaggaggcaacctagtaccttttaaatctctgcttgttatttga

SEQ ID NO: 17403 - DNA, 1995 bp, Glycine max
  Peptide Sequence Number=SeqID_134181
atgttggctgggtgttctagttcgacattgttgtcaccgaggcacagattgaggagcgaagcatcagcacagtttcaagcctgccacttccagctaccttcttccatgagcacgcagagattggacctgccatgcaccaccaccaccttcactcgcaacaacaaagacaccacctcttcacgctctgttctttcagtggatcagaaaccaatcgaagccaagaccagcacctgttctctcaagcaacacattcgactcccacctctggccatcactgcagcaccatcaccattggtggaagactccatcatcaaagacaacaccaacaacaacaagagtttgaagaggctcgcggcggagcaccaagacgattccttcaccaacaacatagccaagaggaagaaaaagagtagcagcactgagtgtgattggtttcagcctgatgttgttgggactactttaggaggatttaacaataacaacaataacaacaacacttcacttgcttctttctcttcagaggaagacagggtttgttttgttccttctgaagtggtttctcattctgctcctttccctttaaacccttggctggaatcatgtgttacaaagatcacaaatttcggcgagggtagccaccgccctcaccaccaccaccacagcgaccatgcctcaggctcagtctccaacgcttcctcggagagccagagcctgaggctaaacgacaacgtttcagaacacgaagtgggaaacggttcagggaacccttattatcaccacgaggtggatacaggggaagaagacaaccaccacgggttcgagctcgtgagtttgctcaccggctgcgtcgacgccattggatcgagaaacgtcactgcaatcaaccacttcatagcaaaactgggtgatcttgcttcccccaaaggaacaacctccataagccgcatttgtgcttacttcacagaagcattagccatcagagtcacgaggctctggcctcacgttttccacatcaccaccacaaccacttctcgcgacatggtggaggacgatgaatccgctactgctatgagacttctcaaccaagtaaccccaattcccaggttccttcatttcacatcaaacgagatgttgctgagggcttttgaaggcaaagacagggttcacataatagacttcgacatcaagcaaggccttcaatggtcaggtttgttccaaagcctagcttcgaggtccaaccctccgacccacgtgagaatcactgggatcggagagtcaaaacaggacctcaacgaaactggcgagaggctcgccggtttcgctgaggccttaaacctgcccttcgagttccaccctgtggtggacagactcgaggacgtgaggctgtggatgctccacgtgaaggagcacgaaacggtggctgtgaactgcgttttgcagcttcacaagacactctacgacggaagcggaggagccttgagggacttcttgggtctaatccgcagcacaaatcccagcgttgtcgtggtggcagagcaagaagcagaacataacgaaaacaggttggagggaagggtgtgtaactcgttgaaatactactcggcattgtttgattccattgacgagagtgggcttccgcaagagagtgcggtgagggtgaaaatagaagagatgtatgctaaggagataaggaacattgttgcttgcgaaggaagggagagggtggagaggcacgagagtttcgggaactggaggaggatgatggtggagcaaggagggttcagatgcatgggtgttactgaaagagaattgagccagagccagatgctgttgaagatgtattcttgcgagagttacagtgtgaagaaacaagagaaggaaggagcaacaggagttacacttagttggttagagcaacctttgtacactgtctctgcttgggggcctgttgatgctgctgcgggtacctcgtcctcgttttctcagccaagttga

SEQ ID NO: 17404 - DNA, 237 bp, Glycine max
  Peptide Sequence Number=SeqID_134182
atggatctcaatggaaaagtcattactaatgaggataataaagagattcctgacactgttaatacacttatatttacaatagcccaacattttattgaagacccatctctttggaacgataggtctgcaaaattactatccaatcttaagcgtagaacattagcagattttaggtggtacggagataccttcctaactagagtctacaccagagaagatagtcaacaacctttctaa

SEQ ID NO: 17405 - DNA, 453 bp, Glycine max
  Peptide Sequence Number=SeqID_134183
atgtgtagtcctctaaaggtgaaggtacaggaccctctgaagccgaggacgtgtagtcctctgaagataaaggtacaggaccctctgaaggcgaggacgtgtagtcctctgaagatgagggcgtgcagccctctgaaggcgagggcatgcagccctctgaaggtgaggacgtgcagtcctctgaaggcgaggacgtgcagtcctctaaaggtgaggacgtgcagtcctctgaaggcgaggacgtgcagtcctctaaaggtgaggacgtgcagtcctctgaaggacagggtactagtacctaagggtggcgagggcgtgcagccctctaaaggtgataattcatgcaaccttatcctatcttttgctaatctctctgggaactccctcagagtgtatgttctgtttgattttgaccatttgggagtgacggcaatggagtcgtttgatgtttaa

SEQ ID NO: 17406 - DNA, 515 bp, Glycine max
  Peptide Sequence Number=SeqID_134184
atggaaagaaaagataaggagcttaggggaagcagtaatgctgaagtccccgaggaaagcgaaaaagtgcaagccttgaaagcagagcttgaaagaatgagagtggtcaaggaaaagctaaagacatcagtcaccacgattaggaaagagtgtgacaagctaggggatgtcaacatgactacggccgaagccaacaacgagctcaagcttcaaagggctgaaagggacaagtcaagggtggaaagtatgatattaaaggataaattgaaggcttgtcaaagattggaggatgagcatgcgaaggtatcaactctgcaagtggaaaaggaagcaagagaaagggtgatagaatcattgcatgaggaagctacgaaatggatggatagattcgctttcactctaaatgggagtcaagagcttccaaggctgttagccagagccaaggcaatggcagacgtatactcagctcccgaggaagttcatgggcttttcgattattgccaacacatggtcga

SEQ ID NO: 17407 - DNA, 384 bp, Glycine max
  Peptide Sequence Number=SeqID_134185
atggtgcacatcacacttacatatggaagaaaagagaagaatgtatgtaatagtgtcattaggacgctccttaacattcagggcaagatgaaagatggtttgaatactcatcaagatctatcagagatgggtatacgagccaagttacatcaaggtctgatgttgaaagcttttaagttggtagggttaaagtctcgcgattgtcacatcttgatgcaacaattgttagtcgtggccatacgaggcattttgcctgacaaagtcaggcttgccataacttggctctacttattcttcaatgccatatgtaggaaagtccttgatcttgtcatgttagatgagctggaaaacgaggatgtcattatattgtgccaattgccataa

SEQ ID NO: 17408 - DNA, 441 bp, Glycine max
  Peptide Sequence Number=SeqID_134186
atggcctcatccagtggaacatcgagcatgtccaatattcttcttcagagctctagctctgaggaggatttgcagcttctaatggaacaaagaaaaaagaagagaaagcaatcgaatcgcgaatccgcgagaagatcaaggatgcgaaagcagaagcacttggatgatctcattgcacaagtggaccacctcaagaaacaaaagagcctaaccctcatgaaagtggacatcaccacaaaacactatctcgaggttaaggctgaaaattccattctctgggcccagaagactgaactcacccaaagccttcaatcactcaatgatatcatcgatctcatcaacaccaccaacggggacaggtcaggtcaccaaagtggcatggtacttgccactgtccaatgttttggaaaaatggatgtcggtgtaagcgtaactgtgcaa

SEQ ID NO: 17409 - DNA, 1086 bp, Glycine max
  Peptide Sequence Number=SeqID_134187
ggggatattgaggaccaagttatagaagtaaaaacattagaacaagatggttccagaccgttatataagaccaactttcagaagttcgatgaagaaggaggagaggttgaggcaagactctttcagaagcttgatgaagagctcaacaaggtcaatgcattttacaaggatcaggtggaagcagcccagcatgaagtaacccttttgagtaaacaaatggaggccttggttgcactaagggtaaaggtgaaaagtccagatacagagaccatggatgaaagtcatcaacaaaaagattctatggttggacctgaagataatcctcttcaacaggccaatagaaatactcattatgaggagcaagcagaagaaaacaataattacatcacaaaagatcccttggaaatcctacagcacgtaaaggttgataatgttcctcaatctccaatatcaacaattaaaaaagcttttactgattccagtgataatgaattgagcttcagcaaagaagagctgagaaaagttaaagagcaactgagacttgtgtttgttgagttctatcagaaactcctccatctcaaagattacagttttatgaacctctcagcattttccaagatcatgaagaagtacgaaaagcatacatcaagggcagcatttgcagcatacatgacagtagtggataactcctatgtgggcagttctgatgaggttgcacagcaaacaccaacaaccgtgacagagaatgaagcaaccgaggtaaccaagattgaggaaactaccccagaacaaccagctacccgggttactaccaccgaagaaccaaaggaagaaaccaccaaagaagcaaaagaggaagaagccccagttgagactaatgaggcaacagaagtgatagaggaagtgaagcctgaggtagaagagaacccagcaccagagagaacagaagaagaagaagtgaaagaggagactaaagaaaccgaatcagcaccagtggaggaacagaagcaagaggagaacaaaccagctgaaaccgttgaggaaaccaaaacagaacaagtttctgttgagaagactgaagcttaa

SEQ ID NO: 17410 - DNA, 321 bp, Glycine max
  Peptide Sequence Number=SeqID_134188
atgatacaaagccccattcacaatgaaattgtgaaagtgaaagaccttctgcgtggaaaccctaacggaagtggaaatagaaatctggtggaaacggtgtcgtacgagagcgacgacgttgacgattctgtaaaggatggaaaggaggtggaagatgcgatcctgccagagcggggagctgttgatgtcccgctaccaattggaggattccgtcaagtcaagggcggcaatagccaccaccaccatcgccggcatacatctcgccaccatgaaatcgctgaatggaatattctaaggaggttttcaataaccgtcttataa

SEQ ID NO: 17411 - DNA, 261 bp, Glycine max
  Peptide Sequence Number=SeqID_134189
atgggtgtcaaatgcctcgaagtggtcaaacgagggtcgcatcccaacaacagatggtccccggacgaaattaggacgcagaatgaccataatttgtctctgcgttttgttggacacgatcgagcctgggcagcgagacacagaatgaccataatttgtctctgcgtgccaccggacacgatcacctctggatggcgaaaaggtgcgcggaatgaccataatttgtctccgccaacctctcgacttactgtccctgaatga

SEQ ID NO: 17412 - DNA, 598 bp, Glycine max
  Peptide Sequence Number=SeqID_134190
atggctgatgccaagtttgcggggctgcttggtcttggcaagccgttggttgaaattttgccccccggtcaacttcgtggtttttgcccgttgttggcttggctagggtcggcggtgctggggattttgccaacttttggcttgcgcccccgttggctaagtctgtgcctcggtggtggatcatcatgtcataacatggcaaagacacaaggcaggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 17413 - DNA, 147 bp, Glycine max
  Peptide Sequence Number=SeqID_134191
atggcaatcaattcatggggctccggacttgatggtggaggacgcacgaacagcgctagggctccgaataagatttgtggaggatgcacgaacagcgctaggcaatcaatttgtggggctccggactcggtggtggaggatgcatga

SEQ ID NO: 17414 - DNA, 1024 bp, Glycine max
  Peptide Sequence Number=SeqID_134192
atgggatcaagtcaaacgccttcgctaaaaaagaggttctatcaagtcaaggtcatgagcctaggaatcaccagtctaaaagagctagggcaattgattggtcagctccaatggcaagctttttgcaaagcttatggtaaaatctgggacctagccatggcagaagtctccacagaggccattgcctccctcgcccagtattatgatcagccgttgagatgcttcacttttggggacttccagctatcacccatggtggaagaatttgaagagatcctaggatgtcctctagggggaaggagaccatacctcttctcagggttctatccctcattagctagaatttctaagatagtccaaatctcggcacaggaattagaccacagaaagcaagtcgaaaatggggtggttggaataccgagaaaatgtttgggggcaaaagcaagaatcttggcaggtagaggcgaatgggccccgttcatatacatttttgcactgttgatcttcggaggagtcctctttccaaatgtggatggattggtggacctagcagtgatcgacgcttttctcgcctatcatgaccacaaggaaagcccggtgaggcatgcttgcccgctagaaagccaccattcatgcacaaagaaaggaggggcaaattgggaccgactcttagcaaacgaagaagaagcgtctatcaacaggttccctcaatggaaagaaggaagaacctgggttcttatttcgtgcagaggatttccgaatgttcccttgatagggacaaggggttgcatcagttacaatcccgttcttgctataaggaaacttggctaccctataagaggggcaccactagaggaagagctcgcgcctatcatttcacgaggtttcaataagaccaacgtggagacacttcagaaggtccgcaaggcatgggaggtggtgcaaaagaaggacaaagaactcaggggcagtaacaatgggcccatcggtggctaccgtaagttgttgaaagcccacgtgcaag

SEQ ID NO: 17415 - DNA, 423 bp, Glycine max
  Peptide Sequence Number=SeqID_134193
atggaagcaaatcggccccaatgcgtcctctatttcaggataattttgatgaatactcccagcgcagcgcttagccactggcaggcgttacatgctcagagcattgctatgctaaatcttgcacattctggtcaatgggatgcgcttatcgagcaggaaatgcattacgtacaactggtggaaaggatttctcaaacgcccatcatgtcatgccctccggctcaggttgagcaagcgcgtgcgctgctggaaatgatcctcgaaaatgagaatgcgctaaaggcgttgctgaaagtccgcatggacgagctgcgcagcctgattgatcaaaccggtaaacagcaatccatcacgtctacctatggaaagctgtcagggaatattctttatccagaaagtttgacccgcgacacacaattatga

SEQ ID NO: 17416 - DNA, 273 bp, Glycine max
  Peptide Sequence Number=SeqID_134194
atgtcaaattcaatgcctgcacccaatccttgggggcaaactcagaccgcaaacaatagtacatctgttgccgagatatccagtgtgccaagattcatgggctgggtggagattcagctctctgggatatcagcatcatctggtgttgatgatggagaaatgggcaccttgcttccccatcctttttctgttgaagtggagattcacttgctcatttcccttattagtgccatatatatgaatatgaccttacaactttctggttctacctag

SEQ ID NO: 17417 - DNA, 357 bp, Glycine max
  Peptide Sequence Number=SeqID_134195
atgactatgcttccaactattggcgagactctattgtggcaaaaatttagagatgttgatgttgatcaacgatctcacaagcctatagaacggtcattccctttgggattttcatggcacccgatggcacaactggggtttatgaactggatgcatatgtcggtgaatggtgtccatggagggtgctctgattgtgcgagccttaaagtgtgtctcatggtcgtgaggaggaacattgatttggggaaaaggggagtgaagaaggtggcatttttggcgatggtgtgtggtgacaagtcactggagacaatagaggagttgctagagtggaagggagaaataggtgctggagaggaa

SEQ ID NO: 17418 - DNA, 762 bp, Glycine max
  Peptide Sequence Number=SeqID_134196
atggtgcttttgggactagttggactatcctccataggaatatcttcccataattgtgttgattacacctctgatttactaggtcttgctccttcttggtggttctccggcctcttaacaaatcaagctaagtacctagcttgttatttggttgcatctaaccccaggccgagaggtttcgtcgggtgtagcctgatgggtacctccaagttgaaagcttcctccagaattgtaatgcgattggccattagagtaagtcttggtgcttccttctcacttgtcacgcttctgtctggcttgtctgagttcattcctaaatctggacatttcttccatctaaatgtagcccttggctcgttcacgcaactcatccatgctatcgcagggcgaggagcatggaatgcaacactacctctaggtcgccgaggtcatgcaatgagatttgctaatcgcatgtttcgcgctgaagcatttgacaagggtatcaaagctatctatggatcttggtgggaatccaccatactagctcaattcaagaaggcatccaagtactcatctggatctatggtcccatcatacggctcaaggttgagtggtttccaccccaaggtcatctgcagtgttaattgtgcatcgggggtgccattccctttgggtgtgctcaagcaatgtgtgagcggagtgttcttcgccctaggggcgatgggagtcttcgaaaggagtctcgcatttgaggccagaccgagtgctatccatggatga

SEQ ID NO: 17419 - DNA, 369 bp, Glycine max
  Peptide Sequence Number=SeqID_134197
atggtgtccaaggtcctcatcgacctgggcaattccactgatatcctatattggaaaactttccaaagactcgaggtttccctcgacactgtccctcttcacggtggtccactcctcgactttgcagacgagagagtagacaccagaggctccgtgaacttaatgaccatcttcgatcaaggaaagctctctaggagcttcaccatacgatatctactttttgatgcagacacatcatatttcgctttgatcggcagaaagacacttaacgagcctagagccatattctccacgcctcatttgaaaatgaagtaccctaccctggctgaggagattataaccgtcacggccgaccaaaagcaagcatga

SEQ ID NO: 17420 - DNA, 1464 bp, Glycine max
  Peptide Sequence Number=SeqID_134198
atggcgccatggtatgggcgcgtccgcgcgggacatagcccgtcgcgatcgttcgcgcggccggtggcggcgtcagccggcgatctgcacgccgatccagaacaggcccgccgccagcagcatcgaggcgggcagggtcaggacccaggccagcaggatgttgcgcaccgtgccgccctgcaggccgctcttgttggcgatcatggtgcccgccacgcccgaggacagcacgtgggtggtggagaccggcaggctgaagacgttggccaggccgatggccccgaccgcggtgagctgcgccgacatgccttgcgcgtaggtcatgccctgcttgccgatcttctcgcccaccgtcagcaccacgcggcgccagccgaccatggtgccggcgcccagcgccagcgccaccgccacgatcacccagaagggcgcgtattcggtggtggcggtcaggtcggcgcgcaggcgctgcaggtcggtgcgttcacgcgccggcaggccctcgatgcgcgccaccttcttggcggtgtcgtccaggcacagcaggtagcggcgcacgtcgatgcgcttggcggcggacaggtcggcgtagttgctgacgccgcgcaggtcggcctgcagcgcgtcgatggtggccagggtcagttgcgggtcgcagcggaaattgcgcggcaggtccgaggcggagccggcgcgcttgagcgccaggaagtcgcccagcatggcttcgttgcgctggtagaaagcgctcaggtgggtggcggcgtcgcgggtgcgctcgatctggtaggtggtgctgttggtgtccagcacgaagttggccggcacgatgccgatcagcaccagcatgatcaggccgatgcctttctggccatcgttcgagccgtgcacgaagctcacgcccatggccgacagcaccagcaccaggcggttccagaacggcggatgtttcttgttgtcgatggcgcggcgctgttccggcgtcttgtgcatcttcgacagcggcagccagcgcttgagcgccagcagcaggccgccggccaccaggaatccggccaccggcgacaccaccagcgaggcgccgatgtcgatcgccttgccccagttcacgccatcggccagcggcaggtcggtgatcagcgcgttggccaggcccacgcccaggatcgagccgatcagcgtgtgcgagctggaggccgggatgccgaaataccaggtgcccaggttccaggctatggttgcggccagcatggccaacaccatggccagcccgcgtccggtatcaacgttgatcagcagttcgaccggcagcaggtggacgatggcatatgccacgcccacgccgcccagcatcacgccgatgaagttgataatgcccgagagcacctccgccaggtggggcggcatggccttggagtagatgaccgtctcgacggcgatcgccgttggcgtggaatgcattga

SEQ ID NO: 17421 - DNA, 246 bp, Glycine max
  Peptide Sequence Number=SeqID_134199
atgaggatgaggaaatggaggaaggaattggagtatcctaagccttggagtgtcgttggcttctactcgaagaacccttgcacttctttgatggttccgccagttgagacacttattagaaatttcaatcggttaaaatggaagaggatgaaaaaagatgaattttgggctttgtgggacgtgatttggataagaaatgataatcgattaccagagagctttttaggagaactaagtgatgaatga

SEQ ID NO: 17422 - DNA, 276 bp, Glycine max
  Peptide Sequence Number=SeqID_134200
atggtgtaccatttgaaggacgcaccagcacaagccgcagaagaccattctccatcaccacctcctcagagagatgattcttcatctcttatgcacaacattcttgacagattggatggactccacaccttcttcggtgagcgctttgactcattggacaactgcattgatgccattgatgcacggtttgcaggaatggatacacgcatcactcagcttgaggaggatatgagttatgttcgtcagtgctttgaccttccaccaccatcctcatag

SEQ ID NO: 17423 - DNA, 348 bp, Glycine max
  Peptide Sequence Number=SeqID_134201
atggttaaggatgtctcctccacctctagaaccctaaaatcactcctaaaacctaaactctcttggaagctgaggctttgctctatttttggtctctctagggcatctaagacagatcctcttctatggttttccaacgcgctaagtaggctgacttccttgcctagcggatgtcactcgctaagcgcatatgcgtcgcttagcgagacaccagctgctagcactattagaaaatacactttcaacatcggttatttagaacattctacatcggttctaaaaccgatgttgaaagtgccgatgttgaatgtatcaatgttaacatcggttttggagaatcgatgttaa

SEQ ID NO: 17424 - DNA, 609 bp, Glycine max
  Peptide Sequence Number=SeqID_134202
atggatggtacgattcactctgaggtgcatggtatttatatgatcattgatcaatctctattctttttattaactaaattacccagtcaaggtgcaccttttgagggcaccattgttgatgactggaagtttgattattctagtcatgatactcgttgtatggtctgtaatgaccaggctgatatgactggtagattgcttgccggatcattaacctttgattgccgcatcatgcattacatcatagttagaatttcatttccccgttcttctaacctggctcaagcttccgaggaggacttgattttgatttgggctttccttgccggtcgtcagatcgactgggttcacttggttaggtaccaaatgcataaggcattacaaaccaatgcacctcttccgtatcctcagctagtcactcatttccttcatcattttcaaatttctcttgatgatgaaccttttgttcaagttaagagatcttttgccattggtgctagtgcggtagcgacttttgggtaccataaggatatggatggacagtggcttaggaaacaagatgtacaacaatcaatccctaatgagtgcactccgtcacctccgccatag

SEQ ID NO: 17425 - DNA, 988 bp, Glycine max
  Peptide Sequence Number=SeqID_134203
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcccccttgaaatcgtcgacggtcagctcattagtgcgcccctttcggacgatctcctcgtaagctcgccagaaatcaaggaagtccatctgctcggcgcccttgatagcaggcacaaccagcttgcgcgatccatccgaggcaacgacgtcgatggccatgccgaggttgatctgatggttttcgatgaggtgcggtttaccgtcaatctcggcatatgcattgttcatggcgggcaccgttttgagggcctggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 17426 - DNA, 501 bp, Glycine max
  Peptide Sequence Number=SeqID_134204
atgtcgtatttgttgatcagtaaaaacatccataacttaattgaaaatgatccatcaactttagtgtcaaccttgatagcacacatcaaaagcattgatgtatacaccaccacgtaccgcaaagtattgttggcaaagcaaaaggctattgaagacatctacgacaacaaggaaagatcgtaccatgatctaccaatattattgcaagttatgcaacaatttcttactggtatggtagtagagaaggagataagccacaacaatacttgcatttggccaagtggattgcttggagaattgtgcaacgaagcctattggtcaccgcatcacgagtcaatgatctttcctgacccagaaaagaaaaaaatatccgaaaaacgagtcaagcgaagtggtgtttcatgtgccgcattgcaagtcattcaaagaaaaattgctctcgtcgtgttggctcaagctaataacaatgttgaatgtatgtcatattgtttgtatttgtaa

SEQ ID NO: 17427 - DNA, 246 bp, Glycine max
  Peptide Sequence Number=SeqID_134205
atgccctctccagatcctagaattgaacctttgtcggttcagtctggtttttcaaatgttgcagagctcggacaagttaaaatcggtggtgctttagtggctgctttggttgaaaggtggagacctgagtcacacacatttcatcttcctattggcgaatacacaatcaccttggaagatgttgttctacaactaggtttacgcattgatggtagaccagttactatcccaacatattatgattga

SEQ ID NO: 17428 - DNA, 458 bp, Glycine max
  Peptide Sequence Number=SeqID_134206
cagcctcagcatctcaggcccactatgatagatcgagattcacatcccaagaggcctgggattgctattctgacattgtgattggcaagaagattcttcctgagaggaatgtaatgatatatcatacagaatttgatgaattcaagactaagttggaaagaaggaattggcacaaggagctgaccaattttctagatgggagcaacgatgtagctttagtgaaggagttttatgctaatttgtatgaccttgaagataaatctcctaagcaaggtacatcctttgtggtacaagtagagggtacatctacttgggttgttgtgactgagaacaagagagggtacatctcctgtggatcagttctagtggagggtacatccactaggttgttcaaagagaacaagggagggtacatcccttgtggatgtttgcttgtaaaaggatttttacaaggttga

SEQ ID NO: 17429 - DNA, 426 bp, Glycine max
  Peptide Sequence Number=SeqID_134207
atgggggcatattctagggatgagaagctgttaatgcatttcttccaagaaagtttggccagagcggtggtcacctggtataccaatttggaggcttctcgtatttgctcatggaaggacttgattactgccttcattaggcagtaccaatacaatactgacatggctctggacaaaactcagctacagaatatgagcaagcgggagcatgaatcctttaaggagtatgcccaatggtggagggacttggcagcacaagtgttggtgggctacatgccctatagcttcgcaaatttagtatttgcgggcaagaggatcgaagtaggcttgaaaagagggaagttcgattatgtcgctcctgctggcatgaacaataggagattcaaggcaagtggggcaaagaagaaggaaggagatgcccacacc

SEQ ID NO: 17430 - DNA, 347 bp, Glycine max
  Peptide Sequence Number=SeqID_134208
taccccgggaccacactctagctgactctgagccttgccccggatatgctattgaggggaaagcagttggtgtcccttctgccatggtggaaagggaggaatttgatcatatagaggaaagactgagagctattgaaggaggcagagattatgcctttgttgacatggcaaagttgtgcctagtgctcgacatggtcattccttcgaagttcaaggtgccggactttgataagtacaaggggactacttgccccaaaaatcacttgaagatctcaagtagcgcccccaatgatggagaagaagatgataacaatgatagtagacacgttactggtgttctactatga

SEQ ID NO: 17431 - DNA, 246 bp, Glycine max
  Peptide Sequence Number=SeqID_134209
atgcggggttaccctatgtttaccctcaccttttgtcaaccaggggcaatcgagtcccttgacgtgcggagactgacatcgtcttctgcaccttttatcgtcctgaccatgaagtcaggtgacatgcggggttacattatggttacccgcacctttcgtcaactaggggaaaacgagctcgttgatgctcgaagactaacatcgtcatctgcaccttttgtcgtcctgacccgtgaagtcaggtga

SEQ ID NO: 17432 - DNA, 528 bp, Glycine max
  Peptide Sequence Number=SeqID_134210
atgatcctagattttaagagaggtgaggactatattgaggttctttgtggcgctacaaacaaaaaatatggagattatgttgggaggctaaaaattaataacgaaggtcaatatttcatcacttgtgagtgttgccctgagtgtcccttggtgaatgtcactctagaagcatttgagaaacatgctttaagggaagggagtagaaggtggaagagaaacatctgggttcattgcaaagatgaagacaaagttccactctggaagacacctctgataaaatattacacacacctggcaaatgtggctaaccggaaagactctacaatgaggaaacaaaactttcacagggatgagttcctgcgttgcacgagatgcgggaaggagcgcaggttccatctcaagagcagaccagacattaagaactaccatgatgctttaaacaacaaatgctggacttgttctctttggccttatcaaaagttaggttctcaatcccaactcaagcatgatattcaagttcatgcatga

SEQ ID NO: 17433 - DNA, 219 bp, Glycine max
  Peptide Sequence Number=SeqID_134211
atggcgagtccgatgacatgcagggagacggcgagtccgatgacatgcgggggtgccttatggttatccgcatctttcgtcaacaaaggcgaacgagtccgaagatatcggggtgatgttggtcgtctgattctgattgttttgaaaatctttgcaggtcttactttcgtcctccagagacattcaagtccaatgacgtgcaagattcttctccactag

SEQ ID NO: 17434 - DNA, 603 bp, Glycine max
  Peptide Sequence Number=SeqID_134212
atggacggggtgctgattgatgcccgggaatggcattaccgggcactgaaccaggctctggcctgcttcgggcgagcaagcacccgtgaagagcacgaggggggattcgatggcctgcccacccgggacaaactgcaccgtctgagcgaacggtacggtcttccggtcagcctgcactcgttcatcaatgagctgaaacagcagtacaccctgcgggaaatctggcagcactgctggccggtttttgcccatcaatatgcgctggcccgcctgaagcgcgagggttaccggaccgcggtggcgtcaaactccatacggcaaagtattgaaaccatgctgggtcaggcgaaactgctggagcttatcgagttttacctgtcgaacgaagacgtctcccgcggcaaaccggatccggaaatctaccagaaagcgatacagcgactggctttgcagccaaaggaatgcgtgattgtggaagacaaccctcatggtattgccgccgcccgggcggccggcgcccacgtactaaccgtcagccatccacgcgacgtcacctgggaacggatcaatcaatttattcaacactgcgaggacataccatga

SEQ ID NO: 17435 - DNA, 780 bp, Glycine max
  Peptide Sequence Number=SeqID_134213
atggcaattccattcaagacaaaagatgtcaacgaggaagtaacctctaaggacattaaaagcctaatggaacaggcaaattataccaataaatacttacaagctttaggagaaaccattaaaactaaagtagttcctaaacaaaaatcaattgagggagcttcgccaagtgtccccattgaaattgaaaaacctttattcaaacctttcaaagttagtgagaaggctaaacgaaaaattagggaacttagaaaaactaaatccttaactgagggcgtaggtgacaatcatagtgaattactaaacaagattggtagtttacttaaggtcatttcagatactccccaagcctcggaaaatacttccaaaatggtaacaagaaatgcacaaacggagtataacatcatgaatacactccaacatatgaccatggtagccacgacttaccaaacctcccatgaatgttcagaagaaaccattatagacatcttagtggcaggattttctggacaactgaaaggatggtgggataattatctcactaacgaagaaaagtcaaaaatttacagcgcacttaagacagatctcaatggaaaagtcattactaatgatgatgataaagacattcctgacgctgttaacacattaatttttacaatagcccaacatttcattggagacccatccttgtggaaagataggtctgcagaattattatcaaatcttaagtgtagaaccttagcagattttacagtggtacagagatactttcctaactag

SEQ ID NO: 17436 - DNA, 191 bp, Glycine max
  Peptide Sequence Number=SeqID_134214
atggggacacttggcgaagctccctcaattgatttttgtttaggaactactttagttttaatggtttctcctaaagcttttgatgttgtgttgtgggaggtaattccgattggattaactcaccatccttcacttgccagttttgttatgacatttgttgttggatcacctatgatgtcttgtttccaagg

SEQ ID NO: 17437 - DNA, 891 bp, Glycine max
  Peptide Sequence Number=SeqID_134215
atggataggttgacgaccatgatgagtgcactcctgtcagcccagaactctcaagctgccgccgctactgtagagcagcccttggtgagcacaaccccgctatctacggtgacttctccacccctctttttgcctccaggttgtacatggggaatgccacctccagtctgtggaagcccccagcccgctgtatctgaagttccacctccttttgctcagcagtcagcaccggttccgcaacccagtacctctttccctcaagctgcaatgacttattcagctccactgattcacactattcaacaagaggttgaaccaattttccaagctgaaaatgttgtagccttcgacaagatggaagaactccaagaaagatttgatggtatgcaaagggaagtcgaagccctccgaggaagagatctgttcgggaaggacgcctgtgaattatgcttggtcccaaatgttactatccctcacaagttcaaggtgccagacttcgagaagtataaagggaactcttgtccccgcagtcacttggtgatgtacgcgcggaaaatgtccatgtatactgacaatcataagctgcttattcatttctttcaggacagcctgactggggccgctctgaagtggtatatgaatttggacagcgcgagcattcgtactttcaatgacctgggtgaagcgttcatccggcagtataagtacaatctggacatggccccagatcgtgatcaactccgtgcgatgacacaaaaagagaaggaaacattcaaggagtatgcccagcattggagggaagtggctgcccagattgtcccgccgttggaagaaagggaaatgaccaaaatatttctgaagaccctgaaccagttttattacgagaaaatg

SEQ ID NO: 17438 - DNA, 723 bp, Glycine max
  Peptide Sequence Number=SeqID_134216
atggagcgcctgcgcgagcgcatgttactgctgtttccggtgctgtcctcgatcgccgaccgcctgagtgcgttgctcagcgatggccaggcgttgccggaaggcctgccggtgctggtcgatgacatccgcgactggctggacgggcccaccaacgccagcgagtatgcccgcctgcgcgcgcgcatcagcgcactgaagccgcaggtggaccgcgacctgcagcacctgcagctggccagcctgctgctgcgcctggaagaactggtggacctgtggcaggactgccgcaccctgcagcatgccatcgaccacggcaccgcgccgatggaccgcgcgcactaccgcatccgcaccgaacgggtggccgccgacaagcacgtcgactacggcatggcgctgttctccgcgctcagtgccggcgtggcgctgatgagctactgcgtgctgtggatcgcgctgggatgggaaggcggcggcaacggcgcgatgatggccgcggtgaccgccgcgttcttcgccgcacaggacgatccggcaccgagcatggtgtcgttcctggtgtgggcgatggtcgcctcggtggtggccggcgtgtacctgttcggcgtgttcccggccgtgcacgactttggcctgctggcactggtgctggcggtggcgttcctgcccctggggctgatgctgcaccaccccaagagcgcgtgttcgcgctgccgctga

SEQ ID NO: 17439 - DNA, 330 bp, Glycine max
  Peptide Sequence Number=SeqID_134217
atggggtttccattgaaaggggagaccatggaattcttcaatgctcaaaggagaaaccaattgtttgaagagtttgttcatcctcgcattctgaagcatgggaagattttcagaacaaggatcatggggtctccaactgtggttgtgaatggagctgaggccaataaattcttgttatctaatgagttcaagttggtgaaaagctcttggccttcttcctcagttgagctcatgggaagggactctatcatggagaaagatggggcaaggcaccgattcctccgtggtgttattggcacaagccttggttatgctggacttgagctgcta

SEQ ID NO: 17440 - DNA, 213 bp, Glycine max
  Peptide Sequence Number=SeqID_134218
atggtggctgtgggtgacggagaaagtgcttgggacgttagaaatggctttggaagaaagaaagaagaagaaatagtgttttttctaagctacacgaaagcaaaggctgaaaatgttcaagtgagaaatggtctcggacacagaaatgttgcgcacactccagacatcttctcgaagatcccaacggttagatcatggacaagtgtcttgtga

SEQ ID NO: 17441 - DNA, 693 bp, Glycine max
  Peptide Sequence Number=SeqID_134219
atggtctatgctaactctgaggggcaacataaacatgatccttcggtaaaatatggtatagatccacacgcttgggatgaatttgctgcaagccgtaaaaaccctaattggcaagactcaatggaaaaacagacgacacagggtacgtttgtcccccatggtcgtgacaacatacttaacactgccattgggcgaccagattatggaggtcgtgttcgtgcagcggggtctggggaggccatcataatggagatgtcacaaaggggatcgcaaatctcatcacctattgaaccaaatatacatgtgttaggtgcacgagtcaacacaaaggggagcaatgctgaagttgttgtgaacccatctggggaagaccatgttgctcatgtgatatcgactatggggttatatgtccatcgtcaagattctacagatgttgacaaagttattaacggtgacgttgaagtcctgttgcctacattagaaattaagtatgtcagacagacccttggcatattcattgcaaggccaacaccgcttgtaaaactcgtattagatgaggtttcagccattagtccaaataaagtgattaaagtttttcaaccggtgaatgatgttgctgtagatgaccccttgcgtgagttgatcaagagtctggttgatatttatgagaagcctattcagttggtgtgggat

SEQ ID NO: 17442 - DNA, 247 bp, Glycine max
  Peptide Sequence Number=SeqID_134220
atggcattcttgggagagacaagtagtcatacaattgtgaactccacattaggttttatttttccaaatagatccattgttcacaacgacaatggtgtttcctttcaagcttccactccagttcccattcgagcacctaacagttgtgattttcaaatgttaaaaaccagaatacacaatacccttaagctaaccaacaagcaatttttggatgaaatttactaccggcaacctttcacatatgcag

SEQ ID NO: 17443 - DNA, 327 bp, Glycine max
  Peptide Sequence Number=SeqID_134221
atggagaaagatgaaggcccagaggcaaaggcactatcaagacagttaatgttgctgaaggcacaaactaatttgaaggcccaaacttatcaaggtaatcctggtggcgtataccctggggtatcttccgtcactggaagtgaagtctatccagacttatcttccttcactggaagtggcgtcttcccaggcttatcttccttcactggaagtggcgtctcccctgacttatcttccttcactggaagtggagtcatccaaaccttcgtagcctgtaacaaacgatccactcctactcaggttcacatcacactatataattgttag

SEQ ID NO: 17444 - DNA, 288 bp, Glycine max
  Peptide Sequence Number=SeqID_134222
atgaccaagatctttgtgctgttatgtctgctcttcttagcttcttctgggtttgtccatggctcttctaagaaggatcatattaggttatttgagctcaagaaaggtgatttttctataaaggtcaccaattggggtgcaacacttgtgtccgtaatacttcccgataagaatgggaagttgggtgatattgttcttggatatgattctcccaaggcatacacaataaggataaagcttttcaataatatattcaatgctcttcaacttgaattgattcacacatga

SEQ ID NO: 17445 - DNA, 1335 bp, Glycine max
  Peptide Sequence Number=SeqID_134223
atggaagcgttttacacaactctctcctcccctgcttccacgtctgttctcaattttcagggctctgaattgcctagaagaaagctttgtaagaaatcttcacacactattttggcatcacctacgctgcctaaaccatttcttcagatttatggtagacctcagacattgctttataggtcaaccagactctcttctggagcacatagagtaacaatatcagctgaagctggcagacaaaattgggattttggaagatttgtaaaaacactgttcttcttcaatgggttcccatctcctgctaagttctttgattttctagttgagaaactatctgatccttccccaagtgaagtggttaacacaatgggaacttctgatattgtcctggtagctggagccactggtggcgttggtcgaagggtggttgacatattacggaagaaaggaattccagtccgagtattggttagaaatgaagagaaagcaagaaggatgttaggctcagatgttgatttggtcattggagacattacaaaagatagcactttgatccctgaatactttaaaggcgtgaagaaagtgattaatgctgcttctgtcattgttggccccaaggaaggagacactccagacagagcaaaatacagccaaggaattaagttctttgagccagagataaaaggtgactcaccagaaaaggtagagtacataggaatgagaaatttgatcaaggccgtgaaggacaatcttggacttcgaagagaaaagctattatttggatttgaaggcaataattacaggcagcttccttggggtgctttagatgatgtggtgatgggtggagttagtgaaagtacatttcaaattgacccaagtgggggtgaaaatggtggaccaactgggatttttaaaggtgttgtttctacagcaaacaatggtggctttacaagtatcagaactaagcctctttgcatatgcaagggtaaggctgcgtacaatatccctcccccataccttcgcatagtgaagagcctctcggcaatggggagagttttcacaattggttttcagaatttctcagaacctgaaaatctttctgcatatgatggtttggagttccgcctaaaaggtgatgggcgtagatataaaattattgttcgcacaagcagtgattgggatgctcttggttacactgcaggttttgacactgagaaaggaaaatggcaatcaattcgagtgccattttcttccttgaggcctgtatttcgagcaagaactgtgtctgatgctccaccatttgatccaagcattgttgtatcattacaggcatga

SEQ ID NO: 17446 - DNA, 291 bp, Glycine max
  Peptide Sequence Number=SeqID_134224
atggcacgacctagcacgttgctgctcctgttgatgcttctcttgtcttcattttgctcgctttttgaagccagaaaacttgttctagagaagcagcagaagaaggaaaacccatcttcaagaagggacagtttgtttctgagtgcacttcctaagggcaccgtgccaccttcttcaccaagcaaaaaaggacactctatggaggttgatgagaagctcatagcacgacacctcatagccatcgatcgagttcttctaagatctgtccctagccctggtgttggccactaa

SEQ ID NO: 17447 - DNA, 180 bp, Glycine max
  Peptide Sequence Number=SeqID_134225
atggcaacgatagagatggtgtcaaagaggaaggggtggttggagactatgaaggaagaagggttagcaagaaagaaagcaaaacaatgccaatacaaagccgagtgcattgtagaagtactggtggactgccaaaacaaacacattggcagacataaatgtgggagttgggattggtaa

SEQ ID NO: 17448 - DNA, 315 bp, Glycine max
  Peptide Sequence Number=SeqID_134226
atggccaacaaaaacatatcatccaatgaaacatacccccccgcacttattcccaaaacaattccaaagctccaaaattccttaagggtaggaaaggggaacataggctcaaaggggctagcaaaggaattaattcaaggtaggctcatttggccagaggcttataagaacaaaatgcctaaatcatctcccaacatgcatgtgaagcaagaagtatcaacaagagtcaagccaaggctattgtgcaagcaatcaatggggcaaaacacaccgaataaaatagatgatgatggctcaaattctcaccaagggtaa

SEQ ID NO: 17449 - DNA, 759 bp, Glycine max
  Peptide Sequence Number=SeqID_134227
gtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatgaggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 17450 - DNA, 438 bp, Glycine max
  Peptide Sequence Number=SeqID_134228
atgaggatatatgtttcattcgtttctgaatttttagaaacaatttacatatcattaacgaataatcgatggatgacaccaaaaagcactagcgaaattcggcttatgagagcagcacgaaaagcaatgacaaccagccgggatgaacgcgcaaaggctcttaaggaaacgagagaactaatggagagaatagaagaagagattaagggaaagaaatatttcggaggggacaatatagggttccttgacattgcactcggatggatctcttactggcttcctgttgtggaggaagttggatcgatgcacataatagacccattgaaatttccagccatcacttcatggatgaccaattttctcagccaccgtgtgatcaaagacaatttgcccccaagagataagatgcttgtttactaccgcaactttgttaattaa

SEQ ID NO: 17451 - DNA, 459 bp, Glycine max
  Peptide Sequence Number=SeqID_134229
atgattttctgggcattttcaatatacttggaggcagttgcaatattaccccagttggttttgttgcaaaggagtggaaatgtggacaatttgactgggcaatacatattctttcttggtgcatatcgtgcattttacatcctgaactggatataccgctatctgactgagccacattttactagatggatagcttgtgtctcaggtgttgttcagacagctttgtatgcagatttcttctactattacttcatcaggagctttgttttgcagctggaagaacaattcgaaactgaagttgcctgcctgaattatctcaagttgttttggaatttagacctgtgtgaccagtcaccgctaaattttacagagcgtcgtggtttggatgatgttagttttgagagtaacgagacaaggctaactcctctccctgttcatgagtggggtaaaggtgactaa

SEQ ID NO: 17452 - DNA, 399 bp, Glycine max
  Peptide Sequence Number=SeqID_134230
atgggagctattgtttccattaccagaaattttgaggaatacccaattacccgacaactatgtctcatgtttcgcagcaattgcagaatggacgagtgccacaaaaggcaagatggggcaaaggacgaatgtgaagagcctcaggagttgcaacttggtggaatcagtgcggtctctgaacccatgagctcaattttggatcaaataatgatggctctggagcaaccacatatcaacattctaggggtgtatggatcaagtaatgagagaaagcgcaacgtggtgaagaaaatcaccaggagaattcagagggacaagctgtttgatgaggttgtgatggcaagtgtgatgaaaaagccagacttgcaactccatgagaagggctacgcgtttgtgtga

SEQ ID NO: 17453 - DNA, 957 bp, Glycine max
  Peptide Sequence Number=SeqID_134231
atgaggatcatgcaagaatctcaatctttcattattcccaccacaattctactactagcactatgctacaccacttcaggccaactctcaccaattcaaccccccacaacatcaccatcactcccatcaccaccactatcccaaccctccccgccgtctccggcactccactccccgccggcaaccgcgccggcgccggggttcaacactgtccctcttgtcccagtaaccccaagtggggcccccacacccaccaccatcatccctaagggccccaccattgacatagtccaaatcctaagaaaagccaaaaggttctcagtcctcactcgccttctcaaaaccacacaactcataaaccaactcaactcacagctcgtaacttcaagctcaggagggttaaccctatttgcacccgaagacagtgccttctccaaactcaaagcagggttcctcaactccctcactgatagacagaaggtggagctcttacagttccacactctctcttccgtcatttccatctcaaactttgataccctcacgaacccggttcagacgcaggccggtgatgaccctcagaggctgcaacttaacgtcaccacttacggcggcagccaggtcagcatggccaccggcgccgtcaacgcctccgtcaccggcaccgtttactccgacaacaagttggccatataccaggtggacaaggtgcttctccctcttgacctagtgcttcccagcaaggcgccggcgccgtcaccggcgttggcgagaaagggtttgccgaaggctgataaagggaattccacggcggcggacgatggcactgttgacggcaacgatgacagcgacgggaaggccttgccggcgggtgtttctgcagggtgtacgatgaagtgggtgaataacgttgttgttgtaggagtggtgggtttggtgggtggtgttttgatgtaa

SEQ ID NO: 17454 - DNA, 1074 bp, Glycine max
  Peptide Sequence Number=SeqID_134232
atgtcaagagtaatgagagataacttgtttgatcttactgtgatggcaattgttacagaaaagccagacatgaagcagattcagggagtgctagcttgggaacaagttagatttaaatttggtgaggagattgtgattgaaagagctaaacttctgagtgaaaggataaagaaacagaagaggatccttttcttccttgatgatctttctgctggaattgacttggacagagtaggaatcccatttggaactgaccatacgggtttcaaaatagttttgttctcggggtgtccagagtcaccagctgcagcccctaaagccccagcaaaacctgcccctgccacaccggctccagcgccggcaaaacctttagtcccttcattaccccagtcaccatcttcaggtgttgattcttctggaagccaagacattgtgaagatcctaaggaaggccaagtcattcaacactctaatccggttgctgaaaacaacccaaatcatcaaccaagtgaatgcacaacttgtgacctcgaaaaacggaggcttaaccatccttgcaccagatgatggagcattttcagaactgaaagcagggtacttcaactccctgggagaccggcaacaaaaggcactgattcagtatcatgttcttcccgtttatgtgtccagctccaactttgatgctctgagcaaccctgtgctcacattggccagtgacagccccacagggtatcagttaaacgtgacagcgtatggtaacagtgtaaacatttcaactggggtggtgaatgccacactcacaggcattgtgtacactgataagacacttgccatatatcatgtggacaaggtgctcattcctttggacttctctaagcctaagcctatagctccagcacccgctgtggctaaagctcctaaagctgataaggagaacgcttcagcagaagatgatgaccaggctcaggcagccaaggacagttctggtgccatgagtttggttagtactcaagggacaaccttggtgtcctttggagttgctcttcttgcagcagcagctacaatgtcgagttga

SEQ ID NO: 17455 - DNA, 2148 bp, Glycine max
  Peptide Sequence Number=SeqID_134233
atggcttcggcggccatattctcgtcgctacggcggcgccggtctccgtcgctggaggcgtttctggtgccggtcgacctctccgacgtggcgctgctggagactcttatctccgtcgccagcgacgtcgcgtcctgcttctccggccaccggttccccttccagcgccggaactcgcgtgccctcatcggaaaagttgagattttccggtcaatgttggagtgtctgagagactccgctgccgccggagctcttactccgacggcggtgctgtgcttaaaggagttctacctgcttctatatcgctcaaagattcttcttgattactgtgcccaatcgagcaagttgtggctgctgcttcagaaccattgtgtttctggtcacttccatgatctgagccaagaattttcgacccttttggatgtttttcccgttggggaagttggcctcagtgatgatgttagggaacagattgagttgttgcagagacaatccaaaagggctaagttgttcatagataagaaagatgatgttcttaggacaaggttcttttggtttctcgaagagtttgagagtgggagggttcctgattctaaggacttgaggtgtttctttgtggataaactgaggattcttgatgctaagagttgtagggtggagattgaagccttggaggagcagattgtgaaccacgagggtgatgttgagccaacggttcctgtgcttaatgggatggtggctatcacaaggtattgcaggtttttgttgtttgggtttgaggaagagttggaaattgagattcaaaagaaggggaggaagaggttgattgctcaggaaattgctgaaacgtttttgactgttcctaaggacttttgttgtccgatatcattggatttgatgtgtgatcctgtgataatttccacgggtcaaacttatgataggaggtctatatggaggtggatggaggaagggcattgtacttgtccaaaaacggggcaattgctttctcataataggcttgttcctaatcgtgctcttaggaatatgattatgcagtggtgcagtgcacatggagtaccctatgatccacctgagggggttgatgcatctgttgagatgtttgtatcagcttgtccctccaaagcttccctcgaagctaaccgaggggcgaccacgcttctcattcagcagcttgcggatgggtcacaagctgcacagactgtggctgctagggagataagattgttggccaaaactggaaaggaaaaccgtgccttcatcgcgcaggccggggcaattcctcatcttaggaacttgctttcctcacctaatgctgttgcacaggagaattctgtgacagcactgctcaacctatccatttttgaaagaaataaaagcatgatcatggaggaggaagggtgtttggggtcaatagttgaggtgttgcgattcgggcatacaactgaggcaagggagaatgctgctgcaacattgttcagcctctctgctgtccatgattataagaaaagaattgcggataatgtgggggctgttgaagcactggcttggttgttgcaagaggggactcaaagaggaaagaaggatgctgtcacagcattgtttaacctctccactcacactgagaattgtttgagaatgatagaggcaggggcggtgaaagctatggttgtggctttggggaatgaaggagttgctgaggaagcagctggtgccttggccttgattgttcggcagcctgttggcgccatggcggtggtgagggaggaagcagcagtagccggattgataggaatgatgcgttgtggaacgccgagaggtaaagagaatgcagttgcagcattgttggagctgtgcaggagtggaggtgcagctgcaactgaaagagtggttagggcgccggctttggttggattgcttcaaaccttgctctttacaggtacaaagagggcaagaagaaaggcagcttcactagctagagtgtttcagagatgtgaaaatgcatctctccattatggtggattaggtgtaggttattcatttgctagcgattcagcttcaaccagaaatactacaacctttgtgagtgacgtttcacttccaatgtccatttctgttcctgttttatag

SEQ ID NO: 17456 - DNA, 387 bp, Glycine max
  Peptide Sequence Number=SeqID_134234
atgggaggaaaaagtgagaagggtgaagttatggagtggtcagttgcaaacacaaaggctttcattgaaaaaatttatgagagagtgaaaaatgggcaattacaagggtcaaccttcaaaactaccacatgggaagaaattaacaaggacttgtttgagatgatccaaactaattatggtgtggacaagctgaagtctaagtttaatcgtctgagacaaatgcatcgtgatttttcaactttgctagctcgtaccggagtcacttgggaaatggaatccaacaaagtgaatgcccctgatgaagtatgggacgaattgattaagatcaagcttatcgataccgtcgacctcgagggggggcccggtaccagcttttgttccctttag

SEQ ID NO: 17457 - DNA, 204 bp, Glycine max
  Peptide Sequence Number=SeqID_134235
atgtcatcttcctgtagagatagagcacaaagtctactgggttgtaaagacctgcaacttctcaggcgagaggaaatgaagttgcaactaagtgagctagatgagatccgtttggaagcctatgagaattccaaattctacaaggataacaccaataagttccatgacaacttgatagctaagaaggacttcgttgttggatag

SEQ ID NO: 17458 - DNA, 318 bp, Glycine max
  Peptide Sequence Number=SeqID_134236
gccaaggttcaaagtagtctaaggttgtgtctcaacggggtcttttatcgtgggagcccgatcttgatatctggggcacaacaaattcgtgtgtcaaggtatcggtctcgggttgaacttccatatcatttccacaaggcacgttgtcgcaacatgcccttttgcgggcgagcgaaggcgaggctcacgggtgcgctttccaaaggaggaaggatgcgcggagtcgccaccaacgtttatttgtggaaaacgtcagaaaaactgaaggaaatcggtcaaaatgaaaattctaagttcgagagttgtatttacgcttga

SEQ ID NO: 17459 - DNA, 252 bp, Glycine max
  Peptide Sequence Number=SeqID_134237
atggcgtgggtggtgatagaaagggatcatgttactaaatctagagtacataaagatgagatggaacatttaagtgctcttggaaagcttggaaagtatttccataatgattctccactgtatgaagatactggagtatggatgataccagtttcagttctacacttgtacctatgttggaaggcgatagtgcagtgtgggccaaaggttttcactcaaacggtggctattttcttgagggtgaatgagtga

SEQ ID NO: 17460 - DNA, 336 bp, Glycine max
  Peptide Sequence Number=SeqID_134238
atggtgttgaagtccaaggcagagttccttatcctcttggtccttgttgtgtgccaaccctcttgtgggttgggggaggattggtctactaggagactcagtaggcataataataaggtgattcctccaagctgtggagagttggtgttgaagtcacagtgctcagagaactcaaagtgcaggtggtgcaccagtgaggaccttgatgacatgtgcttctctaaatctgaggcattgagattgcctcaccagagggtggcgttgttgttgtctattcagtttatgatttacttcaaatttgagacatggttagggtatatagttgaagatagatag

SEQ ID NO: 17461 - DNA, 1209 bp, Glycine max
  Peptide Sequence Number=SeqID_134239
atggatgatgcacagggtagttcaagttccctgccccctttcctggcaaagacttatgagatggtggatgatccttccacggattcggttgtttcgtggagtatcactagcaagagtttcattgtatggaatcccccagaatttgccagggatttgctgcctagattctttaagcacaacaacttctcaagtttcatcaggcagctgaacacatatggatttagaaaagttgacccagaacaatgggaatttgccaatgatgattttgttagagggcagcctcatcttatgaagaacatccatagacggaagccggttcatagccattctttgcagaatctccaagcacaaggcccaataggggaggcagaaaggcagagttttactgatgaaatagagaagcttaaacacgataaagagcaactcctcgtggaattacagaaatatcagcatgagtggcaggcatatgagatacaaatgcattcctcaaaagatcggttggaaaagttggaacagaatcaacaaaagatggtttcttctgtttctcatgtattgcagaaacctgtgatttctgtaaatatcttgcctctgacagaaaccatggatagaaagcgaaggttgccgagaagtggccacttttatgatgaagctagcgttgaagatgctatggaaacttcccaaatgttaccaagagaaaatgcagacaataccactgtcttgacgttaaatgtggagcgactggatcagcttgaatcatccatggcattttgggaggctattgtacatgatattggtgacaccttcgtccaaattcagtcaaacatggattttgatgaatctacaagttgtgctgatagtccatctatatcttgtgcacaattagatgttgaagttcggcctaagtcacctggaattgacatgaactctgagccaactacagctgctgttcctgagcctgttgcatcaaaagaacaacctgcaggaaccactgttgcagcaactggtgttaatgatgtattctgggagcagttcttgactgaggatcctggtgcatcagaaacacaggaagtgcagtcagaaagaaaggaatatgatggcagaaagaatgaaggaaaacccagcgaccttaacaaattttggtggaacaaatggaatgcaaataatcttccagaacagatggggcatgttggtcaagcagagaaaacatag

SEQ ID NO: 17462 - DNA, 222 bp, Glycine max
  Peptide Sequence Number=SeqID_134240
atgaggataattacacaaaggcaattcgagatctacgaaggaggacatcatcttggtgcaagattgagggggagagtagcgatcgatggcgtcggaggagagtccattgaggttgccacaaagggagcaggaccaggaccactgctcgagctcgtagtaggtgttgaagtaggcctagcagttctcgcaccggggcaagaggtcgccatcggagccgtatga

SEQ ID NO: 17463 - DNA, 649 bp, Glycine max
  Peptide Sequence Number=SeqID_134241
atggcgaatcaagaggagtgggtcccgtttgcggatatactagctttgctaatctttggggttgtcctctttccaaacttggacggtttggtggacctagctgcgattaatgctttccttgcatatcaccatagcaaggagagcccggtggtagctatcttggtggacttatttgatacatttgaccgaaggtgcgagaagaacaacgcacggattgtctgctgcttacccgttctttgtgtgtggttggtttcgcacctattccaacaagacataaggcacccgtgtccgctccaaagttatcgctcgtgcgtcgaaaaaagaagagtagattgggaccaatacatggctgggataggaggcataacaatcaactggtttcctcaatggaaggaaggaaaggagggagttctcttctcatgtggggactacccaaacattccgttgatagggacgaggggttgtattaactacaatcccgcacttgctattagacagttagggtaccccatgaggggagcaccgacggaagagagcctctcgcctttccttatgagagatttcagcgcgcaaagtttcaagattatacaaagagtccacaaggcatgggaaagcccgttaaggaaagataaagaacttaggggcatcc

SEQ ID NO: 17464 - DNA, 387 bp, Glycine max
  Peptide Sequence Number=SeqID_134242
atggttcatgatgaagtctggtatatgaggatactgcatgcttgtatgtgtacattatggaaagatactaccaacaccttatgttgggggaaatgtcttgggaattatgaccaggccttgcttaaaggtaggtgtagctttggagtgtcgatcacaaatggaatagaagagaagactgccaagttgaaaggaagtgagaaggctctagttgcacggcatgaagctagtcatgctgtagtaggtactgcagtagcaaaccttcttgctggacagccacatgttgaggtgtggactttggaatatcttattttagaatttattgatcttgttttatggtgggaaattaaagaaaagtataaatctgttatgtgtgatattcaacgataa

SEQ ID NO: 17465 - DNA, 382 bp, Glycine max
  misc_feature (4)..(4): n is a, c, g, or t
  Peptide Sequence Number=SeqID_134243
gttntggaggcctctggtaatcgattaccagtctgtgtaatcgattacatagaggaatgggtcactggtaatcgattaccagctacttcattggtgcatccagatgaacctgcgcgcacgcttcagcgtactgtggagtggatactacccacgcctacaccataccgtctagtggagccagtccaagtgattgaggtaacgtcatccgaggaagaccctgaggaggatcccgaggagctacctcctgagcctgctgtggatgctcttgattttctagagggtgatgaggacccactccctgaggtggattctcccgaggacgtcatgtcggcatccgaggcagactctacgaaggatagtggccccggagatatggcgatca

SEQ ID NO: 17466 - DNA, 2112 bp, Glycine max
  Peptide Sequence Number=SeqID_134244
atggagagtgtgaatgatctgatccaagaggccaagctccgcactctctgggtggagtttcgttggaagcttcaacagcctagaccgcagacctatctatctcatttggagaaaaagcagttgtctctcaatgatccatgcctcactagtttgccttcccctgcaaaatggaagaggaaaattgattctcctgctgtggaggctgcaatgagtgatttcattgataagattttgaaggattttgtggttgatttgtggtactcagagatttctccagataaggagtttccggagcagatacgggcaataatcatggatgttctagctgaaatatcaggaagggttaaagagataaacctggttgacctgctgacaagggatttagtagatttaataggtgttcacatagaacttttcagaagaaatcaagctgttataggtgttaatattatgaaaacattatcttctgaggagcggaatgacagattaaaattccatctgttgaattctaaggagcttcatccggcactaatatctcctgagagtgagtacaaggttcttcagcggctaatgagtgctgttttagctacagtactaagacaacgagaagctcagtgtcctgtgattcgttctatatctcgggaattattaacttgcttggtaatgcagcctattatgaatttggcaagccctgggtatattaatgaactgattgaatctcttctacttctctttaatgatgatggtacggaagggatgggcagtgatcagtcaactaatgtagcaagtctccatcatggtcattctgttgccagtaagggtggacacaacaatctcacagcctctaataagcatccatctttaaatcaaggaactgatatgatattggctaaaatgagtgatcagggagggacatcgttacaagatagcactctccatcaagagtctaaacaagttgggcctgctgattgggcacgaatgttggaggttacaactcagaggagaactgaaattcttatgccggagaatcttgagaacatgtggacaaagggaaggaattacaaaaggaaagagaacaaaattatcaaagctggctctaaggatctttctgcaaagagtccctctacagacagttcacggcctcatagaaaattggctcaggaaacatcagcaagtaaacgtggaaagtatgaagttgcagatgggaagtcttctctgccgccattgcctgccataggttcagatcccctgcaaaatgttggaagtgcaaaaaattcagaatctcctaaaaaccctggcaaggaattgtctattgtgggagatcttgcttctgatgcttatagaagtccactaaagaggtcgagtagtgcttcttccttaggaatcctatctaataaagaagactccagaatttcagagtttttcaaccctgaacttgagaggcacagtgaaggatttcggggaaagagttcttctaatatgattgttaggaaagaagggtcattagttcctaagcttcggtgtcggttgttgataaaagcctttggctacaagcttcaccttgtacttagtaatagagccatctggattctcttttactcgaaacacccacttgcaactgatgacagatacggaagtagtgctgttttgacattcttaggttcagcgtgtgctaacattaaagtgggattgagtctagacttcactatgccagatttggccctagtgcacatggggtgcacattagcctctctcaccaagggtcctgaaccagaatcatcagaaatggatgctacagaggtggatgcaacttgtgctataggtataggtaaaatagaaaggggattggtaggagtagaaggtgaagatgtgggtttgggtggggaaaatagggatgtcaccattcagcactggagtggggagtctagcattgaaaagtctcgcaagaagaatttgggctcgttgaatcttgctaagggttcgaattccaattctgcttctgaagctcaggttcatctaactcagggtaacacacactcctcctcaaactatgattctgtgtatggtaatcaagggatgatggtggctgtttgtatggtcgagtggtcatag

SEQ ID NO: 17467 - DNA, 687 bp, Glycine max
  Peptide Sequence Number=SeqID_134245
atgaccctgtttctgtgggtacctggaagtgcaactgttggaaacggaaccaaagattccgacttttcacgacccatttgcaagcttcggagtccgatgtcggtcaccgcgtgtgcacgttccgggtccttgcttcttgttaagcatgttcattccctgcttttgaaatctggctatgagaggtttggccttgcgaggagtgctttgttgtatttttgtttgcattgctgtggaaccaaagaggctgaggttgtttttgaggagctgcgtgatgggaaccaagtgttgtggagcttgatgcttgcgggttatgtgcagcgtgacatgattgatgatgctatggatgtgtttgagaaaatgcatgcccgagatgttgtggcttggactacgttgatctcggggtatgctaagggggaagatgggtgtgagaagcctttggatttgttcgggtgtatgaggaggagttccgaggtgttgcctaatgagttcactttggattgtgttgtgagggtttgtgctagacttgggattctgtgtgcagggaaggttgttcacaggctttgcattaaggccatagatgatgccaagagagtttatgagagcatggggggggacaacaaggaaatgcaaagaatgcagaaccagaaccaagcacaggggcaagcaaggaagaagaaccagaactaa

SEQ ID NO: 17468 - DNA, 255 bp, Glycine max
  Peptide Sequence Number=SeqID_134246
atggttacaggcagagagaacaccaacaaaagtagctgcattcagaacaactccttgatgccaaaagaagagaaggttcaagtagctgatgactcgctcagcgaggcagatctgctcagcgagtggtatccgctaagcgaggcatatagctcgcttagcgggctagaaaaccctaaaagaggatcagtcagagatgtgttcgcacagggcggagccagcccgcccaacgaggtcgttgttccttctcgcgcttag

SEQ ID NO: 17469 - DNA, 558 bp, Glycine max
  Peptide Sequence Number=SeqID_134247
atggatgatattgtacgccagtttaaaggtgtttcagatggtttaaggcgaaaagttgttggttcatcatccctcatcaatgagggatctgctacatctaataccccatggaatttgtcctggaatgctgatgaaatcgacaaaagcattccaaggcaaagtactgcagaaagtgttagctctgataatgaggaaggtgaaaggaacaattttgaccgtgagaatattgatagagaagcagcacaagatagtggattgcattcttacaatgcattgatctcaaagggttactcatcacgaataagcaattgggatgaagagtccaggaacttggattttgatagaaagcatgatatggtggttgaagctagggctggcaatggtattcctgctacaaatttcattctgattcatgataatttggaggatccagttggagtgccacctgagtggactccacctaatgttagtgtccccattttgaatttggttgacaacatatttcaacttaataaaagaggctggataaggtgttttctagtttacaagttatcttaa

SEQ ID NO: 17470 - DNA, 474 bp, Glycine max
  Peptide Sequence Number=SeqID_134248
atggtcactcactcactcgaccattgtgcttcttcttcatcattcatcttcttcttctcccctccacctcttgttggtagtggattcgattggtggcggtgcgtcaaggttggtgatagtggtgatggggttgcgatgtcgatggggctgattaggtggtgtgccgatggtttgtggtggttcaaggaggcgatgttggcatttgggtggaacaatggttatggaggagtaaagggaggccatgctcgcagaggtctttcacgccacacctccaccaaaccccaatctctctgccacgctcaaatccctatggaggaagatggacgcaacgacactgctgtggttcatggtgtcaaagcagaaggagtcagcatcgttgcggacggagatagcgacaacaatggaggaggcgatggaccccgcgcagctggtggtagaggcagtggaggaatttctaaagagcaacgtagttga

SEQ ID NO: 17471 - DNA, 450 bp, Glycine max
  Peptide Sequence Number=SeqID_134249
atggtttcgtttggagttgaggattttgaagagagatatggaggtctgaaaccatcccagtttgcagatatgatcgcacttactggtgatagatctgataatattccaggagttcatggaattggagatgttcatgctgtgcaattacttagtagatttggtgagggtaccccctacgctggaccatgggaggaaggcacattggagaggttgttggattccgttgatcaaattaaagaggatcacattaaaaaggcattgttgcgctctgatcttccattgtacatggtaccgctcgctataaaagatctctcatttaataaaccagaggacaacggtagcaagttcaacagccttttaacagctatcagtgcatacgcagaagggttttcagctgatcctatcatcaggagaacagttcatttgtggcaaaagttggattcaagatga

SEQ ID NO: 17472 - DNA, 933 bp, Glycine max
  Peptide Sequence Number=SeqID_134250
atggatttggaactcccgccatttcacctccccaaaccaaaaccaaaactcattctctcaagtctcgacacagagaaaatgaaaatgggcactcgcagaaagaagagagaagaagcccctctttctctctccgaagatgatgatggtgatgaaaatgaaaactcccaaaacgaaggttccaaaagggtaaaaaacgaaggttacgagcaagctagggagcaaaggatcaaagagaacatggagagaatgcagaagcttggcttattcgacctttctcataaactcaaacccctaaagaaacagaagaagcgcacccaccaacccaatcattcaccccagagacgctctttcagaataatgagccgggcaccaattaactatgctgagagagattttcgcgagtcagcaagtaagaaaaatgatgaagtagagattgttattccagaaggtacaaaccctgaagtttacactgaagagcaggagaagcttctgggagactgtgagagtacttgggaattgtatgtagatggatatgatgaagatgggaaccgtatatatgatccaatcaaaggagagacatgccatcaatgcaggcagaaaactcttggccagcatactcattgcaacaaatgcgaattactccaagggcaattttgtggagattgcttgtacatgagatatggagaaaatgtggtagaagccaaccataacacaaaatggacttgccctccttgtcgggatatttgcaactgcagtcgttgccgcaggggaaaaggttggatgcctactggtgtcaaaactgggtttcaaatatgtggctcattatctgatttaaaaatcgccgctccaagttggaaggctcagatgctgaaaaacatagttcctgaagaaatatcagaaggcagaggcatctgcagataccacaccgaatag

SEQ ID NO: 17473 - DNA, 279 bp, Glycine max
  Peptide Sequence Number=SeqID_134251
atggagtgtcctttcttcttttgggcccttccaccatacatctcttggcaccatatctttcaccttttccatatcaatgaagaccgccagaattttcggcacaatctataccccgcatacaagagcaaccgtcctccaactcctgataccattgttcagggacttcaatacttcaaagcatccatcaaggctatgtccataaaaataattgaggcaagtgtagaggcagatgatgtgattggaacattagccttaaggagtgttgatgctgggtacaag

SEQ ID NO: 17474 - DNA, 873 bp, Glycine max
  Peptide Sequence Number=SeqID_134252
atgggtgtattagagattggtgtatttgagattggacaaatggaggaagaatatcccctcagtttactcagtctggccttaacccctcaccttacgcgccggtgcgagacgcgtgagtgtgaagaagagacaaaggtgcagttctggggtttggcggtgaagaacagaacacacacgatggggaagaagagaggtacaagttatcaaaagaaagatgccaaaagctcgaaaagtaaaacaagttctcgccatggtgcttattccagtgatgacatggacgacgatattgatacttttcataagcagagggacattgtcccccttgacataaatgatgatgctgaagaatcggaagatgaggagctccctatttttgatgttcaggatattgatgaagatgaggatgacgaagatgaggatgatggtgaagatgacgacgacgacgacgacagggatgacgttgtggcaaagatgattaggcaaaggaaatatttacagggaaagtttggtggaggcgatgatgaaatgaatgatgccgatgatgatgatgaagatgaggaagattataaacttacattgggtgggaaaaaattctcacacggtgctgagaatcgaaattttgagctacaatcaagtgatgatgaggccccaaaagaagaggaagaattggcattacaaatacaaagggagaaggcaaaatccttaacaatggaagactacgaccttgtggatataagtgaagacaaagataatgagaaattaactttgaaggttagtgctgttgatgatctcgttggtttgttgccttattgtggtcaatttccatattacttgaggaaaaacacaatggaggaaggaatattagggcaataa

SEQ ID NO: 17475 - DNA, 492 bp, Glycine max
  Peptide Sequence Number=SeqID_134253
atgataaaacaacttgacacaaaacttccatttgaacttgaggacattcttaaaggaaataatgggttagaaacagtagtaaattcagataatgagaacgctccaacaacagctgattctatcattaaaaaccaagagcagcctcttgtctctgccaaatcaacagaagaaacagtgcctaacaagcaatttgagatgcaaaaattggaaacctcaaagaatagtgtacagaaaacaagaaaagttaaacctcagaaggatcacattggcgcacagagtttggaaatgctaaaagttagagcttccctcgaggaaaaactgaaaaacaagggtctgtacagctccattgctccaaaacctagtaatgcattaaaacgtttgaaaccagttaatgggtatagcttcactcttctatcctttacattacttgtttcaagcatgttggaacttattagccacttacaaatttcacagcatgctcgaaacatatga

SEQ ID NO: 17476 - DNA, 672 bp, Glycine max
  Peptide Sequence Number=SeqID_134254
atggcatcaaataaccactcaccacctctcgagatattagttcgaggaccagaagatttctcgctctggaccggacctcccttcgcgaacggtcaaccaagcatcaagctcgagaaagtgaaatgcatcaacgcgaagttcagcgacgacggatccaagctcatggtgacaaaatcgaactcgctgattagcgtctacgattgcagaatcgccgaagagattagggcttttgaagtccccaatgtcgtcgccgcagctttgtcgcccaatggaacttacttgcagaccttccagaagccttcggcgccgcaggagaagaacgtcacgctgtggagcatcgagaccggtgctgctgttcaccagcagtcacagaagaacatgaccaaagccaattggcctgcaattcagtttagttctgatgaagctactgcgtgtcggttggcaactaatgaggtacaattttttgatactggggatttttcgaaaggagttgtctgtcggttaagagttcccggagttgctgctgctgagctttctagtttaccagggtctcatgtagctgcatttgttccagaatccaaggttgagtatttggaggacaagcgtctttcatttacttctagattcttggctaatagaaaaaatatcagattggccattggtagcctatga

SEQ ID NO: 17477 - DNA, 1004 bp, Glycine max
  Peptide Sequence Number=SeqID_134255
ttgtgggaatctgaactttgcgaaaagggttgaatgcaacaaatgcggtgctccaagtcctaatcccaatagttctaatgatcgtggtggcagtggcagtggcggtggttataatagaggaggtggaggctatggtaacaatcgaggaggaagaggtaatgactatagcagcggagggggtagatctggtagttatgatggagggagaggcaatgaatataatagtggaaggggtggtaatagtgaaggtagaggtggttcatatagaggtagtcaggggagagaagatggtggttatggtcaagttcctgctcctactgcccaatcttacggtggtgttggtggaaactacccatccacttacagttcttatagtggtgggaatgcaagttatggaacagaagcagttcctccacctgcaagttatactggtggacctaattcctatcctccatcatatgggggtagcgtgggtggttatgggggagataatcaaggggatggacggagtggtggtagatctgggcctcctgctggatatgacagtagttacggtgctggtaatcgaggtggatttggtggatcttctgcagagacccctgctacagtgaagcagtgtgatgagaattgtgacgatacatgtgacaactctagaatctacatctcaaacctaccaccagatgtgactactgaagaattgagggaactttttggaggcattggacaagttggaagaataaagcagaagaggggctataaagatcagtggccttggaacataaagatttacactgatgagagtggaaacaacaagggtgatgcatgccttgcttatgaagacccttctgcagcacattctgctggcgattatgatttgaggggttacaaaatcagtgttgcaatggcagaaaaatctgcaccaagagctccacctgcatataaccaagggggcaataggggtggctatggtggagatagacgcagagacaattatagagatggag

SEQ ID NO: 17478 - DNA, 216 bp, Glycine max
  Peptide Sequence Number=SeqID_134256
atgagactgttgaagcagaccccagaagatccactctcagtagggatggacctatcttttgctcagcaagtagcagatcctcctacacccatcatggagatgccagaagaccctaccatgctagtcctgagactgtcattcactcctccagctaccccagttttacatctgacagatgaggaggatatgcaggacacacagggcacacgggactag

SEQ ID NO: 17479 - DNA, 417 bp, Glycine max
  Peptide Sequence Number=SeqID_134257
atggaacatgagatggaactccaacggcttaatcaaaatgaagaaaccgacaaaaagaagagaatgatagcctttaaagcctcatcatcaatgcaagaagaaaatgaagaagaagattcagatgatgaagaagacttctcactctttgtgaagaagtttcagaaatttgtcaagaaaagaagaatcgagaggcgtcagaacttcaacaatggaagaaaatcacaagaagactctcaagttcttagatgttacaatgcaaccaacttggtcacattaaagataattgcccttcaaatgaagaatgacctgagaagagtgataagaaaaggtatgatgaaagaaggaccaaaaaggcctacattgcatgggatgacaatgattcatccgatggttcagaaaaggagattaatcttctaa

SEQ ID NO: 17480 - DNA, 486 bp, Glycine max
  Peptide Sequence Number=SeqID_134258
atggatcttcttgacatcgactccattgccgctgccataaagggttgttccggcgtaatccaccttgcatgtcctaacatcattggtcaagtcgaagatcccgagaaacagatattggaaccggcgataaaaggaacggttaatgtgttgaaggcggcgaaggaagcaggggtggagcgcgtggtggcgacttcatcgatttcgtcgattatgccaagtcctaattggccagctgataagattaagggagaagagtgttggacggaccttgaatactgcaagcaaaaggggttgtattatcccattgcaaagactctagcagagaaagcgggttgggactttgcgaaggagacaggttttgatgttgtcatgataaaccctggtacagcattgggccctctgcttcctccaagaatcaattcaagcatggctgtgcttgttagtgttctcaaaggtaattatcatatatcaccactcaatcaatga

SEQ ID NO: 17481 - DNA, 252 bp, Glycine max
  Peptide Sequence Number=SeqID_134259
atgtgcaaggttgtgcgattcgcggcggcggccagattgcggcgattatcgacggcgattcccggtccatgcaaggttcaaaagcgtggcactgatatcctccacgatccttggttcaacaagtttagtttatttggctggagcaaaagtaactttaacctgaaaagagatggaagggctggattttcatatatgctgccgagtgccgagtgccgagtgcgtggatcaattggcgtgattattccagcataa

SEQ ID NO: 17482 - DNA, 642 bp, Glycine max
  Peptide Sequence Number=SeqID_134260
atgaccaagaataagatgttgaaagagcataacaagactttcctaacttggtttaaagatacaatctttggtgacgataatgcttttgaaatgttaaggaagttagcggatgagcctaaaagaaatgttagaacttggcggggatacaatatcaataactattcgttctacaccaaatcacaagatgacaagagtatagtgcaaaacaatggggttagtcttaaggctgaatcccaacactttgctactgtaaataatgacaatcctcattcagtgttcatgtcttactttggagtcattgaagaaatcttggagcttaattattgtaagtgggatgatagtaatatcggtgtgtggaccaatgattttggatttactttggtagatcgaaagaagctagcttatcagaataagcctttcatcatggtagaacaagctaaagaagtgttttatgttcaagatccttgtggtgaaaggtggtcagtggttctacacagaaaaaccattgatgttaatcttgaagatgacgattcaacccttgatacttatcatactcctttctccacacacatgcctaacgtcaatagagaagaagaagttaacgacgtccatgcaaatcaaaatgatcatgatgtaggataa

SEQ ID NO: 17483 - DNA, 276 bp, Glycine max
  Peptide Sequence Number=SeqID_134261
atggctacaccatcaagcttccttattcttaagtcaacaccttcatcgtctacattgaagaggactagaaaatttacacggctcatatcatttgtttgccagacccgtaggggtgaagaggccactgacaaggtgaatgttacatatgttaactggaagcaggttcctgcagctcagaaggatttaatttgggaggacattcaggctctagtagaaagcaaggaggacgacaatgacaaagtatatgagaagtatgaatgtagcaaagagaagtga

SEQ ID NO: 17484 - DNA, 339 bp, Glycine max
  Peptide Sequence Number=SeqID_134262
atggcgattgatataaggcaagaatgggggcatgatgctgatctccatgtggctctagcttcagcagagcagcagttgctgcaaactgagtatgaagattatgccatgtcacaaaccagtagcattgcttgccttcgctctgtcactctcattttgttgatgattttgcttgtacgccaagctttaattctcacaaagaactctgtaactgggcaagatgcatcgataatctttaattttgagatgtcagtccttcaatttgttggtgttcttttgccatgctttgcaatggcacgttcctggtacgccatacagaaccaaaggagaagacagggttaa

SEQ ID NO: 17485 - DNA, 435 bp, Glycine max
  Peptide Sequence Number=SeqID_134263
atgcacgtggctcaattgatttctgatgccatctactatttgcaaggatcgcgcacctacgaggagtcccttggacctggagaagtccaacagggccctaggggctttcatcgagaagtactgtgccccgaggtaggcacagggcgaggcaccacagcagcctggggacggctagtagcgagcaacagacgcactgctgccacctccagagcccttcagctcatctacaaatgctggagcattgcctacgacccctggtcgactagcaggcgaccaagtccaaagccaaaggtaagcaaaagtactaggcccatgaccgataagtcatcacgcgtccggcttgtcgcaacctaccctttggcaggagggcgacgcgagactcacaggtgcgtcttccaagaaaggaaaatgtgcggagtcgccaccaacgtttaa

SEQ ID NO: 17486 - DNA, 433 bp, Glycine max
  Peptide Sequence Number=SeqID_134264
aggactgcaagcccttgccttcagagggctacacgtcctcgccttcagaggactatacgtcctctcctttagagggctacacgtgctcacctttagagggctacacatcctcatctttagagggttgcacgccctcgccatcaggggactacacgtcctctccttcagaggactacacgtcctcaccttaagaggactacatttcctcatcttcaaaggactacacgtccttgccttcagagggctacacgccctcaccttcagagggttgcactccctcgccttcatagggctagacgccctcacctttagaggactacacgtcctcgccttcagaggactacacgtcctcgccttcagaggactacacgtcctcgccttcaaaggatttcacatcctcgcttttagagggcttcatattctacgcctttag

SEQ ID NO: 17487 - DNA, 291 bp, Glycine max
  Peptide Sequence Number=SeqID_134265
atgaaggccgatatggaggccatgaagggacagatgacaatgatgatggaagcaatgatgagaatgaacaagatgatgaaggagtcgagtgaggatttcaggatccaacaccatgatttgacaccttattggcccaagggcaaacctattttcgttggtgtacgagatagaagttgtcctccctttcgaagtagagattccttctttgagggttctgttggaagcaaagttggaggaagtggaatgggcatatgtgttttgaccttggatgctatgagtcatgggcagtaa

SEQ ID NO: 17488 - DNA, 333 bp, Glycine max
  Peptide Sequence Number=SeqID_134266
atgcataaataccctaactgtggggtatcacggtacaaagtgaaggatgataacgagtgtaacagtgatgaaagcataaagaaaggccccctagcgaaggtgttatggtatcttcttatcattctaaggtttaagtgttcgttttctaatgaagatgatgcaaaagaccttacatggcatgcaaatggaagaaattgggatgaaatccttcgccatccaattgattcttcccaacggaagaagattaatcatttgtatccaaatttcgggaaagagacaagaaatcttaggcttggacttgccactaatggaatgaacccctttggctgttga

SEQ ID NO: 17489 - DNA, 963 bp, Glycine max
  Peptide Sequence Number=SeqID_134267
atgccagcaaaagtccaaaccaattacaaacacctgcatccatcactttattcatattatattccttcaatttcttggattcctcgagtggatattcctcttcttgatgggaaccatcgtcaaattttgcaatgggctctgaagagttgtgaatggcttcctaaggcacagtaccagttattgccttcgatctatgagctagaatcccaagtgattgatgccttaaaagcaaacctctcaattccaatttacatcattggcccaaacataccatattttagtcttggtgataattcatgttacactaataacggtgctaacaataatggtgctagccatggttacttgaattggctaggtcgacaacccaaatgttccgttttgtacatctcacagggaagctatctcccaatctcaagtgcccaaatggatgaaattgccaatgcattgcatgatagcaatgttagattcatgtgggtgacgcgtggtgagactccaaggttgaaagaaatttgtgggcacatgggcttggttgtggcatggtgtgaccaattgagggtgttgttgcacccttctgtggggggttattggacacattgtgggtggaattcggttatagagggtgttttttctggggtgccctttttgaccttcccaattgccatggatcaaccattgattagtaagctcatagtggaggattggaaggtggggcttagagtgaagaaggatgataagttggacactttggtgggaagagatgagattgttgtgttgttgaggaagttcatggagttggatagtgatgttggtagagagatgaggaaaagagccaaggagcttcaacatttggctcagcttgcaattactatggatgggtcatctgaaaataatatcaaagacttcatgaagaatatagtccagagtggatcaaacagagttcaagttcaaaatggtatttag

SEQ ID NO: 17490 - DNA, 339 bp, Glycine max
  Peptide Sequence Number=SeqID_134268
atggaaatactgcacccacagctccaacttgttcgtcgtccagaacgccgccgccggaatattcctctgattcgcaacgacgatggcctagaacagaaacgcgtcacaaatcatgaacgtaggcggtggcgacgcgtggaggcggtcaaggatgagctcgagttgtgcctccatcttcgtcatgacagcttcgaggacgtcgttgaaggtgtccgaggaagcactgaggcaattgaggagagccattgttccgttacaacaaaggtgacaaggatgttagggttttttttatacgacgagtttggagaggttcatcatggggttgatgtggccacttga

SEQ ID NO: 17491 - DNA, 156 bp, Glycine max
  Peptide Sequence Number=SeqID_134269
atgacagtcgaaatttctttaggtggagccatgatggtgcctgtgggatacgagtggaaagttaggtgggaggttacggaacagtgtatgcatgtgagtgaacaatgtgcaacaccacacattaatgtacacgacaaactgtctgttgcatcatga

SEQ ID NO: 17492 - DNA, 135 bp, Glycine max
  Peptide Sequence Number=SeqID_134270
atggaaaaggtcgagggtctacgtattttgaaaatgagaggtgttgcccttgctccttcgtatcctcaagagagagtcgttaaggcgttggaccttgaaacgatcttctcaagtttgaaaggcgagaatcgttaa

SEQ ID NO: 17493 - DNA, 288 bp, Glycine max
  Peptide Sequence Number=SeqID_134271
atggctcaacctccaatcttgaggacttatcacatgaatacgagacttgtcgggtcaaaaaccatgatagtgatactgactcctcttccgggcccgatggaagtaacatgtcttcatcccacaaaacaatattcaaacgggattggtaatctacggatcattcatgtcttagttatttctgctttgagtaggtggcatggtaacataactgtcgaaattcacaacactttgccatttacactacactgtttcaaaaaactaaatgtctcaccagcaaaactgacataa

SEQ ID NO: 17494 - DNA, 219 bp, Glycine max
  Peptide Sequence Number=SeqID_134272
atggctgctagtttcgcctgcagtatggttaagttttgtggagaacgctgtgcacaacggctttcacgcgttgccgaaaaggcgtctgaaattgccttgtcgtgccttgggaataatgatgatctcaagcctggaagagacacagtttctgaaaacttgaaggctattatcattgagattacaaggttcaggaactgtgcaatggcatctgttgcttaa

SEQ ID NO: 17495 - DNA, 237 bp, Glycine max
  Peptide Sequence Number=SeqID_134273
atggaacgagacaacgtttttctttttttccgagaagaagattgtgaagctgagaggcggtacaagtacaagtacctgttgatctccgacgagagcgaaaacgcggacgaagaaatcgagaacgagaagcttgtcgtggacggcttgacaaccgggaaatttgaggtgtccttttgctcaatgtctcaaaaatgtcctcacgagtcccgtgggtttgagcaaacaataaaaatataa

SEQ ID NO: 17496 - DNA, 846 bp, Glycine max
  Peptide Sequence Number=SeqID_134274
atgccattcgggttgtgcaatgcaccctccacttttcaggcagccatgaacagcttgttaacctcgtttctttggcgatttgctactgtgttctttgacgatatcttggtgtatagtaagtctctatcctcccatatacagcacctcaaaattatctttcatacattggtgcaaggtcagttctatcttaagcgtaccaaatgtctttttgcgcaaacccaagtagagtatttagggcacttggtttctaacagaggagtcaaacccgagccatctaaagttcgtaccatggtgcaatggcccttgccaacttcacccaaggagctcggagcgttcctcggacttactggtttttatagaaagtttatcaagaactacatgttgatcgcggctcctctcaattcactactaggcaaagaagcattcaactggtctttaactgcaaactcagcgttcgaacaaatgaaaacagccatgactagtgcccccgtgctagctctgcttgacttcgacaaaccattcatcgtagaaaccgatgcctccgataccggcatgggagttgtcttaatgcagaagggtcatcctctatgcttcgacttacgtccgggaacttcatgcaatcgtctcggccgtgcgaaaatggccggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 17497 - DNA, 504 bp, Glycine max
  Peptide Sequence Number=SeqID_134275
atgtcccatcttttggaatttgggatgatcggccttctcaatgagtcaatctcttgctttctcaaaagggtggacctttgggtactagtaccctcacccttagagggctacacgccctcgccatcagaggactacacgtcctcaccttcagagggctacacgtcctcgtcttcagagggctacacgccctcacctttagaggactacacatcctcacctttagaggactgcacgtcgtcgtcttcaaagggctgtttgccctcgccttcagagggctacatgcccttaccttcagaggactacacgtcctccctttcagagggctacacgccctcgcctttagaggactacatgtcctcaccttcaaagggctgcacgccctcgccatcagtgggctgcacggcctcaccttcagaggactgcatgtcctcaccttcagagggctgcacgccctcgccttccgagggctgcacgccctcgccttcaaaggacgacacgtcctga

SEQ ID NO: 17498 - DNA, 135 bp, Glycine max
  Peptide Sequence Number=SeqID_134276
gtcttccggaagttacgaagcccaattccggaagaagtgattccggaagaacttcttccgcaattggccttcaccacttccggaagaccttcattcggacgtggtcattctggaccttcctccttctgtggctaa

SEQ ID NO: 17499 - DNA, 120 bp, Glycine max
  Peptide Sequence Number=SeqID_134277
atggtgggaagtggttgtgctgggctagatgttacaaggtatgagcctaacatgcatcataaatcaaagggaaacgacttgaaagtgcagaaacatgaaccatcaaaggttcgagactag

SEQ ID NO: 17500 - DNA, 519 bp, Glycine max
  Peptide Sequence Number=SeqID_134278
atggggggtacctcaccttgtgcttcttgcaagttgttgagacgccgttgctccaaagactgcatctttgctccttactttccttctgacgaccctcgcaagttttccattgtgcataaggtctttggtgccagcaatatcagcaaaatgctgcaggagcttccaattcatcaaagagcagatgctgtgagtagtttagtttatgaggcaaatgcaagagttagagaccctgtgtatggatgtgttggagccatatcatacctacaaaaccaagtttcacaattgcaaatgcagcttgcagtggctcagacagagattttatgcatccagatgcagcaacaagagcctaccttagccacacaattagtagaccaagatgacaaatcaatgctcctatctgtaaacaataactatgaaatgcttcctcagtttcttaagtttccttcatcctcttcctcatcttccaatgtattccaagaccctcatgagcctcttaagagagagtctttttggacttga

SEQ ID NO: 17501 - DNA, 2732 bp, Glycine max
  Peptide Sequence Number=SeqID_134279
agctttgctgcgcactctccctgttattcctcgatacaagcattacttcaattctcccatggcttcacctaacctttcatcactagaggattcactcaatcctcatagtccatattatgtgcatccgagtgagaatccatcaacctcccttgtttctcctcttcctgatcccacaaattataactcatggtgcatatcaatgtctattgcactcagtgagaagaataagctggaatttatcgatggttctttgctgcaaacagcgcccaatcatgctcttcatattgcatggaaacgttccaataatatggtggtttcatggttgatacattcagtatcaccttcaatcagacagaacttattgtggctggataataccgtcgacatttggagagatatgaaatcaagatattcccaaggtgatttgttgagaatctctgaattacaacaggaagttgcttccgtcaaacaaggaatctatgtagctactgtggaaagaatggatatgttgttgaagattgttggaaaaagaatggctatccaagtaatttctcatcaaatagaggaagagggggtcgaacttttcttggtcatgaaacatggatatccaccaggacatcatttacacaaagcgcctggtgctaacattaataacacagctacaaaaccaatgaataatgagaactcaacagcaatagctataatccaggaaggacaaaattcagagatgaaattgacatctcaacaataccaagctctaatgagtttgctgcaacagacatccactaatggatcttcttcttctacacagacaacccatatcaatcaacttggtataacttctaaaactgattctattataggaagtgttttacctataatctgcaccataaacaatgacactaatctcaatacttggctccttgactcgggtgctactgatcagattgcatcttcccttgatatatatagtgagtgtaaacagatctctcccatcattgttagccttcctaatggagaacaactgattgctagatattctgggactgtgcatatttcagaatttcttgttctgactaatgtgttgtatctacctaatttcaatttcaatttgatctccatttccaaattgactaattccatgcattatcagcttgtattcttcgctaacaaatgtctgatacaggaaatctccaccaagaggatgattggtacaattgatgttgaatctgcactctcagtgctaacagaaaaaagcaagatcctagagccttaccttaactgctttcctttctccactatcgatattaatgatcctaccattcttgctcaccctttcatcactactcataatccacaagctttttcttcccctatagattcctcttctcctacacctttacctccccaacctgaacctgtatctattgaccaaccacatactaaacacacctcctctgcacattctcctcgtagaactgacagagttcgaaccagacccaccaaatacaatgactatcaaaccagtttcacatcagccactgttactaatcatccaggcattaaacatcctatttcttctgtgatttcctataacaagctctcttcatcttatcacagctttattcttaatatctctgctaattttgagcctaagtcttatactgaagcccgtaaacatgattcttgggttcaagctatgcatgatgaaatttatgctctagaaaggaataatacatgggtgctcactgatttacctcaacataaaaatgtgattggttgcaaatgggtgtacaagatcaaacataatgtagatggatctattgaacggtataaggctcgcttggttgccaagggctatacccaaattgaaggtcaagactatttggatacattttctctagtagacaaaattaccacagaccgtcttttcctgtcactagctacttcaaataagttgtatctcaaacagcttgatgtcaataatgctttccttcatggtgatcatcttgaagaggtgtatatggttctacctctaggtatgaaatctgctaaacctggtcaatcgactgctgactattccctctttaccttgaaaagaaacaattcattcactgcattattggtttatgttgatgatattcttctaagtgggaatgaccttacctcttccattacaaaattactggatgatacttttaagatcaaagaccttggtaatttgaaatatttccttggatttgaagttgctcgtggcacctcaggtattaacatttgccaaagaaagtatgccttggactttctcattgatactgatatacctgatatcacctttgctattcaacacttgagtcagttcattgcttctcctactactgctcattacacggctctttatcgcattcttcgcttcattaaagttgctcctggtctaggtcttttcttcttttccactagggagctacaactcaaagcctttagcgactctgattgggctggctgtgttgacactaggaaatccattactgctgaatatcgtgcactcgcttctgtaacttgtgaaattcaatggctcacatatttgcttcatgattttgatattattcataagcctgctttagtgttctgtgacaataaatcagctctccacattgcagctaatcctgtcttccatcaaagaaccaagcatattgagattgattgtcacttggttcgtgacaagctgcttttag

SEQ ID NO: 17502 - DNA, 342 bp, Glycine max
  Peptide Sequence Number=SeqID_134280
atgaagaggtgcaggcccatagggcagaattcgagcaagctcaatcagtcaaagaaaggttcaaatcagcagctcgatgagctaaaggtttgcctaaggtccaagagaagcttgtctcagcatttatgcgagacagagaccaacatgctagccatcatcagcaagtaccaagaagaattaaatctagtcacgacccacgagcataaagtggcggacgagtatgcccgagtgtacgcggaaaaggaggctaggggaagggtgatcgactcgttacatcaagaggcaacaatgtggatggaccggtttgcttttactttgaacgagagtcaagaacttccctga

SEQ ID NO: 17503 - DNA, 198 bp, Glycine max
  Peptide Sequence Number=SeqID_134281
acccattccatccaggcctctttgttggggacgctggaggatttcaaagtcccacacgtgaaccactgaacgtgggtggtctagtgcccccacattgttccttaaaatcggttgtctcggatgacgcttgcccctggcgctttgctttgttcaacgcgatgctactactccttaagttagctagcgctggcaatgctc

SEQ ID NO: 17504 - DNA, 204 bp, Glycine max
  misc_feature (176)..(176): n is a, c, g, or t
  Peptide Sequence Number=SeqID_134282
atggcagtcataggcttaacaaagactcctcaacctccacttcccagacgatataaccccaatgtgacatgtgcttatcatggaggagtttcgaggcattccattgagcattcgacctatgctcttgagtttgacttccaagtctgttcaatcagaaattgctcgttctacacgtntggtgagggtgccataaacgatgagtaa

SEQ ID NO: 17505 - DNA, 834 bp, Glycine max
  Peptide Sequence Number=SeqID_134283
atgattttaacgaatattgcgttcctttatacttcaatccaggagcatcctgagttgaagttatcctatcacgagaggaaggtgcatagtttaggtaggcctgtccctgccattgagggactagtttttgggacaggactaagtcctctgatcgcgtgttcggtagacaccggcgatcggggactgttgtcctcgtttgtcgagcagtggtaccgggagacgtctagtttccatctccctgtgggagagctcacgatcacgctggacgacgtctcctcgattctacatatgcccgtggatgatgcgaggctgccagagttgagacaaggcagtgtcgtgggccgtacgtacacctgcaatgagtatgtgatatatacgagcgccgatgccaggcaggcccttcgtgacctcagtcagaccgggaggtacgcctggggagtggttgctctggtgcatatgtacgaccagctaaacgatgcctctatcaacagcagccgacaacttggcggttacatcacattgttgcaatgctggatttacgagcactttccctcagtcgcggagtccactactgatcaggactacgacgaggattcctcgcgtgcatgtaggtggattgtgacaaagaagaccgtgaagagcatacgtacgatggtgtacagagagcgcctggaccgactccgaattccggatgtcttttggatcccgtatggggagcaccgaccggtccgggacttccatttgatttcatgctatttcggtctcctgtgctgggggcttgttgctgtttattaccgaccagagagggtcgttcgacagtttggatacacatag

SEQ ID NO: 17506 - DNA, 426 bp, Glycine max
  Peptide Sequence Number=SeqID_134284
atgcatgtgaatagcttccatagttatgtctatcagataaggaattcagtcaagttgaaaagaatcatgcagaccattctttctctgggtaatgttttcaaccatggaactataagaggtttgactgttgggtttcgattggatagtctccttaaactcactgatacacgagccacaaacaacaacatgactcttatgcattatctttgtaaggatatcttacattctctcttagctagggtcaactttcctatttcctcattacctcttaggaatgatcaccacatttccttactttatcatgattttcatagagattcaacagcaaatgaacgggaagggaatcagcttgatcttccatggtttcaatgcactgatcagtggatttcggtttattcgtggttggagactctggataaggactag

SEQ ID NO: 17507 - DNA, 351 bp, Glycine max
  Peptide Sequence Number=SeqID_134285
atgccatcatcgtcgagatctcagaagaagaatataaggaactcctcagttgcaagaataaccttcatgggtgacttatcttgccgaaaggtacaacaagcaaaaaggagtagaaatgaagaaaaaaagaaagaaatcagaagagggcctagcccaactctcgtgctaagcgtgcaagacacgctcagtgcgcaagaaggcaaggtgctgatcgaggcgacaagcacgaggattcagctcgcgctaagcgcacgattcgcgctgggcgcgcgatgtaatggcgctgagcgcgaggcttcgcgctcagcgagactacgaagacctagagcccaattttgcacctataaataa

SEQ ID NO: 17508 - DNA, 444 bp, Glycine max
  Peptide Sequence Number=SeqID_134286
atgggtctccatcttcacacttctatttctctcccactcgcccctcacaaccttcgcagaagatggacatttattggttgcagcattttaatagatttgtatttagaggaggaactcacacggaagacaaatcacgtcggtagtgcaatgaaggaggaagaactcacaagaatgagcattttaatagatttgtatttagaggaggaactcacacgggagacaaatcacgtcggtagtgcaatgaaggaggaggaactcacaagaatgagcattttaatagatttgtatttatcggaggaactcacacgggagacaaatcacgtcggtagtgcaatgaaggaggaggaactcggaagaattattagagaaaggggtaattctgtctttactgatataagtaggggaataagtgtaatttcacataagggaagcattttgttatga

SEQ ID NO: 17509 - DNA, 402 bp, Glycine max
  Peptide Sequence Number=SeqID_134287
atgttattagacatgctagagtttggattgactataaaatcaacgatcgtcctagaggctgcatttctgactggtgtggtgactgctagcttgacgttctacacattttgggccgttaaaagaggcagcgatttcagtttcctaggcccattcctctttgcttcccttatggtcatgttattgttcgcactcattcaagtgttttaccctctaggaccaatcgggcgtatggtgattgcttgcattggtgcaatagtaatgtgtggtttcatcgtatatgacactgatgacctaatcaaaagatacacctatgatgattacatttgggctgctattgccatctatggcgatatcatcaacctcttcatctatctgcttacaattttgaatgaccttttttaa

SEQ ID NO: 17510 - DNA, 1113 bp, Glycine max
  Peptide Sequence Number=SeqID_134288
atggtgtttacgtgttcggagaaagaagagagcatggctatgggacccgagagatcgaagcctcttcacaatttcatgttgccttgtttgaagtgggggggtcagcgccacctccgctgcaccaaacacccctccgactcctcctccgccgacgccgccggagatcgccgatctccggcgccgcgcgaattcgactcgccgcccccgccgctcactaatgccgacacccgaacgcgcctcacgcggccgcggttcctcgtcggcgacgaggggatcgacgccgtcagggaaaagctcatgcttgatctcaagaccgaggccgataggatgaaggacgcgattctcggcaaggaggttgcagaatacaataatgatgtcgagatgaacgacgcaccgccgccgccggttactggagttaggatgaaggatgcgattctcggcaaggaggttgcagaatataataatggtgtcgagatgaacgacgcgccgccgctgccggttactggagtgaggacgtggaatctgcggacgcggcgggctccggtggccggagacaagggagtgaggattgacgagaggaggggtggtggcggggggtcgtcgttatcgccgttgaggatgaagtcgccgaaattgagagggtcgccggagaaggaagagcggcggccggtgaagttttctctgacgctggcgaagaaggagattgaggaggattttatgaggattgtgggccaccggcctccccgccggcccaagaagaggcccagaaatgtgcagaagcaattggatacccttttccctggccagtggttgtcggaggtttgtgccgattcctacaaggttccggatgatgctgagactggcaagaataatactctcaacagtgatgattgttccaaatcacatgctttagtttactactttgcttttgtagccactatcaagagctttctggtgcagaactgtaactatgaatgcagttcatctggtgctattcttgtctgcagtacaaggtttatcaatggcggatggcagaaggccaaaattctgccatataaacacaccttagcgtctaaaaatgctatggtggaagggtctaaaaacacaacttaa

SEQ ID NO: 17511 - DNA, 315 bp, Glycine max
  Peptide Sequence Number=SeqID_134289
atgaagaagaaaggaaatttcaacactcctctagacaaaaagatacaagatttaaaaagaaacacaaggaggagaacaatgaggtcatctattttgagtagacaaagacatttcggagacaagaaaaagaaaagactgatggtaacttgggatgacttagatagtgaaaagagcaacaactcagatgatgagcaacctaacatttgtttgatggccaacacagatgatgagcaacatgctcttaatctaactcttattgttgttcttcatcaaacaatgaagaagatatgcctgttagtcgatgaatatgactaa

SEQ ID NO: 17512 - DNA, 288 bp, Glycine max
  Peptide Sequence Number=SeqID_134290
atggggagtaccagttctccgcttcaagcactcccctcattcatcgaaaccagtttaagaatagagggcaccgagatttgtgttctcttcaaagtagagggaagtgaagaggctctgccaagtgggaacttcgaaattgaagatgggttcatagaagcagaggatttgtatgattcagttgacgagaaggcagagaggttcattgagactttctaccagcagatgagaatgcagagtcagaatccttatatctcttcttcacattcatctctgtgcggcaccgcttaa

SEQ ID NO: 17513 - DNA, 129 bp, Glycine max
  Peptide Sequence Number=SeqID_134291
aagagcaatctggggattgctcttgttggagttggttgtgaacaaaacaaggttgatgttagggtggacaataagcttcgaaagactagtgaaatagtacttgggttgagtggagcctacatagactga

SEQ ID NO: 17514 - DNA, 336 bp, Glycine max
  Peptide Sequence Number=SeqID_134292
atggctttgctgtacatttactttcattggcagaatttcttagagactgggttaattgttggtggatgggataaatatgaaggtggacaaatttatggagttcctctgggtggaacaatagtacaacaaccttttgctatcggaggatctggctccagttacttgtatggtttctttgaccaagcctggaaagagggaatgaccaaggatgaagctgagaaaccccaaacaaagaatgtacaggatagcatgtaccttgttagaactacacccgttcccagaaaagaaacaaaaaatggtccagcattgcataaaccatacagtccacacgattaa

SEQ ID NO: 17515 - DNA, 564 bp, Glycine max
  Peptide Sequence Number=SeqID_134293
atggaatacagcagtgattcattccactatcttgctcctttgattagaatcaggcagctacttgcttgcataagactagaatattcttctttggaaagtaacaattgcacggattggttatccaagcacagatcagatggcaggaatgtgaaagtttggagcatgctcttagcgactgcaaatggacgaagcaggtttggatggcgtttaatatcccataataactccttgttctttcaaaaggaaattattaattggcttcatgtgaacatctgtggtagtaagcatgcttttgatactacgtggagcattgtctttggtgtgattcttgatcgtgtttggtggagacggaatgaatttgtattccgaaataaatggacgagttcggaaggtgttgttgggagtgttttggctctgactaaagatattattaggagtaaggaatgccataagattttatctcatgatgattatcatgattaccgtgttaatagtggaggaaaggaaaccaatatgctgatctatttgctaagatttcagataccaaagctaagttccaagatt

SEQ ID NO: 17516 - DNA, 165 bp, Glycine max
  Peptide Sequence Number=SeqID_134294
atgtccaacaaaacgcagagacaaattatggtcattctgcgtcttgtatcaaccgagaggagcaagttcgacagtatcgggatgatgtgtcggcaattcgtgaagttccgtgacatgccagaactcaaaaggaagcatcgttgcacaaatcgtgaggttccgtaa

SEQ ID NO: 17517 - DNA, 452 bp, Glycine max
  Peptide Sequence Number=SeqID_134295
atggcccagacgctgtatgcgcagcggttcaaacgcctgacggctcagtgccagatgggtaaatcccgacggcgcgccgatgcgccagcggtcagggaaaagacgaatcgttgcgcccgccagccccagctcgcgcgcccagcggtggaagcggctgaggaactcgtcaaggctgtgcgccgacgccagacgcgcctgcagatgcagcagacgatagaacaggctttcgttggtgttggcctgctccatcagcagcgtcatgttctcttcgagctggttgatatggttgcgcgcgcgcgccatgtgccattccaccagcgacacggtcccgcgaaccggatgcggcacgcgcatctcttcgacgacgcgtgcattgcgaataaaaaactcaggattgcgcagcagataatcaacaacagctctgtcgtccagttccgtcactgtttcctgca

SEQ ID NO: 17518 - DNA, 176 bp, Glycine max
  Peptide Sequence Number=SeqID_134296
gatatgctactaagttcaagtatctttcagagttttgtgctccggctggagaaaaagagtggaaatgcaggagatttgaggaaggtcttagacatgagcttaagagaatcattattcctctagacatcatagtgtttcatcttcttgtggagaagagtaaaactaaggagtactag

SEQ ID NO: 17519 - DNA, 306 bp, Glycine max
  Peptide Sequence Number=SeqID_134297
atgagggttcgggagtcatttacgcacggggaaggcacgcactcagcgagtcgtctgtcatcttccaggcttagtgtgagtttggcgttgagcgaaaattcacttactcgcgctaagcacgatgtcgaggttagtgagcccttttttaagcctggaaatgcagaaaagaaagagagagagagagcgccgaatagccgtaagaacttgaacagtgaaatacacagaggtaaagaacagagcaaagaagccaagtttgtagaagcaagcttcacgatgattgatcgaggccgtacccgaatcaaataa

SEQ ID NO: 17520 - DNA, 310 bp, Glycine max
  Peptide Sequence Number=SeqID_134298
atggaatacatctcccaaaatgatcagcgcatgaagctcatggagtcccaactcacttttatacattctcttttgttacaaagagctcctaacacacttccttcccaaactaaagccaatcctaagaagaaggaggctcttaatgaagaaagacaagaggaaaacaaagagggtgagaaagaggtaccaacacctcctgagggtgatagaggatgtgttggtgaagacatggaagaagatgaaaatgcccttatcatattgggattcccttttttgaatacttgtgatctagaggttgaagttagacttg

SEQ ID NO: 17521 - DNA, 308 bp, Glycine max
  Peptide Sequence Number=SeqID_134299
atgaggttgtcggctctcaatgagtatggaagcggagttattgacatcctctttgggaatgtatgccacattgggtggtgtacagttgggaggcaggccatatggcaggaaggcgccagatgggggcatcgggttcacctcagcaatgtgctggcagcggcaactgcaaccatattggcttccattatcttcttcatgctcatcatggcctccatcattgtggccattttctctttcatggcctccatgtcggccttcatctgctcttgcacctcctctgcttcacccattactctagcacgagttcg

SEQ ID NO: 17522 - DNA, 453 bp, Glycine max
  Peptide Sequence Number=SeqID_134300
atggtcattccgcacaccccttttgccattcagacacagtcgagtccgatggcacgtagagacaaattatggtcattctgcgcccttttgtcatccggaggcggcgggcccgatgacatgcggagacaaattatggtcattccacacagccttttgccattcagacacagttgtgtccgatggcacgcagagaccaattatggtcattctgcgcccttttgtcatctagaggcggcgggcccgatgacatgcggagacaaattatggtcattccgcacaccccttttgccattcagacacagttgtgtccaatggcacgcagagacaaattatggtcattctgcgcccttttgtcatccagaggcggcgggcccgatgacatgcgaagacaaattatggttattccgcacacccttttgccattcagacacagttgtgtccgatggcacgtag

SEQ ID NO: 17523 - DNA, 1287 bp, Glycine max
  Peptide Sequence Number=SeqID_134301
tcactgcctacgacttcagatctcggtcacgctcgcgccgccgtttccttcgatatccgtcttcagttaacatgtggtttctactctggttgtaggtaccttaagcacttggactatgagattacatatgtgcggaatttcactgatgttgatgacaagatggctacatgggttgaatgcttccagtatctagcagatcatgtcaagataataaagcgagcaaatgagaccggggaggatccattgatgttgagcaaccgtttttgtgatgaatacaatgctgatatggctgatcttcagtgcaagacaccatctaaggaacctcgtgtttctgaacaccttaacgagataaaggacatgataacccagattatcagcaatggctatgcgtacgaagttgatggcgatgttttctatgctgttgataaatgcccaaattatggtatgctatctggacaaaggctagaacataatagagctggagaacgagtagctgtggactcaagaaagcgtcacccagctgattttgcattgtggaaggctgctaaaccaggtgagcctagctgggacagcccttggggtcctggaagacctgggtggcacattgaatgcagtgcaatgagtgcttgttatttaactcataaatttgatatccatggtggtggaattgatttaatctttcctcatcatgaaaatgagattgcacagagctgggctgcagaccatgagagccatgtcagttattggatgcataatgggcatgtcactaataacaatgaaaagatgtcaaaatccttaggcaactttttcactattcgccagatcactgagcgttaccatccacttgctttgaggcactttttgattagtgcccattacagatctccactaaattactcaatctcacagctggagaactcatcagatgctatttactatatatttcagactcttcaagattgtaaagatgctgtatcaccattacttcaaggggaaactgagaagaatgaaaaggtacctcaaattaatgaggctgccaaggaatgcattaagaagttgaatgttgagtttcaaacaaaaatgtcagatgacttgcagacaccagtgatactaactggtgctcttcaagaggccttaaaatttgtgaacacttctttaaagatgttgaagaagaaaatgcagaaaagagctcagttgcaattgattcaatccttattggaagtggagaaagaagttggaaaagttttggacgtcctaggattattgtcctctaaatcttatgccgag

SEQ ID NO: 17524 - DNA, 618 bp, Glycine max
  Peptide Sequence Number=SeqID_134302
atgattatccaaagttctgctatagaccaagatgtcatcaaagaagacgatgatgaagtgacagagatatggccgaaaaatagcattcattgtcgcctggaacgaggaaggagcattgcacaggccaaatggtatcaccctgaactcgtagtggccatgaaccaacgtgcacctcccaattcatcaagaagttcgtctatcattggtatcgaaaaatggtccttgatagacgaattagtcatttttgtaacattgaatccacctgagcttcaattttatgtttcaggaagtaagggtaacgatacagatgcccaagctgtggacagaattatgggtgctatccccgtcaatgagtatcatcacctgctggctctggtcggagccggagggtctgatggtttgggtacaaaatccgaatcaggggtgatatttggaaaactctcgccacactcccgccgggaagccaattcctccggagaaagtcgtttaactggtaaggaggaaggtggtttgagaggtgtgagtaacaatggaggaggggtcgaagaaatggaagaggggcaagaggagatggtcgacgaaggcgaaggaagggttctggagcagaacgaacgatag

SEQ ID NO: 17525 - DNA, 333 bp, Glycine max
  Peptide Sequence Number=SeqID_134303
atgttttcaattctcgacgagggagatggcaacaatgctctgtacggagaaagagttccggaaggtggtataaatcaaaataacctaattccagtattaaagaaaagaaaactgtggttcctgcttcctatcatccatcatggatttggaaaccaccttgtcctcaagccgacaaaggtaatggagacatgggatcctcagtcgaagggtggaaaggtttcaacaaggaacaatgaaacacatggtgtatctacgctccattcgacaattgaagcttataagcagctttaccaatatgctccaaaatctgatagggtccatagtaacgcttag

SEQ ID NO: 17526 - DNA, 846 bp, Glycine max
  Peptide Sequence Number=SeqID_134304
atggaaaccacccagcttgactacaacactaaaagagcaaaccccacttccccaacgcgcttgaagctcttcggtttcagcgtacaccacgaagacatcatggaagaggacgaggtggtggtggcgcatgatgacgtggcggactccaccaccaaggctacttccacatccccttccccgtctgactcgccggactcctccgtcgccgctgccggacctccttcctccggcgaccggaaatacgagtgccaatactgctgccgagagttcgcgaattcacaagcacttggcggacaccagaacgcgcataagaaggagcgtcagcagctgaagcgcgcgcagttacaggcctctcgaaacgccgccgtttcgttcgtgcggaacccgatgatctccgccttcgcccctccgccgcacctgctggctccgccgggctccgtcatggtctcggcggcacctccctcgtgggtgtacatgccgccacgtgccgcgcctcctcccttccacgtgtcagtgtcgcacggttgcgcgttcccgtcggcgcatggcaacaacaacggcttcagcggtggcagcagcagtaatagtaataacgtgaccataacaacgggtgtgaaatctgcgggtgcagggatgtttccctatgttggcgttgtaggagattcctcattagctgctttgtcaacggtgcaggttcaggcccgggcccaccatgctaggattgatgggccctctttgagtaggttttccaaaggtgacggtgggcccaaatttgatgatgcatggggtttggacttgcaccttagtcttgcgccggctgcgccgccatctctcggctcggcttga

SEQ ID NO: 17527 - DNA, 600 bp, Glycine max
  Peptide Sequence Number=SeqID_134305
ccgcgtgtcactgaagatggccgctccatcccggtgaccctgatcgaagcaaccccgaaccgcatcgcgcagatcaagaccgtcgaaaccgacggctacagcgccgtgcaggtgaccgtcggcgcgcgtcgcgctgccctggtcaacaagccggaagccggccacttcgccaaggcgaaggtggaagcgggtcgtggcctgtgggaattccgcgttgaagacgcgcagctcggcgatttcgccgttggcggcgaagtcaaggcggacatcttcgaagtcggccagatcgtcgacgtccagggtgtcaccaagggtaagggcttccagggcaccatcaagcgccacaacttccgtatgggcgatgcaacccacggtaactcgctgtcgcatcgcgcgccgggttcgctgggtcagcgccagaccccgggtcgcgttttcccgggcaagaagatgtcgggccacatgggcgcggtgcagcagagcacccagaacctggaagtggtcaaggtcgacgtcgagcgcggtctgatcgccgttcgcggcgccgttccgggcgcggcgggtggcgacgtgatcgtccgtccggcgagcaaggcataa

SEQ ID NO: 17528 - DNA, 162 bp, Glycine max
  Peptide Sequence Number=SeqID_134306
atggtgttgtatgctttacaaattatgttcgaggaaattagagtaggatctggtgacaaacggcagagcaagatggcaaagcacaaacaagacgcgtacacaacggccgtggagtaccagcaagcactcccagagggagtagattacgagagttggagttaa

SEQ ID NO: 17529 - DNA, 693 bp, Glycine max
  Peptide Sequence Number=SeqID_134307
atgaagggccaaaataatcaatactccttaaactctgtttccaagtttttcaatgctcaatttcactttattcagtttcttagctatatccttattttgggctttggtataagcattggagttatcttcagtttctaccttaaagactgcaactttagtctacaattcactcagttgtcactctcctcctttccgcgaacaccacccttgccaccaacaactgcaaaaccagaaatatctaatcaaactcaaactcaaactcaatcacagattcaaactcaaacgcaaatgcaaactcaaacacaaattgaaactcaaactcaaattgaaaacagtcacgtaggattgaaggagttccttaagcctcctcctgttgtgcatgatatggatgatgaggaattgctatggagagcttcagtgactgcaaagatccctgattacccgtttgatcgtgttccaaaggttgccttcttgttcttgacaaggggtcctgtgtttttggctcctttgtgggagcaattcttcaaagggcacgaaggattctactcgatttacgtgcactccaatccatcatacaatggatcacgcccggagagtccagtgtttaaaggtcggagaattcccagtaagtacaccggcaattgtgggactgcattgtgggatgctcaagctcatttgcgctctcgtctctag

SEQ ID NO: 17530 - DNA, 900 bp, Glycine max
  Peptide Sequence Number=SeqID_134308
atggattgttcagctgctagaaaaacacaaaaggctgaccgagaaaagttaaggagggatcgaatcaatgaacagttcgtagaattgggtaacattttagaccctgataggcccaaaaatgacaaagcaaccattctgtgtgatacaattcaattgctgaaggacctaatttctcaagttagtaaactcaaagatgaatatgctatgctaaatgaagaatctcgtgagttgactctagagaaaactgatctcagggaagagaaggcttctcttaaatcagatattgacaacttgaataatcagtatcagcagcagctcaggaccatgtttccatggactgcaatggagcattcagttatgatggctccatcatcgtatccatatccagtgccaatggcagtacctcctggtccaattcccatgcagccataccccttctttgctaatcaacatcctgcagtcatctccaacccctgttcaacttatgttccttatttagcccccaataccattgttgaacaacaatccaccctgtacgtatcccctccacttcatccaggtgctcggcccaatgtgtcaggaaaacaagagtccaagagcaagtcatccagggagagcatggctgaaaagaatgaggaatctaatgatgtcactacagaccttgagttgaagactcctgggtcttctgcagatcaggatttatcatctggacaaagaaaatctagcaagttgtcaaggagggaaagcagctgcactgaatggagttcattagctcatcaagcagtgtggtggcgagcagaaaggataacgaatgaaaaagtagacaagttagtcaagttcttgtgccttgaagctgctgaagtttttcattgtgcatctgctgcaactctggaggtataa

SEQ ID NO: 17531 - DNA, 1572 bp, Glycine max
  Peptide Sequence Number=SeqID_134309
atggcaactcacagactcgctttgatcatccaaaacccttcgaacgacgacgagtttttgctcgtgaagcagtcgcgtcctcccaaattccacgatgaagaatacgactctttcgtcgattctgatctctgggacttgccctcggcgcagttgaacccgctgcttgcagaatcagagccaccggttgagttggaacttgcggtctcgcattcggaatcccaggacgtcgatttgaggaaattcgacatccgttcggctctcaacgaggtgtttggacaattagggtttggggcggttgacggaggaggttggaagttccataagtatgtgaaggaagctgcctttggacccgatttacccgtcaacactgtcttcattgttggaaaattggtagcagctgaggacaaggactttagagattcatatagatggaaatctgtccgaagttgtcttaactggattctggaagtgaaaccacatggagatcgggttggaccattggtagttattggtcttataaacgaatcatctatctctacaaaatggaaagtccctcctgccataaactatcagcttgatatttctgtacaaggaatggagaaagaggaagctgggtttttattcttcaaagagtacccgcctggtaatataattatacctatgggaagtaggacattaaggccttttcacacaacaaatttggtggtgtttgcacctgaaaatgtttcaaatgattcaggggaaaacaattttattgtacgtggagatgcactaatagttgatccaggatgcctatcagaattctatggagagctagagaaaattgttactgctttgccaagacgactagtggtctttgtcactcatcatcatcctgatcatgtagatggtctctcagttatccagaagtgcaatcctgacgctactttgcttgcacatgaaaagaccatgcatcgtataagcagaggcaaagatgctaaacgaatgcttggtgtagatactgttgttgtcagtgaaatttccggacaagagagaggaggcagtaaagctgatgtttggtcacttggctataccccagttacgggagatgaagacattgacattggtggtcagagattgagagttatttttgcaccggaggatcaatctgctagagttgccttcactgaaatcctcttctcaagaattgatgagggaatacatgatctacctagttttgatttagagaaagaaatggtttggcatgctgaatttgtgtcatattatccattgtcaaagccatctgatttccttcagggaagtgccaccttggacataaaagctggtggaaatatgtctgtaagtgcgaaaagaccttatatgttggaaatgcaaatgaatcgtaggagtagagaagctaatattgtgaaggcaattgaaggtggagcaaaatctttgtttgacattatagtatatgtatattctgatgttgaccgccgtgcctggattgctgcatcatcaaatgtgaggctccatgtggatcatctagcccaacaacacaagttaccaaaggtaatgactaatatgctttaa

SEQ ID NO: 17532 - DNA, 363 bp, Glycine max
  Peptide Sequence Number=SeqID_134310
atggagagacaacttgcaacggtgtccgacgatcctctttttatcgcaatggttttgttagagagggcatgggatgtgggggaggataaaatgatcgagcgccatgacggcgaccctagatcttatcctcctgaatctggcgatggtaagtttctcttgattcagaatgttcagatagtcgaagaattacgagattttaaatatccacaccataggatcactgccatcgaaatagggcacttcaagtttcatgatttagagaaacaagacgttccagaatggaatccatcttgttgttcatcgttgtttgtgcttgagctagggacatttggttatgagaaagggagtggtggttttgtgtga

SEQ ID NO: 17533 - DNA, 141 bp, Glycine max
  Peptide Sequence Number=SeqID_134311
attttcaggaaagtgatagatctcatccagcatcaagaagttgcagccccagaatcgtacacggctataaaaacatggaggctgcacgagttatgtaccaagtccgggattgaagatttattttgtgagtttgggacttga

SEQ ID NO: 17534 - DNA, 1634 bp, Glycine max
  Peptide Sequence Number=SeqID_134312
cggtcccttccaacctctccaacctcactgctctaaaactcctcttcttatcacgcaattccttctccggcgagtttccggcgaccgtcacgtcgctcttccgcctctaccgtcttgatctttccaacaacaacttctccggcgagattcctgcgaaggtcggccacttgacccaccttttcactctccgtctcgacggtaacaagttctccggccacattcccgacttgaacctccccgaactccaagagttcaacgtctccagcaaccgcttctccggcgagatacccaagtccttgtcaaaattccccgaatcctcgttcgggcaaaacccgtttctctgcggagccccaattaaaaactgtgcatccgaccctacaatacccggatccgaaagcgccattgcgtcactattgataccaccaaacaacaacccaacaaccagtgtatcatcttcgccaagtccaatgccaaaaacaccaacatcgacatcaacaagtagtaataaaagccacgaaaagggtgcttcgaagataagtccggtggtgcttatagctattattacgggtggcgttttggttctaattgcaatagcgtttttgcttctgtgttgctacttctggaggaactataagttgaagggggggaaaggatcgaaggttttcgatagtgagaagattgtgtgctcgtcgagtccgttccctgatcagggagggttggagaggaatcgaatggtgttcttcgaaggtgagaaaaggtatgaaattgaggacttgctggaatccccttcggaaatgcttgggacgggttggtttgggactacgtacaaggcagagctcgatggtgtgaacgtgtttgcagtcaagggactcggtggcacatacatgacagggaagagagagttcgaacaacacatggaagtgttgggaaggttgagacatcccaatgttgttagtttgagagcttactatttcacgagcgagataaagttgttggtctatgattacgagtccaatcccaacttgttccagcgccttcacggattgggacgaatcccactggactggaccaataggctcaagatagcagcgggagcggcgcgaggcgtggctttcattcataactcgtgcaagtcccttaggctcatccacggttacatcaaatccaccaacgtccaactcgacaagcaggggaatgcacgcatgtctgattttgggctctccgtgttcgcgcgcccaggcccagtgggtggcagatgcaacggctacctcgcgccggaggcatcggaggatggaaaacagacgcaggaatctgatgtgtactcttttggtgtgctcctgctggagctgctgacagggaagttccccgccaaggtgaagactgaagaggttggtttcggtgcgttgctggacattccgatgtgggtccggtcagtgccgaggaagaggtggacccttgacgtgtttgattgggacctgatgaggcataaggatattgaggaggagatggtggggctgcttcagattgcgatgacctgtaccgcggctgcacctgatcaacggcccaccatgacccacgtcgtcaagatgatcgaggagttgcgtggggtcgaggtgtcgccgtgtcatcactag

SEQ ID NO: 17535 - DNA, 1181 bp, Glycine max
  Peptide Sequence Number=SeqID_134313
cccatgggctcgaaatctaccctaaggctcatgagaaccctagggccttcccttggatctctagcccaatctacttggagtcttctacccaatgcccttgcggggcactcaatgcgatcatcgtgaagcaccgctttccaatgccatccattgatgagttactcgacgaactggaccaagcatcttggttttccaagctcgatttgcgattgggcttccaccaaatttacgtcacaatggaagatgtgcataaaacaacttgtcaaactaatgagggccattatgtgttcatagtgatgccttttggcctctacaatgccccgtcaacttttcaggtcaccatgaatgacctcctccgaccctttctgcgtaagtttgtggcgatcttctttgacgacatcctcttctacatccctactctttcattacatctctaccacctcaaggaagtcttcgagagaattttatttggccccgaatgcactccagcatctgctagttcatctcgcagtgttccacctaccaacagtctcgtgtccgacaaggatcctcttttcataagtgccttttggcgggaactctttcgcttatgtgggacgaagctatggatgagcactgcctatcatccccaaatcgttagacagatggagtggtcatacaataccttggttcatttgagcactggtatttcaatatccgaagccacttatgggaagctcccatcgtcaataccccagtacctccagggtacctctcaggcagaagtagttgatgacttgttggttacacacaccactattcatgctactttatgtcgccatttacaaaaggctcaagcttctatgaagaatttggtggacgcctaccaccgagatgttcacttcttcgtcaatggttgggtctacattcgtctccgccctcatcaccagacttcagtcgtgcctacttatactaaactatccaagcgtttctatggatctctccagcccagaaccctccctttcaagctctctacctctgacaagcttgggcaacaatcctttgggtatggctcccaaggataccacttgggagattgggatcaacttcttgctgcatatgaccttaaggacaaggtcatttttctggatgtgggtgatgttagcaccttcgagcccaataaacccaagagacacacctag

SEQ ID NO: 17536 - DNA, 1653 bp, Glycine max
  Peptide Sequence Number=SeqID_134314
atggcttgcgagtgttctgttgctcactgttgccatgcttaccgctacattagtctccttactgtattgtccagactgcttttgcagtcacactattctggctgtaaagtcgttagttctgcaagccgactgcagagtgggctgagccttctatgcttgcatgtgcatcttttttatttgaataaccctgttatgattaccacaaggggtagcgatcagggatgtggatgtgcattcgtgggggtaaacattggcactgatgtttctgatctgccatctgcttcaaatatagttgacattctacaagctaatcaaattactcatgtgcgtctttatgatgctaacgcgcacttactacaagccctttcaaacactagtattgaagtaattgttggtgtcaccaatgaggaggtactgaggattggagaatctccatcagcagctgcaacctggattaataaaaatgttgttgcttatgttccctccaccaatatcacaggaatagcagttggtagtgaggttctttccactatcccaaatgtcgcccctgttctggttcctgccatgaattctcttcacaaagccctggttgctgcaaaccttaacttccgggtcaaagtttcaactccccagtctatggacattatccctaagccttttcctccttccactgccacctttaactcttcatggaactctactatctatcaactccttcagtttctgaagaatacaaattcctcctacatgttaaatgcctacccttattatggatatactaaaggagatggtattttccctattgaatatgctcttttccgacctcttcgttccgtgaagcaaattgttgacccggacactgtatttcattataacagtatgtttgatgctatggtggatgctacctactactctatagaagccttaaatttcaataatatacccattgttgtcacagagactggctggccatcatttggtggagctaatgaaccagatgctactgaagaaaatgccgagctttacattaataatatgattcagcgggtcatgaatgattcaggtcctcctagtcagccaaacatagccattaatacatacatatatgaattgtttaatgaagacaagaggaatgggcctgtatcagaaaaaaattggggcatcttttataccaatggaagtactgtttatccattgagttttggtgcttctgaccagattactggaaattcttcaggagtattttgtgtggctaaagatggagcagacactgataagctgcaatctggcctgagctgggcatgtggacaaggaggagcaaattgtgctgcaattcaaccggggcagccatgctatctccccaataatgtgaaaagccatgcatcttatgcttataatgattattatcagagaaagcatagtagtggtggaacttgcgactttgatggtaccgctacaattactaccaaggatcctagttcttcatcctgtatatttgccggaagttctaactcgagcactggtggattgagtttacctccaacggctcttggaccttcaggcccctttggtgcgagtatgaacctgcaagtgtctagccttaagtatttgatatctgctgttggtgtatttttggctctggcggtgttatga

SEQ ID NO: 17537 - DNA, 2002 bp, Glycine max
  Peptide Sequence Number=SeqID_134315
tgctgttagtactgctgctgaaaggacagatttacagttttctggtggttatcaaaatgatgattcttcaggttaccagcaaaatcgtgttgggttttatctggaaagccaaaataaggctgattcttatgagcttttgaacaagcaaagacctgattatgtttcccaagcaaatgcagggcaaaattcttatggagctggtcagattgcagatggaggtcatataaatgtgacccgaaatgttcacaataatttggtgggtcacaatggaagtgtcaatgggtactttggtcaaggcgacatgaaaatgcaacaaaaagttggggcaggtgttgataatgcatggggctctgggatgcatgcaaatccatttgttgagaaacatgattggacacaggaacctggacaagggatgcagtctcccaatgcatatagttcacctgggcctttagagtcacagggaaatcttagaggggacctaaatcaaaacattgatcattttcagcagccacaaaatgttcattacaaagggagtcatgaaatgcgtccacagtacccaggttatggacagtctcagcagagtctaaaagatggtcaatatttgccaaatttgaatactgcacaaagatcagtggttggctctcatctatcaagtaatgcaaatcctgatggcgaatcagccaaagcatctaatgatagtccatatagaggtacacttgaggaattagataatttctgcattgagggtaacgtgaaggaagcagttgaagttttggaattgctggaaaaactagatattcctgtggatttgccccgatatttgcaattaatgcaccaatgtggggagaataagtctcttgaagaggcaaaaaatgtacacaggcatgctttacaacatctgtcacctctccaagtcagcacatataatagaattttggagatgtatttagaatgtggttctgtagatgatgctctcaacattttcaacaatatgccagagcgcaatttgactacttgggatactatgataacacagcttgctaagaatgggtttgccgaagattcaattgatctatttactcaattcaaaaacttgggactgaaacctgatgggcagatgttcattggagttctatttgcatgtggtatgctgggagatattgacgagggaatgcagcactttgaatccatgaacaaggattacggcattgtaccatctatgactcattttgtcagtgtagtagacatgattggcagcattgggcatctggatgaagcctttgagttcattgaaaagatgccaatgaagccaagtgctgatatatgggagactttgatgaatctctgtagagttcatgggaacactgggctgggggattgttgtgctgaactagttgagcagctagattcttcttgtttaaatgagcaatcaaaggctggtcttgtacctgtaaaagcctcagatttgacaaaagagaaagaaaaaaggactttgacaaacaaaaatcttcttgaagtaaggagtcgagtccgtgaatatcgagcaggagatacttttcatcctgaaagtgataagatatatgccctgcttagaggtttaaagtcacaaatgaaagaagctggctatgttccggagacaaaatttgtgttgcatgacatagatcaggaaggcaaagaagaagctcttcttgcccacagcgagagacttgctattgcttatggtctccttaacagccctgctcgcgctccgatgagggcagagaactcattattcgagatgcgaaaaggttccaccattttaacgatggactatgctcctgcagggattattggtgaacatgaacttaggacactctgtatcttggggaaaatgaaagaatataaatccttgaatcccttgtgcgaaacacttgtcaaagggactgttcaattggccataggacatggaataatcattcagcctcgtcctgacccatcatttgaattccgggcaaatgcttga

SEQ ID NO: 17538 - DNA, 1452 bp, Glycine max
  Peptide Sequence Number=SeqID_134316
atggaggattctcctctctactcttcaactccaagttcccagcaacaacatcttctaaaccaccatagagaagagtcagagacagaacaacaacatggttccaacaccaaacaacacaagaagctagctcttctccctttggtttttctgatctattttgaggttgctggaggcccctatggtgaagaggctgcagtgggagctgcaggccctctaatagccatccttggctttgtgattttccctttcatttggagcattccagaggcacttctcactgctgaattggccacaactttccctggcaatggtgggtttgtgatatgggccaatgaagcctttggacccttctggggctccctcatgggcttctggaagttcttcagtggagtcatcaacttagcctcatacccggttctatgcatagattatctcaaactggtgatcccaattttatcttctggcttccctcgttttgtgtctatttctctctccacttgtgtcttgtcctttttgaactattctggtttggctatagtgggttatactgcagttgttcttggtgttgtttcacttttgccttttgtgttgttgtctttgttttccttgcccaaaattgaccccagcaaatggctaagttttggtcaagagggtgtggagaaggattggacactgtacttcaacaccatcttttggaacttgaacttttgggacagtgctagtactctagctggtgaagttgaggagccacataagactttcccaaaggccttgttatctgcagggttgcttacttgtttgggatacataattcccttgttggctaccactggggctatgccacttgatcaacaaagttgggttggtgggtattttgcacatgttgctggggtcattgctgggaattggttgaaaatttggatggaaattggtgctgttttgtcaataattgggttgtttgaagcccaactaagcagtgctgcatatcagcttcttggtatggctgatttgggattcataccaagaatttttggtgaaaggtctaagtggtttaacactccttggatggccattttgatctcaacagttgtagcactcggcatgagtttcttgaccttcacagagatcatatctactgtgaatttcttgtacagtttggggatgcttttggagtttgcagctttcctaaggttgaggaggaaattccctgctttgaaaaggccatttcaggttccattggggttctttggtttaatcataatgtgcttggtaccatcaattcttttggtgtatgtgatgactgttgcttccaaaattgtgtatgtggctagtgccttcttgacctttcttgggattgctttatattatttcatgaatctttctaagtctaggaagtggcttgaattcagccgtgtgggagataaattgggtgaagatgattatgttttgtag

SEQ ID NO: 17539 - DNA, 1266 bp, Glycine max
  Peptide Sequence Number=SeqID_134317
atgtctgtagttgcgtgcctaaactgcattgcaattcctgaattggagtatagaggcatggagggaattcctgtgaggactgtgataccttcagctacaagaagggttcccacccaaaacagaaatttacgctttgctgttcgagccaaactctctccttctgattttcaagattttcagagctatgctaggccttcacatctcttgccagcctctgaagtgaaagtgtatacaaatacatcagtagaaaacatttcgtcatctttgaaggaggatggatccaaatctttatttagggtcaagttagttacaagcaacgcttatggctcagctattagtgacttaagtgctggacttctactatgcttgatagatgaaaacggaaattctatattgcaaaggatccctgtgagtttgatgatgggtcgttctacagaatcaggggatatgactaatattgacatgcttcatttccaaagaggttctttagatgaattcatttttgagggtcctaaaattgcacgacttgaggctctttgggtcagtgttgaatcaggtcagtggcgcctaggaagtgtatccttaatggttattagctgtgaagggaaaccatcaggactggaagatggggtaacaagttacactggcttccagtatgactttcagattgatgatgtgttgcttggtgagggaactgatctgtccatgttggaattaagacctagccttgtgactgagctggaagggattgatcccataagcatcttcaacaaaggacttaatgaccctaccttgttctcaagtcctaagatctcaaatgaagagagcatgaaggaatatgcagatttgaagttctcattgttattttatgatgctatgttgacactattcggtacatcagttgcttccctctcagctggggaaaatgctgggattgctttcttgattggtgggattggaggcttcttgtatctgctactattgcagagatctgtggatgaattgccagcttcagaattaatcaccaatgacaagggaagaactgatgcactgttcagaggagtgaagggtccaatagcaagtgtggcattggctataggcttggctgtaattgcatcaagatatagctctggagatcttgaactgatgctaacaccaaaagatctcatagttggaatgatgggatttcttgcatgtaaagtttctgtggtgttagctgcatttaagcctattacactaggtccaaagttaccaagtgatatgtaa

SEQ ID NO: 17540 - DNA, 564 bp, Glycine max
  Peptide Sequence Number=SeqID_134318
atggcaacaacaacaccctcaaaccgatcatcagaggcgtttgctctcatggcaatcctcagcactctgctttgcacggcggtggcggcgaaggagagcgtgtacgagatactccccaagtacggcctcccgagcggtctgttaccggacaccgtcaccgactacacgctcgacgaggacgggcaattcgtcgtcgttttggcgaagccctgctacatacagttcgattacttagtttactacgagaccaagatctccggcaagctcagctatggctccatcaccaacctcaagggcattcaggtccagcgcctcttcatctggttcaacgtcgatgagatcaaggtcgatttgcctccctccaacagcatctacttccaggtcggcatcatcaacaagaaactcgacgttcaccagttcaaaaccgttcgctcctgccgcaaatccctctcttgcccaccttgccttccacgtccaattcagtttcatgagaggtgtgatttatgccatcagattcggggtttacaagtgggattactaatattgtttgcagtacaacattga

SEQ ID NO: 17541 - DNA, 588 bp, Glycine max
  Peptide Sequence Number=SeqID_134319
atggctactccacctggctcacctcctcctcctcctccttctcctcctcctcttgcaaacccatcagcgtcttcgtctaccgtgaagcggacatgcaaagccacacggctacaatccttagccattagaccacctggggcagagagaccaatggtccacgtcgatcctacgactagtaaggccgacggtccccaaaagaagaaattaaaaacatatttagggattgtcgctcatgataaggtggaatttgaaatccctgaaacttctgacaataggacaaagaagaaagttcttcagactatgggcgacaaggacggtgtggataacactgtctatgaaaaatacagcattagcaaggagaaatgggctcagttttgtcagacccaccgagatccctcgtgggaggatgtgcggaaaaaagtacaagccatccagaagcaaaacaccgctccccacgtgttgtgtcgtgggggttatgattatttagaacaaaagctgatggctgagaagacaaagaaaaaactagaggaagctgctcagtccggaagcactgagggcgtcattaatcctccatctcccataagatga

SEQ ID NO: 17542 - DNA, 1986 bp, Glycine max
  Peptide Sequence Number=SeqID_134320
gatctctactacaatgacaaccccaaagctgaagatgcgtctttgagagcatgtacaaaggtcctgcttccaattaaagacacgcctgacgctaacaacccattcacattcgcaactgcagatatcttcactaaagtagaattaactggtgaatgtgcagattgccactatcgcagaggagggcagtgtcaacttgacagcagagagatatttttttgtgccactgccaatagtaccttgatgaatgtgcagattgtcaccatctccaaggagggcggtgtcaatgttacgataataggccttgtagtagtggtggcattagtagctgtagttctgctgatggtcttggcttgcagctttagaaaaaagatcttttgcatggagaatccaacccatcggataattgaagggtttttgaaggaacatggaccccttcctacaactaggtacagttattcagaggttaagaaaatgaccaattcttttagaaacaaattaggccaagggggatttggtagtgtatacaaagggaagttacatgatggtcaagttgttgcggtgaagattttaaataaatcagagggcaacggagaagaattcttcaatgaagttgcaagtattaatagttctaaacaggctctaatatacgagtttatgcctaatggatctcttgacaagtttatatatgaagagaaaaatccaccaggggttgctcgccaattggattgcaaactattgtatgatattgcaattggcattgctcgtggattagagtacttacacagaggttgcaacactagaatcttgcattttgacataaaacctcacaacatactactagatgaggatttcagcccaaaaatttcagattttggacttgcaaaactatgtccgagaaaagaaagtgtcgtatcaatattgggtgcaaggggaaccgcaggttatattgctccagaagttttttccaggaattttggtgcagtatctcataagtcagatgtctacagttatgggataatggtcctagaaatggtcggaatgagatataattctaaggctgaagtaaactgctcgagtgaaatatattttcctcattggatttacactcatcttgaatcagatcaggaacttggtttacaaaatataagaaatgaaagtgatgacaaaatggtgagaaagatgacaatagtgggcttatggtgtatacaaacttaccctccaactcgaccagccataagtagagtggtggaaatgctagaaagtgaagttgagttattgcaaattccacctaaacctactttttcttcttctgcaacccctccagcccatttttcaagtgagacaaatgataatgaatggactagtgaagctttgaataatacaaagattttgctaactagtacttgggaatcaggacaactactaataaagcttttaaagacgttggaacaacaccggttaaaccaaaaccgtcttcaattcttggccagtgacaattttctaaatttttggatgcgcgtcatcatattggatctaaaaattaaaagcgaagtgtcgattccactccagatcttgcgtgccttgcccttacctctcttgcagccgtcgttgtggtgctttcatcaccgtcgtgttctcaccaccattgtgccgccgtcgacgtccaagtgtgaacccatacaccactgtagaagcgtcattataagaatatttggactattatttgacctattctgtataaatcccgttctttttctggttgtcctgatttttgaacaggctgaggttgctaggaggatgctttttgagtattgcactccaaagaagaaaatttatgctattcctaaaccatttgatatagagggtgctggtgggtttgaggaaattgatactccaaaagccccattgaggaaacccaagtcaaagctgattgttgccggtattagaaagggacttgatacatacttagaagatctcactagctga

SEQ ID NO: 17543 - DNA, 1692 bp, Glycine max
  Peptide Sequence Number=SeqID_134321
atgatccagctcgagaaaaatggaaaaagcatagtgcttacaggcgtggctcagcagaatgcgatttcaattctggatgaagattttcacaagcttttacaacaagacccttgtggcactttgaagaataattatagccttccttcccctttttctttgtattctattcacataaaattcaatgtaacactgttcagatgcaaacacagcctcaaaatgaaaccgccagcacattattttaatcactcgtgccctgactatgattatgatatatactatgacagccttccctctcctaatgataaggaggtgcatagccttttctcatcctgctcagttattcagatatcatcaaaagacttgactaataccaatgacattctgtcgtttgtatctgctgagatggttcttcaagtagtattatctaatgattgtgaccagtgctataatcgctggggaggccaatgtcggcttgacgccaatcaagagttctactgtgaaaaagcaccaaagaataagagtaaaattttgaagctggtacttgtacttggacttgtaacagcattactttctcatccttatataataatctttctaattccaataacctctccagctgttacaattgctctgttgctggtaatggtaatgatctaccatacaagatggaagaagaagcaaaatccgaccaatcaacagattaagatctttttggaaagacagggaccccttcaaactaagcggtatgattattctgagataaagaaagtgaccaactccttcagaaacaaattaggccaagggggatttggaagtgtatacaaaggaaaattaccagatggacgttatgttgcggtgaagatcctaagtgaattgaaagataatggtgaggacttcatcaatgaagtggcaactatcagcagaacttctcatattaacattgttaatcttttggggttctgttgtgaaggttctaaacgagctttagtttatgagtttatgtctaatggatcacttgagaagtttatctttgaagaaaatgtcgtaaagacggatcgtcaattggactgtcaaacgatctaccatattgcagttggtgttgcccgaggactagaatacctgcatcagggttgcaatactagaattttacattttgacataaaacctcataatattctgttggatgagaatttcaaccccaagatttctgattttggactagccaaaatttgcacaagaaaagaaagtatgatatcaatatttggcgccagaggaacagcaggctatattgccccagaagttttttccagaaatttcggtgcagtatcacataagtcagatgtgtacagctatgggatgatgatcttagaaatggttggaagaagaaagaatattaagactgaagtaaatcgctcgagtgaaatatactttcccgattggatttacaattgtcttgaatcaaatcaagagcttggtttacagaacataagaaatgaaagtgatgacaaattggtgagaaagatgacaatagtgggcttatggtgcatacaaacccacccttccactcgaccagccataagtaaagtgctggaaatgctaggaagcaaagttgagttattgcaaattccacccaaaccctttttgtcttctcctccgacctctccagtccatttatcttatgagactttgtaa

SEQ ID NO: 17544 - DNA, 282 bp, Glycine max
  Peptide Sequence Number=SeqID_134322
atggaaagttccaagattaccacaagtaaaggagtgtggacaatcttggtgcccatttccataaccagcggagagaatgagtacaaggtgacaaaacaagaggaagcagaacaaatcaactatagccataccaaattcccattaattttaggaacaacatattgccccaaagacaggacgggaatggactcttccaaaatccacacgtttgccaatttacagtacacttgtcaacaagttaacaatgcacgtgtccagctggaacaagtgatcacgcgctaa

SEQ ID NO: 17545 - DNA, 1695 bp, Glycine max
  Peptide Sequence Number=SeqID_134323
atgatccagctcgagctaaatggaaaaggcatagtgcttataggcgtggctcagcagaatgcgatttcaattttggatgaagattttcacaagcgtttacaacaaaacccttgtggcactttgaagaataattatagtcttccttcccctttttcttctttgtattctattcacataaaattcaatgtaacactgttcaaatgcaaacaaagcctcaaaatgaaaccgccaacacattattttaatcacccgtgccctgaatatgattatgatatatattatgacagccttcccactcctaatagtaaggaggcgcatagccttttctcatcctgctcagttattcagatatcaacaaaagacttgactgataccaatgacattctgtcgtttgtatctgctgagatggttcttcaagtagtattatctaatgattgtgaccagtgctataatcacaggggaggccaatgtcggcttgacgccaatcaaaagttctactgtaaagaagcaccaaagaataagagtaaaattttgaagctggtacttgtacttggacttgtaacagcattactttctcatccttatataataatctttctaattccaataacctctccagctgttacaattgctctgttgctggtaatggtaatgatctaccatacaagatggaagcagaagcaaaatccgaccaatcaacagattaagatctttttggaaagacagggaccccttcaaactaagcggtatgattattctgagataaagaaagtgaccaactccttcagaaacaaattaggccaagggggattcggaagtgtatacaaaggaaaattaccagatggacgttatgttgcggtgaagatcctaagtgaattgaaagataatggtgaggacttcatcaatgaagtggcaactatcagcagaacttctcatatcaacattgttaatcttttggggttctgttgtgaaggttctaaacgagctttagtttatgagtttatgtctaatggatcacttgagaagtttatctttgaagaaaatgtcggaaagacggatcgtcaattggactgtcaaacgatctaccatattgcagttggtgttgcccgaggactggaatacctgcatcaaggttgcaatactagaattttacattttgacataaaacctcataatattctgttggatgagaatttcaaccccaagatttctgattttggactagccaaaatttgcacaagaaaagaaagtatgatatcaatatttggcgccagaggaacagcaggctatattgccccagaagttttttccagaaatttcggtgcagtatcacataagtcagatgtgtacagctatgggatgatgatcttagaaatggctggaagaagaaagaatattaagactgaagtaaatcgctcgagtgaaatatactttcccgattggatttacaattgtcttgaatcaaatgaagagcttggtttacagaacataagaaatgaaagtgatgacaaattggtgagaaagatgacaatagtgggcttatggtgcatacaaacccacccttccactcgaccagccataagtaaagtgctggaaatgctaggaagcaaagttgagttattgcaaattccacctaaaccctttttgtcttctcctccgacctctcctgtccatttatcttatgagactttgtaa

SEQ ID NO: 17546 - DNA, 1694 bp, Glycine max
  Peptide Sequence Number=SeqID_134324
actgtggcatattggtgatacatggctgtgatgacaaggaaccaggggccaaaaaaaccataaaatgtaacaatacatggtttgatgttgtcgggctcgaccagtttacgattaccataaaagacgataaactgcacgacttgttgctacaaagaagttgcgacaccttcagctacagctctacgttcacagtcagctcccctttgcttaaggcttctcgtttaaagcattacctagagatactcagatgcaaccacaccctcggtcatccgccaaaaaaatctgtttctaacaacacactttgcaaaaatgaaacactctattcaatggtggaccccaacccctccggctccgggtacagtcatcacaatggatgttcgatgcttctgattccaacctgcttgcagctactggatcgccatggccatctatattccagtgaccctttcgagttcataactgataatatcgccgtcgaaatagaattatctccggattgttctacttgtatctatgctcatggaggccaatgtcggcttgacaacacccaaaagttttattgttacaaagttgcatctgccggtggagcactaggagctatgatatttttgatttggtgcattagaagacgcttttacaagaagaaaaatcccacccaccaaataattgagatgtttctgaacacccacggtcaccttgcagccaaaagatacagttattcagagataaagaaggccaccaactccttcagatacaaattgggtcacggaggatatggtagtgtatataaggggaagttacaagatggaagccttgtggcagtaaaagttttaagcgactccataggtaacggtgaggaatttatcaatgaagttgctagcataagtgtcacttcccatgttaacattgttagtttactgggattctgtctggaaggttctaaaagagctctgatatataagtacatgcctaatgggtcacttgagaagttcatatatgaagacaaggatccactcaagctcaatcttcaattgagttgcaaaaccatctacaatattgcaatcggcgttgctcgaggattggagtatttgcacaggggttgcaatactaaaatcttgcattttgacatcaaacctcacaatatattgctagatgaggatttctgtccaaagatttccgattttggactagctaaaatatgtccaaagaaagagagtattgtgtccttattgggaaccagaggaacagcgggatacattgctcctgaggtattctcaagaaacttcggagaagtgtcacataaatctgatgtgtacagctatggaatgatggttttggaaatggttggggaaagggtgaataacaatgttgaagttgaatgttcaagtgaaatatattttccacactgggtttacaagcgtcttgaactgaatcaggagcctagattgcgaagcataaaaaatgaaagtgataaagaaatggtacgaaagttggttatagtgagcttatggtgcattcaaacagacccgtcaaataggccagcaatgagtagagtggtagatatgatggaaggaagcatggagtccttgcaaataccaccaaaaccttatctctcttcacctcccagatctcccccaagaccctcggatcacaacacttacacatctcacactacgtatccttctgagaactga

SEQ ID NO: 17547 - DNA, 195 bp, Glycine max
  Peptide Sequence Number=SeqID_134325
atggaaccaaaatttcacaatttaaagagtaagggatctaaaattgagcaaaaacaacaattccagccacgtcacataaagatgaagatcgagctacaatctttattgtcttggccactcactattgataaagagttgagaagccagacaaaatctcaaaaagctccccagtatacctccggagctgagaagtaa

SEQ ID NO: 17548 - DNA, 192 bp, Glycine max
  Peptide Sequence Number=SeqID_134326
atgtaccctttctatggcccaagtcgcactaacgctccagcctccagcaacattcggactctttatgagccgggggggacctttcttctagcctgtcaattcttagaaagaagccagacaaaagctcaaaaagctccccagtatacctccggagctgagaaaaggatgctaaggatgcaaggaggatgttaa

SEQ ID NO: 17549 - DNA, 1443 bp, Glycine max
  Peptide Sequence Number=SeqID_134327
atgcataattatacaaagtgccccgattacgatctctactacaatgacaaccccaaagctgaagatgcgtctttgagagcatgtacaaaggtcctgcttccaattaaagacgcgcctgacgctaacaacccattcacattcgcaactgcagatatcttcactaaagtagaattaaccgatgaatgtgcagcttgccactatcgcagaggagggcagtgtcaacttgacagcagagagatatttttttgtgccactgccaatagtatcgcagggagaagaagttggattgtgaaaatgatactaggactcggtctagcattactttctcatccttatataataatctttctaattccaataacctctccagctgttacaattgctctgttgctggtaatggtaaagatctaccatacaagatggaagaagcaaaatccgaccaatcaacagattaggatctttttggaaagagagggaccccttcaaactaagcggtatgattattctgagataaagaaagtgaccaactccttcagaaacaaattaggccaagggggattcggaagtgtatacaaaggaaaattaccagatggacgttatgttgcggtgaagatcctaagtgaattgaaagataatggtgaggacttcatcaatgaagtggcaactatcagcagaacttctcatattaacattgttaatcttttggggttctgttgtgaaggttctaagcgagctttagtttatgagtttatgtctaatggatcacttgagaagtttatctttgaagaaaatgtcataaagacggatcgtcaattggactgtcaaacgatctaccatattgcaattggtgttgcccgaggactagaatacctgcatcagggttgcaatactagaattttacattttgacataaaacctcataatattctgttggatgagaatttcaaccccaagatttctgattttggactagccaaaatttgcacaagaaaagaaagtatgatatcaatatttggcgccagaggaacagcaggctatattgccccagaagttttttcaagaaatttcggtacagtatcacataagtcagatgtgtacagctatggaatgatgatcttagaaatggttggaagaagaaagaatattaagactgaagtaaattgctcgagtgaaatatactttcccgattggatttacaatcgccttgaatcaaatgaagagcttggtttacagaacataagaaatgaaagtgatgacaaattggtgagaaagatgacaatagtgggcttatggtgcatacaaacccacccttccactcgaccagccataagtaaagtgttggaaatgctaggaagcaaagttgagttattgcaaattccacccaaaccctttttgtcttctcctccgacctctccagtccatttatcttgtgagactttgtaa

SEQ ID NO: 17550 - DNA, 384 bp, Glycine max
  Peptide Sequence Number=SeqID_134328
atggaggctgcggttgcacctgaacagagttgtgttgtagtggatatgaaaagaagcaaagtggaagctgtgaggaaaaggaagagtataattgtttctgaaagcttcacaactttcgttctgcagaaggtcatagagatttttgtctctaaaatgaaaagttgtgagaggagtagtaggacttctgaaatgctgagtaacgctggatcatcacaattgcgaatgggcaataagccacagtccgggcgttcagttagagtgaatgggaaactgatattgctcagatatccacatggaaacgaaggtggacactctgcttggttcccagccgccaagacaagtggcaaaaggccacaaaataaaagcaataatactaattcataa

SEQ ID NO: 17551 - DNA, 225 bp, Glycine max
  Peptide Sequence Number=SeqID_134329
atgagccttccctctcctaatgataaggaggtgcatagccttttctcatcctgctcagttattcagacatcatcaaaagacttgactgataccaacgacattcagtcgtttgtatctgctgagatgtgctataatcacaggggaggccaatgtcggcttgacgccaatcaaaagttctactgtgaaaaagatacgcttcacatgaatttctcatttattccttaa

SEQ ID NO: 17552 - DNA, 483 bp, Glycine max
  Peptide Sequence Number=SeqID_134330
atgaaaccgccaacacattattttaatcacccgtgccctgaatatgataatgatatctactacgacagacttccctctcctaatgataaggaggtgcatagccttttctcatcctgttcggttattcagatatcatcaaaagacttgactgttaagaatagtcccacatcggttaggatagaagggttgagtttgacgccagactgggaacatggaccccttcctacagctaggtacagctattcagaggttaagaaaactttcggtagtgtatacaaagggaagttacaaaatggtcgtgctgttgcggtgaagattttaaataaaccagaaggcagtggagaagaattcatcaatgaatttgcaagtattagcaggactccacatgtcaacattgttagacttttgggattctgtttagagaccgaaatgaagttgcaagtattagccagaggaaccgctggtatcaatacttggtgctag

SEQ ID NO: 17553 - DNA, 1467 bp, Glycine max
  Peptide Sequence Number=SeqID_134331
atgtatcattatacaaagtgccctgattacgatctctactacaataacaaccccaaagctgaagatgcgtctttgagagcatgtacaaaggccctgcttccaattaaagacgtgcctgacgctaacaacccattcacattcgtaactgcagatatctccactatagtagtattaactgatgaatgtgcagcttgccactatcgcagaggagggcagtgtcaacttgacagcagagagatatttttttgtgccactgccaatagtatcggagtaattttaatttctgcagcagggagaagaagttggattctgaaaatgatactaggactcggtctagcattactttctcatccttatataataatctttctaattccaataacctctccagctgttacaattgctgctctgttgctagtaatggtaaaaatctaccatacaagatggaagaagcaaaatccgaccaatcaacagattaagatctttttggaaagagagggaccccttcaaactaagcggtatgattattctgagataaagaaagtgaccaactccttcagaaacaaattaggccaagggggattcggaagtgtatacaaaggaaaattaccagatggacgttatgttgcggtgaagatcctaagtgaattgaaagataatggtgaggacttcatcaatgaagtggcaactatcagccgaacttctcatattaacattgttaatcttttggggttctgttgtgaaggttctaagcgagctttagtttatgagtttatgtctaatggatcacttgagaagtttatctttgaagaaaatgtcataaagacggatcgccaattggactgtgaaacgatctaccatattgcaattggtgttgcccgaggactggaatacctgcatcaaggttgcaatactagaattttacattttgacataaaacctcataatattctgttggatgagaatttcaaccccaagatttctgattttggactagccaaaatttgcacaagaaaagaaagtatgatatcaatatttggcgccagaggaacagcaggctatattgccccagaagttttttccagaaatttcggtgcagtatcacataagtcagatgtgtacagctatgggatgatgatcttagaaatggttggaagaagaaagaatattaagactgaagtaaatcgctcgagtgaaatatactttcccgattggatttacaattgtcttgaatcaaatcaagagcttggtttacagaacataagaaatgaaagtgatgacaaattggtgagaaagatgacaatagtgggcttatggtgcatacaaacccacccttccactcgaccagccataagtaaagtgctggaaatgctaggaagcaaagttgagttattgcaaattccacccaaaccctttttgtcttctcctccgacctctccagtccatttatcttgtgagactttgtaa

SEQ ID NO: 17554 - DNA, 474 bp, Glycine max
  Peptide Sequence Number=SeqID_134332
atggaaccaccaagccagattgtctcattgcggactaccacgactgatcccgatcatgtgaaagtcattcagtgggacgacttccagcacgatcttgcaaggttggcgagtctctcttctgcactccacgaagccaacgagaagaagcggaatcttcagcacaagctcgagtccctaatccagtggccggaggtacggcgcgtttggtgtcgtggagaatgtgagctcgagtggcgaatggaatcgcgttctgtgtttgattacgaaatttcttggcggaaggaaatggaattggggaggggagatgaatgctattttatccccattttgttttcggattgtggttttaaagttggtgaccaagaggctttagacctcgaccactgtttagtgatgttgagagtgtcatgtctatgggctgctccatggaagcctgccatgtcgcaactcaccgtcgtgcctggagtgacatga

SEQ ID NO: 17555 - DNA, 276 bp, Glycine max
  Peptide Sequence Number=SeqID_134333
atggcaaatacgttgcggttatacttgacctgcattcggaacacgctcgaggccgcaatgtgcctccagaactttccgtgtcaagaagtcgaaaggcataacaagcccgaggttgaactcaagaccagccccgaactcctgctcaatcccattccaattagaaggaaagctggagcttgtaggcactgtgctatatattctataaagtccagcatttctggattgagtggagtgctggacttcaagacatatcttattccaccattttccttgtga

SEQ ID NO: 17556 - DNA, 1071 bp, Glycine max
  Peptide Sequence Number=SeqID_134334
atggcatcttcaaagaagaaaactatggaaggtttgatgtctggaccttttatatttatcccatactcatctgtctatgatcatgatgatgctgcatgtgggacgtttgtgtctcccaatgaagtctattggcatgattcaactggttctattcagaaaatgaaggagttccatcctcaatgtggctcatcttcttcccctataaacaagtcattatgcaatatttaccctagtcttcgtggtttctttgttgatgaatgtcaagtacaagaggcacctcctctatgcagctatattcaaattatgttgcagttatcaactgttactttgccttcacaagcagcagataaaattttgcaagttttcctcaagtgggcagatggactaaaatctggtttgctgagtgttgaggatgtcacatatctcaaagaatgtctttcaaaattggaatttccagtgcttcccactgtgcaagataagtgggtttcgttgcatccttcctttggtcttgtctgctggtgcgatgataagaagttgaaaaaggaatttaaacattcagacaacctcgactttctctatttcggtgaactggttgaggatgataaggaaatggggcaagaaaaaatttccatcctcatgaaaaacttaggtattccagctatctcagaggtggtaactcgggaaccaatatattatggtcttgctgattgtagtttgaaaaagtcattggtaaactggactctgccatatgcccagcgctacattcataaatttcatattgataaatatgataaactcaagcagtctggttttgatattttcaaccatctgaatgtcattgttgttgagaagctgttctacaggaatgttataaagacctgtggcagtgtatcaaaaaaacgagtcgaatgtagttgtcttttgcagcctaagattccccttgatgatttcctccaacctcctttttggtctcccacgactcctttttaccagactaacaaccatgcaatctattcttctaacgggcacctcctcttgtggccttctttgtatatgcctaaatcaccataa

SEQ ID NO: 17557 - DNA, 4449 bp, Glycine max
  Peptide Sequence Number=SeqID_134335
gtttcatctatcaaatctggaatgaggaacaacatctatgataccttccaagctatcatcgataatggattgggcaactcaccgaccaagggttctgaatacgatactatagacgttggaccaggccaggaaaatgtaccggtcataactaaggataacacagagaatacaaactgtgaaaattgggtggctgagcagtttggtatgaaaaaattcgattctcttggttatggagatttcttatcattccttgagaagcaccctaacctgttacctcatgaactactgaagttgttggttggtgacacgtgcgaaaattcctctttcagggcctgtatgtcctcaaatcaattgattgctctagtatctcaggctctaagtggtttgtgggagaatgaaacaataaccaagcaaatgatatccatgctgcttatgaggcagttcccttcaattaattttgaacttgtggaaaatggctctcttgtggatctgctggatactgttaaggggcatacatctagcgtgacttcaaaatgtgttgtattttctgctactattatagaaaagaactataatggagactcatcaagtgatagagataacaattggtcagaaattcccactgataggtctgaaacgagccataaaaaaagcactgaaactgttatagcaaaaaatgcaattgaagtcttgctgaaggcgccaatgttgtctgacttgagcaagtggtctcattgggatcttaggtttgcacccttcctaggtccatttatatcgtggctgttgaatgatgtaaataccaaggaactgttttgcttagttaccagagatggaaaggtgatacggatagatcattctgctaccttggactctttcctggaggctgcagttcaaggatcctctttccaaactgcagtgcatttgctgtctctgatctcacttgttgggggagaaaaatatgttccattgtcacttctaaaatgccattcctgccatgcatttgaagttatgttcagaaactctgtagaagatgttgaagttagtaatgatgggaatgctctccaccagtctgtggaagcattaagtaaaacaaaatttttaactgaaatttcaactgctaaaatgagaagtgtgtttagcaaacacatgcataaagtgagtaaggtagcatccattctgtcaaggtttgtccttgattgtcttggtaacttaccggctgaatttcacagttttgcttctgatgtgttgctttctgggatgcaatctgttttcaaggatgccgcttcaactattttatgtgaatgcagcaatatggagcaacgtctcatgcttcatgaaatagggttatctctgggtatttctgagtggattaatgattaccatgcacttatttcaaacaactcttctgacattcattgtgctcgtgtttcatgcttaaaagatgccacaactgatataaacacaagtctgaagcttgaccaagttaccttggataagtctcctatacctgaagcaaatatggttacatctcttgtaccccatcgacttattgaagggtgtacagaaatcattgaaacagttgatccagaaaaatctaatgatgaatctaacacttgctgtctgggaaattcatttcaacatgtcgaagatatggatgcttctcggcttattgaatctattaggcgagatgaatttggcctagattcaagtctttctgatattgatagttgcatgttgaagaagcaacatgctcggttaggtagagcactgcattgcctttcacaagagctatattctcaagattctcattttattcttgaattggttcaaaatgcagatgacaataattatccagagaatgtggaaccaactcttacatttattcttcgagattctggtattgttgtattgaataatgagcgaggtttctcagctcaaaatatgagagcactttgtgatgttggaaattcaacaaagaaaggatctactgctggatacatagggaagaaaggcattggtttcaagtctgtgttccgagtcacagatgctccagaaattcattccaatggttttcatgttaaatttgacattagtgaaggccagattggttttgttttgcccacagtagtacctccttgtgacattggggtgctcaggaggatggcatctactgatactgaattgtgtgacgataatccctggaacacatgcattctgcttccattcagatctcatctatcagaaggaatggccatgaatagtgttttgtctatgttttcagatcttcatccttcactgttactatttcttcaccgcctcaagtgtatcaagttaagaaacttgcttaatgatacacttactgttatgaaaaaagaaatttcaggagatggtatcattaaggtttctcatgggaaagagaaaatagtgtggtttgtagtatctcagaagttgcaaacaaattccattcgctttgatgtgcagacaactgaaatttctatggcgtttactctgcaggaatcagataatggttacattccatgttcagatcagcagccagtttttgcatttcttcctttaagaacatatggcctgaagtttattcttcaaggtgattttgttcttccttcatctagagaggaagttgatggagatagtccatggaaccagtggttattgtcagagtatcctaatttgtttgtcagagcacagagagagttttgtgaacttccctgttttaggagtgagcctggaaagggactgtctgctttcatgagttttgttcctttagttggggaagtgcatggttttttctccagtcttcctcgcttgattatttctaaattacgtatgatgaattgcttacttgtggacggtgacaataatgaatgggccccaccatgcaaggtattgagaggttggacagagcaggtgcgtaatcttattcctgacaacatgcttcttgaacaccttgggcttatatacctggatagaaatatagtattgtctgatgaactagcaagggcactaggcattgaggagtttgggcctaacattcttgttcgagtactgtcatctttatgccatacgaagagtggtctgatatcgatggatatgagttggttagcttcttgtctaaatattctttctgtaacaatgttcaattcgtctggctctgtgccaatcaattttgaaatgaaagatgttcagaaaaatcttcaaaaaatgccatttattccactttcagatggtacatacagctcagtggatgaaggcactatatggttgcatttcaatcatttaaacacaggatttgatggtgagcataaaattgaagctttccctaatatatgtgctaaactaaggactgtaagtcctttccttttttctgcatcttctggtactccgagcttgaatgtgacatttttggacaatgttacccggttacttcagagtattggtgttcaacagttgtctgtacatgatgttgtgaagctgcatattttacctgcattgtctgatgaaacaatggcaaacaaaaacagagtgctgatgattgaatatgtatgttttgtaatgctacacctgaactcgagctgttctgattgttttattgaaagggagcatataatatccgagtttagatgtaaatctttgttattgacaaattatggtttcaagtgtcctgctgagataccaattcatttctgtactggatttgggaatcctgtcactccaaaaatgttggctgatagtgtgagtatgaggtggcatgaggttgacataagctatttaagccacccagtaaatgaatcagtttcatctgcactgattaagtggagggatttttttgagaaatttggcatcacagattttgctcaagtagttcaggtggataagagtgttgtcgatatatgtgatgtcacatttaagcagatgatgtgggataggggtctaatatctgctgagtcaatagtcaaagattgggaatcctctgaaattgtgcaattagtatccttattgtctaaaagtggcaatctagaaaattgtaaatatctcttggaggttcttgatacattatgggatgtttgttatagtaataaaactacgggttatttctatcttaaatctgttggagatggccatccctttaagtctacttttatatgcagcctgtgtgatatccagtgggtggtttcaaccatggatgatgagctacactatcctaaagatttgttttatgattgtgaaacagtccggatgctccttggagattttgcaccatatgctgttccaaaggtgaaaagtgaaagattggtaaaagattttgggtttaagactagagttactctcgatgacatttttgatgttcttaaagcctggagaaaatcatcaaagactccattcaaggcgagcacaagtagatatgacatcgaagacagatacatgtga

SEQ ID NO: 17558 - DNA, 549 bp, Glycine max
  Peptide Sequence Number=SeqID_134336
atgggttccaaggcgaagaagaagggttcaccggaggacattctggaaaccctaggagacttcacgagcaaagagaactgggacaacttcttcaccctccgcggcgattccttcgagtggtacgccgaatggccccatctcagggacccactcctctccctcctcaaaaccatccctctccctctcccgcttcagctcctcgtccccggctgcggcaactcccgcctctccgagcacctctacgacgccggccacaccgccatcaccaacatcgacttctccaaggtcgtcatcggagacatgctccgccgcaacgtccgcgaccgccccctcatgcgatggcgcgttatggacatgaccgtcatgcagttcgaggacgagagcttcggtgcggtcattgacaaaggtggactcgatgctttgatggagcccgagcttggccccaaattggggaaccagtacctatcagagggttcaacccttgtagatggaaaaaacgtagttgggagggagaaccccactacagttggccagccaggtttccgataa

SEQ ID NO: 17559 - DNA, 459 bp, Glycine max
  Peptide Sequence Number=SeqID_134337
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaaatcaacggttcctctcgtactaggttga

SEQ ID NO: 17560 - DNA, 144 bp, Glycine max
  Peptide Sequence Number=SeqID_134338
atgccaagaccagacaaacccaattggcctacgatgcattcgcgctcagcgccacacctcgcgcttagcgcgttcagatcgtgcgctgggcgcgccatgcacgctgggcctgtgcttctgttggatcgggcgctgggcgcctag

SEQ ID NO: 17561 - DNA, 360 bp, Glycine max
  Peptide Sequence Number=SeqID_134339
atgggcgatgttgtgccacccaagggtccttgggattacacccttgactatctgccttggttttatcgggtttctcacccctatgccattttgccagaggagggagagtgtccacgtccttctgtacatttattgcccatcctaatgcagctatcgcctgcacaaccactagcagagtatgtaccaggtggagtctacttttgccaattactaattgaaattgttcttccaggatcaatttcggattttgtcaagcaccatgcaaagcttgttggactttacaatcatgccaaagggcacaagtcatcattagactatacatcaagctctgcaattgctgcaggaaggcttcgaagctag

SEQ ID NO: 17562 - DNA, 471 bp, Glycine max
  Peptide Sequence Number=SeqID_134340
atggcagcgttgcagaaattcaagctgttcgcgacgccatgtggagtggggcaaagcccaacccaaagcccgaggacgagcccattggttcaattccggcggcccaaaaccacgctgcgtagtctgcttagcctgaaccggtcacttcggcggcaagaaaacgtggtggagaagaatcccatgcggagacactcactgaaggccctctttgtgtcctcgccgccacgagaggagcgtgtgcatgaaaatgaaactactccaatgttggcttccgttgccgttccccattcttcttggagtaatgaacccggttcaaccaacccgccttgggccggttttcgttgcaggaaaacaaaaaaacaaaaaggaaaagttgaattagaattgtgtaaagagaggcgtgagacacgtcatgagttgggagaggtgaagaatactttcataaagcatgaacaatcagtgtcgggataa

SEQ ID NO: 17563 - DNA, 477 bp, Glycine max
  Peptide Sequence Number=SeqID_134341
atgagggtttatgtattacggttagggttatcagtcctagttatgatgcggtaccccaccgcaaacaagggcttcatgaatgcccttgtggagaggtggcaccaagagatctcatccttccacctacatgtcaaagaaatgaccatcactctggatgatgtgtcatgtctcttgcacctttctatgacaggaagacccattgatcatgtcccctccaccttcactagagaggttgtaaaggttttgttcatgactcgccttggcattctgatagaggaagaggctacagcgatgattaccgtaggtgccaaggttaggttgacgtggctaacaggcccatataactggtacatccagtcaggatcatacgtgtgggctaccatagcttatcttttgcacttggttgacaatatgatatttttttacaatcctcgactcacgtcaatgtctcctacctcttctacctcaacaacctag

SEQ ID NO: 17564 - DNA, 213 bp, Glycine max
  Peptide Sequence Number=SeqID_134342
atgtgctataacatattacagagcaagagcctggtcaggacctgctcgaatcgaaaagagaggagagtctttaagaaggaattcccaggttcaaaggagtatttacgaagtacaaagctaagacaagaaagaggacttcgagctattgggcaattcgaactggtgtatggacgagtcgaagtcgaggcagcaagagttctggacttagcgtaa

SEQ ID NO: 17565 - DNA, 1977 bp, Glycine max
  misc_feature (3)..(3): n is a, c, g, or t
  misc_feature (614)..(614): n is a, c, g, or t
  Peptide Sequence Number=SeqID_134343
atnctgcgctgggacgagtgggcagcatccgcgatcgatgctccgctgatccccggacacgagttctacggcgaggtcgtcgaggtgggggcgggagttcgcgacatcgtcgtcggggatcgggtctcgggagagggacacatcgtctgcggcacgtgtcgcaactgtcgcgccggtcgtcgccagatgtgcatccggacgatcggtctcggcctgcaacgcgacggagcgttcgccgagtacctttcgctacccgcgacgaacgtgtgggtgcatcattccgaggtcgcccccgagctcggcgcgatcttcgatccgctcggcaacgccgtccacaccgctctcacctatccgctggtgggggaggacgtgctcgtgaccggatgcgggccgatcggcctaatggccatcgccgtggcccggcatgccggagcgcgcttcatcgccgcgaccgacgtcagcacgccccggctggagatggctcgtcgaatgggagcggacgaggtggtcgacgtgtcagtccgcgacatccgcgacgcgcagcgtgcgctcggcatgcgggagggcttcgacatcgggttcgagatgagcggtgcgccgtcggctctccccgncatgatcgacaacatgaaccacggcggacgcatcgcgatgctgggactgcccagcgccgggttcggcatcgactggggcaagctcgtcacccacatgctcacgatcaagggcatctacgggcgcgagatgttcgagacctggaacgcgatgggggcgatgctgcagaccagtgcgacgctgcgggacgcgatcggccgtgtgatcgccgaggtcgtccccgcgcgcgagtgggaacggggattcgctgcggcggagtctgcggctgtgatgtacggaacttttcagaagcacgtggccggcgagctggcgggcatcgaggaggcggggctcaccaagcatgagcgcggcatccgcggaccgcagagcgcgcagatcaccgccgacggcgccgaggtgctgaacttctgcgcgaacaactacctcgggctcgccgacgacccccgcatcctggatgcggcgaccacggcgctgcaggaatggggctacggcctggcgagcgtgcgcttcatctgcggcacccaggagcagcacctggaactggagcgccgtcttgctgatttcctcggaacggacgacgcgattctctactcgtcctgtttcgatgcgaacggcggcgtgtttgagacgctcttcggcgccgaggacgcgatcatctcggacgagctcaaccacgcgtcgatcatcgatgggatccggctgtcgaaggcgcggcgcctgcgctaccgcaatcgcgacatggccgacctcgaggagcagttgcgggcggccgcggatgcgcgcttccgcgtcgtcgtgacggacggggtcttctcgatggacggttatatcgctcctctcgccgagatctgcgacctggccgaacgtcatgacgctctggtcttcgtcgacgactcgcacgccgtcggtttcatcggcgagaacggtcgcggcacgccggagctgtgcggggtcgcagaccgtgtcgacatctacaccggcacgttcggcaaggcgttgggcggggcttccggcggctacgtcgccgcgcacgccgagatcgtcgctctccttcgtcagcgctctcggccctacctgttctcgaacacgctcgccccggcgatcgtcgcggggaccctgactgcgctcgatctggtcgaggggtccgccgatcttcgtgcgcgcctgcgcgagaatgccgcgctcttccgggagcggatggcagccgaagggttcgacctgctgccgggggagcaccccatcgtcccggtcatgttcggcgacgcggtgaagacggcgcgaatcgcgcgggagatgcaggacagaggggtctacgtgacggcgttcagcttccccgtcgtgccgcggggcctggcgcggatccgc

SEQ ID NO: 17566 - DNA, 129 bp, Glycine max
  Peptide Sequence Number=SeqID_134344
atgtcgtcaaaaacttgttcgcttctgacaagtgcaccggatcgcacatgtagtacaaaacagtcatcagaatcagatcagtttccactgttgaatgaccctaacaaagcatgcatctatgtgatcaag

SEQ ID NO: 17567 - DNA, 1926 bp, Glycine max
  Peptide Sequence Number=SeqID_134345
atgtctctggtgtatgtaatccttttgatttcttgtgtaatggtggttcttctctccgctgggaatgctaatgggcaccatgatgattgtccagactcatttgactgtggaactttggggacatttagcttccctttcaccactgtagaacgccacaattgtggtgttcttgcaatccaaggctgtaatgatcctaaccaaacatcagtgaagtatgtccagttgaacaataagggaaaaccattccaagttacacatgtaagtagtcatggtcgccgccctagaagtatttccattattgatatggagttcagcaagcttctggaaaatggtagttgtgcggtcttcaactataatattactgtccctccttcctctcctatgggttattttgatttgcaaaacaatataagcaccttcaattgcagccgccatcaacacaaactcaaccatacaaatgacttcatcaactatacaaatgatttcatcaactataccagtaccagatgtccttcctctgttttttactttgcccctccatcctattatgatcagtccctgcgctctttaatctccttatgttctatggttaaacttcctgtcagacaagattctcagttcatcaaaaacccatttggatttttaaatgctgaaattacctttgaattccagttttcaagtgaatgtcaccagtgttataatgaagaaagaggagaccattgccgacttgacagcaacggaactttttattgcgccaagaggaaaactagagtttcgactcggaagctagcattgatgttaggcaccggcgtaggaccttggatcatattcgggttgttcctcacgttacgccactgcaaacggaaatatggtcaatccagcatcactaatgctgatccctaccctagtcgtgacacagagaatgacaggatcttctttggggtacccattttctcctacaaggaacttcaagaagcatcaaacaattttgaccccactagaaaactaggagatggaggctttggcactgtttactatggaacactaagagatggaagggaagttgcaatcaagcatctatttgagcacaattacaagagagtggagcagtttatgaatgaaattgagatccttactcgcctacgccacagaaatcttgtgtccctctatggctgcacttcacgtcacggccaagagctactgcttgtatatgaatacgttcctaatggcacagttgctagccatctccatggtgatttagcaagggttggtttgttgacatggcctattcgaatgcaaattgccatagacactgctgctgcattgacctatctccatgcttcaaacatcatccaccgtgatgtcaaaaccaacaacattttacttgacattagtttttcggctaaggtagcagattttgggctttcaagattgctccccaatgatgtaagccatgtctccacagctccacaagggtctccggggtatcttgaccctgaatatttccaattctacaggctcacggacaagagtgatgtgtatagctttggggttgtgcttattgagctgatatcatccatgccagcagttgatgcagccagggaaagagatgaagttaacttggcaaatcttgccatgaaaaagattcaaaaaggaaagcttagtgagcttgtagacccatccttggggtttgagtcagaccaagtagttaaaaggatgctaacttcagtagcagggttggcctttcggtgtgtgcaaggagacaatgaattaaggccttctatggatgaagttctggaagcactcaagaaatttcaaaatgggaattatgagtctgagaatctagagaaaggagatgatgatggtgttatctcttccacttcatccagcgaagtacatccacctgtttacactggaatttggtaa

SEQ ID NO: 17568 - DNA, 264 bp, Glycine max
  Peptide Sequence Number=SeqID_134346
atggtagctagtgcatggaaagaatacgctttacagcgcccttaccaaacgtgtgccaaagctagagtgataagtgaaatagaggaagtgcatgtgcagatgaaggccgacatggaggtcatgaaagagcaaatgaccacaatgatggatgccatgatgagtatgagaaaaatgatggaggtcaacatggctatagtcgttgctgctgtagatgcaattgactttgatgttttgatgatgatcatgatgatgtgttgcaattga

SEQ ID NO: 17569 - DNA, 1863 bp, Glycine max
  Peptide Sequence Number=SeqID_134347
atgacgaaactggaaatttgttgctatggcatcgactgcgcaatgactgcgcaggcgtccggtgccgatcgcgtggagctgtgcagtgctccgcgtgaaggcggactgacaccttcggcgggtatgctggaagccgcacaacgtgaactgaccattccggtccacccgatcgtgcggccgcgcggcggcgatttttgttacaccgcacgcgaatttgaggtgatgaaatcggacgtggcgcgcattcgcgagctgggttttcctggcctggtgattggcatgctggacgaagatgcgcacgtcgacacggttcgcatgcagcagattatggcgctgtgcgacggcatggcggtgaccttccatcgcgcctttgatttgtgccacagcccgaagcgttcgctggaggtgctgactgatttagggatcgcccgcattctgacttccggtcagcagcagagcgctgaaaccggaattgcattattacgggaactaaatgaatacagcaccggtccaatcattatggcaggggcaggcgtgcgcctcagcaatctgcaaaagttcctcgacagcggattgcaggaagtccacagctccgccagccgcgccgtcgcgtcaccgatgcgctaccgtaaagccggtgtctcgatgtgttctgaagcggaaaccgatgaattcagccgctcctgtgtcgatggcgatgtcgtcgaagccatgaagagcatgatgcagatgagcgttgaccggcgcattggtgaaaaagatgctttgattactctatggcttaacgcgcggataacgctgatgaaatccctcccttatgctgttgtgattctgctgttccccgttgccggcgcggcgctggccgccagcagcacctgcccgccgctgagcaaaaacatcaccagcagcaacaactggattatgctgggtggcgacgccaaaggcgcggtgcgccaggtggtggccggggagtttggtaaagacgtcaactcgcagaagcgcgtgctcgggcagtttgaccagtgcggcgatctgatggtggctgacatcacctatgacaaaagcgaaggcaacgtggtgctgagcatggagcagcatatcgcgcgcgtgcagcgcggctgggtagctgactatgcttatctggttaaagtgacccgcgcgggcaaagaggaggtggtggataaccggcagggcaccatcagctggcagatggggcaacacggcaacatcatcagcgcctcagacaaatttaccagcatggggaaagagggctttaccgataccacttaccgctacgataaacacttccgactggaaaaaagtattgcgcgcggcagcgatgaactgaccaacggcgagaatacctggcgctggaatccgcaggggctggtggtggcatccaccagcgcgcgcagtaaagatacctacagctacgataatcagtggcgcgaactgcggctgcacggcacctcgaccacgccggtcagcactttgcgatcggtggatgagtgccagttgtgggacgaggtgggcaattgcacgctgagctatttgcatgagaccgaagtgtttgccaaaggcaccattgagcggcatctgagttcggcctacaaatatcagtactgggacctgcacaacccgggagcccatcatgacactgattatttcattccttttcgccattaccctgcttacgctgacgcccggcttcgataccgcgctggtgctgcgttcagcggctgcgcagggctggcagcgtgcctcagcgacggcattgggcgttacgctcggctgtctggtgtggggcgtggcggtcggactgggcttaggcgcgctgctgctggcttcggaaatggcttataa

SEQ ID NO: 17570 - DNA, 664 bp, Glycine max
  Peptide Sequence Number=SeqID_134348
atggcattcgattttgatcaagggatagaccgtcgtcacagcgatagtttgaaatggcacaaatatggtgatcgcgatgtgctgcctttgtgggttgccgacaccgattttcgctcgccgccgtgcatcattgaggccatcaaacagcgtgccgaccacggtgttttcggctatggcgcgacgccgcacggtttgattgatatcactatttcccgcttagcccagcgctatggctggcagattgagccggaatggattgtgttgctgccgggcgtggtgagcggactgaatttatcggtccgggcatttaccgagtcgtcgcagagcaccgtggcaccgacgccgatttatccgccgtttcgcgcggcagcgcggctggcgcagcgcgctcaggtcaatctgccattgcagttacagcaggatcgctgggtgatgcagctggatgacagccagatgcagggcaacgagcgcctgctcatgctgtgcaatccgcagaatccgggcggcaccgtctaccgccgggatgagctggaggcgcagctggcctttgcccaacgccacgatttgctggtgtgctctgatgaaatccattgtgacctgctgttaacgcctggcgtacagcacattccgtttgcctcgctgagtgaagacgccgcccagcgca

SEQ ID NO: 17571 - DNA, 708 bp, Glycine max
  Peptide Sequence Number=SeqID_134349
atgtttcccgtttacatgatctttccgatgatgcttctcattctctctattgggaatggaaatgggcacaaggaagagtgtccattgtggtttgattgtggaaatcatgggaggttcgagtggcctttcaccaaggtagaacaccaagactgtggcatatggccaatccatggttgtgatgatgatcttattaatccaaattatgtgttgttaaagattggaccaagctcgattaaagttcaaaaatttgagatgcaaaggtttgctactattgtttacttcacagatcatcatctcagaaatctcttgcaatctgatagttgtgagatctttagctacaatattacacttcctcctagctctcctttgggttactttactattaacaacaatataactttgttcaagtgcaaccgcaccctccaagttaacaccccaaaaactttcctcaaaaatacaagctgtggctatgatatcttcatgggccctccacactctgatgatgtgtctcagggctctcttgcagcatgttcaatggttcagcttcccatgaatggctttgcagtctctgcaaacccatttgcattcttaactgcggagattagcgttcagttccttccatcagatgagtgcatgcagtgtcatcattacagaggccattgtcaccttgacagccaaagaaaagttaattgcgcccaaagcttataa

SEQ ID NO: 17572 - DNA, 1761 bp, Glycine max
  Peptide Sequence Number=SeqID_134350
atggcaggtttaggtgttgcacctgcatggatgataattatatttgggttgatcctcacgttacggcgctgcaaacggcaatatggtcttgcacaaactcaactccaatcaagaaatactcgcattgatccttacgagaaatccgactcaatgacggacaggatcttctttggggtacccgtcttttcttataaagagcttcaagaagccacaaacaattttgaccacaaaacaaagctaggagagggaggatttggaagtgtttactatggaaaactccaagatggacgggaagttgcagtgaaacacttgttcgagcacaattataagagagtgcagcaatttatgaacgaaattgagattctcactcacttacgccatagaaacctcgtgtccctctatggctgcacttcacgtcacagccgagagttactactcgtgtacgaatatgtcccaaatggcacccttgcataccatctccatgaaagggatgattcgctcacgtggcccattcgaatgcaaattgcaatagagaccgctactgcattggcttatctccacgcttccgacatcattcaccgtgacgttaaaaccagcaacattctactcgacaacaatttttgggttaaggtggcagattttgggctttcaaggctgctccccaatgacgtaagtcacgtgtcgacggctccacaagggaccccggggtaccttgacccagagtatttccaacactaccagttaacggataagagtgatgtgtatagctttggggttgtgcttattgagctaatatcgtccatgccagcgcttgatgcggccagggaaattgatgaaattaatttggcaaatcttgcaataaaaaggattcaaaatggtaagcttggtgagctggtggccaaatcccttggttttgattcggaccaagaagttacaagaacgttggcttcagtggcagaattggcctttcggtgtgtgcagggggaccggcaattaagaccttgcatggatgaagtcgtggaagcactccagaaaattcaaagtgggaattatgagtctgaggatgtagagaaaggagggatctggcacagtgaaggagagtcaaatttttcagtacacaggggactcggactggggtcaaaagggaatgcaaatggacaccgtgatgattgtccagactcatttgactgcggaagcatagggaaaatttacttcccattcacgacggtagaacgccacaactgtggtgttctggcaatccgtggctgtaatgattccgaccaaacatcagcgaagcatgatttcagagggcttctggaaaatggtagttgtaaggccttgagctataacattagggtccctccctcctctgctttcggttattttgatgtgcaaaacaatattagcatcttcaactgcagccgccatctacgcaaactcaaccatataaatggcttcatcaactataccagcaccagatgtccttcctctgtttattactttgcccctccatccactgatgatcagaccctgcgctctttaacctcctcatgttcaatggttcaacttccaaaaagaatagattctgagttcttcaaaggcgatccatttggatttttaactgctgaaattacttttgaattcacgttttcgcatgattgtatccggtgtcacgaggaaggaaggggcttttgtcgaccagacagcaacgggaaatttcattgtgcctctcccacgactcccacaactcccacgaggtaa

SEQ ID NO: 17573 - DNA, 681 bp, Glycine max
  Peptide Sequence Number=SeqID_134351
atgagggctccggttctgctcgtacatggtctttttggttcactcagttctcccgggatacttgcccctttcggcgagcgacgtgtctatactcctgatctgatcggatatggtcagtgcctgaataaaggtaacaaaggatggacactgaacgaccaggccgatcaccttgccgactttgttaacgcacgtaaatgcggaccagttcatctggcaggtcattcagttggtggggcagtagcggtactgatggctaaacgttatcctgaaaaagtccgctctctcacacttatagagggtaatctcacgctgaatgatgcgttctggtcccagaaaatatcaagtcagagcctggaagaaatacaggcagaggtcagtgcttttcgcgcagacgttgccgcttgggtcgagggtgcgggcgtggcgagagcggtggttgctgcaacagctgaagccagttacctggaaggactgcgtcatattctgtcgtctttaatgccggttcatcttatatcaggcgaaaattcacaaagtggctggcatgttccctcctggcttaaagagcgcgccgctacgtacaccgtcatacctgatactggccaccttatgatgattgaacgaccagaaacatttgcacgctcggcggacattatgcgatgtaccgactggttctgcttttga

SEQ ID NO: 17574 - DNA, 1050 bp, Glycine max
  Peptide Sequence Number=SeqID_134352
atgtttgcgttgggtgagtatccagcgataaagctcgccgaagctcgcgagaaatgcgagcaagcgcgtaagcaagtcgcagatggagttagcccgacacaggctcgtcagttagataagatccgcaaggtcaatgacgcttctaacacctttgagctgatcgccaaagagtggttgcagatgaaagactgggccgaaattaccaaaacacgccgactggatatgcttgaacgcgtggttttccccgcaatcggtaagctccctgtcagagagatcaccccacaccacattcttaaaattcttcaggaaaccgctaaacgcggcgctccgactgttgctgctgaagcccgacgtaccatttcatcggttttcgagttggcagtggcaacgcttagagctgacagcgatcctgtctggcctgtacgcaaggcacttccggcgaataagacacagcacaaacaagcattgaacccacagcaaatagggaagctattaagctgttttgataacagtcgcggctcatatcaggttaactattgcatgtggctaatgtggtggacgctggcgcggccagccgaagtcaccgaagctgaatgggcagaattcgatctcgataatgcactatggaccattccggcgacgcgcatgaaggctcgcagggaacatgttattcccctcccctcccagtccgtcaacatgctcagaacgctacagggattaaccgggcatcgacaccacctctttcctggccgtgatgacccgcgtggcccgatgacatcacactcgctgcgtcagctacttaaaagcctcggctggagtggaacttacagcccacatgcaacccgaaccacaggcagcacacggttaaacgagatgggctatcgacctgatgctatcgaagctcagcttgcgcacgctgataccaacaacgttcgccgcacgtacaaccatgcgacgtatcttgatgagcgtaaagtgatgatgcaggaatgggctgataagcttgatggatgggtaagcagcactgacatcagtgttgatgtttcataa

SEQ ID NO: 17575 - DNA, 543 bp, Glycine max
  Peptide Sequence Number=SeqID_134353
atgctgtgcgcacgcgcgggcgtccctgcagaagacagcggcggaaccatcaccagccatcgggggcgggcatccgcagtgaccgcgctggccagcgtgccgcagggcatgtcgctgtatgaactgatgcagtggacggggcattcaacgcctcagtccaccatgcattatctgcgtattcgcccgactcagctggccgcctcgttcgtcaaggcagatcgtgtcgctcacatgataagcgtgctgattgaccatgatccggaagccgcctgcctgaccggacctgcgacatactatgatttgggcgattcgtactgcacaaatcccttctggagcagttgtcagcaccggatggcctgcattggctgcgactttaatctgctaaaacagagtgcacgcggactggtactggaaagcaaggcctctgtcagacgttatcttgaggaagttccgctcacacccgatgagaggaccatcgttgaacaggacgcagagaaaattgagcaggctcttcaaaaattggcgcttaaacctgaaggctaa

SEQ ID NO: 17576 - DNA, 296 bp, Glycine max
  Peptide Sequence Number=SeqID_134354
atgaataaaactgatcttaacactacgtctggaaatatccttgtactcggtgccggtgagctgggactccccgttctgcgaaatctagccctccgggcaaaagatgtggaaggagcgaaaatcagcgtgctgctacgcgaaagcaccataacgtcagatcaacctggcaaacaactcgttatcacggaaatcagaaacctcggaatcaatatagttgcgggcgatctcgtcatgagttctgtcgacgaactggccgccctttttgcgcagtttgacacagtcgctggctgcgccgg

SEQ ID NO: 17577 - DNA, 1224 bp, Glycine max
  Peptide Sequence Number=SeqID_134355
atgataccgggaagcgatgaggtggatagagacgagatccttaagtattctcaggctgtttgtcaggggctgagagaggatgatgatggcttacggcgggagttgctggctcatgccggaagtcgctggtcactgggcattatcaacacgcttggcgtttatggcagactgcgtcatgctgaaattggcaggcgtatgcacggcgtgacccagcgcatgctgacccgtacattacgacagcttgagcgtgacggactggttatccgccatgatttcaatgaaatcccgccacgagtagaatatgagctgtccgatacaggcaatgttcatggagcggaaatcattcaagtcactttgaatcgaccccctatagacaatatcagtgatgtggtatacgagacagtaaaaaagactcgctcggtcaggcaattgcacatgtcctttctggttcctcgcacaagtgatttgaaaccagccatcatctattttcctgggggaggatttatgacagctgagcacaataaatttctggaaatgcgcttggccttagctgaggctggctttgttgttgcagctgcagaatacaggacaatcccggatattttccctgcgccattaatagatgctaaatcagcagtgaggtaccttcgtcaacatgcccccgattatggaattgacccctcgcgaattggtgtattaggtgattctgctggaggatggctggctcagatgctcggtaccactaatggcgataaatcatttgatcacggtaatttcctcagccagtccgctgatgtgcaggctgtgaccacgctttatggaatatcagatctgcgtaacataggtgacggctttcctgagcatcgtcaaaaggtgcatcagtctcctgcagtaacagaatcattactagttaatggtgtggctttcagggattttgaaggtacttctatcagctccacacctgaaaaagcgattaatgcaagccccataggacatatcaagggatgtagacctccgttcctgataatgcatggaagcaaagatacgttagtatcacctaatcagagcgtaacgctttacaaggcacttttggagtcgggaaacaaagcggactatgtactcattgaaggtgctgaacacggtgatgatcactggtatcaacccgttgtcataaatagggttgttaactggttccgcggacatctttttcctaaaaatacatga

SEQ ID NO: 17578 - DNA, 1443 bp, Glycine max
  Peptide Sequence Number=SeqID_134356
atgttctcccctctcataaataaaacactaataatatttttgtcacagcttctgcttcttgtttcagctcaggatgatggaaagtgttcaccgtctttcaactgtggatatcttggcctcattaagtttcctttcacaaccacaaagcaaccacactgcggcttattggctatacatggctgtgaagaacacgatccatacgctcccaaaaccgtcaaactaagcaattcaacatcaagatcttacactgttctgcaggttgaacctcgtaccatagggatcttagatgagaaacaagatcattatttgaaaaccagaaattgcacaatcttcaccggagtcaattttactcttcctcacacctctcctttagcttctttccacatcaaatataatataactatcttcagatgcaatcactccctcaaaatcgtcacctttcccaaatatttttatagatattcaaactgtcctgaatacgatatctactatggccttccaaatactgaaactcctctgggcttcaagtggcccagctctttggcaccatgctcaaccactcagcttgctgtagacaagatatctactcgcaatccctttcaatttctatctggtattatgattattgaagtacgattatctgatgaatgtgaaaggtgtcttcttgatggaaaaaaccgatgtttacttgacagtaaaggaaaattctattgcgccagagggaataaaaatttggcgtggatactgggactaggtattggactcccaggaattattataattgggctactgattatatggcactgcaaaccaagatatgtgtctgatttctattcaaatccataccccgagagtgcgagtatctactctggggtccctgtgttcacctttaaggatcttgaaatagcaacaaaatgttttgacagttcaagagaactaggagaaggaggctttggtattgtttactatggtaagcttcaggatggacgagaagttgctgtcaaacgcctatatgagaacaactacaggcgagtagagcagttcatgaatgaaatcaagatcctcatgaacttgcgccacacaaatttagtgtctctttatggctccacttcacgtcacagccgtgaactattgcttgtgtatgaatacatttcaaatgggactgtggccagtcatctccatcactatggatcaacaaatactgggtttttgccatggcctattcgaatgaaagttgccatagagactgctactgctttggcctatctccatgcttctgacataattcaccgtgatactttggactgtcaagactgttccccaatgatgtcacacacgtttccacagctccccaaggaacacctggctatgttgatccggaatatcacagatgctaccagcttacaaacaagagtgatgtgtatagtttcggggttgtgctga

SEQ ID NO: 17579 - DNA, 201 bp, Glycine max
  Peptide Sequence Number=SeqID_134357
atggtgtccaacgccagcaagaagaaggccgctgctgttatggccgccacgtcttccaaagctgccgacaaggtcgccaatggaatcacagatatgcagatttcggatcggacctacacctccagagatattcgaaaccggttgcaaaaccgaactggtttcaagaaccgtaatcaaaaccggactgcatttgaaaactag

SEQ ID NO: 17580 - DNA, 267 bp, Glycine max
  Peptide Sequence Number=SeqID_134358
atggcctatccaaatgaaagttgccataaagactgctactgctttagcctatctcctgacataattcaccgtgatgtcaaaacaaacaacattctccttgacaacagtttctgtgttgaagttgcagactttggactatcaagactattccccaatgatgtcacccatgtttcgacagctccacaaggaacacctggctatgttgatccggaatatcaccgatgctaccagctcacaaacaagagtgatgtgtatagttttggggtg

SEQ ID NO: 17581 - DNA, 624 bp, Glycine max
  Peptide Sequence Number=SeqID_134359
atgtctccccccatctttaaagtactcacactgatcatatctgtttttgccatcttgcaaatatcaacagctggtgacccagatattctcactgacttcatagtcccacccaacaccatacctaatggcaacttcttcaccttcactggcttccgtgccattttttcacccaacaacattgtctcagctttcaaagtgttgaaggcaaccaaggtagaatttccagccctcgatggacaaagtgtctcatatgcaatccttgagttcccaggtggcagcatcaacccaccacacacacaccctcgttctgcagagttactcttcgccgttgagggttcccttcaagtggggtttgtggacacaaccaacaagctcttcactcaaacactacaaaccggagacctctttgtgtttccaaagggtctcgtgcacttccaacacaatgcagatcctcagaagccagcactcgctatatctgcctttggaagtgccagtgctgggactgtgtcaattcctagcactctctttaacaccaccattgatgacaatgtcttggctctggccttcaagactgatgttgccaccattcgaactctgaagaaaggctttgctcctaaagcatga

SEQ ID NO: 17582 - DNA, 1656 bp, Glycine max
  Peptide Sequence Number=SeqID_134360
atggtagctgggaaatacccttcccccacatacttcatcctcctgctcataaccataacacgtttgatctccacagtgggcaagacctcccaatggatgaaggccctaacgccgcctccggaactcgcctcggtctccctcgatgacaccatcttcagcaagctccgcaacgacccagaggccctccaggggagggcctccagggactacgggaacctcgtccgcgaggttccctcggcggtcttccacccgacctcgtcgagcgacatcgcgaggctgatcaagctgtcgtacaacggttctgtccccttcaagatagcggcgagggggcaagggcactcgacgaggggccaggcgatggtacgtgatggggtggtggtggacatggccgggttcagagagagagggaatggagagggaataagggttgtgatgagtgttgttgtggaccctaataataagaatggttatggttactattatgctgatgttggaggggaacagttgtggatcgatgtgctaaacgccacgcttgagcatggacttgcacctatgtcctggactgattacttgtacttgacggtgggaggaactctctccaatgctggcatcagtggccagacattccgctatggtcctcaaatcaccactgtccgccaaatggacgtcatcactggaaagggagaatttgtgacttgctctcagcagacgaattcggagttgttccacgcggttctggggggcttaggacaatttggaattataacaagggcaagaatcgctcttgccccagctcccaagagggttaaatgggtgagacttttgtacaatgacttttctgctttcaccaaagaccaggaacaactaatctcaatcactagaaggaaacaaaatattgcactggattatttggaaggattgctgctaatgcaccaaggacccataaataattggagatcttctttcttccctttagccgaccatgcccgaataatttcgctagtaactaaacacagcgtcctctattgcctagaagttgccaaatattatgatggccaaaatgaaaactatgtggacaaggaactcaaagttttactacaaggactgagctatatccctggattttactatgaaaaagatgtctcgtatgttgagttcttgaatagagttcgaagtggagagttgaagctacaatcacaaggactatgggatgttcctcacccatggcttaatttgtttataccgaaatctcaaatcatggaatttgactcgggcgtgttcaagaatatcatccttaaacgaaacattaccacaggacccgtcttggtttaccccatgaatagaaacaagaaaaatgttaattggtgggacaataggatgtcagcatcaatacccgacgaggatatcttctacacagttggatttttgcattcaagtgggtttgataattggaaggcctatgatgctcaaaataaagaaattctacaattttgtaacgattctgggatcaaggttaagcaatatcttccccactaccgcacacaagaagattggacaaaccattttggccctaaatggaggacttttgtagaaagaaaacaccagtttgatccaaaaatgattctatcacctggacaaagaatctttaacaattaa

SEQ ID NO: 17583 - DNA, 468 bp, Glycine max
  Peptide Sequence Number=SeqID_134361
atggcaacttcttcaccttcaccggctttcgtcccatattttcacccaacacaactctcagatttcaaagtgctgaaggcaaccaaggtagaatttccagctcttgatggacaaagtgtctcatgtgcaatccttgagttcccaggtggtggcagcatcaacccatcacagacacccttctgcagatgggatttgtggacacaaccaacaagctcttcactcagacactacaaactggagatcgatctctttgtgtttccaaaggatgtcgtgcacttcctacacaatgcggatcctcagaagactgcattcgctatatctgcctttggaagtgctagtgctgggactgtatcaattcctagcactctctttaacaccaccattgatgacaatgtcttggctctggccttcaagactgatgttgccaccattcaaactctgaagaaaggctttgctcctaaagcatga

SEQ ID NO: 17584 - DNA, 1986 bp, Glycine max
  Peptide Sequence Number=SeqID_134362
atggctctagttgatttgttctgcttcctcttgttttgtcaccttgtactcattctctccgctggttatggaaatgggcaccaagattgtccacactcctttacttgtggtaatcttggaactttccattaccctttcaccaaggcagaaaaacctgactgtggcttgctagccatacatgattgtgataatcctcatcaacacagaaaaatgattcagctcgagaaaaatggaaaaggcatagtgcttacaggcgtggctcagcagaatgcgatttcaattttggatgaagattttcacaagcgtttacaacaaaacccttgtggcactttgaagaataattatagtcttccttcccctttttcttctttgtattctattcacataaaattcaatgtaacactgttcaaatgcaaacaaagcctcaaaatgaaaccgccaacacattattttaatcacccgtgccctgaatatgattatgatatatattatgacagccttcccactcctaatagtaaggaggcgcatagccttttctcatcctgctcagttattcagatatcatcaaaagacttgactgataccaatgacattctgtcgtttgtatctgctgagatggttcttcaagtagtattatctaatgattgtgaccagtgctataatcacaggggaggccaatgtcggcttgacgccaataaaaagttctactgtaaagaaggaccaaagaataagagtagtaaaagtttgaagctgatacttggacttgtaacaggtttaagtgttatattgtcagctattctgatcattggatacatagtatttagacggaaatatactccatcacacccccaatcccaatcaagaaacacatatgttgatgtaattggtccgagctcaaatcctgatccagaaaacggcaggttctactttggagtccctctcttctcttacaaggagcttcaaaaagctacatataatttccaccacgccagacaacttggaagtggaggctttggaacagtttactatggaaaactgcaagatggacgagaagttgctatcaagcgtctatatgagcacaactacaggcgagtagaacagttcatgaacgaagttcaaatcctcacacgcttgcgccataaaaatctggtgtccctctatggctgcacttcaagtcacagccgtgaactactccttgtgtatgagcatgttccaaatggcactgttgcttgccacctccacggtgagttagcaaggcgcgacactcttccatggcacacaagaatgaaaattgccatagagaccgcaagtgcactgtcttatctccatgcttctgacatcatccaccgcgatgtcaagaccaaaaacattctccttaacgaaagtttcagtgttaaggttgcggactttggtctttcaaggttgttccctaacgatgttacgcatgtttccactgctccactaggaaccccaggttacgttgatccagaatatcaccaatgctaccagctcacaaacaagagtgatgtgtatagttttggggttgtgcttattgagctattatcatctatgccagctattgatatgacaaggcgtagggatgagattaacttgtcaaatctagccataaataagattcagcaaagtgcatttagtgagctggttgatccttgtcttggttttgattcagatagtgaggtaaagaggatgatggtttcggtggcagaattagcttttcagtgtttgcaacgggacaaggaattgagaccctctatggacgaggttttgaaggtgctgatgagaattgaaactgggaaggatatgggtgagcatccagatgatgtagaagatttacgccccccctctctaccttcaccagattgggatgagaatggattagtgagaaaaatgatggttcatccttcacctaaagccgtcactgatacatggcacagtgagtctactacgcctaatggcagtgggtaa

SEQ ID NO: 17585 - DNA, 186 bp, Glycine max
  Peptide Sequence Number=SeqID_134363
atgagggctgattgtccaatatttaagaaaaagatacagaagtctgaaaaaaagactattggagataagaaggcaaagaaggcctatatcacatgggatgataataacttagaaacgtctgatgattctgaaaaagaaatgattaatctatgtctaatgggcaaaaattatgaaagtgacgaagag

SEQ ID NO: 17586 - DNA, 153 bp, Glycine max
  Peptide Sequence Number=SeqID_134364
atgatatgcgtacaatggaaatggaatatatgcggttggcagaacaaaactatgctaaatgaaagagggactatcagcgacaatgcatcactaaaagaggaaaattctagatggggcttcactctcatcaagcgagtcggagacccaacatga

SEQ ID NO: 17587 - DNA, 875 bp, Glycine max
  Peptide Sequence Number=SeqID_134365
atgggtgaagtagacgaggtgcaagagtggataaaggctgacatagaggcccagaaagagcaaatggacacaatgatggaggtcatgatgagcatgaagaagatgatggaggtcaatgaggctgcagttgctactaccagtgccgttgctgaggtggacccgattaccccatctggccttgaccaaataattcatccaaccttagatatggtaggtcagggaggcaaagaattgggaagtacgggcgccccccattttgtgcaagttcaaaacgagcatcccttccagccatacagcttgcctcccaattatacaccacctaatgttgttcacactcctgatgagaatgtcaataactccactcccataatcactgagagccaacaacctcaatctgatcatgcacatgtccctcaacccatggaggagacacatgaaataccccaccacaatctagccgacttcgagccttgcctcgaatacaccactgaggggcaaacagttggtggtgtacccctgccaaacactttagagggccctcaattttgcacacaaccacaacccttgcatattgcggtgggaagagtccctcttgccatggtggaaagggagaaattggatcatatagaggaaaggctaagggccattaaaggaggcagagattatgcctttgctaacatggaagagttgtgcctagtacccgacgttgttatccctctaaagttcaaggtgctggattttgataaatacaaggggactacttgccccaagaatcacctgaaactgtattgttggaaaatgggggcgtacacgaaagatgaaaaactactgatgcatttcttccaagaaagccttactgaggcagccatcacctg

SEQ ID NO: 17588 - DNA, 3348 bp, Glycine max
  Peptide Sequence Number=SeqID_134366
tccttcaaatcttatggttcttacaacaaacattctcggttttccggcgccggaaactctgattctgatcacgagcagcagctccccattcttcacgaccaagaaacccactgccaccctgccatgcccgccggcgactacgtcgtcaaaatcaacgaggacggaagcgaggccccccagggcaacaggatttggcgcgagtccagctacgaattctggaacaacgatggcgccaccaccaccgccggcggaagcgaccagagcttcgatttccgccagtcggaggacccgccgtcgcagctgatcgggcacttccttcacaagcagcgagcctccggcgagatgcagctcgacatggatttggagatggaggagctgcagcgcgaaggcgacgacggaaagttaacgccggtggatgaatctccggtgactcaccgcgtctcgagagagctcaaggtttccttcgaggaacctacctgcaatgtgaatttcctggaagcgcaaaacgacgccgtcagaagaaggcacagcaaggactcgccgtcgatcgcggagttccaacgccctccgcaaccgccccaacacgactgtcgccggtctccctcgccgtcgccagccggcgacgaggaggttgttcggtgcacctcgaacgcttccttcgagagaagcctttccatgcagagaaaatcggccttgttgaaggccaagacgaggtctaggttaatggacccgcccgaagagcccgacagaaaatcgagtcgggttctcaaatcgagtcagctcctatccgggtttctagggaagaagaatgatgaagaggatgaggatccttttttggaagaggatcttcctgatgagtttaaggagactcatttcagcttgtggattcttctcgagtggttgagtttgattttgatcattgggttgttgataaccaccctttgtgttccctttcttaggaacaaggatctgtggcagcttaggttgtggaaatgggaggttatggttttggttttgatctgtggcaggctggtgtctgattgggttattaggattgctgtgttctgcattgagaggaacttccttttgaggaagagggtcttgtattttgtatatggtgtgaagaaggctgttcagaattgtgtttggttggggcttgtgttgattgcttggcatttgttgtttgacaagagggtgcagagggagacccgcagcaatttcctcgagtatgtgactaaggtgttggtgtgtttccttgtggggactttggtgtggttgttgaagacccttatggttaaggtgttggcttcctcttttcatgtgagtacctactttgacaggattcaggaatcgctgtttaaccagtttgtgattgagacgctttcggggccgcctttggtggagattcggaaggctgaggaggaggaggagaggcttgccgatgaggttcagaagcttcagaatgctggggttaccataccccctgatcttagggcatctgccttttctaatattaagagtgggaggttgaggagtggaatgcttccgaaaagccccagatttaagagtgacaagttttctcggcctctttccaagaagtctgatgagccgaatatgatcactatggataacctgcataagctgaatcccaataacatctctgcctggaatatgaaaaggttgatgaacatggtccggaatggggctctttctaccctggatgaacagattcttgataactcgatggatgacgagaatgccacgcaaattagaagtgaaaacgaggcgaaggctgcagctaagaaaatatttcaaaatgttgctagacgcgggtgcaggtatatatacccggatgacttgatgcgctttatgcgagaagatgaagctgcaaaaaccatgaatctctttgaaggagcgtctgaagctgagagaatcagcaaatcggccttgaagaactgggtggtcaatgccttcagggaaaggagagcacttgctttgacattgaatgacaccaaaacggcagtgaacaaacttcatcgaatgctcaattttatagttgcaattgttatactggttatttggctcttgatattggaacttgccaccaccaaatttcttctctttgtgagctcacaggttgtcgtggttgcatttgtatttggaaacacctgcaagaccatatttgaagcaattattttcttgtttgtcatgcacccatttgatgtgggagatagatgtgaaattgatggggttcagatggtggtagaagaaatgaacatattgacaaccatatttctgagatatgataatcaaaaggtcatcatccctaacaatgtccttgctaccaaggccatatataactattaccggagtcctgacatgggagatgctatcgaattctgtttacatatatctaccccagttgaaaagatttcactcattaaacacagaatacaaagttacattgataacaagaaggagcactggtatccttcacctttaatcgtatacagggattatgaccaattaaacatggtgagaatggctatctggccaactcatagaatgaacttccaagacatgggagaaaggtttgtgaggagatcccttttgcttgaagagatgatcaagatttttagggagcttgacattaattaccgtctattgcccctggacatcaacgtgagagcgactcctaccacctctgatcgtcttccacctagttgggcatcagttccaactccaactctcggttctcttctctccttgctccactccggagcacgagatgcttaccgccagtttttcgtcgattccatgtcgctcattcaagatattctatacgtgtcttcactcagtgttaatggatcctccaggtccagggtgacgctcaagtgtttttccgattccttctctggagttgaagaccttccatccaccaacaggcccgtcgatggacgtggtttattgattgacctcaccgccccaaccagatggcaaccctttgcaacttggattttgaagcttgtctgtaaaagtctaactgaaggaacactctatgttgagggattgatccgtgcgtcctttatttctgctgcgtgttctcttttatgctatgggaatgctgacctgcatatggcgtgctttgactttgtacatatcattgggatggtcacaaactatgatgccattagctactatcttgaatttggacaaggggggcttcctgttttcagaaacatggcttatgattcatcgttgggtattttcctgaatacactttactctagctgcccagaagatattgtcaaattaacagctgctgatttagtcagtgtattcctttaa

SEQ ID NO: 17589 - DNA, 246 bp, Glycine max
  Peptide Sequence Number=SeqID_134367
atgcaaaccgtcagtcccattggcgcgtttgttgtggctgtgacacatggcaaagacgccactgccactgacaggttccttggtatcgccagccccattggcgatttcgccatgcaagggagagtagccagtcaaactggcgagttacaggctagggcgatggcttctcagccttttcaggctcttcagttggcaagggcaagggtacatgctaaagggaagtggccactggcattggcgagttag

SEQ ID NO: 17590 - DNA, 357 bp, Glycine max
  Peptide Sequence Number=SeqID_134368
atgttggctggaatagaatgttgcgctgaagtagttcagcaagattcaacattagaggctcctatagagcagtttgcttgtgttgctcaagacgcgcttcatgcgcaagaatcatggtttcaatatcaagaacagagacatcaacatcacgaatactcactgcaagatttgtcgcctttcttgatggttcacagttccaagcgtaattgtttggttctctcacgtagatatcttagtcctatttataaggtgcagcacaacttagcaaaggctaagttagttacaaagtttgatgcaatcctccataggaagggaccagtcactagagccatgagcaagaggctccaagaggattag

SEQ ID NO: 17591 - DNA, 333 bp, Glycine max
  Peptide Sequence Number=SeqID_134369
atgtgcctttgggcttccttgtgggcctttccacttttttggcataggctcagtttttcatatcaagggttatgtgaggctgaggagatgaaaatcatattgaagcgatttgagcagctcgatgtttgtggcaaagtaaaaatgatgaattttgtgaaggctagcagcctaagcgagacactcaacctgcttagcgagttgggagaatctatagaagaatctgagaagcatcttctcgctcagcgcatcatcagttcgctcagtgagacgtttgtctcttcctgcgctaatcgcgcccagctcgctcaacgtatgttcacttactcgcactaa

SEQ ID NO: 17592 - DNA, 486 bp, Glycine max
  Peptide Sequence Number=SeqID_134370
atggcggtgcctctgctctcaaagaagatcgtgaagaagagggtaaagaagttcaagaggcctcagagtgacaggaaaatttccgtcaagggttttcctttcttttttgttttgaatttgaatatgggatatgatgacaaccttttgacacccagtcttacttgctccattgggactaactggcgcagaccaaagggtatcgattctcgtgttaggagaaagttcaagggatgcactttgatgccaaacattggttatggttcagacaagaagacccgccactatctccctaatggtttcaagaaatttgttgttcacaatgtgaaggatttggaactgctcatgatgcacaacaggacttactgtgctgagattgcccacaatatatccacaagaaagagaaaagatatagtcgagagagccgcgcagcttgatgttgttgtgacaaacaaaacggccagattacgcagccaggaggatgaatag

SEQ ID NO: 17593 - DNA, 1728 bp, Glycine max
  Peptide Sequence Number=SeqID_134371
atgaaggactcaaactccagcagtagcagcaacagaaccgaacccattgcccaaaacatcatcaaactcattagcaacctctgcttctccctcttcgtcttctctgtcttaatcttcaccgtcatagccataacctaccagcccccagacccatggctccagtccaccccagccctaaccaacctcttcacccaatcagaaaacgccactttccgaatcgactcctccgtcctcagaaccggcgaagacctctccccctccccgcaagaccctcccctcccgccaccgcccccctccgaacccctcatcgatataacccaacagcaaatcgccaattccaccgttaattccaccgccgactctaccgcttactccaccgacgcgcagcctccctctctccctgcctgcgatgaaaccctaaactgctctaaccctcgcgttcttattgccgttcagagattcaacctccgcgcgttcaagtccattgccttcttcgactaccagccgccgatgaacggctccgtccccggcgagtgcgacgtcgcatggcgcttccggaacaagcgcgagcgctcctggcgcaagtaccgcgactttcgccgcttcaagatcgccgtcaccgacgactgcaggtacaaggtggtccacgctggcggttggcactccggcgccaatgctcgccggaatgtgacgcgaaccggcgccggcaggggtggtaagtccctgccgccgcgggcttcggcccgcgacgatgagatcaatgacacgattccgactttgggatcggatactaactttaggaatgggaagtatttgtactactcgagaggtggggattactgcaagggaatgaatcattatttgtggagtttcttgtgtggattgggggaagctatgtttttgaacaggacttttgttatggatttgagtgtttgtttggcttcaacttataaccctagtaacaaggatgaggaagggaaggatttcaggtactactttgatttcgagcatttgaaggagacggcttctattgtggaggagggtgagttcttgagggattggaagaagtgggataaaacgcatttgaagaagaagaaggttcctgttaggaaggttgtcaatcacaaggtgactcctatgcagcttaagaaggataagagtacgattatatggaggcagtttgatgcgccagagcctgagaattattggtatagggtttgtgaaggtgaggctgctcagtatgttcagaggccttggcatgctgtgtggaaatccaagaggttgatgaatattgttactgagattagtggaaggttggactgggattttgatgcggtccatgtggttcggggagagaaagctcagaacaaggagctgtggcctcatttggattatgatacgtcaccagatgttcttgttgagaagctcaaatggatggttcagccttggaggcatttgtatattgccaccaatgagccttattataattactttgataagttgaggtcaaattacaaggtgcatttgcttgatgattataaggagctgtggggaaatacaagcgagtggtataacgagaccacgcttctcaacagtggaaagcctgttgagtttgatgggtacatgagagttgcagtggatacagaggtcttttaccgtggaaagacacgcgtggaaacgttctataatttgactaaagattgcaaggatggagttaatacatgctga

SEQ ID NO: 17594 - DNA, 1524 bp, Glycine max
  Peptide Sequence Number=SeqID_134372
atgtctcattatacaaagtgccctgattacgatctctactacaacatcacagcagctgaagatgcgtctttgagagcatgtacaaaggtcctgcttccaattaaagacgtgcctgacgctaacaacccattcacattcgtaactgcagatatcttaactaaagtagcattaaccgatgaacgtgcagcttgccactatcgcagaggagggcagtgtcaacttgacagcagagagaaattttgttgtaccaacgttataaaaaaagggtcgagtttgaaactggttataggtattggaatcccaagcatgttggcaattgggttgctgtttctctttctactctacaaacgaaaatatgctacctcaggcggacaattggagtcaagagattcttattctgattcctcctcaaatcctcatcgagaaactagtagcgagtactttggagttccactcttcttgtatgagcagcttaaagaagcaacaaataatttcgaccatactaaagaacttggtgatggaggcttcggtactgtgtaccatgggaaactcccagatggacgtgaagttgccgtgaagcgcttatacgagcacaactggaagcgagtagaacagttcatgaacgaagtcaagatcctcacacgtttgcgtcacaaatatcttgtgtcactctatggctgcacttcacggcacagccgtgaactcctgctcgtgtatgaatacatttcaaatggcactgtagcatgtcatctccacggagaattagcgaagcctggctcgctaccgtggtctatacgaatgaaaattgccatagagactgctattgcattgacttatctccatgcctctgacatcattcaccgtgacgtgaaaacaaacaacattctccttgacaacaacttttgtgttaaggtagccgattttgggctttcaagagactttcccaacaatgtcacacatgtctccacagctccacaagggtccccgggttaccttgaccctgaatattacaattgttatcagcttactagtaagagtgatgtgtatagttttggagttgtgcttattgagctaatatcatccaagcctgcagttgatatgaacaggagcagggatgagattaacttgtcaaatctagccgtgaggaagattcaagaaagtgcaattagtgagctggttgatccttctcttggttttgattcagataatgggattaaggggatgatagtttcagtggcagggttggcttttcagtgtttgcaaagggaaaaggacttgagaccttctatggatgaagtgttggatgaactgaggagaattgagagtgggaaggatgagggagaggttcaagatgagggtgatgttaatggtgctgcagtttcacatagttctgcacattcaccaccaccagcctcacctgagtgggaagaagttagattgttgaggaatataaagcctacatccccaaacactgtcactgataaatgggaaagtaaatgtactacccctaatatcagtggttaa

SEQ ID NO: 17595 - DNA, 810 bp, Glycine max
  Peptide Sequence Number=SeqID_134373
atgtgggaatttggaagagttaactcccgtcctgtctttttgagccaatatgaagtatcatccgtaggagaatttaatggaaaacacggtgggtcgtgcttcatgaatcaagtgtacaactgttcaccttccttctattgtgggaatgtaaggcctttccgttaccctttcaccgagactgataccagagacattctaccgtttgtgtctgctgagatggttcttgaagttgtattatctaatgattgctatgagtgctataatttcagaggaggtcaatgtctgcttgtcaaccataaaacgttcaactgttctgaagcggaaaagcattatagtaagagtgaacatgtgatgctgtcacttgtacttgtaacagaggaaaactctccaatatcaatcaagaaagataatgatgtacttgatcccagctcaaataaaacttcgtaccccattgcccagagctctccgctatgcgaaggtatgggagagggatattgtatgcagccttacccttgcatatgcaaagaggctgtttccggattcgaacccatgaccaacaagtcaccaagacacaactttaccgctgcaccagggctcgccctcaaatcccgacacaaaatggcagtgtgtactttggaatccatctcttcacttaaaaggagcttcaagaagctaaacataatttccacctcgacagagaacttggaagtgaagattttcgaacagtttggcatagtaaaccattccctctctattggaagttggattggaactaagattgatggtacttgtacttgtttaattgaataa

SEQ ID NO: 17596 - DNA, 381 bp, Glycine max
  Peptide Sequence Number=SeqID_134374
atggaggctgcggttgcacctgaacagagttgtgttgtattggatataaagagaagcagcaaagccagaactatgaggaagagtataattgtttccaaaagcttcacaactttcgttctgcagaaggtgatagagatttgtgtctctaaattgaaaagttgtgagaggagtagtaggactactgaaaagctgagcaacgctggatcatcacaattgcgaatgggcaataagccacagtccgggcgttcagttagagtgaatgggaaactgatattgtcaagatatccacatggaaacgaaggtggacactctgcttggttcccagccgccaagacaagtggcataaggccacaaaataaaagcaataatactaattcataa

SEQ ID NO: 17597 - DNA, 723 bp, Glycine max
  Peptide Sequence Number=SeqID_134375
atggcaaagaacgtctctctgaatctttttcttcccatgctgctgctatgtgcaggagtgcaatctgacgtgactttcactttcgagaacttatgctcggacaccctgtggcgcgcctcaaaccctagcatcggagacttggagccagaccttccccgcgacacctacgagatattcaacatggacgaccactacagcggctccatctgggttcgaaccggttgctccaccaacgcatcgaactacttctcgtgcgaaaccggcgactgtggcaacgggatcatggagtgtgcaggcctcaacccctcattcccaataacccaattaaacttcgttgtgaacaaccctattgtgtcctacgaagtgagcttgaagcatggccaaaacatgttggttcgaatcaaaccaaatggtggaaccctcgtggacggttcagggccatgccctatggtggattgcaacaaagagctttctagtgtgtgccctttggatttgattgctgggaacaagaatgaccaatatgtgggatgtaatagtccttgtgatgggtataaggaccctaaatattgttgcaatggcaatggttgccaaccggatgagatttccgtgaagtacaaagggctttgtccgtttgctcatacttaccctggggacaatcaacctccgatttatcagtgtaaaggggctgatagttatgatataaccttttgtcctgccctttag

SEQ ID NO: 17598 - DNA, 885 bp, Glycine max
  Peptide Sequence Number=SeqID_134376
atgaacctcttctttttcctcaaacccctctcgtctctcatgattctctcctacatcatcctcttctttctccttgtaagaaacacctcttgtgatgtggacccaaattatgtcgcatgtccacctaaaacctgcgccaacaacaaccaaagtataagctatcccttttacatcgaagaaacacaagaacctttttgtgggaaccctggttttgccatctcttgtggcccaaatggttttccaatcctcaatctgtctaatacccattacatcattcatcagatattctacgaaaatcagacccttcgagtgtccaatgctgcgttttcagtttcacggtcaaacaccaccaattccaaaggttgtcttcctgttcctcttactcataatctcactcttcctagtacccccgagttcgatattgctccgaatcaatcaaacatgagattgttctacggctgtgagtcattattaccttggccggaagagcacagagttgggtgtcctaacgaaacgagttcagttctggcattctataaagaggataaaaatataagcttggtgtcaaagaattgcaggggcgaggttgtggatacgatagtggaagatggaataattgaaggaggggttgaagaagcgttgagaaaagggttgttgctgacgtggaaggccggtaactgcagcgagtgccacagcagtggagggaggtgcggcttcgattcaattatgtacactttcaggtgcttctgcactgacagagttcattctgccaaatgtgatcctgataatggtccagtttctaatagagttaattccgcccttggttttgtggtttgtcgatatcttcttaaatcatcaaagagcgagttcgaatacgacatctaa

SEQ ID NO: 17599 - DNA, 294 bp, Glycine max
  Peptide Sequence Number=SeqID_134377
atggcttccattatggaatcccatccacaatgtgtgaagaatgctcctattgctcaattgacatttcctatgtttgctgatccgttttacaatgagaagtttactgtgcaagtagctgagatgggtgaatgtgttcaagtgaatagggaaaatgttaaggaggctatagagaaggtgatgggtgatggtgaagagaaagaaaaaagagaagagaaagagctagaaagtataaagaaagcaatggaagaaggtggttcttttaccccaacatctccatgcctatcgatgacataa

SEQ ID NO: 17600 - DNA, 777 bp, Glycine max
  Peptide Sequence Number=SeqID_134378
atgatatactatatcgtggaaatttttgtcagggttgcttcctacaatgcaggaagttatgccagtgtgaaacacaaatattgtgttatgcacttatggaggaatttctcaaagcagtggaaagacaaagagttaagaggcctagtctggaagtgtgcacaatctactactgaagcagaatttaagttaagtctggaaaaggagaaacttgaattcaacaagtggattgcaaactgggttggtgatcctgatggaactagatttgagaatgaaacctatgaaaattacatacgccctatcaggagtcaacaatattgggaaactacaacgtttgataggctgacaccaccccatattaaaaagagacctggtcgacccaaaaaatgtagaaaaaaagatcaaaatgaggaccaagtcaataacaatagactaaaaagatcctacaaagaggttacatgtactagatgtggtcttaatggtcataacaacagaggatgcattaatagtggtgttccaccaagaccaaaaaagtggaaacctactgttgatgaaggcaataactcaaatgcaaccacaacaacaccagaaacaatcttcatacctccaccgatgtcaactgcatttagaccacctccacttagacctccagtaccaattcgaattataatgccagatggagtatctcataacaagaaccaaccaaattatgagtttcatacctacactaggaatgcccaaccgccaagattcgaagaactaaaatatggaatagattaa

SEQ ID NO: 17601 - DNA, 252 bp, Glycine max
  Peptide Sequence Number=SeqID_134379
atggatgttgatggtgttaaaggtggttcagatgatgaaaataaagtacttggaactaatgtacaagaagcagaaactgaagttgttgaaataggagttaaaacaaaacctaaagttgttggaattgaaactgaagtgaacaatgatacagataatgatgaagttaaagaacatgatggggatgttgagttttctaatcattctgaaaatgacccaaactatgtatatgtgtctccagaagatgatggataa

SEQ ID NO: 17602 - DNA, 297 bp, Glycine max
  Peptide Sequence Number=SeqID_134380
atggggtcctataggtcgatgatgcaaagcaggtttccaatgcctgaagtagaccagtccattagattgcgtggccgcgtggggagtagcggcagaggaaaccaacaagtgttggttggtctccaattcagccattttctgaagcaaatcgtcaagtttcgtggacatggaattctaggttgcaaggagatggatttgggtggtgagtttggcaatgacttcttcgattctatcgatgttagacttagaacgtgtagattccgtcattggagctcaatgaaagcaccaagatgttag

SEQ ID NO: 17603 - DNA, 1512 bp, Glycine max
  Peptide Sequence Number=SeqID_134381
atggagacaacaccagaacgcaaccttcactttgtgttcatccccttgatgttgtcaggttgcatgcgtcctttggtagacatggccaaattaatggcacgacgcaaagtaaaagttaccatagtcaccacagcccgctatgcagtccaattcaaagccagcatcgacagagagatccaatctgggtcatcaatccaaattcaactagttacatttcccaatgcagaggttggagtaccagaggggtttgaaaacatacaactaccttctatagatttgaaggagaaacttttcacagctttaagcatgttgcagccgcaactagaagagcttcttaaaaagctaaacccctttccatgttgcattatacatgacaagcacattttttgtgttgctgacatcgcagtcaagttaaaagtcccaagaataacatatgataggactaattgtttcaatctcttgtgcaatcacaacttgctaacttataaggtctatgagactgtctcttcagattcagatgaaattattatccccggattaccccatagaattgaaatgaggaaatgtaggttgcccacagtatccaagccttactcgcctaactcgagccaaaagatggatgttgtacgtgagagaataaggggatctgaagcagaggcatatgggatagtggtgaatagttttgaagagtttgaagctgaatatgttgaagagtatcaaagggttacagggcataaggtatggtgtgttggtcctttatcactaacaaacaaggatgattgggacaaagttgggagagttagtaaaagcccaaatgctagtgaaattgaaaccaaccaatatatgaagtggcttagttcatggccacaaagctcagtaatttatgttggtagcttttgtccagtagaacctaaggttttgatagagattggtttaggattggaagcaacaaaaagaccattcatttgggatctcaaaggaatatataggagagatgaaatggaaaggtggttgtcagaagaaagatttgaagtgagggtcaaagataaaggaattttgattcgggataactggttgccacaagtgtcgatattgtcacatagagcagttggagcgttcttcacacacgctggatggatatccacattggatgccatttgtgctggtgtgcctttggtgatattacctgtgtctgctgttgaaatgttttacaatgagaagcttctttctcaagtggctgagattggtgtgacgatgagaactgaaattgctattcactgtggagggaaagataagtatggagaatgtgttcgagaggtgaaaaaggacagtgttaaagaggccatagagaaagtgatgcgtaaaggtggagatcatgaaaaaagaagagaaaaagctaaaaagtacgcagacatggcaaagaaaaccatagaagaaggaggttcgtcttaccataatatgtctatgttgattgatgacatagtgcatgcccaatcgctgaatcaaagttaa

SEQ ID NO: 17604 - DNA, 312 bp, Glycine max
  Peptide Sequence Number=SeqID_134382
atgccaggaagaggaaaaggaggcaagggtttgggaaagggaggagcgaagcgacaccgtaaggttctgaggaacaacatccaagggatcacaaaacctgcgattcggtgtctcgcgaggcgtggcggcgttaagcgaatcagcggcctcatctacgaggagacacgtggcatcctcaagatattcctcgaaaacgtgattcgtgatgctgtaacctacaccgaacacgctcgccgcaagattgtcattgctatggacgttgtttacgccctcaagagacagggcaaaaccctctatggtttcggtggttag

SEQ ID NO: 17605 - DNA, 318 bp, Glycine max
  Peptide Sequence Number=SeqID_134383
atgtctggtagttgttattgttctgttgatttctcaaattttatcaaaatttttcaaaatgaagaccataagagagtttctccatgccaagaaatagagtcaccacaggaagatgcagtagatggtcatgttagtcgagactctgacactgcaatagagatagacataaacaattcatctttaagcacaaaaaatgtgaatggttgcaattctgattatgatggaaatggtctttccatggaagtttatgccatatatccatgcttaactgttaagaaactttggtgcattctaccttggaaccttgtgaggatgtag

SEQ ID NO: 17606 - DNA, 264 bp, Glycine max
  Peptide Sequence Number=SeqID_134384
atggaaagatattttttggttgcacgactcactcatatcaccctcaagagagagacttgggttacctatggtgcccttattcctattgttgctggagttgtcattgcaagtgggagatatgtcaatgttgcatcatgttccttgagccactctagatttggagtggtgttggacagattaggtggtggtggtgggcgagcgagggtttcagttatttggattcattatgtgcctaagattgcaagctttgcttcaaataaataa

SEQ ID NO: 17607 - DNA, 195 bp, Glycine max
  Peptide Sequence Number=SeqID_134385
atgctagaaacactggcgttgtgcaagtgccaaaggtggaggcttgatgaaatcgaggaagaggctggaggcaaaggtgtggtggaagggaaaagttttgtggggagcttctcaagaagagttggagatggagaggagcgacacaaggataaatatggaggacttctgtctgtccttagacgaggacatcactaa

SEQ ID NO: 17608 - DNA, 1683 bp, Glycine max
  Peptide Sequence Number=SeqID_134386
atgctgacggagggaaacaacagcagctgcggcagcggcagcggagtgcagcaccatacgacgtcgtcctcgtcctcgccggcgcagagccggctacagcggcagaagctggaagtatacaatgagattcttcgccgcttgaaagattccggcaacgaagaagccatgcaacctggcttccacgatcagctttgggctcactttaatcgactccctacgtggtatgcgctggatgtgaatgtggaaagagccgcagatgttcttatgcacaagagattgctgcatttggcgcatgatcctgctaataggccttcaattgaagttcgattagttcaggttcatcccacatccaatggaaactcagctgacacttttgaatcagatgatcctgggatagaatctggacaaagttcttcaaagtactcaagcagacagagtatacatccacctcctgcatttggttcttctcctaatcttgaagcactggctcttgaagcaaataattctgaagacatagaagaggaacaatctgcacatgccaatgttcaatattcacggcatatgcatgaaatcaccatctcaacagatgacaagcccaagcttctcagtcagttaactgctttgctttctgagattggactgaacatccaagaagcacatgccttttctacaactgatggtttctcattagatgtgtttgttgttgaaggatggccccatgaggaaaccgaaaagcttaaagctgctttggaaagaggagtcttgaagaagattgagaggcaggtgaagtctagtccacaatccgtatcttctgttgacaagcccgatcaagcaaagatgaaaagcgaactggattatttgacaataccaactgatgggacagatgtttgggaaatagatcctaaacatttgaaatatggaactcaaattgcatctgggtcatatggtgaactatttaaaggtgtatattgtagccaggaagtggccatcaaagttctcaaggctgaccatgtaaactcagaattgcagagagagttcgcacaggaagtctatatcatgagaaaggttcgacacaagaatgttgtacaattcataggagcatgtaccaagcccccaggcttatgcatagtaacagaatttatgtctggtggaagtgtgtacgactacctacataagcagaagggcttttttaaatttcctacccttctcaaagtagcaattgatgtttctaaaggaatgaactacttgcaccaacataatataatccatagagacttgaaggctgccaaccttttgatggatgaaaattgtactgtaaaggtcgctgattttggggttgctagagttaaagctcaatctggtgtcatgactgcagaaactggaacatatcgatggatggctcctgaggttatagaacacaagccgtatgatcacaaggctgatgtatttagttttggaattgttttatgggagttgctcaccggaaagcttccatacgaatatttaacccccctacaggcagctataggagtggttcaaaagggtttacgacccaccatccccaagaacactcatccgaagtatgttgagcttcttgagaggtcttggcagcaagatccaacattgaggcccgatttctccgaaattatcgagatcctgcagcagttagcaaaggaggtataa

SEQ ID NO: 17609 - DNA, 387 bp, Glycine max
  Peptide Sequence Number=SeqID_134387
atggcgcctactaggcaccctctggaccaagagaagtccaacagggccctggggttttcgactctaatcacgggcctctgccagtcctacggagttcctgtcacccccagcacgataatccgaccactgatcacccaagccttcatcaagaagtactgcatgcctaggcaggcgcagggcgacgcacatcaggacgggccaggttccgccccttttgtatgccctaccccggagcagtttggggctgaggtcgcatggcctggagactggcccgatgcccaggcaggggaggagcctgcaggaacccccgatgaggcggatgaatcccatatggatgaggatatgactgacctgctcgatttcttgggagggagcggagccacatga

SEQ ID NO: 17610 - DNA, 2352 bp, Glycine max
  Peptide Sequence Number=SeqID_134388
atgggatgtgttgcctccaaactagaggaagaagaggaagtggtggctatttgtagagagagaaagcggctgttaaagcaagctgtggagaaaagatatgcacttgctgaggctcattgtaagtatttccactctctcaatgcagtagcagcggccattaagctctttgttgcacgccactcttcaccttcatcacctttcctcataactttccctcctccttgcccttcttctccttctccttctccttctcatcccactgagaatgtcataaccaaccccatgttcctccagcagacaccctcagaaaccaagcatgaagccattgcttgtgactcatgcatctcttcaacaacctcagagtcttctgaggaagagagtgaagaaaaaagggaaggagagggtgaagaaggtaacggagaggaagagcaacatcaacatcaacaaccctgtgggtactattgcatgcctatgactatgcctatgtccatgtctatgtctatgcctatgcctatgtccatgtctatgcctattccaccttcaatgccatcccctcagagagattttggatgggactttttctacccttttgacagtatgaggagtgaggttatgagtggctaccacaggaactcggatgatgatttgagggcagtgagagaggaggaggggattcctgagttagaggaagaagtggagagagaagagattcagcacaaagtggtgagtgttgaagagaataataataataatagtaataatgaaggtgctgttgagcatgtgctgagtggtgttgaaacagtgaaggtggtagatgtggccactgaaaaccaaggggagcaaagggggcttgcagttcttgatacaccagcagaggggagagagttgcttgaagctttgaaagacattgaggaccattttctcagggcttatgattctggtaaggaggtaaccagaatgctggaagccaatagaatcccccttcattctagtttggatgaaataaaagaaagttcaactaaactcattcatgcaataacatggaagtccatttcatctaggcaaccatcatgcaagagtcttacggttccaaatgtgaaaaattcttcaacttgggtggaatataagaatgatctgtttgatgattatggaggaatggattcgggaagtcatttattaaccttaggaaggttatatgcatgggaaaagaaactgtttgaggaggttaagacttatgcaggagaatctttcaactgcatgtggcaggctggagataacacacggaaaaattacgaaaaaaaatgcacgcagttgagaaataagaatgttagaggagatgatgtactaagcacagacaaaactaaagctgaagtgaaagatctgtatgctgggatcttggttgcaattcgacgtgcagagtcaatctcaaagagaattgagaaaatgagagatgaagaattacaacctcaaattgttgaactgttaaaaggcctgactcagtcatggaaaatcatgttggagtcccatgaaacccagaagaagattctatctgaagtcaagtacttcacatgcgccacatatggtaaattctgcaaccaatctcatggatttgcaactcttcagcttgaagctcagcttcataattggcgcgactgctttaaagagtacactgcatcgcaaaaagcatatgttgaagctctccatggatggctcagtaagttcatagtccctgaagttgaattttactcaagaagcaaaaatgtcacaatgccataccaattcaatgggccaccgctgcttgtgatatgcaacgactggttggcttcactgcaaaagctacccgataaaatggtaacagttgcattgaaaagtgttgtgaaggatgttagagctttgtggcttcagcaaaacaaagagcaacagcagaaaaggagggtagataggctaacaagagatctggagagaaggtattcttcaacgtcacataaagtggtggagactaagatgctcgagtttcacgtcgtggaccacgaattagaggtgggaaatgatcaagaggaggaggagtgcatgatggagaagagtgatcatttggagacactgagaagaaaactggaggtggagaaggagaagcaccacagtagcatgcaagaaacacagaggatcaccttacatggattgcagtctgggttttctctagtgtttgaatcattgacagagttctccaaagcatcacagaaaatgtacaatggccttgtaacttatagtgaaaatagtgacaaggttgggaacattacgtatatagagggtggctgcaatgttgaaaattgcaacagccaaaacggacaatag

SEQ ID NO: 17611 - DNA, 873 bp, Glycine max
  Peptide Sequence Number=SeqID_134389
atggcagcagccactctctccgtccggcccgaccgtctctcgcccggttcggtgtttcccagaccaccggttcagcctccgctgcgaaaaccaatcgcggcgcccgagccgtggcgcgccgcggcgccgcggatacgcatcaggacggtggcgccggtccaggcgagctcgcgcgccgatgactccgcgccgttcgagatgtcggtggagaacgcgctgaagctgctgggcgtgtcggagggcgcttccttcgacgacatactccgcgccaaaaacgcaatcgtcgccaattgcaaagatgaccaagatgccattgctcaggaatctatgctcaaagttaatgtaaacattcattacacgaattcacaaggtggtgattggtcagtagtgaagctaggttatgtttggataaacttctcaatagatattatagactgtgttggttataaggttgaggctgcatacgacatgttgcttatgcagagcctaactcagcgtcgggcagggaaagtagtgaacagtagtgttcgttatgctgatgtcaaacgtgtgaagtcccctgctgggggatcaatgcctcaatggttgaagaattcacctgtatctattgagtcaccttccactagtgatttgggtttacaagctggagtgtatggtgcattgatgggtttaacttatcttaatggggcttctgcacccgccgcaggttatgctggggctgatgttcctggactcctcttggctggtagctttggagcttccctgtacttcatgaccaaaaagaatgttaagttagggaaggccactgtcataaccataggagggctcgtagctggtgccgttgtagggtcagctgtagagaactggttgcag

SEQ ID NO: 17612 - DNA, 300 bp, Glycine max
  Peptide Sequence Number=SeqID_134390
atgggtgtggctgagaacattcccgatatggaggagggtaccttggagattggaatggaatacagaactgtatctggagttgctggaccattggtcattcttgacaaagttaagggacccaaatttcaagagattgttaatattcgtttaggagatggaactactcggcgtggacaagttctagaggttgatggcgaaaaggctgttgttcaggtatttgaaggcacatctgggatcgacaataagtttacaactgtgcaatttactggagagcagaaagtggagacttcaattttatga

SEQ ID NO: 17613 - DNA, 378 bp, Glycine max
  Peptide Sequence Number=SeqID_134391
atgtttggatatgcattgaaggcccttggatgcacgtattttatggtcaaacatgggaaggttcaacttggtgtagaggttgttgaggttgagaaaaaaaagctttatcatagcatgctaggaataagtgtccaaaggagaaccactcggtacaagttttaccaagaatgggtggaatggaattgcatccaggaaaatcctttatatggaaaatttaatatcaaaggacttccatttgctcacaagttgactaaactttttaaggatgtagttgctaatggaaagttccaatgggctctctcatttgggatattgcctgctagtgttaaggttgatatggatgatgggtatcatcaagtcttaagggcattggcctag

SEQ ID NO: 17614 - DNA, 2124 bp, Glycine max
  Peptide Sequence Number=SeqID_134392
atggcggcggcagcggcgactactccatcgtggcagcctcaggagcaagggttcaaggagatctgcggcctacttgagcagcagatttcgcattcttcttccgccgataaggctcagatttggcaacaccttcagcgctactcgcatctccctgacttcaacaattacctcgccttcatcttctcccgcgccgagggaaagtcggtggaggttcggcaggctgcagggttatatctgaagaataacctcagaaacacgttcaaatctatgcagcctgcataccaacagtatgtgaaatcagagttgctgccttgtcttggtgcaacagataagcacataaggtctacggcaggaactattattagtgttgttgttcaaataggaggagttgttgggtggcctgaattgttgcaagcccttgtaaattgcttggatagtaatgatctaaatcacatggaaggtgcaatggatgcgttatctaagatctgtgaggatattccccaatatcttgactctgatgtaccagggttagcagaacgccctattaacatatttcttcccagattatttcggtttttccaatctcctcatgcttcattgagaaaattatcactgggttctgtaaatcaatacattatgttaatgccttctgccttatacgtatccatggatcaatatcttcaaggtctgtttattctcgctaatgacgctgctgctgaagtgcggaagttggtttgtgcagcatttgttcagctaattgaagttcgcccatctttcttggagccacatttacggaatgttattgaatacatgttacaagtcaacaaggatacagatgatgaagtagcccttgaagcttgtgaattttggtctgcttattgtgatgctcaactgccacctgaaaacttaagagaattcttgccccgtcttattccagtattgctgtcaaacatggcttatgcagatgatgatgaatcagttattgaagctgaggaagatggttctcagcctgatcgagatcaggatcttaaacctcgatttcacgtatcaaggtttcatggatcagatgaagtagaagacgatgatgatgatgttgtcaacacatggaatttacggaaatgcagtgcagctgctcttgatattctttcaaatgtgtttggagatgagatccttccaactcttatgcctattgttgaggctaagttatctgctggtggggatgatgcttggaaagatagggaagctgctgtcttggctcttggtgctataggcgaaggttgcatcaatggtctttatccgcatctgttggagggtattgggcatcctaaaggctatgaacaatttgataatgttcttatgggtcttctacgaagaattttggatgataataagcgggtccaagaggctgcttgttcagcctttgcaactctggaagaggaggctgctgaagagttggctccacgcttggaaattatactgaagcacctgatgactgcatttgggaaatatcagaggcgaaacctcagaattgtatatgatgctattggaactctagctgaagctgttggaggagagctgaatcagcctgtttatcttgacattctcatgccaccattaattgagaagtggcagcaactttcaaattcagacaaagatctttttccgctcctggaatgctttacatctatagcacatgctctgggtactggttttgctcaatttgctgaacctgctgatcctgccgccaccacaggggttcagtatgacaaggagtttattgtatgctctcttgatttgctttctggactagcagagggtcttggcagtggaatagagagtttggttgcacaatgttctttgagggacctacttctgcattgttgtgtggatgatgctcctgatgttagacaaagtgcctttgccttacttggagaccttgcgcgaggtggggactgggtgaaaataagtttgggtctacccaaacatgtgtgcccggttcatttgcaccctcgtttgtctgagtttcttgaggctgcagccaagcaactggagatttctaaggtaaaggaggctatttcagtagcaaataatgcatgctgggcaattggagaattagcagttaag

SEQ ID NO: 17615 - DNA, 951 bp, Glycine max
  Peptide Sequence Number=SeqID_134393
atggaggcagagatggatcactacgcggtgctagggttaccgtccggcgaagaaggcgcgaaactaacggagaaagaaatcaacaaggcctaccgatggaaagctctcgaattgcaccccgacaagaggcccgacgaccccaacgccgccgccaacttccaacagctccgcacctcgtacgacatcctcagggacgacaaggcccgcaagttgttcgacgacctcttgcgcgtcaagcgagagcgcgagctccgcaatttgcagcgcgacggaaagcgccgcaagatggtctccgatctcgagcgccgggagcgcgacgccaacgcccccgaccccgccgcgaaggagcgcgaagaggaggccaggattgcgaggcaactcaaggaggagatcgcgaggattcgtgctatgcacgggaagaaggaggaggcaccggcggcggcgccggcgaaggagaaggatagtggcggtagtagtggagtggatcaagagaaggttctgaaggtttcgtgggagaaggtgggtgaggattattcggctgataagttgagggaattgttctccaagtttggtgaagtggaagatgttgtcatcaaggggagtaagaagaagggttctgctctcgttgttatggccattaaagaaggagctgttgctgctactgggagtgtgattggtcatcttgccaatccgttgctggttgtacctcttaaaccagcatctgtggctgattcttcgagcgttccaaaatctgctgaaaccaccaggatgagtaatctggttggtgctgggtatcaagcttttgaggattctgttctgaagaaactgcaaaagccgctacagtgctattgcattgcgaaattcctcggatctgtgaccactgcagaaatggacgccatgtcttcaattttattacctgaagcctatatcagtccaaatctgaaacactag

SEQ ID NO: 17616 - DNA, 876 bp, Glycine max
  Peptide Sequence Number=SeqID_134394
atgtacaagctggcaaatgatcctacaattgagcgtattatcactcctcgtattgctcttactactgctgaatatttggcttatgaatgtggcaagcacgttcttgtgatactcacagacatgagttcttatgctgatgctcttcgtgaggtatctgctgcccgagaagaagtgccgggtagacgtggttatcctggatatatgtatacagatcttgcaacaatttatgaacgagctgggagaattgaggggcgtaaaggctctattacacaaattccaattctaaccatgcccaatgatgatattacgcacccaactcctgatctaacaggatatatcactgaggggcagatatacatcgacaggcagctgtataatagacagttgcatttactgttgattaactatgtagatttaatattgaggccaaaactaaacattctaattatttttaactgggcagatatacccaccaatcaacgtcctcccatcactatctcggttgatgaagtggttcacgctctaatggtgcatcattggtcacttctgcagagtgctattggtgagggaatgactagaagggatcattctgatgtgtccaaccagctctatgcaaattatgctattggaaaggatgtccaggcaatgaaagcagtggttggagaagaagcactttcatctgaggacctgctgtatctggaatttttggagaagtttgagaggaagtttgttgcccagggagcctatgacacccgcaatatattccagtcacttgatcttgcatggactttactccggattttccctcgtgaacttcttcatcgtataccagccaagactcttgaccagttttacagcagagatgctggtaattga

SEQ ID NO: 17617 - DNA, 438 bp, Glycine max
  Peptide Sequence Number=SeqID_134395
atgttgttcttttctcacactgaaacattcgttggagataaccatcctcttgagcttgatctcctaaatccaggggtaggcaacaaccatggccttgatctaagggcccacataaatgccccaaccctcagggaccaaattgaagtcagcgaagtgcagcttccccttgatggtgatggatctaaccttggggaagcggttgacaatggtggccgaagagattatgtaacagttttcaacaaagactctccggcgacaccaacgctcgatctcgtaccaggacttgcagacgagggagatcaaacttcgatccttgtcacaatcgataaaggagaacatgtgctccagcacctcctcagggaacaagtaatttactctcgaccgcatgtccaatggaatacaacaaccctacccaaaacgttattgttttctgaatga

SEQ ID NO: 17618 - DNA, 163 bp, Glycine max
  Peptide Sequence Number=SeqID_134396
atgtgtgactctaacattgcctccattgagagcccttgtgacgcgctgagcgtggatgcacctggaatgtttcgcttcgatgtgatctacaactgtgccgttttgagggagggggtggaagaggtgaggatggcgtggaacatggtgttgagagggtggaaag

SEQ ID NO: 17619 - DNA, 1182 bp, Glycine max
  Peptide Sequence Number=SeqID_134397
atgaggatagataccttcataacacaagaatgtgacagttctaatgattttgacaacagatcggcattccaacgcttcttgtgcaaaggcatcgccgcttttggcttttgtatgaaccaaaacagacgtaacaacgttgtgaaacaaccctacgagagaaagcagcaggagagtcctcatttcacaatcccatcttctccttcaggaaatgaagaacttctctccaccatttcttactgcacctttgttttcaccttcactgacccttcagaatctcctgcacaaagagactcaaagaggcttcaactcacaagattagtgtctatattgaagtcctccaagaagccagtgcatgaaaaagttttgggggcctctagtggccatgatctcagccaacctcttcaggccactccctccaccttccaacccttcttcttccctcacagaattgccagaaaaagaagaccccatctctatattctcatccctatgggaattgatcattctttcctctgcaacctccaagcacttttccagcctgaggatccaatggaacgcgagagtttgaaaaacgtgtaccacaagatatactccgagttcatttctgatcgttccttcatgaggaaatcgatgaccaagggaaccataatcaatggctttaccgtgccactcaaggaagagcacaagctgtttctcatgagagtgctcattcctctacacaagaccaaagggatgcaaaaggagcctatgcttggaggggttgttgttagaggaattttgaggtactggcctgtcataaactgtcaaaaagaaatcttactaattggggaattggaagatctggtagccgagcgtgcactctatgtgtggaacaatgagcagttcgtgaaaatggcattaataggaacggtagaagtatttactgtgattgtagaaggcatggaaaagaacctgaagtcgcattggagcaagagtgtgaggcaactaacagagagtgtgaaagtgatgctggaagacattgatccagatatgtattcaaagggtctcatggacatggaagctaaagaatcaatggcacatcaagaagatatcaagagaaaaaagagatgggaaagaatagaattggaagctgccaagaatcagtttctcaatccacaacgttatatacgtgtctcctactaa

SEQ ID NO: 17620 - DNA, 1389 bp, Glycine max
  Peptide Sequence Number=SeqID_134398
atggagtccaataatgctgaatatgtgacactgggaggagaaggttcaactccaaagttagagaagatgagcaaggtttcaattatgcctctgatgttcttgatcttttatgaggtctcgggaggaccttttggtgtggaagacactgtgagagcagctggtccattgttggctctccttggtttcttgcttttcccattcatttggagtgttccagaggcactcctaactgcagaaatgggtactatgttccctgagaatggtggctatgtggtttgggtttcatctgcactgggtcctaactggggtttccaactaggttggatgaaatggctcagtggagtcattgacaatgctttatatccagttctatttttggattaccttaagtcagctattccagctttaggaggtggttttccaaggataatagcagtgatagttttagttttagctctcacttacatgaactatagggggctaaccatagtggggtgggctgcaatattgttgggaatcttttcattacttcctttcatggttatgggagttatagcaatacctagaataaaaccaactaggtggatcatggttgatttgaagaaagtgaactggggtttatacttgaacactctcttctggaatttgaactactgggactcaattagtacccttgctggagaagtggataatcctggtaaaaccctcccaaaagctcttttatatgctgttatgttggttgttttggggtactttttgcctcttctgataggaactggagctatgccggttaaccgtgagctatggtatgatggttacttctcagaagttgctagagtgattggaggggtttggttaaggagttgggttcaagcagcatctgctttgtcaaatatggggatgtttatggctgagatgagcagtgactccttccaacttttggggatggcagaaagaggcatggttcctgagttctttgcgaaaaggtcacgttatgggacccctcttgttggcattttgttctctgcatctggggtggtcttgctttcatggttgagctttcaagagatagttgctgctgagaacttcttgtactgttttgggatgcttatggagttcgtggcatttgtcaagttaaggaggaaactcccatatgccgagaggccttataaagtgcctgttgggaaaacgggagctatattgatgtgtgtgcttccaacactgctgatatttgtggtcttagctcttgcttctttcaaggtcttcattgtaagcttctcagctgtgatcatagggcttgtattaaggccttgtttgaaatatatggagcagagaagatggcttagattctctgttaatcctgatcttccagatattcgtgctacttag

SEQ ID NO: 17621 - DNA, 366 bp, Glycine max
  Peptide Sequence Number=SeqID_134399
atggagcatttcatgcaatcttggtgcactgctttgtcaatgatacgagatgatgttgagaaagaggatgcttttagaggtctatgtgctatggttaaggctaatccttctggagctctaagctcgcttgtttacatgtgcaaagccattgcaagttggcatgaaataaggagtgaagatttacacaatgaagtctgccaggtcttacatgggtataagcagatgctgcgcaatggagcgtgggaccagtgtatgtctgctttggagcctccagtaaaagaaaagctttcgaaatatcaagaagttccacaagccttgaagatctcacttgatggagtttcccatgagaaatgtacaggggaatga

SEQ ID NO: 17622 - DNA, 303 bp, Glycine max
  Peptide Sequence Number=SeqID_134400
atggagttaaagggtgcttcattgaggagagggtatgagttgttgaaaggtcagaagcaaaagaagaatagattagcaaaggaaagcaatattgttccaaagggaaagggaaatggagtagtttcatgcacagaggaagttggaggggttgtgaggatgaagattgtggtgagaaagagcgagttaaagcagctggtggaagtgatgaatggtggtgtcaaaaaaaatatttgtccagagccaaaggaaacccccaaaagtgctggagtcctgtcctacaaagcatccctgaagagaaattag

SEQ ID NO: 17623 - DNA, 165 bp, Glycine max
  Peptide Sequence Number=SeqID_134401
atgagtgttgatgccatacctttaaagtcttctggtaaacctagccttcaaacgtttatggttgttgtggagaaggagctgtctactttagtgcatcagattacatcattgctccataattcttcacttcatagtaattcaaaacagagaaggggtagtttttaa

SEQ ID NO: 17624 - DNA, 162 bp, Glycine max
  Peptide Sequence Number=SeqID_134402
atgggaatggctggtgcattggatgtggaggccttgctgaatgaaaaggccaacagaaaagacagatttaattataaggaaagatgtgaaaacatgatggattatataaaatggatgaaggtttgcatcaagtggttccaagaccttgagattagctactag

SEQ ID NO: 17625 - DNA, 1905 bp, Glycine max
  Peptide Sequence Number=SeqID_134403
atgtgcctcgagtatcatgggactccagaatatgacagactcacaattgcctccttctatatggagggaagagccttggcctggtttcagtggatgaccagcaatggtcaattcacttcctggcccgttttcttgcaagccctccaaacgaggttcgcaccatcgcaatatgaggaccctacaggggctctatgcaagctaatgcagaagggttcagtcgcggcttacctggcggagtttgaggacttagcgaatcgcgttgtcgacgttcctccaccgtttctcctcagctgcttcgtctccggcctcctttcggagatatgtcgagaggttcaagctcatcaacctctcaccatctaccaagctgctggtctcgcccgtcttcaagaagacaagctctccgaccatcgtcccccacccccgccaccccgccctcgaccaccaccacttcccaaccctaaccccattcgacctaaccgccttccacctcttctctcgccacccccatgcctaaatcctcccccacccttcaaacgtctcaccttcgaagagatagcctctcgccgtgagagaggtctctacttctcttgcgatgagaaataccatcgagggcatcgctgcacctctcgggtgtttctcttaatcgcggagggggaagatgaccctaacccacctcatatagatacttttgacccaggcccagacccgaaccccaaaacacttcccgacccggacccatacccgacccaacttagccttaactccatggcgggtcatattgctcccgaaactctgcgtttcatggctaccatctccgatcacgatgtggtgctgctggtggacggcgacagcacccacaatttcattcagcaccaacttgtggatcaattgggcctctctacgcgacccaccacaccattacgtgttatggtgggcaatggtcaacatcttcaatgcttctctatttgtgaatccattcccatcatcattcaatccaccgaattcattgttgacctttatgtgcttcccctctctggtgctaatgtggttctcggcgtacaatggctcaagtctctgggcccaatcctcacagattacagcactttagccatgcaattcttctataatgagaaattgatcacactacagggagacattgatgcttcgttgcatgcactttctccattacaatttaaacgcctctgtcgcactcacagtgaagctaccttttaccacatcacattattatctcctccgtcctccctcaacaaccaagaaccaccccctgttgttcaaccactcatctctaaatatgagagcctctttcaccctcctacaactctacccccaattcgcgacactgaccatcatatacatttactccctcaagcttcttcggtcaacgtcagaccgtaccgatacccccattatcagaagcaaaaaattgagaatcagaagcatgatggctcttggtgcttctgcgtcgactaccgtgctttaaatgccttgacggtgcgtgaccggtttccaattccgactgtggacgagctcttggacgaattaggaggcgccagttacttttcgaagctcgatttgctccaaggttatcatcagattcgcatgcatcctgatgatattcctaaaacggcctttcgaacgcatcacgatcactatgaattcaaagtgatgtcgttcggactctgcaacgccccatcgtcatttcaggccaccatgaattccattttccggccatatctctgtcaattcatcatcgtcttctttgacgatatccttatatatagtacctccattgacgaccacctgcaacatttggagcttgcttttcagatttatacgaggctatgctacgattgctgcccctttggtcaaggcaaccaccattaa

SEQ ID NO: 17626 - DNA, 2713 bp, Glycine max
  Peptide Sequence Number=SeqID_134404
gactgaagttgagctgcttgaaaaaatcaccgaatctgttaatcttgagttaaggaggttgcgtaaccatccacataacttaaaaggggttataggaattgaaaagccaattcaaagtttggaatcattgatacgtcaaaagtcaataaatgtcaatgttattggaatttggggtatgggtggtatcggaaagaccaccattgcagaagcaatgtttaacaagctatattctgaatataatgcttcttgctttttggcaaacatgaaggaagaatatggaagacgtggaataatttctttgagggaaaaacttttttctacactgctagttgaaaatgagaaaatgaatgaggcaaatggattgtctgaatatattgtgagaaggattgctggtatgaaggttttaattgttcttgatgatgtgaaccactcggatctactagaagaattatttggagaccatcattggtttggaccaggcagtagaatcattataacaagtagagacaaacaagtgcttatagctaataaggttgatgatatatacgaagttggggcattgaactcgagtcaagcactagagctttttagtttgtatgcctttaaaaaaaatcattttgatatggagtatgatgagctatcaaagagggtggtcaattatgccaatggcattccattagttcttaaagttttgggtcgtctcctttgtggaaaagataaggaagtatgggaaagtcagctagacaaacttaaaagcatgccaaataaacatgtttacaatgcaatgaaattgagttatgatgatctagatcgcaaagaaaaaaatatttttttagatctttcatgtttcttcataggactgaatttgaaagtggaccacataaaagttttattgaaagatagtgaaagtgataattcagtggttgctgggttagaaaggctgaaggataaagctcttataaccatctctgaaaataatattgtatctatgcacaatgttatacaagaaatggcatgggagattgttcgtggtgaatctattgaacacgctgaaagtcgtagccgattgatagatcctgttgatatttgtgatgtattagcaaataacaaggggactgaggctataagaagcataagggctgatttgtcagtatttctgaagctgaagtttagccctcacatatttactaagatgagcaaactacaatttttgagttttacaaacaaacatgatgaagatgatattgagtttcttcctaacgggcttcaatctttcccagatgagctaagatatctccattggaggtattaccctctgaaatccttgccagagaatttttctgctgaaaaacttgttatactggacatgtcaaatagccaattggaaaaactttgggatggagtgcagaatttggtgaatttaagagaagtaaaagtctgtgattctaaaaacttgaaggagctgccagaccttacacaagctacaaatcttgaagaattggatatcagtgcttgtcctcagttgactagtgtgaatccgtctattttctctctcaacaagctccagagattgaatataggttactgttatattaccaaagttgtaagcaataaccatttaagctcccttagatatctcagccttggaagttgccctaatctagaggaattttcagtgacatcagagaatatgattgagctagatctatcgtatactcgtgtcaatgcattgacatcatcttttggacgtcaaagcaagctcaaactcctaagacttggctccactgacataaagaaattgccttcaagcttcaagaatcttactgcactgcaatatctgagtgtagaattgtccaggcagcttcacactctaacggagcttcccccatctcttgaaactcttgatgccacaggttgcgtatcattgaagactgtactgtttccatcaattgctcaacaattcaaggaaaataggagagatgttcgcttttggaattgcttgaatttggatgaacattctcgcaaggctattgggttaaatgcacgtattaatgcgatgaattctgcgtaccaacatttatctgcaccggatcaaaattacaacaattacagtcgtaagtacagattttatcaggtgaagtatgtgtatcccggccgaaaaattcccgaatggttcgagtatcagacaagagatgattatataatgatcgatctcccttctactccacgatcatctcaattgggcttcattttcagcttcgttatatcttaccctctgcacagaacagtaggttatttttcaagatttacatttcatatcattatcagtgatgatggggggtataaaagtgaaaagagtagtatcaacatctacatgtctgcccttcatctcaggccaaattcgaaacatgtgtgtgtcatttatgaccaacgatgttctcgctacctgaacagtagagctgaaaataagaggaggcttaagattgaggttgaagtaatgggagacacacatcctgaatggggtgcggagttggaagcattcggggtcagtgtaataaatacctcagcatatcacaatttcgttcaacagataaacacttcatcaggtcataatttcattcaacatataggaatgtctgatcctatgcattcattatgcttgaaatcatcttgcgcatatccctcttgtggtttagatgaagactttgattaa

SEQ ID NO: 17627 - DNA, 1287 bp, Glycine max
  Peptide Sequence Number=SeqID_134405
atgatgagagagaagaaagaattccctaagggagagttcttaggctttagttgctggagtggacttgggcctgtgtgctcacgcttagcacggatgcatgtattcgtgcttaacgcgcctcttcctcccttagcgttagtgcttgttttcgcactgagcgcgccttgggtgttgagcgcaatttgtactttggccatgcttcgaggccttttgattataaacttctataagactaagacattgttttctacagaatgtgcatctgtatcaagtattcctcggggtgagtggtactgtcaaatttgtcaacacacattcctcagagaaaggcctgtgttacacaatgccgatgctgtggcagctggaagggtagaaggtgttgatcctattgagcagattgccaagagatgcattcgcattgtaaaagacataggagctgagatgggtggatgtgttttgtgcaggagttctgacttcagcagatcaggatttggtcctcgcacaattataatttgtgatcagtgtgaaaaggaatatcatgtgggctgcttgagggatcataagatggcatatttaaaggagttgccagaaggggattggttttgttgcaatgattgcacaagaatacattctactttggagaatctcctgattagggtggctgagagacttcctgaatctcttttggatgttataaagaagaagcaagtgggaagatgtttagaaccccttaatgaaattgatgtacgatggaaacttcttaatggaaaaattgcatctcctgaaactaggccattgcttttggaggcagtgtccatgtttcatgaatgctttgatcctatagttgatccagctgccggacgtgaccttattcctgccatggtttatggaaggaatttgcagactcaggattttggaggaatgtattgtgcattattgattgtcaattcatctgtggtatccgcgggcatggttcgaattttcggtagagatattgccgaacttcctttagttgcaacaagatataagaaccgtggaaagggctacttccaaacacttttcgcgtgcattgagaggctgctggcttttttgaatgtgaaaaatcttgtgctaccagctgctgaagaagcagcatctatatggacagaaaaattcgggtttagcaagatgaaacccaaccagcttaccaactacagaatgaactgccatcaaatcatggcattcaaagggacaaatatgcttcataaaacggtgcctcaatgtcgggtcatcaatactcaattgtga

SEQ ID NO: 17628 - DNA, 1119 bp, Glycine max
  Peptide Sequence Number=SeqID_134406
atggaatccaccgccaccaccgtttcccccgattccgaaaacgacaccaccaacacgcgagtgaacggctacgtcgtttacactcgccgcaagcgcaccctcctcaccctccattccggtaatgacgccgccaagaggctcagaacagctgaaatcaaagtcgaagctcgcaacgacgatgacgacgtcgttttcaagcgccccaagctcgagtctgaattaacggaggaggaattgaaaacgacgtcgtcgtcgaagaagatcattgtcgtccacaagaaacccgccaccgtcaaggagctcttccaaaccggcttgctcgatggggtaccggtcgtttacgtcggttgcaaaaaggattcaactacggaattgcgaggtgaaatcaaagatggggggatcttgtgctcatgcagtctgtgcaatggacgcagggttattccaccttcccaattcgagattcatgcgtgcaacatatataagagggcagcacaatatatttgccttgaaaatgggaagagcatgcttgaactaatgagagcatgcagggcagctccactgcatacattggaggcgaccattcaaaatttcattaattctccacctgaggagaaatattttacttgcaaaaattgcagagggtgtttcccttcttccaatgtggaaagagtggggcttttatgtctatcttgcgtggaatcaaggaaatctgaaaaaagttctattcatgctgttggcaaaagaatcagagtagtaaatgaaaaatttgacaagttacaaattcaagaatcaggtgatggcagctcaagggtgaaaaacagttgttttaaagaaaaagttattggaggaagagatgagatgtctgagaaggatagaatggttggcaaagtagtcttcggaatcttggtggtggaaggaaagcgttcaagaaatggtaagaaacaagaggagtttaaaaattgggcaaggtattggaagtttaaaaatgaaacaaggaaagttgtgaatgagactgatccaaagcttttgaggagttttaccaagatcttgaaacatagaatgaaaaacacaagatatataagcttaccaaaaatagggaaaggaaatcaagagatttga

SEQ ID NO: 17629 - DNA, 4104 bp, Glycine max
  Peptide Sequence Number=SeqID_134407
atgaatgctgattctaatctgtttgtttctgttgtctcagtagaaaatggtaaaactattgcaaagtcgagcaaagtgtcagtgcgtaatggaggttgtcaatggtcagataacttttcagaatctatatcgatttcgagagataattcttccaaggagattgatgattgtgacctcaagcttattgttgccatggggtcatcaagatctggcatcctgggagaggccactgttagtttgaccagctatatgagttctggtgctgctattccactttcaatcccactgaataagtgcaaccatgggacagttttgcatgtaactgtgcagtgccttacaccaagaacgaaactcagggatcaagaatcaagtgagacaaaattccatttgaaggccatcaatgaaagtaattatgatctgtctgtcaagtccaatgaatcagattgttcaaatgtacagagtgttgaatcttcctctgttgaagatttcgactctatcttatcccccggagaaattgagacaatggcaacaagcttctctggatctgtatcaaactgcagccataactcaactgagggttccacaggaaggggaaatatctccccatctatcagtgatgggcagagcccgactgcaagacaagattcaaccagttcccagaaaagtgtatcccatcacaattaccctgtgaatgatacttctcagccaaataattcatcatttaattcccagaatatgcaacacattggtgcattatcttctaagaagaccaatgcttctaataaccgtctggaagctgcaggggacacaagtgaagagctacgggcagaagcaaagatgtgggagatgaacgcccgaaagctaatgggtgatttagacatgttgaggacagaattctcagatcaatccaaaaaactggctggtatagaaatggacctttcagcgacacaggtagagcgcgatggtttgaaaaaagaagttgaacagttaaaattgtcatttgaggatccagtagtgagacagaaagcattggaagattcagtgtctcaagttgaaggtattccagaaattgaaaatgctctaaaagaggaactgaagttcgaaaaagaatccaatgccaacttgtctttgcaactgaagaaaagccaagaagcaaatatagagcttgtttctgttctccaggagctggaagagaccatagaacagcagaaagttgagatagaaaacctttcatcattacccttaaaattcagtgatctagataaatctttccaacaaagtatagaaggaaacaaacacttaatgcaacaactagaacaattggaggaatcgaagaaaagtctgctggtcaaggtgcaagagctggaagggaccttagaggataaaatgcgaggcactgaacatgcgaagattcaaaacaacagaacactttcagatattgaaatggaatatgaaagcaaattatctgctaaagataaagaaatttcaagtttgaaagcaaagctatttgattctgtccccgaaagttgtaataatgtggagactgtgtccagaaatttaggtgatacagatcttttgagagaaatcgaagcactgaaagagaaagttcgggaacttgagatggactgcaatgagctgacagacgaaaaccttgagctcgttttcaagctaaaagaagcaaagaaaaattcgaaagatggtggtgcatctgaagaccttttgtcagacaagctcaaagatcaatcttctactagcttggggtctgaggtaagcaacaatttatttcgaatattccattcagaaggcatggtccaggcgaaaaaggacatcaagattagtaatgatgatcatttttctattcaagagcttgagacttcaaaattagctctagaagtccgaatcacagatttgaataaggaactgactaataaaacatctgtgataggaaatcttgaggctaatttatcacataaagaaaaggaaattggggttctgcagaagctgctaagtgagttggaagccaatgtttatcatcttgaacaggaaaaaagtcaactagagaaacacatggataccttgataaaagaaaataagcatgaactggagcttcacatattagacatagaacaggaaaaacaacaattgtcaattcgtgtttctgttttagaagctcagttgagagatttgacaaatgaacaagagtttcgtttatcagaactagagaactctagatcacaagctgcaagacttcaagagaagattatggagatgcagtctgagatagattcttcaacagaagacttgaaacaaaaattaatggtggcaaaaattcactggtcagaagcacaagaagaatgtgaatatctaagaggagcaaatcagaagttacaaattaccattgaggatcttgcagaagaatgcagttctttcgagaagctaaatggagatttgaagcagcaaaacttgaagctagagggatattgctcccatatggaagccaggttgagggaatcagatgaaagattttccaagtgctctgaaggagtggaactcttggaaaagaaatttgatttaaagctggaagatattgcatcaaaagaaaagcatctaacttcagatttagatggttttttttatgaaaatcggaaacatatggagcaggctcaagtcttgttgaatcagatgcaaatggagatgatggtagaaactcagaaccttgaattagaagttgagaaactcagtctgaaactttcagcagcgcatgatgagaaagagagaatagcttccaatgctatgcttgaagtatccacattacgtgctgataaagccaaactggaatctgcttttgaagaagctcaatctaaagtgagtttggctaagaaagaggttgatatgatacagtctcaatatgaacaaaagctggaagacctaacaacacagcttgccgaatacaaaattaaaatggaaatgctgatgactgaacatgaaaagttgttgaagctggtggaagactacaaatcaagagagctaaaattcaaaagtactataaatgcccttgaattaaagctaacagtcactgaatatgaaagacaacaagtcatggatgaatctggaattttaaaggttcagttgcagcagacccatcaatttgaaaatgagattatagctctaaagaatgagctcgatgcttctaattccgagaaagagagactggaagcctcattgtgcctaacatctgaactatgtgaagatctgaaggcagagaagatatcatctggactaaagatattagccttggagcaggctgcgtctgaattggaggactgcaagaaaactagagcgtccctggaagaaaaacttctgcagttggagaatgacttgaaggcaaaagaaacaagatgtgtccaggatactgaactcagtcacagcaaaagaataaacaggcagcatcaacagaccatacaactgcttgaacaagaaaaagctgagttccagacaaaagcccaagtccttgaagaagaattgaagctgatcaaggaacaaaagagaaatcaagtttcaaagttaaacaggaaaagtttacctgttcacgatgatctgaaggcctcaaaacagaaccctgtggtgaaaaataccattcaatatcgcagtaataggagaaagtcattaaagaatgacagagaagtcatgaaagatcagcaggaccctggttacagcatcaaacatcagagtgaggtagaaactgaacttggacttcttgatgaaaatgttcatgctgttgaagtagatccactaccaaagactcaattggttgagaatgaactagcaaaagaaaaagaagtcaagaacatttatgaagttcagttcgacaggtcgccatctcaagaccgaaacaaccaagcaaatggcccagtaaaaccaatggctgaggaactagtgactaaagaaaaatttgaacgtacaaaatctatgctagaggcagagttaagagatattcaggagcgctacttccacatgagccttaaatatgctgaggtggaagctgagcgtgaagaacttgtgatgaagctcaaggcaaccaggaaaaaaggatggctttcgtag

SEQ ID NO: 17630 - DNA, 1249 bp, Glycine max
  Peptide Sequence Number=SeqID_134408
atgaccgacatgtgcttaatggcagacatcatcattcccccgaaattcaatgtacctgattttgataggtacaaggggacgacttgccccaagaatcactttaaaatgtactgtcgaaagatgggtgcatattctagagacgagaaagatttggcagcgcaagtggcccttcccatggttgagagggagatgatcatgatgatagtagatacactgccaatattctactatgagaagttggtgggttatatgcccgctagctttgcggatttagtgttcgcgggagagagaattgaagtaggcttgaagagagggaagtttgattatgtctctcccgccgacaccaacaataggaggactgaaacagttggggcaatgagaaaggagggggacgcccacgccatcaccttgacacctgcttggccaaaacctcagcaagccccgcatgctcaaaggggccctcttcagacatcggctccagcccaacctcgcctagccggcaatgccaaccctgacatgggctccaacattggaagaaaccttccagcaaagaaggctccggagttcgccccgatcccaatatcattggaggaggccaacgagttcctctacattatccaacagagcgagttcaagattgtcgaacaactcaacaaaaacccggctagggcccatgtggcccaagacatctccgtagaaggctttaaggggattgtcaacaacatcacagccaacaactacctcaccttcgtcgaggaggagatttttgccgaaggaagagggcataatagggctctgcatgtattagtcaaatgcatggaatacatcatggccagggtgctcatcgacaatggctcgagcctaaacttgctgggaagtaagaggggagatcgacctcccgattcaaattgggccccacacctgccagatgttctagtgagctgctcctcatctatgccatatgtggaaaccaccgaagagtcatttgaaatgactttccagtcctttgaggtggtaagcaatgcttccatagaatccctcccaatccagccccgcatgtctgacacggtaataatggtggcctgggtaatgttaggtcatagctatgagcccataatgggtttgggaaaaaataaagatggcatggtcggccaagtggacatcaagggaaactgtgagagattcgagttaggctataaacccacgcggactgatgtgaggaaaaacatcttggaaaggaggaacaagg

SEQ ID NO: 17631 - DNA, 639 bp, Glycine max
  Peptide Sequence Number=SeqID_134409
atggaaacgttggccacatcttcttcggcaactcttccatcttcttcttctcccttttctatattcccttcaagaagaacttccctttctcctcccaagactctccaatttcgtttaccctcctccaagcgtgatgatgctcgcgattcagactctaaccaaaacaatcttcctattctcagtgatcgctgcctctccctttcccctctttccaaagatgctgcgatggggctggtgctgagtgctgcaacgggcagaggatggaccacgggttcagggatggaaggcccctctgttcctgcagttggtagggatagcgaatctgggacggggaacatctccactttcccatggtctctcttcacaaaatcccctaggagaaggatgctggtggcttttacttgtaccatctgtggccagcgaactacaagggctattaatccccatgcttacactgatggcactgtttttgtgcagactagtggtagatggcttgccacatatcgcaaaaactcgaaaagacaagttatcctgcacagccagcttcaagaatttttcagtgttaatacattgaactggttcatggacaaatggactggtttgtgtggttcaatggttctaatgccggttttaaattaa

SEQ ID NO: 17632 - DNA, 1611 bp, Glycine max
  Peptide Sequence Number=SeqID_134410
atgaacaagaggaaggcgcttccagatctttgcaatcgagaagtcggccacctatcccccagaaatttcgctctccgtcttggctcttccgaggatcttgtccttcgacttcaattactgaggaatctgcaaaagcaccgaggttgtgtcaacgctgtgagcttcaatgcagatggtgacattctggtctctggttccgatgattgtgggattattctctgggactgggaaactggccgcattagactctccttccattctggtcattctaacaatgttttccaggccaagatcatgcctcactctgatgatcgaaccattgtcacctgtgctgccgatggacaggtgagacatgctcaacttcttgaaaatggacgagtcgaaactaagtgtctggccaagcatcaaggaagggctcataagttggctattgagcctggtagccctcatattttttatacctgtggtgaagatggattagtgcagcgttttgatctgagaactggggctgcaacagaactttttacatgccagccaatcaaggataggtggagttacatgccagtcatccatcttaatgcaattgcaattgatccaaggaaccctaatctctttgcggttgctggctctgatgagtatgctcgactttatgatattcgcaagtataaatgggacggatcaactgattttggtcaaccaaccaacttcttttgccctccacacttgattggcgatcagcaagttggaataacaggcttggccttttctgaactaagagagctgcttgtgtcatacaatgatgagcttatttatctttttacccaagatatgggtttgggaccaaacccccctgatcctgtgtctcctaaatctatgaacagtgatgcaagtgaaattggatttagtcatggatctgtgtcatctcaatccaagatggatgctgatgagaaagtcaccccgcaagtttttaagggacacaggaattgtgagacggtgaagggtgttaacttttttggacctaaatgtgagtatgtggtgagtgggtcagattgtggtcggattttcatatggaaaaagaaaagtggtcagcttattcgtgtcatggaagcagataagtatgttgtgaactgcattgagtctcatcctcatacaatggttcttgccagcagtggtattgagcatgacatcaagatatggactccaaaggccctcgagaaagctactttgcccaaaaatattgagcagagggttcatgtgtttgatcatattcattggtttacaattggtggtggctatgatgacgatgatgatgacaatattatgtttgatgatgactatgaagttgatatgtctgacaatgatgatgatgaggaggaggaggatgatgatgacgatgatgacaatgatgacaattatagcgcttatcctgaagacctgatgcaactgatttcacttccaagacgaagggtcaggacagaaagcaatggagaaaactcatccacagatcgagaccttctacagttgatattgacattcaatgccaatagtgacagttctaacgaagatgatgacgatggtgatacaaccagccaagacgacttgttcagttag

SEQ ID NO: 17633 - DNA, 1299 bp, Glycine max
  Peptide Sequence Number=SeqID_134411
atgttatttactctctctaatgctgttcaaaccctttcgtcaccctgcacttattttccacataactcctcttctaaatttaagtgtgttagttctaaagttcccgtctttgcgcagaaaccccgcgagagcagttactacattgaaaggggtttggagttttgcgccggtgacgcgtttttccggcaagagagcgcaaccggcagagacctcggcgttttggcagcttctctgcacaagaaagagaatgggaggttgcgtgttctcgacgcgttgtgtgggtgcggaattcggtcgctacggtacttggcggaggccgaggcggattttgtggcggcgaatgatgggaacgaggactatggaagcaccattgtggagaatttgatgcgggtttcggcggaagaggaagggagatgggtggttactcatttggaagctaatagggttatgatggattattatttgcagaagagtttctttgattttattgatgttgattcttttgggagtgattcctctttcttgaggtctgccatttgtactttgaaattgggtggcttgctctatgttacttccactgatggcttctcatctggtggccaccgtcctcatcattctttagctgcatatggagcttatgtgcgccctatgccgtattcgaatgagattggtttgcgaatgctcataggtggggttgccagggaggctgcattgttggggtatcatatcactcccttgttttcatactatgcttttcatggacctgtttttcgagtcttgctcagattgaatcgtgggaagattcatgacagtaggcattatggttatattggctactgccaccagtgtggaaattcccatgaattttcttgggatcgacttggccagatcagttgctcctgcagtacgcctaaggtttcaaactcccttgtggtctcaggacctctttggacaggacctcttcatgatgctgcatatcttacgaacatgttaaatctggccaagcagtggaaatggatagttgatgacggtaaagacagcctcgaaaagcttataaaactgatggtggatgaaagtgaccccaagttgccatttgggtatatcaagttggatgagatggcaagccgtgcaaaaatcaattctccacctttgaaggccttgatgagcgccatgcaccagaagggttatgctgccagcaggtctcacatagaaacaaatgcaattaagacaaattgccccatgacagaatgcattaagattgccaaagaactattgcagttgcaggtttctgccgcttaa

SEQ ID NO: 17634 - DNA, 1032 bp, Glycine max
  Peptide Sequence Number=SeqID_134412
atgacgaagcagaaaattcgcaacgctcttttggtgcacttggtgattctcttcttcttttctacatcggttgtttcagcgagagttgtgtctctcttgcagaactacgggaacccgattttcagatcaaattttcattctatttacgacacttccaagtacggtgtgtttcaactgagtaacgggttggctgatgcactggtatcaacggggttggctgatttaggttatgtgtatgtcaacatagatgattgctggtcttctgtgacaagaaatctgaagggtcaactggttcctgatcataagacatttccatctggaatcaaagctctagcagattatgtacatggaaagggactcaagcttggcatatattctgatgctggatatccgcctatgcgtgatgctctcaatgcgactgggcagaagattttctattcactctgtgaatggggcgttgaggaccctgctttgtgggcagacaaggttggtaacagttggcgcacaactggagacatcaatgattcatgggcaagcatgacaaccattgctgatcttaatgataagtgggctgcatatgctgggcctggaggatggaatgacccagatatgttggaagttggcaatggaggcatgacttaccaggaatatcgtgctcacttcagcatctgggctttagcaaaggctcctctattgattggctgtgatgtaagaaatttgactgctgaaacacttgagattttgagcaataaagaagtcattgccatcaatcaagactctcttggagtccagggaaggaaagttcaagtttctggagcagatggttgcagacaggtttgggcaggtcctttgtcaggaaaccgattggctgttgctctttggaatcggtgctcaaaagtagctactataacagcttcatgggaagcacttgggcttgaatctggggttcatgtttctgtgagggatttgtggcagctagagaccttcagccttgaaatcattaagcggcagaaacctccaacagttctttag

SEQ ID NO: 17635 - DNA, 561 bp, Glycine max
  Peptide Sequence Number=SeqID_134413
atgggcatagatgcagcagttttaatgtgtctaagaaatattaggcataatcaatttgaagactccctaattggaacagtcgaaaccagcctaggacaaggtccaatatattttaattgttatccaaacaaaacagtgagtctgatggatagaaacattcttgactctctgttcttaaacatccactttcatggccttgacatgaaagaaggatcaatcccaacagccttaatttataggatccagtacaaggtcatgaatacttgtgcatctagagtcctgttaaaacctcaaaaaggagaaacaactttgtttatcactgatatgacaaaggctaacgtttctctcccgagaaaaataaaatgggatgaagtaactcttcccgaaagatgggttatggataaggccacaccgtctattccccgacccgctccaaccatagagcatattaagcaagataactccggaaagatagagataatcttcaacaggagaaattctttttcatcaaggatagaagcctctaggtctgaatatgagtcagccaaaaggtctttttcg

SEQ ID NO: 17636 - DNA, 450 bp, Glycine max
  Peptide Sequence Number=SeqID_134414
atggaggcgtttggtttgcttgcaggaaacggcaagaagatgaagaagaactattttcgtatttgtcgcgcatgttctgctgtccaatcgtgttcggtgacagtagaagcaacggactccgcgtcacaccagagtcgtacccgcatgcatgtccggtgtgagtctgacgcaggacatgccgctgaagtgtcgcatccatgcttcttagctttggatattgaacagatgaagagttctagtgctaacctaatcaagcaaatggatttcattgaagataccaagggaaggctttgtgtgccaaaggaggaggtgaagattgaggtgcccccagagttggtggaagacaatttgctccctctacgttataggcctttcaattatggggattacttccaatactttgtttcaactcttaaggaaaatgcattagatgtgtttgttggtgtttga

SEQ ID NO: 17637 - DNA, 285 bp, Glycine max
  Peptide Sequence Number=SeqID_134415
atggcggtgagtgaatgggttgcggctgcaattgacgtatatgtgatgttgttggttcctttgcttggtccagatggtggaaccggccccttcggaagcatgttcaggatcattggcccgtatttccctccggcgagtctcgttcccggcaacgccagcattccggcgaccctcgtgtggccacatcctgacacgtgtcggggtgctggctcctccggcaccaccaccctgtcgctgggaagcgcgaggttcaaagaaggctcagtggctgcaaggctgaaatag

SEQ ID NO: 17638 - DNA, 450 bp, Glycine max
  Peptide Sequence Number=SeqID_134416
atgggaaaagggggcttacggcggaggcttccggaagatccgttaagggttcttccggaacttccgcaagaagctgttccggaaaaattccggaagaagtgttcttccggaagaaaccaaaggtcttccggaacacctcttccggaaattgagtattttactaattataaaaaaatacgtgttccacatgatttgcatatcatagttagaacacgaggtttaggtcgtgctataggtagagttatagacagagatagacagaatgaccatgatgatgttcccgagaggcgtaggcctacttccgggaccacttcttccgaaattgaccttagtaacttccgaaagaagtacttctggaaatccaacattctcattccgaaactacttcctcatgtggttaaaatttctttcggaaatagctttttactgtttatcttctctaaaaactag

SEQ ID NO: 17639 - DNA, 267 bp, Glycine max
  Peptide Sequence Number=SeqID_134417
atgatccagagggaatggaggaaggaattggcatttccagtgacccggaatgccgttgacttcgactcaaagtgccctttcgcttcttcgaaggtgcagggatgcgttgtaatcgattacacaaatatggtaatcgattaccagagagcaacattgccagaaataactgcttgtaatcgattacactattatggtaatcgattaccagtggttattttagccaaaaaacaaaaaacaaaaggctttctaggagaaaagaaattttga

SEQ ID NO: 17640 - DNA, 384 bp, Glycine max
  Peptide Sequence Number=SeqID_134418
atggctacgaggggatctaagcccaggtttgtgctcattattgtgctacctcttcttctgtctttgatgtgccaagagattgtagcaacgggaagattaagaagcaaagagggttgtacatctactggaattgaatgcaatgtcaaggtcactggatcacatgatcctctagaaatggatgaatatggtcaagcttatgtttctccacctcatgatgattatgattatgacttctatagaaaacatggtgatattccaagccctggtgttgatttggctatgattgtgattatggttttggggaccaaaacttgcctattggtcaaataccgtgccgaagacgatgatgtgagagatgttttatatggattgtgggcattttag

SEQ ID NO: 17641 - DNA, 2730 bp, Glycine max
  Peptide Sequence Number=SeqID_134419
atggatcttgaatccagcaagtgttgggacacctcaaagggctcttggaagactattctgctcttggcctaccaaagccttggtgttgtatatggggacttgagcatttctccattgtatgtttacacaagcacatttgctgaagatattgagcattcagagaccaatgaagagatttttggtgccctttcttttgtcttctggactctgacactggtgccactcttcaagtacgtttttgtggttcttcgagctgatgataatggagagggaggtacttttgctctatattccttgatttgtaggcatgctaaagttagtctcctaccaaatcgacaacacgcggatgaagcgctttctacatataagatggaggaggctccagagaaagatacttctaaagtgaagatgatgcttgagaaatataagggcttgcacacagctctcctaattgtggttcttcttggcacttgtatggtaataggggatggtctacttaccccagctatttctgtatctggtcttgaggtatctatgtccaagaaacaccaccagtgctcagaagctatgtttgctgatcttggacatttctcatatatggctattcagattgcattcacctttctggtatatcctgcgcttatattggcctatatgggtcaagctgcttatttgtcgcatcatcatgattccgaactccaaatcagtttctatgtctcagttccagaaagtgtgaggtggccagtgcttatattagctattctagcttctgttgtgggaagccaagcaatcatcagcggaacattttctatcataaaccaaagccaatctctaggttgcttcccaagagttaaggttgttcatacatctgacaagatacatggtcaggtctacattcctgaaattaattggatactcatgatcctctgcattgctgtgaccattggatttagggacacaaaacacatgggaaatgcttcagtatcaacaagggttagcagtgatgaccgtgatgctggtgacaacatgccttacttctttacttcactgacaaagttttgtgagggtgcctggttacctattctgctggccctattcctcatgattataatgtttctttggcactatgcgaccatcagaaaatatgaatacgatcttcacaacaaggtgtcactagattggcttctagccttaggtccaagcttgggaattgctagagtcccaggaataggcctagtgttcactgacctcaccactggcatcccagcaaacttctcccgctttgttaccaacctccctgcatatcaccgcatccttgttttcgtgtgtgtaaaatcagtgcctgtccctcatgtccctgctgctgagaggtatctggtaggccgtgtaggacctgctgctcatcggtcctaccggtgtatagtcagatatggatatcgtgatgttcatcaagatgttgattcctttgagtctgaactagtagcaaggcttgctgatttcatccaatatgattggtaccgatctaggaggagtagcatgagcattgaggatgatggttcaaactccaatgaatcatcaagttacagattaactgtaattggaacaactggtttcaccatccaaccaggatacgagagtggcggggagagtgtgcagcaagcaagtgtatctgttggtttcccaactgtacaaagtgtgactgatgttattgagatggaaccggtcatgactgagaggagagtgaggtttgctattgaagatgagcctgagagtgatgcaaggtctgagacaggagtgcaaatgcaggaagagttggaagatctttatgctgctcaagaagctgggattgccttcattctagggcattctcatgtaagagcaaagcaaggctcatctgtactaaaaaagttggcacttaactatggctacaatttcttgagaaggaattgtagaggccctgatgttgcacttaaggttcccccagtttctcttttggaagacataggcttcaatgccatagcagtgtgcagtttccaaaaggattttgtgaatgagactgtgggaatgactctacccttaaaatttaacgcaagagagatcctctcgttttatgagttccctaagattccacatagccctctattaaccaccaggttttgtgagtggcaacaaattgacaaccaccatagtgctgagtaccaagagaaagctaaaatgggacttgggactctgccactgaccccttcttacagcagtttctcttcaaagtcaggagggcttttacatgacatcaccaatcacagcagggttaatagaagcatgaaattcagagtttcagccaaacaagagaagcaagaagagaagaaaaagcaatctttgttcagcagtgtgactgaagctcttgatttttctcaagtgagatctgctgaggatgctcagcttatagaagaggctagagaagccacaagatcgggagaaaggatgagtagggaacagtatggagctcttagaaggaaaattggtggtacatacaaggattttttcaaatcttacgttgaagtggacggggcatatgtagaagagggatgggttgacaaaacatgcaaggtgtgcaagaaggatactaagggcgaggcaaggcaagtggacaagcttggaagatatgttcatgtagcatgtctagagaaggccaatgcaggaaacttctttaccagactcttctctagataa

SEQ ID NO: 17642 - DNA, 282 bp, Glycine max
  Peptide Sequence Number=SeqID_134420
atgtgtgtgaaggccaggctccaatcagattcattaggatctatctctcaaaattcccacgtggcacatgcagcccaccatgataacgtgctgagtgaagtggtgattttcacgagcacaactttacgacttttgggacgattcgggatcccatcccattcccatcttgacgtgattgagacaagcaagcctttcacggtcaaaaagttgatttgggtgaatgccaaaaagggacaaatcacaaagcttatagctatatatccacagtggggtttgctataa

SEQ ID NO: 17643 - DNA, 1149 bp, Glycine max
  Peptide Sequence Number=SeqID_134421
atgtctccagcaatggtggtaggaagtggtgagaagggtgagagtgatacaccaggaaatcaatatcagaaaggagtgaaacagcttgttgagaatggccttcacacaatacctaaaaagtacatacttcctccttctgatcgaccagctacaaattcagaaaattcaaatgttgccaagcaaaaccttcagctacccatcattgatttttctgaattgattggtccaagaaggccccaagtccttcaatctctagccaatgcttgtgaacgctacggattttttcagctggtaaaccatggcatatcagatgatgttataagcagcatgagggatgtgagtggcaggttcttcgatcttccttttgaggaaagagccaaacacatgacaactgatatgcatgcaccggttagatatggaacaagcttcagccaaaccaaagatagtgtgttctgttggagggacttcttgaaactcctctgccatcccttgcctgatttcctccctcattggcctgcttcccccttagactttaggaaagtggtggctacctactcagaagaaacaaaatacttatttctgatgttgatggaagctatccaagagagcctaggaatcaaagtagaagtcaagaagcaagaagaggagacagaaggaaatgacaataatattctgaaggacttggaagatgggagccagatgatggtggtcaatttctacccaccatgccctgaaccagacctaaccttggggatgccccctcattctgattatggattcctcacactcctcctccaagaccaggtggagggtttgcaaatccaattccaaggtcaatggctcactgtcaaacctatcaataacgctttcgttgtcaatgttggtgatcacctagagatatacagcaacgggaaatacaagagcgtgttacatagggttattgttaatgcaatgaagaaaaggacatctgtggcttcgctgcatagccttcctttcaactgcaccgtaagaccgtcacccaaactcattgacgaagccaaccccaaacgttacgcagacacgaattttgatacttttcttgcatacgtttccaccagagagccaaagagaaaggaattcctggactctaggaaattgtcttctacatga

SEQ ID NO: 17644 - DNA, 718 bp, Glycine max
  Peptide Sequence Number=SeqID_134422
atgagatgtgctgagagattagtggagaagctacaacctgatgcacttaatggaactgctgttaacatggaggcaaagttttcgcagttgactcttgatgttattggtttatctgtttttaattataactttgactcgctcaacatggacagtcctgttattgaggctgtttacactgcattaaaagaggcagaggctcgatcaactgatcttttaccgtattggaaggcatgttttttccaatcttacattcatgacatggattttctttccttgtttgtgatgtcatgcgtacattttaaatttctttgtaagataattccgagacaaataaaggctgaagaggctgttagcattatcaggaaaactgttgaagatcttattgaaaagtgtagagagattgtagaatctgagggtgaaagaattgatgtcgaggaatatgtgaatgacagtgaccctagtatccttcggttcttgcttgccagcagagaagaggtttccagtgtgcaattaagggatgatcttttgtcactattagttgctggtcatgagaccaccggttcagtgctgacctggacactttatcttctaagcaaggattcttcctcattggcgaaagcacaagaagaggtagacagagttttacagggaaggcgacctacctatgaagatattaaaaatcttaagttcttgacacgctgcattattgagtcactcc

SEQ ID NO: 17645 - DNA, 222 bp, Glycine max
  Peptide Sequence Number=SeqID_134423
atggtggtggctaggcttggcgacaaggtggtgtacaatggcgcggaggtgcaaatgtggcacacgttggcaagatggcttgacaacaagagtttgagtttgaagaagggaatgggtttaattctttttggagatgcagaatacaaaatgggaggtgcaggatataaatgcccttatgtactatctgatcggttggcccaaatcagctatcagcccaagtaa

SEQ ID NO: 17646 - DNA, 570 bp, Glycine max
  Peptide Sequence Number=SeqID_134424
atgaagttaacttcagagttttcccattctcacaattcaaaaacactctcacaaacacaattgaagcaatatttgaaaaagcgagagcattaccgtccagagaggaccttcggcgatggcgaaaccggacccaaacaggaactcggagacctcggcaacaagacccttggcgtatttgccgtagttcctgagcacgtgcttggcgatggcggggtcgctaacgacgacgaagtttcgggggccggcggcgaggcggtagatggggccgtagtcctgcatccacttgaagagagggaggaagagcgcgccgccgaggagatcagagacgtcgtcgagcttggcggaggcgaggggaatgccggagtcgtcgttgccggcggcgagggagcgggagagggaggtgagccagtcggggctgaaccaagagctgggcttggaggtgccggtgccggtgtcggggggtttgttgatggaggatttgacggagaagcgataaggttttggagtgggagaggaaacggtgggtctgcggggaaggaagagagagagaggtgtgagatgggagagtga

SEQ ID NO: 17647 - DNA, 1530 bp, Glycine max
  Peptide Sequence Number=SeqID_134425
atgaaatgttccaattcttccagctacacatcaccaccagattttgagcttgagtctgatgatccaacactcaccaatgaagacctcaagccaacaacaccaagtcaaaggacattttcaggcttcgaaatagcaagtttatgggttggattagttgttggcgtcccttcttattaccttgctggaagcctcgttgaccttggcatggcatggtggcagggcatagcaactgtggtggcagcaaacatgatcctcttggttcctttggttctcactggccatgcaggaacacgttatggcatatcattcccagtacttgttagatcctcttttgggatcaatggtgctcatgttcctacccttataagggcacttattggttgtggttggtatggtattgagtcttggattggtggagaggcaattttccttctcttgccgaaggcaatgaaggaagctacttcattgtctcagtctctaccttggcttggcacttcccctcttgaatttgcttgctttttggtcttttgggttgctcaattggcctttgtttggaagggaattgatggcattcgaaagcttgagaagtactcagctccaatattggttgctctcacttcttgtcttcttatttggtcttgtgtcaaagctggtggaattggtcacatgctctctttgtcttctaggctttctacttcagaattctggtctgttttttttccttctcttactgccaatataagcttttgggccactgtggctattaacattcctgatttcactagatatgctaagagccagaaggatcaagttattggtcaaattggacttcccatctttatgggggcattcacatttgttggtctagctgttacttcatccacaaaagtgatatttggtcaagttatttctgacccaattctgcttcttggtcaaattggtggcctcacaactaagatcgttgcaatccttggtataagccttgcaattatcaccaccaatattgctgccaatgttgtggcaccagcaaatgctcttgtgaatctaagtcctaaatggttcacctttagaagaggagcacttctaactgcactacttgggattgcatttcagccttggaggcttttgaagtcaagtgagagctttgtttatacttggctagttggatattctgctttgatgggtcctattgcagggattgttctagctgattactatattgtacagaaaacaaatttgaatgttagtgacttgtactctaggagtccttatggggcatataggtattcaagagggtttaatgtggctgctattctggcactagttgttggagttttacctgtggttcctggtttcttgcagaaagttggaattgcaacttcagttcctaacacttttgttgtgatctacaacaatgcatggtttgtaagcttcttttctgcaggattcttgtatttggttctatcaaatttgagagggaaacctggtaactctgctgctagagacccccttttgcctactgcaaagtaa

SEQ ID NO: 17648 - DNA, 261 bp, Glycine max
  Peptide Sequence Number=SeqID_134426
atgtcgcgaaacttcacggattgcttaatgatgggtgtcaagttcctcgaagcggtcaagcgaaggttgcattccatcaaacaatggtccccagacgaaattagggcaatcaattcgtggggctccggactcgatggtggaggatgcatgaacgacaatcaattcatggggctccgaataagatttgatggtggagggtgcacgaacagtgctaggcaatcaattcatggggctccggactcgatggtggaggatgcatga

SEQ ID NO: 17649 - DNA, 228 bp, Glycine max
  Peptide Sequence Number=SeqID_134427
atggtgtcttgtgcttacgctactttggatcttgtttgcgtctctacgttggaagtggcacaaggttgggtcggctacgcatcagcatcaccttctttctcctcaatagctgtatctctcaaattcatccacgatcggggaaaccattgtccacgtggcgttctaaccacggtccatcgtagattggtggggcccactttcccatgccatggcatcaccacctactag

SEQ ID NO: 17650 - DNA, 588 bp, Glycine max
  Peptide Sequence Number=SeqID_134428
atggaagttttggctaggggatcacaagaacatcaacatggttcttcttcttccagcagcaacacttcacacgtcccccctgcccaagctgctggacttgttgctattttgaaggataaaagtgttgatgagttgcggaagcttttatctaacaaagatgtgtatcagcagtttttaagttcacatgatgaggtcaagattcagaataatgtgattgatcctacaaaggcttatgaaagcaaggtgaatgatgatctttgcaaggagaatctgcagcttgccgatgaaaatctacgaaaggaacctcgtgttgtggaactcaggaaccagttggctgtggctcaagagaaactgaatgagcttgagaagcagaaagaggaaatgttgaagttgaattccccactataccttctccaatggattcaagaggctatgaataatacagaagaggaatctgaaaatctgcatcagcaagtccttgacagagagattgaccttggagcttttctgcagaaatacaaaaagctacgtactgcttaccacaggaaaagtctcatacatcttgcagctagaacatcaaatatatag

SEQ ID NO: 17651 - DNA, 537 bp, Glycine max
  Peptide Sequence Number=SeqID_134429
ggtgctgctgctgagtgctccccgagggttaatcagtgcagctacacctttcagtatggagatgggagtgggacatcgggttattatgtttcggatgcaatgtattttaacttgatcatgggacagcctccggcagttaactctacggctaccattgtttttgggtgtagcattagtcagtctggagatttgactaagacagataaggcagttgatggaatttttgggtttggccctggacctctatctgttgtatcacaattgtcatctcaaggaataacacccaaagttttctctcattgcttaaagggagacggcaatggaggaggcattctagttcttggtgagattttggagccaagaatgtacaaggcatttctgaaagaaattgatttagtgatcctggaagatcttaacgtttctcaagatgatattgtcttgaagggatctatcacaccctctcatcaaaacccctttggcttctattgcattttggcatacacaaacccaaaattatgtcacatgccacactcttga

SEQ ID NO: 17652 - DNA, 465 bp, Glycine max
  Peptide Sequence Number=SeqID_134430
caaaaccacttcttccaccagcagcagcagccactgttccaacctcagcaccaaagcctaagccaagaccttggctttctaagacccattagaggaatcccagtgtaccaaaaccctcctcctataccattcacccagcaccatcatctccctcttgaagcttccaccaccaccccttcgattatttccaacaccaacactggctccacccctttccactctcaggcccttatgagatcaagattcttgtcacgcttccctgctaagcgtagcatgagggctccgaggatgcgttggacttctaccctccatgctcgctttgttcatgctgttgaactcttgggtggccacgaaagggctacacccaaatccgttcttgaactaatggatgtcaaggatctcactttagctcatgttaagtctcatttacagtttattccttatgaatttcttgagtcagcttga

SEQ ID NO: 17653 - DNA, 429 bp, Glycine max
  Peptide Sequence Number=SeqID_134431
atggtggctgaaatcattgatctttcagactcccctccatcatcaccctggtcatctcataatgatgcagcaagaattctcaattttgattctgtttctaatgaaaaaaatcaatttgagaaagttattcctatatccttaatggcttgcacaaatcccaaccagccacaaactagtctatggcgagctgcttcaagacataccaatgagcactctcagattgctactacattccaacccagcatgcaattacaaagggttgctacagtacttgaaccagtacctgaatcaatcacatgcatgtttcctcatggagctagactcaaggagccctggactcacagagaacatgagtttgtgtccttcaaacttcatatacttagcattctctcattttgcttttcaatttccattactcttctacaatga

SEQ ID NO: 17654 - DNA, 909 bp, Glycine max
  Peptide Sequence Number=SeqID_134432
atgccaggatggattctcgacatgtcagatggctgccaggcaaacaaatccgtgtttctatgtagcatgtcagtgatgcacctgtgcttatggctgcttgatgagcttttcaatgggttttgggcctctgtcaaaggtgtcattgtacggatctatgtcaaattcattgtccaggcttgcttggtagatggtcagggctcgaattggagacccttcatccatgctcatgacttgagtaccttcagccactataaggtgagtcttggcaggctctctggcaagaggatagggtgctaccttcaggctctctacatagcactatcttgcttgcttttggttttccttaacggttacaatttccccgatcagggtagggaatttcattttcaaatgcggtgtgaagactatggcctcaagctcattaagtgtcttcatgctgatcaaacctttggtctctactctctcgcctacaaggtcgaggagtggattgacataagggtggatagtttcgtgggagaccttaagcctttggaaaggttgatacccttgaagtccctatctatgaaagggataggagagagacttcgttgtactggaaaatccgctcgcaatggtgttgattacacctttgatttgctcgacagtgcgcacaaatatgtccaagaattttctaagggactcgtcgtctacttttcacagactggccaaggcgacttaggttatgcagtgagatttgctggttgcgtactacacactgaagtgttcgacgagggtgtcaaagttgtctatggatctaggttcgcctgcgtcaggaaggcatccaggtgctcatctggatttgtggtcccatcatattgttcgaggttgagtagatttcacctcaagggtatgtcagcctctataatgtga

SEQ ID NO: 17655 - DNA, 297 bp, Glycine max
  Peptide Sequence Number=SeqID_134433
atggtcttgcttctatccacttggcctttggcagtggtcccagtttatccattccccatatgtcgaagggccaaggaagctcagactgtggagattgtcaggagtagtgtgtggcacatctgtaaactcttggcattgtctgcacctcctggtaaagttgaaggtgtttgccttgagtgttggccagtagtagtcgactcacaccactttggtggaaaaggagtgtcctccgatgtggagaccgtggatcccttcatgaagttctctcatgacatattctgccagttgactgtttag

SEQ ID NO: 17656 - DNA, 309 bp, Glycine max
  Peptide Sequence Number=SeqID_134434
atggttagcactcggtctggcctcaagcgcgagaccctttttgaaggctcccatcttcatccgacagctatgacagacacaaatactcttcaacaactccaaaatcgcattgtggagatggagcgacgacatgaggaggagctgagaaagctaaaggctgaccatgaggcttatatcaaatgccccgagggcaaagagcactctgcttacactttgcctaagcgcacccaaggggaatcacagccccgacgtacaatcaacacttcatatgacttaagtctctcccacatgcatcaaccagcagggtag

SEQ ID NO: 17657 - DNA, 912 bp, Glycine max
  Peptide Sequence Number=SeqID_134435
atggtcttcaagtctcaaagcatagcccaacacgtggcatatttggaagaagtatttggggaactctgcaaatatgacatgttcttcaaccctaaaaagtgtactttcgaggtaggcggaggtaagttcctcagcttcatgatcactgatcagggaattaaagctaaccttgacaaatgcactgccatactggagatgcacagcccgaccaacatcctagaagtcaaaaaactaaatggtagtctagcatccctgtctaggttcctcctaaagctcgctgaaaaggcgaagccatttttcaaattgctcaagaaaactgagtccttcttatgggatgagagctacgaacaagccttcctggctttcaagataaccatagccacaactgcatccaacataaaggggagcggggtaggattcatcctcgaaggccctgacaatgtcacgctagagcaagcccttaagctctacttcagagcctcaaaaaaccaggcagagtacgagaagctcgttgcaaactcacagcttgtccatggacaggttgccaacaaataccaaaccaaggagatagtgatgctcaagtactatcacattgccaaaactttcattgacaatttcgagtgttttgaaatgtactacatatccagggagagcaacaccaaagtaaacctagtctccaagctggccaacactaagaaagtcgagcaccttaagactatcattcaagagacactccaaactcccaccatagacgctgaggaagttatggccagagaagagaaggaaccaagctggaggactccctacaagaacttcctaattcagggggtactaccactaaacaaggacgaagcccgatgcctcaaacgaaaggccaattactatatcatccttgatggtgagctattctaa

SEQ ID NO: 17658 - DNA, 195 bp, Glycine max
  Peptide Sequence Number=SeqID_134436
atggatccaattactgctgatttgaggaatatgaatagtttagctaagaaaatgagattaaggcgtattgagagaggagctttgactcttgcatctgctgaagtcaaatttcagattgacacagagactcatgacccccttgatattggtataatcttcttacttaataacatttccgtactactatttctttag

SEQ ID NO: 17659 - DNA, 399 bp, Glycine max
  Peptide Sequence Number=SeqID_134437
atgggatttggctcctcaaaagtgagggaggaaaagttgtgctttcacattgtaagcagtttctattcccatgaggagagggtggatattgctgatgtgacaaattttgttcatcctggcactccccttgatgatgaggctgcacaaaggggtacatctgtctaccttgttgagcggcggatagacatgcttcccaaacctcttacagaggacatatgttctcttcgttctgatgtggaaaggcttgcattctctgtcatatgggaaatgacacctgaagccgacattatttctaccagatacacaaaaagtgtcataaaatcttctgcagcattgtcttatgttgaagcacaagcaaggatggatgatagtgtatatgcctgctataattgcttatga

SEQ ID NO: 17660 - DNA, 606 bp, Glycine max
  Peptide Sequence Number=SeqID_134438
atgcagctattcgagtggctactcagtgagaacaaaagaaaggctagtgaagagggcattttggctgaaacagttgagtcatatgtgaagtctttagtccgacctgatttacttgacctgcttgtgcggcctgcatctgaagatgtggacatggaagaggttgaagatcttagaccatccaagaggaaagtcatctattctgagcataagccgatgtcagaaattacttctggtttgcatcgtggaatatatcatcaagggaaacttcgtgtaaaccgttataatccatttgaagcatatgttgggagtgagagcattggtgatgaaatagttatttatgggcgctcaatcatgaatcgagcatttgatggggatattgtggcagctgaacttctgcctcaggaccagtggcaaggagtctcgtctctatctatagcccatgaagaagacgaggatgagaatgaagatgttcatctagctccaaatagtgctgatgatgcacctagagctgtttctcagcagggttcttctgaacaactaaatgctgtacccagtcgtccttgtggtcgtattgttggcattataaagagaaactggcattcgtaa

SEQ ID NO: 17661 - DNA, 492 bp, Glycine max
  Peptide Sequence Number=SeqID_134439
atgacacatcacatgtgctcgtgggtaaggggccaatggattccttttgatgcagacaccctcaaccagttcttggatcacatgtgctcgagggttagcaatgatttcgcccagacttctataaggagccaggtgcggatcatgcgcaccagaatgaccaccctgacccagatgtggatgatgctgctgctcaacaacatcttccctagtgaccacaactctgaccttcccctgctgaagtgtcagctggtgtatgccatccttacgggaatgagcgttcacatggctcagttgatcgcaaacgccatttatatttttgcaggtatgactcccacgagataccccttggacctggagaagtccaacagggccctagggtttccagctctgatcacagtcctctgccagttctacgaagtgcccgttatacccagtaaggtcatccgacctcctatcactagggccttcattgagaagtattgtactccctga

SEQ ID NO: 17662 - DNA, 609 bp, Glycine max
  Peptide Sequence Number=SeqID_134440
atgcatcagcagttgaagggaagaataaatgataattttctaattaattaccgccgctacacgcccgcacctgtttcctgctccgacacttgggcgattgtgatcaccgccggcaaacaccgcggtctcactcccaacactgagaaagcttcgaaacaagcacactctccaggtagggttactcagcgcagagcaatctcctccgcctccaacatgctccacaacaagtccttcgtcaagaaaacaaaaggtggcaaagtcatgaagcaagtgcgggagcactatctgcgcgatgatatatactgcggcgcaccgttttgcacagtttgcgattcttccggtgctcgcctcagtgcttctccttccaccattctcgtcgtcgacaccaatgtcgttctcaaccagattgatttgctggagaatccggcgatcgacgatgttgtggtgttgtccattgtgttggaagaggttaagaacaagaacatgtctgtttacaaccgtataagagctatctgtagcaattccatgaggaagttctttgttttttccaatgaataccacagaattaacaaggagagtatgggaaaactaaggatgcagcaggattga

SEQ ID NO: 17663 - DNA, 252 bp, Glycine max
  Peptide Sequence Number=SeqID_134441
atggagaacatggttgatgatgtcactcaggcactaagcgtgcatccatgttcaatctcgctaagcatgtgcctatggcttagcgggaagttatgttctgggaagctgagaattctgatggctttgaggaaatgtagagtcgtgcccactcaactcaagatggggagcccgcatgggactcctctcggttcacatccaaccttgcttggcacagataccaggacaatgttcaccttcggaacatccttctag

SEQ ID NO: 17664 - DNA, 838 bp, Glycine max
  Peptide Sequence Number=SeqID_134442
gcgcactcgtgagcctcgcgtctccctctcaccaaagggtaggttacgacagatgggttttgttgattcaagagttcgacatggtcatcaaagacagaagggatccgagaatgtagtagctgatcatctctcccgggaggaagctcaaagcatattatggcactattacagctcaccttatggaggccattacagtggagataggacaacttccggaatacttctagctagatttttctggccctccatctacaagtatgcccatgaccacgtggcttcaccttatcatccccaaaccaatggtcaggcggagctgtcaaataaagaattgaagagaatcctggagaagactatcacatcctcaaggaaagattgggcagcaaagatggacgatgctttatgggcttacaggactacattcaagactctcataggcttttcaccatttttgatggtttatgggaagacgtgtcacttgtcggtggagttggagtatagggtctactgggtcctcaaattcctcaatttcgatggctcactatctagggagaagcaaagattgcagctactggagctggaggaaatgaggcccaatgcctatgaatcctcctggcattataagcagaagataaagatgtttttccctggaaagctcaaatctaagtggtctgggccattcatggtcaaagaagtgaaaccctccggagtagtggagctgataaatcctaccacatctaatcttgagaagacttggatcatcaatggtcagaggttgaagatatataatggtagtgatattgagagactaaccaccgtcatccatctccaggacccatga

SEQ ID NO: 17665 - DNA, 600 bp, Glycine max
  Peptide Sequence Number=SeqID_134443
atgggcccgaaatataccctaaggctcatgagaaccctagggtcttctcttgcatctctggcccaatcttcttcgagtcttctatccaatgcccttggggggaggattgcatcaccatggatgcacgcaacaacaccctccgtggtgtacttaccaccatcttggataaggttgtcctcatttcgatgtccaccatcactactacaccaagcactgagaccccttcctggtcagaccgccctttcccctttccatgttggtattgatggttttgtccacaacataagtcctactttggggttctctacccctcttcactcctgtcacaacctgcccttcggcggggtcacgaaaaaggcctctcgtgcgggccaagggtgtgtcttccatcgaaggaaaacgcgtggagtcgccaccaacgtttatttgaggaaaacattagaaaaatcaaaagacgatggtctgtgtattttgaaaatgaggattcgggagttgtttttatgcacggggaagggtgtttccttcgctcctacatattccccgattgcgatgaggaaatcagacctacgtagttctttcatagaactgatcattggttaa

SEQ ID NO: 17666 - DNA, 276 bp, Glycine max
  Peptide Sequence Number=SeqID_134444
atggatcccatcacaatactcgtcgcccttaaatggctacaatgcgaagggtattcctctgagctcagacatgattttgaaattcccaacggtgagaatgctcggaatttggttgcaaacttggtgcttaaatgtcacaatgatccaacggtcaatatctctgagatcgtcatttttatgagacatgtttggtggtctgcgggaaaagaaaggttgagaagggaaaacgaaattgagaggcgtaggaggcggctgaggagtcagtctgaaaactga

SEQ ID NO: 17667 - DNA, 198 bp, Glycine max
  Peptide Sequence Number=SeqID_134445
atgggttcaagagctttgccaactttggtcagttacacgcgagatgcctttgaggtgcataccggttggattggatgtaccaagtatcaaagtgagggtatgataactggcatgggaataggtcgaccacaaagacattccttgaccatcttgaataatatcagtggtgttgtcaaacctggaaggagatctttataa

SEQ ID NO: 17668 - DNA, 117 bp, Glycine max
  Peptide Sequence Number=SeqID_134446
atggcatttcgccagtgggattggcaaaacaggcatggcatttcgccattggggttggcgaaacaagcacccatcacgtcatggcagcagtgggtttcgccggtggaaagaaaataa

SEQ ID NO: 17669 - DNA, 234 bp, Glycine max
  Peptide Sequence Number=SeqID_134447
atgaagctgtgttatgatcttgtcctaaaggataagatagttgtgtatgacatagctcaacaacgaattggatgggctaactatgactgttctttgtctgtaaatgtttcggtgactatgagcaaggacgagtacatcaatgcagggcagcttcatgttagcagctccaaaatacacattctttctaagttactaccttgttgggaatcaaaatcatcactcaagataatgtaa

SEQ ID NO: 17670 - DNA, 1855 bp, Glycine max
  Peptide Sequence Number=SeqID_134448
tggttcttccggaaacattccggaagaaggggttcttccggaaaggtcttccggaactttgaaagttcttccggaagtgcgcgtcttccggattcttccggatgaaccacttcttccggaaagttcccggaagaggttttccggaagtcttccggaagaagtgttcttccggaagacgtttggttacttccggaagaacacttcttccggaaactttccggaaaatgttcttccggaactttcggaagaacccctaacgggttccattgttatgctaaggttccattgctatgctaacagtgatgcacattacaagctaacggtaaggggaaggggaactaacctgttcgcggagaagaagaagaaagccttggcgcgcctcgcggagaagaagcttcacggagaagagaagaagaagcaggttccgggagaagaagaagctgttccgggagagaagaagaagctgtgttccggaagagaagaagaatctgtgttccgggagagaagaagaatctcactgaaggcagagaatctgaagccagtaatcctcctcaaagctggtgttcccttggctgtatctttggctggtttgatctatgcatggattgttgcaaagaaaaacttatctaccaaagttttttcttcaccagaaaaagagtgtgtttctccaaaaatcacttgtcatcaaggaacaaaacatgaagaaagctttcttcacaatctttcttctattaaatatgaagaatcatcattttctcccatgaatagcagtgttctttctgggagcttggtgatccatgatcacaacaactgttgtttggaacaagagatcactagcctaagaagccaaattgaaggacttcaaatgagggaattggccttgcgtttgcagtttgagctgtattgtgaaatgaaggaacaagaatctttgcttctagatgtcaaaaacatgttgtctttggagaatgatcgcgctgagttcttgagtaaagagatttcgtcgatagagaccgagactaagaggttggagagttttgtagtccaatacatgagtgttgttgaagagcatcaatattggaaatcacagaatagggtgcttcaaaagagggttcaaaggctacttagggactcaaaggccaaatctcgtttgataaagtgtcaggctttgaagatcaaagagaaagaagaagagatattgagaaaccatgatgccttgcaaacaagggtatgtgttattaacaagttagagggtgaaatcatggagctacaaaggattttggaacaattggaggatgagaaggacgaggttgtgaagaagcttgaaaccgcagaagcgtatgcatctaagttagacaaggaaaagatgcatagaaaacctttgaaatactatttggaggttgaatcaagagatgtgagtaaggaggactacaccaaggttctcagtgaattggaggaaatcaagaaggatcgcgcaactgaaattgaagagctgattcatctgaggagggtcaatgcttgcttaagggaagagttgatgaggcactatgaagaacaacatgagcaagatagagatcatgaagaagtggaatttgaaggaggcttaggagttgtgaaatatgagtcagagcatgaattgcatcattcccttttggagcatcaaaatggttcttctgctcatggtgatcatgctgcttccaaaaggagaaagttgcttaagaggctcaagaggtgggttgaaggaagtgaaaaggtaagagtgaagcctgaaataaagtgccttgatatgcattctggttcctatggatcaaagaaaccacaagttcctccaagtgtaaggttctgctctagtgcttga

SEQ ID NO: 17671 - DNA, 562 bp, Glycine max
  Peptide Sequence Number=SeqID_134449
atgaagaaccccaggaagaagaagagaccgaagccgcagaagaagcttgagaagaacaaaggcgttgttgctgctgctgctgttgttgccgagaacgaaaacgaaaacgaagaagaaaagagaaaacgcagcattttggaggcactggttgaggccttctccttgtcttcagtcagggaagcttccatggcctataacattgccggcggtgatcccgacagggcttcggagatcctaaggaagggtttttcggacagatccgaggattcgttctcgtgtttttcttacggctcttcttcttcttcttcctcttcgtcggggttggaattgggttcgaaaggtggttggaggcagcagcagcagcagaagaagatggttgcttcaaccggcactgtttcaacggttttggggaaggaatatgtgaggaggaacaataataatataaggaacaaagggttaagttctaatggagtttttgaaatggaggaggcagagcagttcctctgctctatgcttggcgatgattctgatattaacttggctgttgttagagacgttcttt

SEQ ID NO: 17672 - DNA, 756 bp, Glycine max
  Peptide Sequence Number=SeqID_134450
atgaacggtggcgctcgtgccacctaccgcatgggtggcctaggcacttcccatgtagtcaaaggcatcgaaattgactggaaaataacacgtgtcaacattcttcaactcaactatttcaacttagtggctactgaagaggttttggttgatgaaatcacttaccctaccaagatcactactaccaagcccctatctttgcttggccatggaatcaccgacatggagattcacttcatccatgtgaaattctattcaatcggggtttatttggagccagaagtagtaggccacttggaccagttcaaaggaaaatctgcaaaggagctggaagataatgaagagttcttcaatgctctcatttctgccccggtggagaagtttattagacttgtggtgatcaaagagatcaagggtgcacagtatggggttcagattgagactgcggtgagggataggttggcagctgaggacaaatatgaggaggaagaagaagaagctttggaaaaagttattgaatttttccagtccaagtacttcaagaaactttcagtgatcacataccatttcccagcaaattctgccactgctgagattgtggtatctttggaggggaaagaagactccaagtatgtgatagagaatgccaatgtggtagaggccatcaagaaatggtaccttggtggctcaagtgcggtttcttcctcaaccattcaatctctggctagcactttctcgcaggagttgtccaagtga

SEQ ID NO: 17673 - DNA, 1050 bp, Glycine max
  Peptide Sequence Number=SeqID_134451
gcctcagatatattgcttgatttagctgcttccacaaatgagaaaccgaatactgctagacatcctaactacggagtggacaacatagatgatgagaggttctttgctgaccccaatgacagtttgatagacaggagattagagtgcacatctctttcatgggaaggttatctttctaataatccatggtctgttggatcttttggaaggaaatatgcggaggttctcaataattctaaagctaattctgctgttagcccaggatgtacaaagtctgagattcctcagaaggtgttggaatctttgtttaacattcccaaaagcactgaacatgacaaaaataccatgaattggagaaatgtagtaaagaaaattcagtctttgggacctgggttctatgtttctccgcatgttgcagaatctcagcaacgtggcttggggcttgccaccctaggcaacctgagtcagagcgaagaggattcatcatgcatttttggcaagattacctctgctatattggtagagtttactagaaaggccaagggagatgaatatcatgtgtttagggaagattcaaggaagcaatgggattcagtgaaatcttattatacgaaagctgcaacagcatatactaaacgggaacgagcttatgctgcgtatctttccgaccagggtaaagaacaaactaaattagctcagaaagcagacactaaggccagccatgacatatttgtagctagaaacaaaggtatagaaaatgtgataactattgacttacatgggcagcacgtaaaacaagcaatgagaatgctgaaacttcaccttctgtttggatcatatgttccctctgtccagactctaagggtcattacaggatgtggatcacatggtgttggaaagtctaagctgaaacaatcagttataaaccttttagatagagaagcaattgaatggagggaagagaaccggggaactgtgttgattaaactcagcagatggagagagtatagctttctggacaccagcagtgacagtgacagtaatgattaa

SEQ ID NO: 17674 - DNA, 135 bp, Glycine max
  Peptide Sequence Number=SeqID_134452
atggctacaatcaaaggtgctctttcaaatttccaaagaatagaaatcaacgagattcatgatttctcatcaaaacgtgaacaacacccgcaggatcagggatcaacgacgatgaaatggaagagaaaggattag

SEQ ID NO: 17675 - DNA, 375 bp, Glycine max
  Peptide Sequence Number=SeqID_134453
atggatgatatggttctatccaataatgagttcatgaaaagcattgttgacaatgtcaaaagggatgtatgtcactcaacaaagacaacatccaagcatgtggttaccaactcaacaaagacaacatccaaccatttggtgaaaaacttaaaggccacaccatcaccgttggaacaggatttcagtcaacaaaattctggtattaggacatgcatcgagaccatattcatttactctgaaaatgaagataacacttcaaagagagtgttaggtttaaaaggcaagtatgtccacctaaagacttgcacaaatgttggtggcagtagcagtaaaagaaaaaaagtggttgaagatgtagtgtatgctgctgaataa

SEQ ID NO: 17676 - DNA, 243 bp, Glycine max
  Peptide Sequence Number=SeqID_134454
atgggtctaggagtggcacgaggcagggttgcatgggaacgtggcctaatgggttcctccacgaggcttacatgcgacgcgcgtgaaatggaaaaaatggacggtggagatagaattgggggcaaaagagtaataaagcgcgagtggggaggattcggtgaagagaatcccacacgaaaagtgcatggattgcgaaggcgggcacacagggagcgttcgctttgcgaaaagcttggccaatag

SEQ ID NO: 17677 - DNA, 267 bp, Glycine max
  Peptide Sequence Number=SeqID_134455
atgggtgatcaagaggagacacaggaacagatgaaagccgacatgtcggctctgaaagaacaaatggcttccatgacggaggccatgttaggaatgaggcaactcatggagaaaaacgtggacactgctgccgctgacgaggaaggagcacactggggcacaacagcatccctcatttgggatacaaccaggggagcctcctcgacagctgatatgaacccacatggcacaagggctaacttaggatcgtctaggattaaaccttga

SEQ ID NO: 17678 - DNA, 327 bp, Glycine max
  Peptide Sequence Number=SeqID_134456
atgatttgcatgttcagacaaactgtggatgtgaaactaatagctgaagaggcacaagcttgcgcctaccttctcaatgatagcttggatctgagagacaatgagatagctgatgccattgaagggtttccagttcacgatatatgtttgcattacgacaaagactatctcaattcgtttgacaacctcaaccttatttgcataccaattcttgaaaacaaagagcactggtatttaatgttcataactactgaggagcggaaagtctatcatttggactcttatttgacaaacaatgtaaacgaggaaagggaaaggctaatctag

SEQ ID NO: 17679 - DNA, 171 bp, Glycine max
  Peptide Sequence Number=SeqID_134457
atggagatgcagcggaagataaaggagaaaagcctaggtagcttccttgagaagctttgttcgtggccggcaagtgcaccagatcgcacaagtagtataaaacggcatttaatctatctaggcataaagaaagaaaatcacgcaagagaaatactgtgtaaaaacatgtag

SEQ ID NO: 17680 - DNA, 831 bp, Glycine max
  Peptide Sequence Number=SeqID_134458
atgaaaatcagcaagaagaagggtctcaagcctgaacaacaagaaaaggcttccaattcaaacaaggaggaagtgatagatttcatggagctttcaaataaggctcaagaacaagaacaaccatcaagtaaggtggttgattcacctctttgtgactctaaaggtgcagatgatgaaaatacaaagctagaagcaaagactttctcatgcaactattgcaagagagagttttctacctcgcaagctttggggggacaccaaaatgcgcataaacaagaacgtgctcttgctaaacgtcgccaaggttttgatgttggtggttttggacactttccttactacccttatccaagtttttacaactcaaattctctttatggaggatctttcaatagggcacttggggtccgaaacgattccatgattcacaagcttccttggaccccaaggtatgatcattcttggttgaaacaacaagatcatgtgcccatgccgaattcgtcaatctttgatgggtttggaattgtgaaaggttgttatccaattataaagagtgatggaactctaagtttaaggcaagagaatggtaatgccaatgatggaacactttctctttttccaaatgctgctgccaattcaacaagccaacttgtaaacaatggtggtaatgccaatgatggaacactttctctttttgcaaatgctgccaccaattcatcaagcctacttggaaacagagaaattcttgcaaccaaaattgatgatcattccatgccagaagaaacctccaaagctgcttctgccaatcttgatttgtcacttaagctttaa

SEQ ID NO: 17681 - DNA, 261 bp, Glycine max
  Peptide Sequence Number=SeqID_134459
atggtgatttcactttgtctgtatatatttgggttgccgatcagcccaaagctggttgtaatagaagctgagagaaagcttgctgcacttgttctcaacccacgactgaggaatcaatatctcccaacctatgcataccgtcgtgaagaggagtcacaattttaccggtcacctaaaagaagaagagagagatttgatcagctttatagtgtgagaaatggagatgaaaagaaaatcaggaacctctctggctgtctttaa

SEQ ID NO: 17682 - DNA, 2937 bp, Glycine max
  Peptide Sequence Number=SeqID_134460
atgcgagtgctattttcaagcatgagagtttttcttcttcttgtgtggttgttggagctggtttgtgtttcggtgaccgccgtgaacccttctctgaacgacgacgttttggggcttatagtgttcaaagctgacatacgagatccgaaggggaagctcgcttcttggaacgaggacgatgagagcgcgtgtggtggtagttgggttggggtgaagtgcaaccctagatccaatagagtggtggaggttaaccttgatgggttctcgctctctgggagaataggtagagggttgcaaaggttgcagtttctaagaaagctttcactggcgaataataacctcactggtgggataaaccccaacattgctcggattgataaccttagggtcattgacttgagtgggaatagtctctcaggggaggtttctgatgatgttttccgacaatgtgggtctctcaggactgtttccttggccaggaacaggttttctgggagcattccctctactttgggggcatgttctgctcttgcttctatcgacctttctaataaccagttttctggttctgttccctccggggtttggtccttgagtgctctcaggtctctggatttgtctgataacttgttggagggtgagattcctaagggggttgaggcgatgaagaatttgaggagtgttagtatgacgaggaatcggttgaccgggaatgttccttttgggtttgggagttgtttgctattgaggtctattgatttaggggataattctttttctgggagtattcctggtgatcttaaggaacttacattgtgtggttatcttagcttgcgtgggaatgctttctcgagggaggttcctgagtggattggggagatgagagggcttgagacgttggacctttcgaacaatgggtttaccggtcaggtgccgagctctattggaaatcttcagttgctgaagatgttaaatttttctggaaatggtctcactggtagtctgccggagtctattgtgaattgcacaaaactttcggtgttggatgtcagccggaattcgatgtccgggtggcttccgttgtgggttttcaagtcagatttggacaagggtttgatgtcagaaaatgtacagagtgggagcaagaaaagccctttgtttgccttggctgaagtcgcgtttcaaagtcttcaggttttggatttgtctcacaatgcgttttctggcgaaatcacatctgcagttggaggtttaagcagcttgcaggttttgaatttagcaaacaactctctcggaggtcctattccagctgccattggtgaattgaaaacatgttcaagtcttgatttgagctataataagctgaatggaagcataccttgggaaataggaagagctgtgtccttgaaagaactggtattggaaaagaacttcctaaatgggaaaattccatcgtcaattgagaactgctctttgctaacaactttgattctgtcccagaacaagctgagtggtccaatacctgcagcagttgcaaaacttactaacctgcgaactgtggatgtatcgtttaacagtctcactggaaaccttcctaagcaattggccaaccttgccaatcttcttaccttcaatttatctcacaacaaccttcagggtgagctgccggctggtggttttttcaacaccatttcgccttcctctgtttctggcaatccatctctttgtggcgctgcagtaaacaaatcatgccctgctgtcctcccaaagcctattgttctaaatcccaacacctctactgacactggtccgggttcattgcctccaaatttgggtcataaaagaatcattctcagcatttctgcactcattgccattggtgcagctgctgtcattgtaattggtgttattagcatcactgttctcaatctccgtgttcgctcctctacacctcgtgatgcagctgccctcacattttctgcaggggacgaattcagccgttccccgactacagatgctaactctggcaagcttgtcatgttttcgggtgagcctgatttcagttctggtgcgcatgctttgcttaataaggattgtgagcttgggcgtggaggatttggagcagtgtaccaaactgttcttagagatggacattcagttgctataaagaagctcactgtgtcaagccttgtcaagtctcaagaagattttgaaagagaagtgaagaaattaggaaaaatcagacaccaaaacctcgtggaactcgagggttattattggactacatcgctgcagctgctcatatacgagtatgtctccggtggtagtctgtataagcatctccatgaaggatctggtgggaacttcctctcatggaatgagaggtttaatgtgattctcggaacagcgaaggccttggcacacttgcaccattccaacattattcactataacattaagtcaaccaatgtccttcttgatagttacggtgaaccaaaagtaggggactttggcctagcaagactgttgccaatgcttgatcgatacgttttgagcagcaaaattcagagcgcactcggctacatggcgccagagtttgcctgcaagacggtgaaaatcaccgagaaatgcgatgtatatgggtttggtgtcttggtcttggagatcgtcacagggaagaggccagtcgaatacatggaggatgatgtggtggtactatgcgacatggtgagaggggctttggaagaaggcagggtggaggagtgcattgatgagaggctccaagggaagttcccagcagaagaagctattcctgtcatgaaactaggcttaatatgtacttctcaagtgccatctaacaggcctgacatgggagaggtagttaacatattggagctgataagatgtccctcggaaggacaagaagaattggcatga

SEQ ID NO: 17683 - DNA, 345 bp, Glycine max
  Peptide Sequence Number=SeqID_134461
atggaggatcagaagatcgaagcccgtgactgtgagttccattcagagtcaacaacaacaccatctctttctttgcattcatgccacataatcaataacatatactatgctcgtactctgccactaatacattttgcacttgactcctatgtgcctgattctgcaaccaacacaatacgacacccaattcaattctatactttcatcaagtttgtttcagtcttgctcctgccatgggagcagggggacaaaatggggaagaatgtgaatggaaaggagatggtgataaaacaaacaagcagtaaacgacaagagattggtggcgttaagggccctttaaaatga

SEQ ID NO: 17684 - DNA, 777 bp, Glycine max
  Peptide Sequence Number=SeqID_134462
atgtcctccgaagacatcactctcgtccccgaccagaggatcgagaacggtctcaattcccctctcgtcttccaagacgaccctctccgcttcaattgccccaccccgcaccaccgccgggtcggagacccgcctccgaaaacccgcgaacttggctccttcatcgacgacaacaagatgttcatcgaccgcgaccgcttcttcgccgccgcccacaaccccgaattccgccgctacgctgactgctccgcccgccgcgacccgcgcaattggaacaccaacggcagcgccaccgaagacgacgactccgacgacgacgacgaagatgacgacgacgatgaagaggatgacaccgaagtagaaggactcgttggtgatggaaccaaaagcgaacttaaaattaacaataacaacggtgccggtggtggcggtaatttacctgctgttgcaaacgggaaagcccactcttacgttgctggaagacagctattggtgaaggatggtggagacattgggcaattggtgcatagcaatgttagtggtggtgatgaagatcaccggcaagaggggttaggtaagtctcagaattctgttacggttgctgaaactgactgcgaggagtactattcgcactttcttcaaggcggcgaaggggcttctgggcagaaagttatggtggatgacagtggttgtgggtttagtgggaggaaggatgctatgtattccagcgagtcaggggagtcactcagggcaattctttcagatcctgttacgtaa

SEQ ID NO: 17685 - DNA, 195 bp, Glycine max
  Peptide Sequence Number=SeqID_134463
atgggaaaatcacgtaatttctgggtgtatcagcaatttagctgtatgcacgtagcaatgcccggtcatcactcatcaggcccaatgactaattgttgtcctagggctgcgcggcagagaaagagggtgagttgcggaggaaggaaaggaattgaaattgggaacgaaattgtaaggatgtttagggaaaaatag

SEQ ID NO: 17686 - DNA, 456 bp, Glycine max
  Peptide Sequence Number=SeqID_134464
atgagtgttgttccagccgatacttcagacagtgatattaagagtctttacctgaacatcatagcggtatcaggacatggggttaatcactctgatgaggtgttgaagtgggtagcatttgcagaagccttccctgtggcccttgatgcatgctttgagaatctcaatagattaaatgatgaactgtctgaaaagtctgtgcttctgggcaatggattgaaaccctctgaagctgatgttatagtgtattcagtgattcattcttccctgatatctctggttgcttattgccagatcaacctttcagatacaaacaaggaaaaactgccacatgtattgagatggatggattacatccagcacaagcaagaatttgtaggtttatttgagaaaatattgttgcagaagcctggatttgagcccccggtgagacatcattccattgttgccttttga

SEQ ID NO: 17687 - DNA, 171 bp, Glycine max
  Peptide Sequence Number=SeqID_134465
atggctgcaggttcttcttcaaattgggtcatggaaagtggtgatgttcctcatgttttggccgttgatgacaaccttattgatcgcaaactcgttgagaaactcctcaggaattcttcttgcaaagagttacacgtttctcttgcggagagaataaaaagtgttcagtaa

SEQ ID NO: 17688 - DNA, 243 bp, Glycine max
  Peptide Sequence Number=SeqID_134466
atgaggatgacttcgaggcattttggtcaaacactatttcaagatgaatttaccgaaataagggggaaaaaaagaattagatgcaagattgaggtcgacaaaaattatagcaaatgtgtaaggactaaggacaaggatgttggagccggtggaacaacatatcctgttgaaaaaaggtcgtgtgtagaaatagcaaagcggttcaatttgtcctcactcacttacaagtttcaacataattga

SEQ ID NO: 17689 - DNA, 204 bp, Glycine max
  Peptide Sequence Number=SeqID_134467
atggaattgtcatcctctaacaaagtgataaatgcagataagaaaaacccccacactggtgtcattgttaaaatgtcaaacagtggccctaagtacaactgttcgctagctgtgtctgttctttgcaatttaaatggagtgcaaggaccgcaagctctggagagattaggggcctgtgattatgtctccagaatccgatcatag

SEQ ID NO: 17690 - DNA, 987 bp, Glycine max
  Peptide Sequence Number=SeqID_134468
atggaagaggtaataaattcgattcgacgcgcttgtgtattggcccaaaaccttgaacaagacctacccaacttggcgaaccaaccagctatgatgtccttgtccattgatcagataactgaggctttcagtggtgccaaggaaaagatgttacaattttcccgacagaaccaaacttcggacgaatctcctccaacgttggttcatgaaacgacacagctgcaacctcagatggatgctactctaatgcaggaatggctaaggtctagtcatgcactaacaatggatcagttgtttcaaatgcatcagtttcatgctgcaaggagtacccttcagattggtgaaatgggagggagagatggggaagataattttgagagaaacaagggacctgaagaaatgcaaggaatcaacgaatcttcatcacgaccacgaagaagggaagctaatcaagagaagagaaaagtgatggttcctgccccacagtttggaaacacagagatgccaccggaggatggcttcacttggaggaaatatggccagaaagaaatacttggctccaagttcccaaggagttactacaggtgcacacaccaaaagttatatgaatgccaagccaagaagcaagtgcaaagacttgatcaaaaccctaacatattcgaagtaacatatagaggagaccacacttgccacatgtcctccacagcattatcatcagttccacttcaacaactacttgtggacataacacaaaataacagtaacaccatttcctcccaattgtctccgacaatgaacctcagcctccaccctggtggcggcagtggcaccgctgccagcagtggtggagcctccgcttcaagattcggtggtgattatcctgtggtggatatggccgatgctatgttcaactctcgtagcagcagtaataacagcatggaatttctcttctctcccgaagataaaagtgatccaaaaattgaatag

SEQ ID NO: 17691 - DNA, 942 bp, Glycine max
  Peptide Sequence Number=SeqID_134469
gcaagggcgtgtagccctctgaaggtgaggacgtgtagtcctctgaaggtgagggcctgtagccctctgaaggtaaggacatgcagccatctgaaggtgacgacgtatagtcctctgaaggcgagggcatgtagccctcaaaaggcgagggcgtgtagccctctaaaggcgacgacgagttgccctctgaaggcgagggcatatagtcctctgaaggcaagggcaagcagccctcggaaggcgagggcgtacagtcctccgatggcgagggcgtgtagtcctctgaaggtgagggcgtgcagccctctgatggagaggacatgtagtcctctaaagggcatgcatgcccctctgaaggcgaggacgtgtagtcctctgaaggtgagggcgtgcagccctctcaagacgaagacgtgtagtcctcttaaggtgaggaagtgcgaccctctgaaggcgaggacatgtagtcctttgaaggtgagggcacgtagcccttggaaggtgagggcgtgcagccctctaaaggtgagggcatgcaacactctgaaggcgagggcatgcaaccctctgatggcgaggacgcgtagccctctaaaggtgagggcgtgcagacctctgaaggcgaggacgcgtagtcctctaaaggtgagggcgtgcagccctcaaatggcgaggacttgtagccctctgaaggcaagggtgtgcaaccctctaatggcgaggacgtgtagtcctctaaaggtgagggcttgcagccctctgatggcgagtgcatgtagtcctttgaaggtgagggcgcagagccctctaaaggtgagggcgtgcaaccctctaaaggtgaggacgtgcagccttctaaaggtgagggcgtgtagccctgttatgtcgaggatgtgtagtcctctgaaggcgaggacgtatagtcctatgaaagcgaggacg

SEQ ID NO: 17692 - DNA, 240 bp, Glycine max
  Peptide Sequence Number=SeqID_134470
atggtggatgacattttcacaccatctaggtacaaagaaatcatcatggtgcagcccaaaccaagtgctggcctaaaggggaaacctcaccaacatgctctcactttcatgccttcttgcattcaaaaatcaaaggcttgggtccctaggcctaagtcatgttttggcacttaccctaacttctgcaagctgtccacacatccaaaaatggcatcacacatgcacaaacccaatctataa

SEQ ID NO: 17693 - DNA, 258 bp, Glycine max
  Peptide Sequence Number=SeqID_134471
atgaggatcaaaaggtcttttaaggttgtaatggggccaaggacaaggcttacagtgagcttcaaaacaaggaaagggaaacatgactcaaaagggctatcaaaggaattaagtcaaggtaagtccatttggctagaagcttataagaacaaaattgcctcaatcatttccaaatatgcatgtgaattaggacgcatcaacaagaatcaagccaaggctattgtgcaagcaatcaatggggcaaaacacaccaaatga

SEQ ID NO: 17694 - DNA, 615 bp, Glycine max
  Peptide Sequence Number=SeqID_134472
atggagaaagtacggacaaaaggaaatcctaaattctcaatttcccagaaaccaaactcaaacacggaaactggaaaccaattaatgcagaaacccgaattaggacactttgctgatacactgagactacttcttaggatactcaaattcaccagtagtatttccgtgggagttacttcaggtgcactagaaagtttgaacaaggttgccgagcaaccaaacaagtgcaacggatacaagagaatcccgatagacaccctcaaggctccacaagtggtgacacattctaaaacttgggactcatttcttggtcctgaatcaaatgtgccaaatgaacattattccaccattggatcacaaagccaaattgtaatacaagaatatcccaacgatgagactgatccaagtgatctcacagatgctaacctgtggtctgatttgaaggattttgaactatccaatgacaagcctgcaggtttgaaaatagcacctgaaaatgcagattctgtgtattcatgcactggctcgagaagtttggacatggattttgggatattctctcctcatttctgcagcaccgaggacttccactttgatgaaagccaattgctttag

SEQ ID NO: 17695 - DNA, 195 bp, Glycine max
  Peptide Sequence Number=SeqID_134473
atggagaaagagttggtggaattgtacgaagcggcgaagaaggcggcggacgcggccatctccggcgacggcgaacatgaggaaagcagatgcatcgatgcgcttgagcagctcaagaagtttcccgttaattacaagattctcgtcaacacccaggttagggttcaattggaaacagaatacatctctcgttaa

SEQ ID NO: 17696 - DNA, 231 bp, Glycine max
  Peptide Sequence Number=SeqID_134474
atggcgcgcatgggctcgccaacactgcaacccatgttgaggattctgtggctgggcctggcctcaacactgacgaggatgcttgtaatggagatgttggagttggggtcagaaatctcaaacaacatcatcttgttcaaaccaaatgatggggagaacatgccggtgtgtttctttgtgagtgctaaggtgactgggacttggacagaatggctaatgagtttcctttga

SEQ ID NO: 17697 - DNA, 2970 bp, Glycine max
  Peptide Sequence Number=SeqID_134475
atgtctggcgacttggctcccaaacttcgggtagttagatgtcctaaatgccggctgcttcttgaagagcctgcagggtgtgatttgtacaagtgtggtgaatgtggcactactcttcaagctaagaaacgaacaaatgtggctgccaactcaaagtccagtgtacaagcaactgatgcaactcctaggaatgcatcggatcatgtttctgaggggaaacaacgtaacaatagaaaccatctggttccttcacgggaagatagtttgaaggaaagagaaacttcttctggagagtgtcatgtggatggaaatgctggaaggggtcaaaacgaaaatggtgatcaacttgtaccgtttattttatcagatgaaggacaggaaactgaatcggatatctatagtttgtcacacagaaggcatagagtgtccatcaaaggtggttcagcttcaaataagaccactcactctgagattggggaaataaatgatggaaacttagaagaagaagcagaagaggagtctgtttgtgcattggatgaagatggcgataatgatagatcagctctgataggggtaacatctgaaaaggaaattactgaaggtgatttagaaggagtagaagggttaaataatgaaaacttgtcactagaaggagagaaagagttcatttctgactcagatggagaagatgacaatgaagaggaatcagctctagcaggtgcaatccttgaagtggaaattactgaaagtgattcagtcggagccgaagacttaaatgatggaaacttgttaccagagggagcagaggagttaagttctgcattggagcgaaaagatgccaataatgacaaatcagttatagttggtgaaaaccttgaattggaaaccactgaaaagaatatagcagaagagttaaatgatggtaaattgtcagagggagcagaacatgcaccggatggagaagattccaacaatgatccatcggctatagagggtgcaaaacctgaagtggacactacagaaaatgcttctacgactgataggacaagtagagagaagggaaacattttacatgttactcctgataaagttgaagaaggcacacctgctaatcctacatcttctcataaacaacagaagaaagctaagaaaattattcaccgtggctctgaccgtgtaaggtctgtggatacaacagaattaattgatcccagttcagagcttagtggtatacttgctggaaaattgcctaaatccccaaccactagaagctcttttgcttatgatggcagcctctcttcttatgatggaatggatgagccgttccctatccaacattcaggttcattcgacaacacttacaccaatgctaatggtgtttctgagggaaggaccagaaagggtaaaggccttgtgaatagcatatatggaggccttgaaacacaacatcaatcacatatgtccaatgcaaagcttcatgccaagaaagacagcagggggaatcaaaacaaagtggtggactctacaagaaatggtcatcaacgttggatgggcacaaagagagatgagtttccacccaaaatacctttgcatcgaagtggttcccattcttactatgaaaggggcagctcatcaaaccaaatgcatgatgcgctctaccacagctcaagctttctttcacctgattcctctgaggacactgaccatgagaagatgaaactgttgagaatgattaataagttgcaagatcaactcagcaggactctctacaaaggtggagaaacaaatggaagactgcccaagggtgtctcttacaagggaaatcatatttctgcatatcatagccatgactttggtgagggaagaaggttttctcatagtttggattacccttcgtgtgatggaagatgtggtcatggagttaactggcaccaaaggcatcataaattctcgcggataccttattcagccgaggcaacaaggaatgcacaccatgttgatcattcttgttaccattgtttttcccaagagaggcatttctcaacagatatgtcaatgtcaccacatgttcttttccagcatgaagggttacatgggtcctgttcaggccaagattgttgctctttttctcatcactcttatccttcaagtccacaatggttcatagcctctaaacttccaccaatatatggccgcaaaacaaaatctgatgaacagaggcgtagggctcccgacttaaagaaatacttaagggagaaaaagaacttggtggccaagagacatcacaggccagtggcaggtggagctccttttgtcacttgtcataaatgcttaaacctgttgcagctacctgcagattttctccttttcgaaagggcatgtcatcagctgatatgtggagaatgttcagaggtgctaaagttttcaatgcatggaagccatatagattttttctcaccaaataatgctataggtcctccatcaagtgaccttaatggtcgaagcgaggtgattagtagcagaaatctaccttcagcatctcatgccaactattaccattattcagctactgaggccatttcatattatgatgattatggactttctatctctaaaagctactcctcagaaggagagcctgtttctctggcacattctcatcacttgcacagcggtgaatatgctaatccaagtgtctctcatggtacatttgagccttcaactgagaaggagaacattaatccaagatattctagtgcaagaaagggtcaggtggagacagatgcatcagctatgttttcctccaatatgtctggatccaggaaaatggcatcagaaatggaggctaggccagcaccaaaaagttcatcacttcatctactaatgggttattcttcaccaagtcaagtgataagagggactcggccttctgttgaagctggaaagagcaacaatgggggagttctgtga

SEQ ID NO: 17698 - DNA, 135 bp, Glycine max
  Peptide Sequence Number=SeqID_134476
atgggacaggacattgctttgtgtgtagaggtagaggtactgttagcaaggatgacaaaaataatcaatcaatcaatggcgaagattaatatcgggtgtagttttgcaaatagagaagaaatttgggagtggtag

SEQ ID NO: 17699 - DNA, 114 bp, Glycine max
  Peptide Sequence Number=SeqID_134477
atgcaacaagagtcttccatttcgtgtctagaagggaagggacccgacaacctggtttacacgttggaatgcaacaaaagtccgcgccacaatttatgggtcccatcttcttga

SEQ ID NO: 17700 - DNA, 606 bp, Glycine max
  Peptide Sequence Number=SeqID_134478
atgcttcttagaacagcgtcctctttctctctcttcaacgccaacggcgaccatatactactcccttcctctgttcgctactctcagggcaaacacttggttccatgcgctaccaagaactccaataaccggcccttaaccggcgtcgtatttgaaccctttgaagaggtcaagaaggagctcgaccttgttcccactgtcccacaagcttcccttgctcgccagaagtacaccgatgagtctgaggctactatcaacgaacagatcaatgtggagtacaatgtttcgtacgtttatcatgcgatgtttgcctacttcgatagggacaatgttgcgctcaagggtcttgccaagtttttcaaggagtcaagcgaggaggaaagggagcatgctgagaaattgatggaatatcagaacaagcgaggtggaaaggtgaagttacaatctatagtgatgcctcttactgagtttgaccatgaggaaaagggagatgcgctatatgcaatggaacttgccctgtcgttggagaagctgacaaatgaaaagctgcttaacttgcacagtgtaagatatcaagattgtttggtcctagttttggattcatag

SEQ ID NO: 17701 - DNA, 1448 bp, Glycine max
  Peptide Sequence Number=SeqID_134479
atggaggactctgaaaaatttgatgcaggtagtgaccaagggaatgcattggtgactccatattataccccatatccgaagcacttgttaccgaaatctggccttcaacctgtcaatatagagttttctcctagctcaggcggtgataactctgtggcctctatgaaagagggccctggatcatcttcttcatcatcctcatcatccacagactcagagcaagaaaggaaaatagttggggaggaaaaaacagataatgtatcattggagagtgagaatagaagttacaatgagttgcttaaagaattccttaaaaataaggaagagctgaaactttccaacatcaaacttaagctctcagaagaaaagatagtcaagttgaatgttcaaattgagaaaagtgagggtgagcttaataatgtgttggtagaattaaaagtgaaagaagaaaatctcgagtatgaaaaaggacaggtactggagttgcaaaaaaagacagctgatttggagacacatgttccagattgcagcctcaaaatagcaaagttagtggcacagctggagttggctgaagaacagcttaagatatcagatgatgaaattgcaagattgaaagaggaacttaatagcaggtcatctggtactcatgaattgcaaggtcagcttgaagtagcacaggaaattgtggccgcattagagagccaacttgtctcagagagaaagcagattcatgacctagaaggcagggttacatggtacaaagctaatgaaaccaacactgaacatgcggtgcaaaaattgaaggccaaaatgcttgatgcccaagcacagttctcattggagaaagatcttttgcattctgatattgctcgtttgtcagaagagaacaaacagctgggctctagacttgaggaatatgagtctagaagcaacataatagaaaacaaatcaaggcaacttgaagcggaaaaactgaaactagaagagctgcttgctacccaacaaatggatttgcaaggtgaaatcagttgtttgaaggaagaacttgatcagagaagacatgatgttgaagctgtgaataaggaatttgacaggcacaagcagaagtgtgatgtgctcatgactgaaaaagatgaggccaatgctaagattcataaccttatggctgagacaagagaccgaaacaattacattgcaaatctggagagagatataatcctgctacgtggacaagaggcagagctgagcacaggatctgcagctacactgagacttgtaaaggagttgaaactaaaagccgatgggctcgaaaaagaggtgattctgaagaatgctatgatctcagacagggctgaggagaagagggaggcaatccgacaactatgcttttcaattgagcactataggagtggttataaagaacttcttcaagcatttgctgggcacaa

SEQ ID NO: 17702 - DNA, 918 bp, Glycine max
  Peptide Sequence Number=SeqID_134480
atggtggcgggtggcaattccaaatccgacatctcctttgctggcacttacgctagcagtgctttcgctgcatgtttcgccgaggtgtgtactcttcctttggacaccgccaaagttaggcttcagcttcaaaaacaagctgtagttggtgatgtggtgaccttacctaaatataggggtttgctgggaacggttggaaccattgccagggaagaaggtctttcagcactctggaaggggattgtgccagggctacatcgtcaatgtttgaatggtggtttaagaattgcgttatatgagcctgttaagaatttctatgttgggcctgaccatgttggagatgttccattgtttaagaaaattctcgctggatttacaactggtgctatggcaattgcagtggcgaatccaactgatcttgtgaaagttagacttcaagcagaaggaaaattacctcctggtgtgcccaggcgttactctggatcattaaatgcttattcaacaattgtgagacaggaaggagttggagcactttggactgggattggtcccaacatagcaagaaatggcatcattaatgctgctgaactagccagctatgatcaagtaaaacagactattttgaaaattcctggattcaccgacaatgttgtaactcaccttcttgctggtctaggagcaggattttttgcagtctgtgttggctcccctgttgatgtggttaagtcgagaatgatgggagattcgagttacaaaagcacccttgattgtttcgttaagacattaaaaaatgatggaccttttgccttttataaggggttcataccaaattttggacggctaggatcttggaatgtgatcatgtttctaactctagaacaggctaaaaagtttgtcaaaactttagaatcagcttga

SEQ ID NO: 17703 - DNA, 792 bp, Glycine max
  Peptide Sequence Number=SeqID_134481
atgcctgagagagtggaagaaggagttgttgccttgaatcagcactttgtgcttgtacatggcataggtggaggaagttggtgctggtacaaaatccggtgtcttatggagaattctggctataaggtctcatgcatagacctcaaaagtgctggaattgatcaatctgatgctgattccgtgctatcctttgatgattacaataaaccactaatggatttcatgtctgatttgcctgagaatgaacagattttaaatatcagtcgcgatagcattgcgatttcgtcgtgtttgttgatatggcagcaaatcgcaaacaaatgcggtgtcaattgcagtgaaaaacagttaaaaaatcttgatgttgtggttatattggtggggcacagcgctggagggttgagcattactcaggcctgtcacaagtttgcaaacaagatccgtttagctgtttatgtggcagcaactatgctcaagttcggtttcttgaccgatcaagatcataaagataaatggtcaaatctctttgctttcttttcgttccttcaatccgacaaccctgtctattccacagatctactttgtcctcaggagggtgtgcctgatttatccgagtatggggatgtgtacgagctaggatttggattgggacatgataagcctccaaccagcgctttggtgaagaaagaatttcaacgcaaaatcatctatcctttgagccctcacgaggaccatttatggcaattttcttgcgaaaagatgaaaaacacggaaaattattcttccaaatga

SEQ ID NO: 17704 - DNA, 406 bp, Glycine max
  Peptide Sequence Number=SeqID_134482
aagctcttgtgtcgatgaagaggacgttccaccaaatgccatcgttgaagttggggatgccactccaaatgacatcgttgaagctgaggacgttgcagcaaatggcatcgctgaagcagtagacgctcctttgaacatagtcgtggatgttgttgtggccattgaggaagctacgacaaacaatgtcataggagttgagggcgctgcgccaaacaacgttgtcatggtagagggcgttccaccaaaaggcgacacggcagaggacactactacccaaaacgatgtcgtcattgtggaagaggaagaaacactaaacgacgctactgtaacactgaaaattgaagaaccagtgcgggaaaggaagaagaggccaatgagaaggaaggtgcgaaggaagaagaagtga

SEQ ID NO: 17705 - DNA, 748 bp, Glycine max
  Peptide Sequence Number=SeqID_134483
ccttggacggaatttaccgcccgattggggctgcattcccaagcaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccggggacaccgtctccgggcccccgggagtcgcacttaacagattgagttccttggcgcacgaagcgccggggtttgtgtttgtcgcgaggacgaggaggccgggcgcacggggcgccgtggtcatcccctccctcccgacggtagatgaataa

SEQ ID NO: 17706 - DNA, 219 bp, Glycine max
  Peptide Sequence Number=SeqID_134484
atggcgagtgacatgtacgcacaagcacactactacgactccagtgcatgccacctgtcataccctaatttcgtccggggacctttgcttgatgacatgcgaccattctttggtccttgtgaggacatgccgaaaaaccaaaaaaatgttgatgcacaatccgtaagtttccgtgacacatcggaaatcaaatggaagcatcgttgcataattaagtga

SEQ ID NO: 17707 - DNA, 352 bp, Glycine max
  Peptide Sequence Number=SeqID_134485
cctttaccgttatgttcatatgcagtatgatatgaagctgctggctgttgatgttcccatggcttctggtccagaccagcggttgtttctaattggggatgaagaagagtacagggtcggtggggggctaatatctgatcttagagacccagtagtgagagcaatggcagcaaccaaggaatttgatgatcttgatgagattgaggaagaggaagatgctgaaagagaacgtcaagagactgaaagaaaggagcgtgaagagattgaaaagctggaaaagagtagtggcacctatttcgagttttccctagatttagaaacccttgtaccacaaatggccaagtttatctga

SEQ ID NO: 17708 - DNA, 180 bp, Glycine max
  Peptide Sequence Number=SeqID_134486
atggtgatggcgcaaaggtgcatgagcaacgtagactggaccagaggtgattgtgtgcacttctgggtcttagggtggtggcataattgcacaactagtggtggcatgacaacaaaggtgatcagattgatagtagatggtggaggtaaaaggaatggagtagatgagaaagttggttag

SEQ ID NO: 17709 - DNA, 348 bp, Glycine max
  Peptide Sequence Number=SeqID_134487
atgcaaatcgttgacgagagcaccaaagaaggtgcggtggtggaccctgtagagcctcagaaagttctagaagctgccaattctcatggggtcaataatctcaagcttgtcctcaccacacatcatcacggggatcatgctggtggaaatgaaaagataaagcaattggtgcttggaatgaaggtctatggtggttcaatggataacatcaagggttgcactgataaggttgaaaatggggataagatgtcacttggggctgatattaatatattgtgtcttcacacaccttgcaaattgtgtactgctgcagcgctgcttactgaattgtgtcatgctgctgcttag

SEQ ID NO: 17710 - DNA, 672 bp, Glycine max
  Peptide Sequence Number=SeqID_134488
atgcaaatgtcaagattcacccaattccgagctctactccgcggcaccaccagccaccagcgctcccctctccgccaccccgccgtcgccgattcttcatttgcatcaaaaccctcagtctctaatgcctccgcgttccgcccctcttcgccggtgttccacccgcaacaacgcctcggcaatagcacctttcgattcttctcctccaatttcgacaaaggatttgcgcagaaggtgtttgataagcctgcggcagcagtgacttcggccttttcgcggtaccgcgaggcaattgggttgcaaatcgaggcgttcttcaagaggaatactctgtttctttggggcgccggtggagttgtgctctgcgccgttctatggaggatccttttcgggatcgccaacctcttcgttggactctccgaaggcatggctaagtatggcttccttgccctttcatctgctatcgttgcttttactggcttgtatattcgcacgaggctcacaatcaacccggataaagtttatagaatggccatgacaaaacttaacacgtcagctgggattcttgaagttatgggtgctcctctttctggaactgatttgagagcatatatcatagggtctgagaaaaagggtctagtcagtgttgaagtcaagaaaaagaagggtcag

SEQ ID NO: 17711 - DNA, 177 bp, Glycine max
  Peptide Sequence Number=SeqID_134489
tatgcagtgaggaacttgctatttgctctgacaattgagccagataatttgaggatacaacaaaaattaacatgggctaagaatcagcagcaagctggccaatctacaattccctccaccattgaggaagaaatggaaaccaacccatttatgagggtcaacctacctgagattcag

SEQ ID NO: 17712 - DNA, 945 bp, Glycine max
  Peptide Sequence Number=SeqID_134490
atggaatcgtcaccgtcgtcttcgtcatcgtcgatgtcgtcgtcgtctggaagcgataccagcggtggtggtggtggtggcgctgtcacgtggttcgggatgagtttcccattccgttctccgctatctctcgtcatggattactgcgcgcgcgaggattccgcggagcctgtgattatcattccccgcacgcgccctcggtttcaggcgcatgccgaatccgcctctgcttcgtcctctgattccgatgagaatgcctgcaacggcgctgctgaggaggttgcgatacgcataattggggccggcgagcaggagagcggttcgtcgccatcgtcgtcgtcgaggggccggggaggggagccgggttgtgaggaggcggtggttgggaggagtgggatgctttcgtcggaggctcgccggcgaatggcggaggaaagggtgcctttggtgtctttggatgatgggattggtggcgttagggaatcttcctcttcttcttcttcttcttcttcctcttcttcatcgtcctctacttaccagaggtatgatattcagcaggttgcgaagtggattgagcagattctaccgttttctctcttgttgctgattgttttcatccgccaacatttgcaaggtttctttgtcacaatttgtatatcagctgtgatgttcaagtcaaatgaaattgttaagaagcagactgccctgaagggagatcggaaagtctctgttcttcttggtatctcttttgcctttgtgctgcatgtgataagcatttactggtggtatcaaaatgatgatcttttatacccactggccatgcttccaccaaaaacaccaccacctttctggcatacaatattcatcattttggttaatggtatggatttattctatgtgcactctatatgtgatcattgcattgctatagtttgtttacactag

SEQ ID NO: 17713 - DNA, 198 bp, Glycine max
  Peptide Sequence Number=SeqID_134491
atggttcgaatagttgcacgtcttccatggtggcattgccgaatgaaactaccagaaaatgcacaacaactgccacttgcagacatggagaaatcaagtgaacaagcagtagcgactgagcgtcagaggagaagaagaagaaatgactcaacgtgggaaaccagcagcttcgtaagactcagcgtgggaaaccagtag

SEQ ID NO: 17714 - DNA, 426 bp, Glycine max
  Peptide Sequence Number=SeqID_134492
atgaggcaggttgtgaaaattttggaggtggaaattgacagcattgagtctgatgaagataacatggaaatgagtttgcttggaaaaataagatcagctactacgtggtctagagctgaatgtgctttaccatacagtggttacccttcttttgatgaagttaagatgttcagttttaattctaggactactagaagtggctcaaacacaactaaacatgaagacagtaaatctgaagctcaaattaaacatcatgggtttcatcaagttcagtgtactaacttagaccaaacgctcaacgaaactgataatgtggcacaggatgacacaccactgatgaaggatggcagcaggctattcccgaaagtcgttcactcactgcccgcaagtcagcttcatcaacgagccccacataaaccccactga

SEQ ID NO: 17715 - DNA, 237 bp, Glycine max
  Peptide Sequence Number=SeqID_134493
atgacggtttcaaagaaacgtcgtagaagctcaaccggtggcatatccgtaattaagggcttcagaacgacgacgtttgccgctacccgtcgtagacatccagctgttgtggcgattcctacacagagcatcttctccgacaaagaccatcgtctccgacaaccaccatctcgtgtccgttgcgtctcgttccgtttgaagccgccgccgacaaaggaagataagctggttccataa

SEQ ID NO: 17716 - DNA, 1509 bp, Glycine max
  Peptide Sequence Number=SeqID_134494
atgatgatgatggtaaggatagggatgttttatggggaactgggttcttctactctttgtttatcccatcgctgcaataactctacactttcacatatacacaaacatccctctcctctaatatctccaaactatgctgctactcacactcacaacaaacgattagttgcttctgcttcttcagctccatcaggaaaagtcattatggttgttaggttacttacacaagtgctttatgttgaacccatttcttcagagcagatggtggatgtgggagcaaaaaagaaaaagaagagtatagcaggcatagatcaggacgaattagtggatccaaagcttttagctgatctagacagttgtttttgtgagttcaaaggagtgcatatacaccacaagatatgtgatgccgaatcaaaagcacaaagcacaccccagagtcggactgtttctcatcaaatcaagaagctaggttatcctatgattttgttacatggatttggtgcctcagttttctcatggaaacaggttatgaagccgttggccgaggttgctggttcaaaagttcttgcttttgataggccagcctttggattgacatcaagggtaaatttatctaggcatccttcttcagaaacagaagacgcaaaacctctaaatgcatactcaatggcattttccgtgcttgctaccctgcacttcattaaattactaaatgctcagaaggtgattttagtggggcactcagctggttcacttgtagcagttaatacttattttgaagctccagaacgtgttgctgctctgattctagttgccccagcaatttttgccccacttactacacggaaagttgttaaagaaaatcaatcaggacatgataaccaaacggaagaagacaacagttccatcagaaaaaatccaattttggggctttacaagatgttgtccaagactaccaagtacattgcagaggcaatatcacagatgatgaagtggacaatagatatcctcaacttttggtacagaaaattgttatcagctatcctgcgttcttcccttgctataatgctggtaagaatggcaattgataagttcggtactactgcagttcgaaatgcatggtatgacccaaagcaggttgctgagcatgtccttagtggttatataaagcctttaaggattaagaattgggatagggcactggtggaatacactgcagcaatgcttctggatgaggaatctaaaacaaagccatcactttctaaaaggcttcatgaaatatcatgtcctgttctgattgtaactggtgatactgatcgaatagtcccttcatggaatgctgagagactttcacgagtcataccaggagcatcttttgaagtaattaagcaatgtggtcatctgccccatgaagaaaaagtggaggagttcatttcaattgttgaaaacttcctaaggagattagtgagtgattcaaacgaacaatatctacaagaagcaactgcatag

SEQ ID NO: 17717 - DNA, 123 bp, Glycine max
  Peptide Sequence Number=SeqID_134495
atggaaatgacgaatggaggtggtgttattgaggataaattggttactttgaagggtgttagaggaactttcaggccaggtgttctcactggtgctgaaaaaacaactctgatggaagtttag

SEQ ID NO: 17718 - DNA, 1340 bp, Glycine max
  Peptide Sequence Number=SeqID_134496
ctaccaagacacaattggctggtggtggtgcaatctatgccattgcacaatgtgctgaaactgccacagagagtgcttgtttggattgcctcacagttggatacaacaacatacatatttgtttacccaacacagatggcagagcatttgatgcaggatgctttatgagatactcagagacagcattttttgctgataaccagaccattgatatcacacccttcttgaaacaaggaggttcaagcaacaagaagggagccattataggcggtgttgttggaggtgtaggtcttgttgtaatcctccttgcactatttggcttgcttagacggtataagaaacccaagagggttcctagaggtgacatattgggagcaaccgagttgaaaggtccagttccctataggtacaaggatttgaagactgcaacaaaaaatttcagtgatgaaaataaactaggagaaggaggttttggagatgtatacaagggcactttgaaaaatgggaaaatagttgcagtcaaaaaattaatcttaggccaatccgggaagatggatgaacaatttgaaagtgaagtcaagcttataagtaatgttcatcacaagaatctggttcgacttcttggatgttgcagtaaaggtgaaaataagggttctctcaactggaaacaaagatatgatataattttaggcacagcaaagggtttggcctatctacatgaggatttccacgtttgcatcatacatagggatataaagaccagcaatatcctcttggatgatgagatgcagccaagaattgctgattttgggttggcaagacttctaccagaggaccaatctcatctcagcacaagatttgcaggaacattgggatacacagcacctgagtatgccatccatggtcagttatctgagaaggctgatgcatacagctttggtgttgtagtccttgaaatcataagtggccaaaagagcagtgaattgaggacagatactgatggtgaattcctccttcaaagggcatggaaactatacgtgcaagatatgcatttggagttggttgacaagacattgttggaccctgaagactatgatgcagaagaagtgaagaaaatcatagagattgctttgctttgcactcaagcatcagctgctgcaaggccaacaatgtctgaaatagtagcttttctcaaaagcaagaactcactggggcaaataaggccttctatgcctgtttttgtagaaactaacttaaggactcgggcagaaacctctacctcaactggttcctccacatctaatgctactgcttccatttctatgctctcagctcgatga

SEQ ID NO: 17719 - DNA, 447 bp, Glycine max
  Peptide Sequence Number=SeqID_134497
atggaactacaacgccttaatcaaaataaagaaaatgacaaaaagaagagaagtataacccttaaagcctcatcatcaatgcaagaagaaaacgaagaagaagattcaaatgatgaagaagatttttcattctttgtgaagaaatttcagaaatttatcaagaaaagaagaattgacaggcgtcagaacttcaacaatggaagaaaatcacaagaagactctcaattccttaggtgttacaaatgcaaccaaattggtcacatcaaggccgattttccttcaaatgaagagtggcctgagaaaagcgaaaagaaaaggtttgatgaaagaaggactaagaaagcctacattgaatgggatgacaatgattcatccgatggttcagaaaaggagattaatcttctaaccaaggattatgaaagtgatgagaacatctctcaagaatga

SEQ ID NO: 17720 - DNA, 315 bp, Glycine max
  Peptide Sequence Number=SeqID_134498
atggatgccgccactagctctagcgagaatggtgctgacgtggctgggtgtcgccagcaccaacagcgttacagggcaactcgccagtgcttagatcagtcccgccattggttcttgcgagaccaacgtggacctggttcttcacgccttgacacagctacaactagggttctggcttcacacgacagcttagggcactgtttgcaagctagggcatggcatgctgagggttcacatggatacagtttcatattcacatgcgcctgtaattattgtagagaagatcacatgctacatggtgtaaattggctttaa

SEQ ID NO: 17721 - DNA, 498 bp, Glycine max
  Peptide Sequence Number=SeqID_134499
atgtatgtacatgtttggtttgctgttaaaaatgctgccacacacattccaatgcaaatccaacagacaaaagtggcaatggtgattaaagaagtgctacgtttatacccaccagcagcctttgtttcaagggaggcatacgaagatatccaaattggaaacctcaatgttcccaaaggcgtttgtttatggactctgatcccaacactgcacagagatcctgatatttggggaccagatgcaaatgagtttaaaccagaaaggttcagtggaggtgtctccaaggcttgcaagtttccacatgcttatgtgccatttggattgggtactcgcttgtgcttgggaaagaactttgccatggttcaattgaaggttgtgctagcacttatcatctccaagtttagcttctctctgtctcctagttataggcattctccggcatatagaatgattgtagaaccgggacatggtgtacatattatcattcagaagatttga

SEQ ID NO: 17722 - DNA, 706 bp, Glycine max
  Peptide Sequence Number=SeqID_134500
tattgtcttgaatttaatcttgaaaagcccatttgcatcaattgcatcatatcatcatgatcatcatcaaaacaccaaagacaattgcatctacatacacacccttgccctcagaggactacacctcctcccctttagaggactacacgtcatcgcaattagagggctacacgtcctcgacttcagagggcttcatgtcctcaccttcagagcactacatgccctcccctttagaggactacacatcttttcctttagaggactacacgtcctccccttcagagaggacaacacgtcctcgccatcagaggacaacacctccttgccttcagagagctacacgtcctcaccttcagaggactacacgtcctctctttctgagggctactcgccctcgcctttagaggactacacaacctcaccttcagagggctacacaccctcgccttcagaggactacacgtccttgccttcagagggctgcacaccctcgccttcagaggactacacgtcctcgccatcagagggcaacacctcctcgcatctagagagctacacgtcctcaccttcagaggactacatgtcctccccttcagaggactgcaagtcctcaagttcagagggctacacgtccttaccttcagagggctacgtgccctcggcttcagaggactacatgtcctcacctttagaggactacacgtag

SEQ ID NO: 17723 - DNA, 132 bp, Glycine max
  Peptide Sequence Number=SeqID_134501
ggtagcaaaggatcattaaattgtaaacatcatgagccacatgatgagggaagcagtatcaaatcaatgctttacaagcttttggtcaatctaaggagtggtgtcttcatgctgcaaattgatggtttctga

SEQ ID NO: 17724 - DNA, 237 bp, Glycine max
  Peptide Sequence Number=SeqID_134502
atgaactcgctaagccagcatgctgtgctaagcaagttcatcagtacttattgtatagaggcattctctgaagaactagctaagcgcgcttactgcgctaagcgagttcatcctttgaggatgaatactcatccttttgctgaactacctgtggctaagcgagcagatgttcagcttagcaggcactatccagctaagccaattctgcagaagctgaatttctgcaacttccgctaa

SEQ ID NO: 17725 - DNA, 747 bp, Glycine max
  Peptide Sequence Number=SeqID_134503
atggaaggtggcaagagaattacggtgagccctcgaccttgctgcggccgcagaatcgttgccgcgaagaagagaccgcgtgcgaacgatggcttcgtcaacagcgtcaagaaactacagagacgcgaaatcagctccaagcgtgatcgcgctttcaccatgagcgacgctcaagagagattccggaatattcgcttgcaggaagaatatgatacgcatgatccgaaaggtccttcatctatggtgttgccgtttctgagaaaaagatcaaagattattgagattgtagcagcacgcgatattgtttttgctcttgcacaatcgggtgtttgtgcggcatttagccgagagaccaatcaacggatatgctttttgaatgttagtcctgatgaagttataagaagtctgttttataacaaaaataacgactcacttatcacagtttctgtatatgcttcagacagttacagttctttgaagtgcagaagcacaaggattgactatccgcctatcccagagtggaatagtgggcgcaattgcggtggtggaattttgttattggaaattgaaatcccaaaagccctaagccctcacttcagagggctttttttggaaccaacacatagagccgctatcctgttcactgcagctgttattcagcctgctatttggtctggctgtagccactacactaaactagtctgctacagtgttcaggggccactctgcactgctccaccgcaataa

SEQ ID NO: 17726 - DNA, 824 bp, Glycine max
  Peptide Sequence Number=SeqID_134504
atgaagcaacacctgtatgtgaaccaaccggatctagtgagagaaatgaatcagtctatcactttggatttgggtaagcctacttacataacaaacaaacttgcacctatgcttggcaatggcattttgagagccaacgggctcagttgggcacaacagaggaaacttgtcgcagctgagttcttcatggacaaagttaagggtatggtggggctaatgatagagtcagcgcagccattactactaaaatgggagcaacttatcgagagccaaggaagtgccactgctgaagttaaagttgatgtaaatttgaggggcttctcagctgatgttatttcaagggtttgctttggccattcttattccaagggaaaggaagtcttctcaaagcttagaagcattcagaaggccatgtccaagcacggtggtttcctttttggactcagcagtttccgtgacaaactgaaacatttctcgtcaaataagcaaaatgagatagcaggtttggagaaagagatagagtcactgatatgggagttggtggaggaacgcaagagggagtgctcagagacatcctcatcagagaaggatttgatgcagttgctgttggaagcagcaatgactgatcagagtctggggaaggacttctccaagcgattcattgtggataactgcaaaaacatttactttgctggccatgaaaccactgctgttgcagcctcatggtgtttgatgcttcttgctttgcaccccgaatggcaaactcgtataaggactgaagtggctgaactttgccccaatggcgtacccagattgccgattct

SEQ ID NO: 17727 - DNA, 201 bp, Glycine max
  Peptide Sequence Number=SeqID_134505
atgtgtaaaaaggagcatgagtccttcaaagtatatgcccagaggtggagggatttggcggctcaggtagcgcatccaatgatggaaagagaaatgataacaatgatagtggacacattaccaatgttgtactatgagaaaatggtggggtacatgccctcaagcttcacgaatctggaattaatgaagcattgggcttga

SEQ ID NO: 17728 - DNA, 183 bp, Glycine max
  Peptide Sequence Number=SeqID_134506
atgcataaattggattcaacaaatttaagcccctcatcagcaaaacaacaaattctgattttggctagacaacaagcccaaagagaggaagagctagcagtcacagcgccatattttagctcttcaagtgaagttgaggtattgctaccagttattggaatgctgcttcagtttggtccataa

SEQ ID NO: 17729 - DNA, 2205 bp, Glycine max
  Peptide Sequence Number=SeqID_134507
atggagattctgaaagctgcaattccagaaaacctgaagcgagcgatagcggatagcgatgtggatgaccttggcagcacatgctcttctcttcaccgcttctttcttcacttccacccatttcaccagatgatcactgaactggctgatccaaagtacgctctgtccggtaagaataaggacgctgcgttgaaatccaagcagcttggcaatcagtgcttctccaacgcagattatgctaaggccttggactgctacactcaggcattgcgtgaggctccattagacactggtgatatggagagtaatcttgttgcaacattgtatatcaatcgtgctactgtattgcataaaatgagtcttttagttgaatgcttacgggattgcactcgagctcttcaagtttgtcctagctatgcaaagttatacaccattatagaaccggttgaatccttgcatttgtaccaggcatggtacaggagaggtaaggcaaatgctttgttgggaaattataaaaatgcaatctgcgatctaaatgtggccaagagtgtggaaccttcaatgggtgggaggagacaaatagaaggtgaacttaaaattcttttagaccaatgcagaagcacaactgcagtagtacaaatacaacataaggagaacaactgcaatactgtgggtgagatgcctcacataaagctacagtgtgtctccacacctgataagggaagaggcatggtgtcatcatgtgtcatttcaccaggttctttggttcatgttgaagaaccttatgctatgaggttgccggtggtaagacgacaagctgagaggtccaccgaggacagtaagtctctggtggagaacgacttttgttatgcctatgtcaagaataacctaagttctgataccacacaacgttacacaataatattaaagcaatgtcgggaaacgcattgccattattgcttgaatgacctacctgctgatagagttccttgtatatcatgttcaataccattgtattgctcccaccaatgccagacacgggcaactgggcaaatgttcaagatttacccagactataatggcttttttaaaaacttgcccagtgatcttggagaatatgctgctgaagttattcaatgcaatgattctgaacaggaaattggggatataactgaacataaacatgaatgtcaaggtgtacattggcctgtggtactgccgtctgagatagttttggctggtcgaatacttgctaggtttttgctaaatagctcacctgaagatattataaactttgtggaaaggctggttgtcataattatttctcaaattaaagtgaattgtatgactgttgttcgtttaaaatcaatagacgcccatggatcaggtcattttggagattttccatttcaatctggtgctcattcaactagtaatgtggaacaggtcagagtgggtaaagctatttataaagctggcagtttattcaaccattcttgccagccaaatgttcatgcatattttctttcacgcgctctttatttacgaaccacaaatgttgtagcagctgggagtcagctagaattgtcttatggtccacaggttgggttgtgggattgtaaagatcggcttaattttctcaaaaacgagtatgcgtttcattgtctgtgtactggttgttcagaagttaatcgatctgaccttgtcctcaatgccttccattgtgtcaatccaaattgttctggtgcagtgttagaaagcagagtacttgattgtgagatgcagaaaatcaagcacttccctattcctgaccatgttgacaagaatgatgacatttatgaagtatgtcatcatgtcttcaaacaaaatggtaaatctattcatattcaacctggatactgtttgaaatgtggttcttactgtgatttggagtcttcgcatgctgcagtcggtaaagctttagcatgcataacaaggttgcaggatgcaatattgtcacaacaaatttcaagtattatcatctctgatgcgttgagatctctaaaattgctaagattaaatttgcatgcatacaacaagctcactgcagaggcagaagacagcattgcccaggctttttgtttagtgggagaattacaattatctttggatcattgtaaagcatctatccaggttggcttgtttctgccactcggcaaaaactaa

SEQ ID NO: 17730 - DNA, 270 bp, Glycine max
  Peptide Sequence Number=SeqID_134508
atggctcctcaaaacgttttacaaatggtagacactaatattgctgatgaaaaagatgaacctaagaagaaagtggttaaaactttgtcattcttcaaactcatgagctatgctgacgtgatagactggattctgatgggtttgggaggtctaggttcggttgtgcatggcatggcatttcctgttgggtatctcttgttgggaaaagctcttaatgcttttggaaacaatatcaacgacatagatgccatggttaatgctcttaaaaag

SEQ ID NO: 17731 - DNA, 438 bp, Glycine max
  Peptide Sequence Number=SeqID_134509
atgacttttgccttaaatagcatctatcacgagcctttaaaaattgccagcgaggttgcactgcagcactggtaccatctcaatgcctcaattaagccccaggatgactcgcttaagcgaggctgcatcttcaaggagctcgtgctccacccccttgtcctcgaagtggttagtccccaggcatatgagccatcctacatgagctacatagtcctcctgagatgggaaaggatagtcaatggctctattgttggccaatgtggtgaaggaggtgttggagtcactgagtcatcatcatctcttggacattgttggtttgaatctgatgcatgggcgggcaaaagcagcattcacatccacttcattgtgggcacacaagactgtgatcgaagctgggtaaccaatgttgaagagcagagtgatcatccaaatctgtga

SEQ ID NO: 17732 - DNA, 2757 bp, Glycine max
  Peptide Sequence Number=SeqID_134510
atggacctaagactaacagctttgagcgacaagttagctgaaacttttagcaaggccactggtgctacatgctccccggaagatctgacttgtttagctaaattttctcaacattttggtgccactaatatagagcattctttatgcaagtttatagaacttactcaaaagagccaggatgttgcccccctgagcaaagaaacaaccttgcactcatgtgatgtgaccaaagatgatgcaaacgaggctgttaaaaacctgcaggtttccaaaccattaccttcagatacaccagttaagtatggtgtttcaccagcaaaagcggcccaagttgagagacacagttcaacagaaagtgaggaatcttctaactctagtgatgaggaccaaagatctgccgagagaagtcgttctctagtaagatctgcaacacccagaaggtcagcatccccaatgcgaagggtccaaataggaagagctggaccccgcagagctgctgcattaactatcaagagcctcaattattttcctggcagagagaggataactgtacaagatgctgctgaaaatgactttgaaggggaagtatctgaactacccaataaaaagtcagaaattgatgtaaagaggataactgtacaagatgccatcagtctttttgaaagcaaacagcgggatcaaactacagatattcagaagaggaagtcattagcagatgtttctgttagtacaaataaatctgtattgagaagatggagtgccggtatgggggaaacctctgttcaagaccagccagaatatgttcctgaagatcctgttccagtgacttctaatgatgtggtacatgctgaggctcctagaaattcagaagtaggagtggtgtctgattttatttcggaatgtcacaataataatgagatcactgatcatgatgtaaaaccagaaagacaggaaaatataggttatgttgctgtagataatccagatgaaaccaacccaacagtaaaacaggaaactaacaaaaagttagcagcatcagcagagtggaatcaacgaaagcaagaagagttcaaccaaattcttaaaaaaatggtcgaaagcaagcctgttttatttgggaagtcccagcccagcagaaaccagaatatttcatttgagcagagaggagggtcttacgataattataaggaaaaacgtgatgcaaaacttcgaggagcaaaggctggaaaacaagtagaaaaagaagcacaatttcgacaaatgcagcgactacttgataagaggaaggttgaaatgtccaaaagtgtgagtgcaagtaaaaaaagttctccaaggttgccccaaagttctcttagaaattcaactccacctgcaaattccccaaaggaaacctctaaaccttcaactatgaaaaaaacatcatctagaacatctcccatgcctgctacacgtaagtcttggtcagcaacaccttcaccaagggcagctgggacatcccccgccaaagctcgtggtggaatttcatctgctaacagcaccccaacacatcgtaagccagtgtcaacatctgttccccaaccaagcacccaaagggaaaaatctctgccccggaacagaaatgagaaagaacctcagaccaataatgccaggagcctcaaaagcatgaatgagaagcggcagccagctgtcccaaacaagagcaaggcagtcaaagcaaaagtgacgaaagcttctgaagaagcctctgttccttcaaagactagcattggtaacaagggaaccaagaaaagcagtgtggtgccattggaatcaaaaccatttctacgcaagggttctcgaatggggcatggaactgctgatcttaacaagaaaaaaggtcctcctaagatggacaaatctctgagagtaagtgcagatcttattgaagatcaagaaagtgagttggttgtcaatgcttctgacttggtcagtcagcattcagatggggacacaatgacacctattcatcagaatgctgctacagaaccagacccacagatacataaccaattgcaatgcggtgagacagaaaacttggaccaaaatcctacagatggtgaggtcttaacatacacaggagagtcttccataaatataaggaatgaagaagaatcaaccatatcaccttctgcctggttggagacagaagaggatctggaaatgcccaagccatgtgaggatgacaccttccaatctgcatctctagccaatgctgccccagtgggatcagctagtcctcgtgttcgtcattctctgtcacagatgctgcaagaagaaagtagtgaacctgacacatgtgagtggggaaatgctgagaatcctcctgccatgatataccaaaaaaatgcacccaaaggtttgaaaagactcctgaaatttgctcggaagagcaagggcgatacaggttccactggctggtctagcccatctgttttttctgaaggagaggatgatgctgaggaatttaaaaattctaataaaaggaatgctgataatctactgagaaaggccgcacaaaatgtgaaaagctacggacaaccgaaaaattcagtacatgaaggatatgaaagaaatttaggtagagatgatggcaagggttctcacaagatgcgagatggacgagatttaggtgctggttcaaccacaagagcgtcaaggtcattcttttctctttcagcttttaggggaagcaagccctccgagtcaaagtttcattag

SEQ ID NO: 17733 - DNA, 1044 bp, Glycine max
  Peptide Sequence Number=SeqID_134511
atgggtggatccggggtgaaaagagagcaagcagccaatggctcacggtctggagcaaactattcgtgtggtggtgagactaatagtgataatggggaatgcaaagtgaatgaaaaaatctcttgcttgattggttctcagacaaggagcaatttttacaaagttgaagggggtttgatggcattgttgagatgctgtttagagtctgaagttggaaattcttatagtattttgtcaggttatgttgatcatttccagtgccttgaatctgtggatgctggatggggttgtggctggcgtaacattcagatgctttgttctcacttactagtgcaaagaccagaagcaaggaaagctttgttttgtggttcgggatttgttcctgatatcctttcactccagagatggcttgagattgcttgggaaaagggttttgatgcgcctggatcagctcaattcaatcatgttatttggggttcaaaagaatggataggaactactgagtgcgctgctcttttgcgttcctttgctcttcaggcaagagtagtggattttggtcctaaggattcccaatcccttactggttcaagtgttgatgacatgatggataaagcaagtattcataatatggtaaaaagaaaagctgaaaagagtaagggttatcaagttctcatggattttgtgtggaattacttttctgataaaagctcaatccaatttggccagcagcatgttgtgatcagtgagaaaacgcctctatactttcaacatgatggtcactcaagaacaatagttggaattcaagtcaaccgtcaacaaaaaggacatcttcaatataatctcttagttttggaccctgctcatagtacggatgctcttgaaagatcactaaggctgagagttggatgggagaaactcataaaaagaggaatgcatacactgaagaagccacaataccagttgtgttatgttgatcctggaatcgctagtgaggaggagatggaaaaactcaagacaattgatagtgtcttccttgaattttaa

SEQ ID NO: 17734 - DNA, 387 bp, Glycine max
  Peptide Sequence Number=SeqID_134512
atgagatcgccgatgatagatggaggaaatgaatgcgaagggtcactttgggaaagttgcagctcgccaagtgagctgaaacttaaccctgcagcagtgagctcgcccaggcgagctagtttcttcaccatgaagctatttggtggcccggtgagccagaggctagcctgggcgagctggggtccaggaaaaaacccttttgcccccttttttgtaagtcgaccagcaaggatcaaaagatcaacgaatgatagtccccggaaaaaattaagggaagtaaagataaggacactaatttcattcgagcaaccttgctattcgaccgaacaactggcgaaaaccaaggaagtgaatgcaaaaaaacaagaggacattgaagtcttataa

SEQ ID NO: 17735 - DNA, 162 bp, Glycine max
  Peptide Sequence Number=SeqID_134513
atgtttatagagagaaaagcttttgggaatcttggtggtgttttttcaaaaaccaggaaaccaaggaagacaggcgcaataagtggccctgttatttttggaggggaattgagaggtaaaaatgagccagaggctcaagaaaaagaaatagaggtttattag

SEQ ID NO: 17736 - DNA, 374 bp, Glycine max
  Peptide Sequence Number=SeqID_134514
atgtcttccaattctgtaatagattatgctgttagtgttatgagggctggctttgagggtgcagtaggagaccctcaaactctattactcaaacaggattgcagcggattcacggcacccaacttgtccaacttcaaccaaaatctaaacgcaagtttggcagacctgagagcagaagtgagcaaccaaaggaagcactttgccacttctcaatcaaccaccggaacgagtcctgtctatgccatgattcaatgcaggaactacctctccaacaccgactgcgctgcctgcctcgccgccgccgacgccaagattcgcaactgctccaccggagctaacggtgcccgtgtcatttacgacggctgcttcctcag

SEQ ID NO: 17737 - DNA, 357 bp, Glycine max
  Peptide Sequence Number=SeqID_134515
atggaggagaaagcagacaacaaacttcaaggaagcgtagcacgcacacactcaaggagactcaagaaaggagaagctcagcttggggaagagaaccctaaacactgcaaacattgtgaccctaaacactgcatgactgaaggtgtctcgccaatgggagaggcgagacctttttcacgtggctacgtggcgtgtctcgccaatggaaacagcggcacccctccacgtcagcgtgtattgtcagtggcaatggcggcaccgtccacgtcagctcctgtatcgccaatggcaatggcaagtcatgctttattgccaatggcattggcggcttccatgcagaatagaccccctacataa

SEQ ID NO: 17738 - DNA, 213 bp, Glycine max
  Peptide Sequence Number=SeqID_134516
atggctgatgcagcatcatcaagattcaccaccaaaaaataccaatggattggcagagcacttagattgcatcatagtcccacccaccttcatttgcatgtgaatcttgatggtgctacatccgcaaacaacgactgtcaatctgtccatgcaactatagctgatgaaaaagaaaggcccccagggggaactgaagggggttgttgccagggg

SEQ ID NO: 17739 - DNA, 393 bp, Glycine max
  Peptide Sequence Number=SeqID_134517
atgaaactatgtttaagtctgtttggaagagcagctctccgaataaagtcttggctttttcgtggaaacttttacatgaccgtttggcaactaaagaaaaccatgattatgaagggtcaagacatttatagtagacaagatgaggttgctacttcaccttcctctagtgaaagtgaagaagcaaaaggggaagaatctagggaagaaattgactcccaagaagaaagggaccttttaatggtcagaaggcttctaggaggccaatcttgtcacttggtaaatcggattgatgctattaaacttcactttatacctactaatgttgatgagaaaaagcttggcctacgtcagttgaacaaaccttcaactgccatcaatagaaaacaaacttag

SEQ ID NO: 17740 - DNA, 687 bp, Glycine max
  Peptide Sequence Number=SeqID_134518
atggttacaaggaaggtgttgtccattacccactatgacgctcaacggagtgcttgtgcgagtgaggaggcccaatctaagggccaattgacccgagagagaatggaaactgatttgggtcgttgtcgggttgtgtgtatcgggcgcacaacccacattcccggcgagaagcaagttcctcaggtgacaatcgctttagaggaatatagttggtggacctcaaaggagtgggtaaaagcggaagcgaaggtggtgagggtatcacggaaagggacaatggggtcggactgggtggaagcctaccacgcaatgtccaacgattgtctaggagcttctcttcttgaagcttggctaacccagtcgcttgtactaggagatgaagcagttgaggaggaatggaggcggaagacctatggtgtggttggccagatcttcaaacttcgagaggggcaaaccttgtttgaaatgcttgcaggaaagtcagccatgattgtcatgatacttgaagaattggttgatcttgaagatccaattgagaggatctgttctgtcaaaccttggaacatccagtttcatgcaataaggggtggacactggaacaaggggagtctattggaggaaactttggaatgggtcgactcgaccattgaagaaggacaacgagagcaccacaatgttaacacttag

SEQ ID NO: 17741 - DNA, 972 bp, Glycine max
  Peptide Sequence Number=SeqID_134519
atggtgagaaccccatcttgtgacaaaagtggaatgaggaaaggaacttggactccggaggaagatatgaagttaattgcttatgtcactagatatggttgctggaattggcgccaactccccaagtttgcaggtcttgcaaggtgtgggaaaagttgtagattgagatggatgaattatctaagaccaaacctcaaaagagggaacttcactcaagaagaggaagaatgcatcattagaatgcacaaaaaacttggtaacagatggtctgctattgcggctgagttacctggaagaacagataacgaaataaaaaatcattggcacaccacactcaagaaaagatctcaacaaaacacagtcacaattgaagaaactagagtctcaaaatcaaagaataacgaatcagttcccaataagggggtaactgttactcttctggctacttcttcccagatgtcagataattcatcaatatccccagtttcatcctcctgcagcgagttttcctccataacttcgtatcattccaccgctgctagctgtatggagaatttggtgtttgaagatgatgacttcggttttcttgattcatacaatgaaagcttctggacacaactaaatctggatgacatttccaacaatgcaccatgtgaaattttttcagaagattccaatggctgttttcaaagtacagatgctacccagatccatgattcttgtgcaaagtctcctacaactagcgaaagtaatattgttgtggataatgactttgtcgactttcaggatgcatacaaagacgcaacggttgataacttttggtcacagacatatgtagctgacatgtcccacgttccaactgaactacttgttcactccgtggcagaatctgaatgttttactccaatatatgatgatttgtggggtcaaagttatttgtaccatgaaaatcatcatggtttattccgatga

SEQ ID NO: 17742 - DNA, 1422 bp, Glycine max
  Peptide Sequence Number=SeqID_134520
atggtgagaaccccatcttgtgacaaaagtggaacgaggaaaggtacttggactccggaggaagatagaaagttaattgcttatgtcactagatatggctcctggaattggcgccaacttcccaggtttgctggtctggcaagatgtggcaaaagttgtagactgagatggatgaattatctaaggccaaatgtcaaaagagggaacttcactcaacaagaagatgaatgcatcattagaatgcacaaaaaacttggtaacaaatggtctgctattgcagctgagttacctggaagaacagataatgaaataaaaaaccattggcacaccacactcaagaagtggtctcaacaaaacgcaatcacaaatgaagaagctagaacctcaaaatcaaaagataaggttcccaacaagggtgtaactgttactcttccagctaattcttctctgatgtcagataattcatcatcatctccagtttcatccacctgcagcgagttttcatctataacatcagataattccactgctgccagtatggaaaatttggtgtttgaagatgatgacttcggttttctggattcatacaatgaaagtttctggacggaactaaatcttgatgacatttcctttgatgccccatgtgaaatggatttaggagatactaatgtctcttttgaaagtacaagttgtagcaatagcaacacccttgattctctgcatggatcaaccagtgaaagtattgttgtggataatgactttggcggctttctcgatgcatacacaaaggcagccgttgataacttttggacacaaccatatgtggctgacatgtcccacgttccaagcgaactacttgttccctctatggcagaatctgaatattttactccaatatatgatgatctggatttggatgaggtcttggaaggtcctgacatgatgttttcatccatcataccatcaaccaccatgtcagtggcaacaaaggcatcccttgtggttgccctatcgcctcaccattatcaaacaaggaagaatgtagggaagaagtggaagaagaggaggaggaggagaaaaaccataatcctattgttcgtgatcgtgatggatagccgcaaagatcttcaacgaatggattctgaagtgttggacacataccactcatggtggttcggtgtggatctgccatggctccgacaaagtcaaacatgctatggactctggttcatgcctcacacgatgaagctcgctttggactctcgctcacttgaatggatccttcttcttccttatcgcaaaatacttgaagtgaagatgaggattatgataaagggcaatgtttggaaaaacaccgaagatgaaatcctaaaagcgattgttatgaaatatggtaagaaccagtgggctagaatctcttag

SEQ ID NO: 17743 - DNA, 321 bp, Glycine max
  Peptide Sequence Number=SeqID_134521
atgggtaccactttttctgttgggcacccaccttattacaatggattagaatacatttatgaggatcgtggtgagagcttgtataagaaaccatttaaacagaaaatgaaaacaaaggtagtgaagcagagacaccaaagagcaagaagagtgaagggtcatctaatgctcagtcttcaagtgttgctgcttctaaacccaagaaacccgtctattcctactgagtggaggagagaagaggatgataagctacttcatcttgctaagcttatgcccactcagtggaggacaattgctccaattgttggccgtgttggataa

SEQ ID NO: 17744 - DNA, 804 bp, Glycine max
  Peptide Sequence Number=SeqID_134522
atggaacgtgtattggctgatgtacttagagatcaaaggaatttgggcaacaagggtgacggaggttggaaaaggtcagcattgaatgctgcaaccgtagtgttatctacaagcttcaatgttaatgtcacatcagataatgtcaaaaaccgtatcaaattatggagatcgtggtatggtattgtaagtgacatccttggccagagtggatttgattgggatggcactaagcacatgatcacagttgagaatgaaaatgcttggaatgaatattgcacttcgcataaatcggctaaaccgtttcgatacaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaaccaagctctaatacaaaaggaaaaagacaaggttcgacttcttctggcacacatcctcacaagagaaagatgggagaaaaagaaggaatagcagcttctttggataaaatggcgaactcttttaaccgaatggtggaaaaaatggatggtaaagttgatgatgaagatattcaagaagtattacgtgagacatctttgataccagatcttaatagacaacaatgggctaaagctattaaatggttagctgacgatccaaaacagttagctattgtgaaagcccttccaattcaccaaaagacaaattatgttttaacacatcttggagaatga

SEQ ID NO: 17745 - DNA, 831 bp, Glycine max
  Peptide Sequence Number=SeqID_134523
atggcagaaatacttctctgcctccagccaacattagaaggacttgaaaaatactttcaggttgcttatgtagctgtaatgaggaatactaccacagaaaataggactggattggaatccctattgagtttctataggagttctatagcatcaagtgcagatccaaatgtagttatagaagttctgaatcttttgttgtctgatgcgattccagatcaagatattatttatgtactagcaggaataagcaatgaaggcagtgaaattgcttggagatggttgaagaccacactgacagtgcatgcaaagaaaccattgcaattcaaggtcagagctgtggtgacagtgaggaataagatcaaagtggatttcaaagagactatgttgaagcatttggatgccatcaatgatagcataggaacaagaaatgttgtgctggagcttatcagcaccgagattgatccaactaggtgtcacaaattgaccatttctttcttccatcattttaatgaattggttctgctacttagaaacgaaatctccaaagaagagcagcaaagcagctggtcgaagaaatccattgtcaaagcagagagagttaattatacaactgaattcattgtggactcgaattttggagtccctggagctattactgtgacaaacaaacaccaaagagagttcttcttggaaagtataaccatcgaagggtttgtcagtggagcagtccatttcccctgcaagtcgtgggtacagggagagaggatattcttttctaacaaggtaactaaccggtcattttccaacttggaaaggtcaaacaattactag

SEQ ID NO: 17746 - DNA, 630 bp, Glycine max
  Peptide Sequence Number=SeqID_134524
atggactgggcgaggttagtttatggactggttatgaagatggacatgggcgtgggcttgctaatctctggacagatatcacagatggcccagtccaactcctctaggctcggcctaccagcactgatcacaaccatatgcttcgcccgaggagttgtcccagactctcttaccttcgagtctctcagccctgccattaatttgggcccgtcttcttctgctccccttgctcttgcttctacaccaacaccatcagtagctctagctctagttccaacacctgccggcacctccactcagagctcagatctcataagcattcataatttggctcagcaccggtcaatcattagtatggaggagtttatagcccaggtggcctggctaggagtccagccttctcctttgggaggaggtggggcttctatagcccaggagcctcagccacaaccggaggttactcttgaggtcagaccagagaccactccacgaacttcaccggtcactacaccacttgtggaggtctctgatgaagaggatgtcactatagacacagatcatgcaactaacatggcaacagcgcagagcacctgggatccctggcccgctacagctcaagagacatcttag

SEQ ID NO: 17747 - DNA, 663 bp, Glycine max
  Peptide Sequence Number=SeqID_134525
atggaaaggacatctttcaaactttcagttagaaaccaacacccctttcttgctcacaggactaacgcttgtaataatgaaaatccaagtactgaggaagaaagaccaaaactttatccgcttgcttcacttagctcaagagcgtacaattcaggcaaaggccttgaagtcggagtgtgtgttaaggatttcttaggagttgcttctgtcttgactgaagaaatggaggtatatggcaaatctatggttgcaggtcctgcaaatgttatttttctgtcaagtattttgggccaagaaggtccagttcccggtcacaaatgcgactggaaatgtcaaaatgaacatgtttgtggaaacatgtatcgctgcaagctaactgggctgactcacatctgtgataaaaactgtaaccagagaattctgtatgacaaccatagctccctttgtcgagctagtggtcaaattttccccctttcacctgcagaggaacaggcagtgagaggcgtacgaaggaagcttgatgcagagaattcgccttccgaaagctgtggttttaagcgtagacggggggatgcccaaatccatccttctccttttgagagatctttctctgctgtcagccctatctgcagccaagttggagatggcatggatatgagctag

SEQ ID NO: 17748 - DNA, 897 bp, Glycine max
  Peptide Sequence Number=SeqID_134526
atgccaacaacaacatcctggaagctcaccagtttgctcattttctttacattcttctgttgttctttctcatacacattcaccataatcaacaactgcccacatactatatggccaggtacactttctggttcagggagtcctccacttgcaacaaccggattccggttagacacaggtcaaagcatcaaacttacgactgttccaggttggtcagggcggatatgggcaaggactggttgcacatttgatgcaacaggagttggcaaatgccaaacaggtgactgtgggggaagactggaatgtcagggaaatggtgccgctcctcctacctcactgtttgagataacacttggtgcaggcaatgggcaagacttctatgatgttagcatggtagatggctacaatttgccattactcgctctaccacgaggtgtatatggtgatgcctgtaattccacaggttgtattactgatattaatagaggttgtccaaaagaacttcaattacttggaggcgatcaaaaccaacgggtagtcgggtgtaggagtgcttgtgaggcattcaagacagacaagtattgctgcagtggagcattcgctaatccaaatacatgccagccttcctattattcaaccattttcaagaaggcttgtccaagagcttatagctatgcctttgatgatggcaccagcactttcacttgcaaagcaaacgaatatgatattgttttctgtcccaacagcaatgggatgagaagaccaaatcttgcagctcctcctccaccaattaggcagcccttttggaagcatcagcaggtcacttcctcatcaaatattttattaccctttccagcgccaatctttctcttggttctcactctttctcatttgtaa

SEQ ID NO: 17749 - DNA, 519 bp, Glycine max
  Peptide Sequence Number=SeqID_134527
atggtcctttttcacctcccaaggttccctctctacctcgttctccctccctcactctccgagcctactccaaaaccaccttcttacggccacccaaatccactctcaccgcctcaaaatccagtcttgaacggtttcaacattctgttgagtaactacgccaatgatgctcaggtattgcaagccgagtttgtgaaaagcagtgtgaagatcgaggattgtcccttcgatggacttcctgagttcgctatcgttggccgctccaacgtcggaaaatccttgctcctcaactccctcgtgtgccgcaagaagctcgccttaatttcgaagaaacctggcaacaaagagaacaggttggatcagatctgcattaaaatgtggggaggcagcagagaagggtcttttcttgagaagtctatcttggagaattattggttggaagaggctcttatggcagccaaaacttgtgtcttagctgatttggttcatcacccttccgctcatccttcctctccttaa

SEQ ID NO: 17750 - DNA, 552 bp, Glycine max
  Peptide Sequence Number=SeqID_134528
atgggtacaagtgcattgctcatctctaaccctgtgagatacataatttcaatttcctcagagcctactcactcttccaaatcgaccccatcgcgcttctcaccgcgaacgccaacaacatctcttaccccaacgtggagcaccacattctcccctcgaagctcttcctcaaagtccccatctcctgctcttgcgtcaacggcattcgcaaattcgtcgctactcactacaagacccgcccctccgacaccctccttcatcactgacgtcgcctatgccggcctcgtctcctccgaccagctccgcgaggctaactccattttcgacccttcagttcttgatgtgggccaaaacctcgtcattcctctcccttgcacctgcttcaatagctccgataactctctccctgcgatttacctctcttatgttgttcgcctcgttgacacccttgctgccattgctgctaggtacttcacgatgaatgttaatgccatgggaagcactgctatcaacgacgatgatatcctcactgttccaatacctggtaattaa

SEQ ID NO: 17751 - DNA, 279 bp, Glycine max
  Peptide Sequence Number=SeqID_134529
atgagtaggagagagaagggtggtgccgccaattgcatttgcgggacacgttcaggggtggtgccacactcccgcctttggagctggcgggatagtggggacgttaattttcggtgcataatcataactaacgagatcacagcagggcctatagcagcctacgttgcaaaggcttcagtctcacgctccatgcttagtcccatcaaactactagctgaacgtgtccctctacttttcatgcttcatcacctgcactttctcatcatatataatatatag

SEQ ID NO: 17752 - DNA, 287 bp, Glycine max
  Peptide Sequence Number=SeqID_134530
atgaaaattgttaaggaatggttcaagtggtcgcagactgtgcttagcatgcttttagtgcaagtttttgcaaccgggatgcagattctatcgagggttatactggttgagggcactttcatttttgcactcattgcataccgtcatgctgttgctgctatttgtgttgctccttttgctttctactttgaaaggcaagcttttcttccctcggatagtttcatagacggcgcgaagaagttgaggtggtcgatttggttttggctcttcctaaacgccttggtggg

SEQ ID NO: 17753 - DNA, 189 bp, Glycine max
  Peptide Sequence Number=SeqID_134531
atggattgtgctcatttttgtggggcaaagggaaggagacgcaatgtatgcttcaagcatctggagaagtttcaacaactatggcagctgagtctgctggagtgcactccacagccacagtggtaccaagtttttcacctaggcatgcagttcttagagttgaaaagaatgacagaaactgaaaagtaa

SEQ ID NO: 17754 - DNA, 1485 bp, Glycine max
  Peptide Sequence Number=SeqID_134532
atgggtaacttagaaggaaaaaggcctggagtactagaagcaaaaggaaggagaggagggtcaaatcggtcagggcgaatgagtcgtcgcatgttaagtgggcagcattggtgggttgggtttggacgtataatgagaacggataggtgggctaagagcatgggaagaatttcaaggattgggagttttgcgatttcttcttccattaaggaaaaccaacaacaaccttgtattacttgcaccacttttaacattctcgcccccatatacaaacgcatcaatcatgaggatccgagttgccgcgagagcgactacagagcttattggttggcgaggaatcacaggatattggattggttattgaatgagaggtcttccattatctgtcttcaggaattttgggttggaaatgaagagcttgttaatttgtatgagaagagactaggtgacgctggttatgtcagtttcaagcttggaaggacgaacaaccgtggggacggtcttctaatagcagtgcaaaaggagtactttaacattcttaattataaggagttgcacttcaatgactttggtgatcgtgtggctcagttgttacatgttgaactggcttctccattttcacaatggcgaaacagtaatattaggcaggaaattttgattgttaacactcacctcctatttccacatgattcaactctatcccttgtacgattgcagcaggtttacaagatacttcaatacgtagaatcttatcagaatgatttccaactcaagccaatgccaatcatgctttgcggtgactggaatggaagcaaacgtggacatgtctacaagttcttgaggtctcagggatttgtatcatcttatgatactgcacatcaatacactgatgcagatgctcacaagtgggttagccaccgcaatcatcggggaaatatatgtgctgttgattttatttggcttctaaatcctgacaaatatcgaaaactactaaaagcaagttggagtgaagcagtttttggcatgttcaagtatctactacggagagcttcattgactgagagtgatgcattttcctttctaaaggttgataacgaagattgtattacctattttggtttctgtgaagcacttaaacagctcagtttaactggtcactgccatggattgagtgaggaagagataaaggacttgtggctccaagcagatgtagatggaaaaggtgttcttgattttaaagaatttctgcagcaaatctggagttcaacagctccagatagagatgacaacaagaatggtgatcaggatgacggttcaaatgatgcacaggagcaaacaattggcttcagtgtgaaaaatgcagttttgttccctccagaagtagagaaaggtagatggcctgaagactactccctttctgatcatgcacggctcactgttgtatttttgccgataagaatgccatgctcccagttgatttgctaa

SEQ ID NO: 17755 - DNA, 1749 bp, Glycine max
  Peptide Sequence Number=SeqID_134533
atgggttcggtggactgttatccttctcgtacggacgatgctgccgtggtgtctttggattcgctgcctttagggttccgattccgacccaccgacgaggaactcgtcaattactacctgcgacagaagatcaatggtaatggtcgccaggtttgggttatccgagaaattgatgtctgcaaatgggagccttgggatatgcccggtttgtcggtggtacagaccaaggatccggaatggttctttttctgtccacaggaccggaagtatccaaatgggcatcgattgaacagagcgacaaataatgggtattggaaggcaacggggaaggatcgtagaatcaagtctgggaaggatttaattggaatgaagaagactttggtgttctacactggtcgtgcacccaaagggaataggaccaattgggttatgcacgagtatcgtcccactttgaaggagcttgatggtactaatcctggacagaatccatatgtcctttgtcgtttgtttaagaaacatgatgagagccttgaagtttcacactgtgatgaagcagagcagactgcttccactcctgtggcttactccacagaggaaatacaatctgatctggctgttgttgcaggatccccctcacaagttaccgaagatgataagcaccaggcaatgatccctgcacactctgaggaagcaatatccaatgttgtaaccccggttgtttgccgtagtgacagatatgatgcttgtcatgcaccaaatcaaattgtattaccaactgcggaggagtttcaaccattgaactattatgacccaagaaacgagctattggatgataaattattctcccctgtacttgcacatattcaaccagaatttcattatcaagcaaacatcgaatcagatgattggtatgggcttcaatatggtacaaatgagacaaacatgtcagactttttgaattcagttgtgaattgggatcaagtatcctttgaggatctcaattgtcaacagcagagctaccccttgtttaatgttaaggatagcgtattaagcagcgatctagattctgaacttgccattatgacatgtatgcatgctggttctgcggaggggccaaataacggaaggaaacctttggtgataacttcagaatttcgcagcaccactggcatccctgttgactgtggtggtgacgagcaaaaaagcaatgttgggttatttcaaaacaattcccagagagcttttactgatgttaatataggccaagtatataatgtagtcgatgattatgagcaacgaggaatctacagtgcagttgctagtggcaatactggaatcattaggaggcatcgtgaggtacaaaatgaacagctaagctcaaattcaacccaaggtactgcacagagaagaattcgtttgtcaatggctacacatggctcaaataagatggtgaaaagtggaagttgtgcacaagaagagcttaatttaaaatccgtcattgctatggaggagaaagcttcagaaagccatatttctgatgaaagttctactcttactaatgacgggaatgaactgccgaagacatccaaatcatccggcaaaagaaagatttctcgacaagctacaaaagcaggctcaaccttggggttgaaagactttttattgctcagaagggtgccttacatttcgaaggcttcctcaaatcgtgccaagtgctcttctgtttttgtagtttctgcctttgtaatg

SEQ ID NO: 17756 - DNA, 483 bp, Glycine max
  Peptide Sequence Number=SeqID_134534
atgaaaacacccaccaccaaagtggtgaatctgaagacgaaaaagtccctttcgaaacgtccacgactacaagatgtcatcgacatcgacacccccatcagggccatagcttgtctcaaaaaaatcgacgacatgcgccgcttcgaggaaaccgaggattgcttcatcctaggtttcgacccttacgccgccgttggcctctcggttgattcttctgccgatgatgtctccgtcattgctgaaaagggcaaggttgcttgcagagattacccccactcaagacatttgtgtctcaaattcccgtttaagaccacgcctcatgagagctattgtgaaaagtgctattgttatgtttgcgataaggttgccccgtgtaaggactggaagggctggcattgcaatgcagagagtggtatttactggaagaatcaaaggaatgtgaagaaaattcaaccagcgcgtctctattattctcaaccataa

SEQ ID NO: 17757 - DNA, 3402 bp, Glycine max
  Peptide Sequence Number=SeqID_134535
atgaagggtgttggaggatatcacgattggccttattacgcgtcgccgacttcaaatttatcagctttcgcggcgccttttagtgtgaatccctacacttcaagcgaggcttcgtctcagttcatggatacagctgaatccgcagaaaccctgcccccaattcagtttcaaccctaccggtacgatttcttttcgggccccgttagagaattggattccgctgcgcaattctctcatctgggtttgccttcttattccgcaagatcgaaccttgtcgaagcccaaccctacactgcgtcttctgcaattcacgatcactcttctaattcggcggcgccatatcattggtcttctggggctccctcttccgattggccttctctcagggaagctaataggtctcctgaattagggttttctggtcagagtgcggtttcctgggaccagtttccggagttcaatagccgtggtaaagggaaacaggtcggagttgggagcaatctctccgtaaaggaaacaaatgcggctggttcggttggtgaacaaaggaggaaccaagggaatcaagatgtgaaggactcttctaattgtgaggttccacaaattattgattgggaaaactacaatgtgcctgcaagtgcaaatcatatacataatacatctaactggtggggaactatcaaacccatgccagttgaattttctggtacctctgttatgcaatccccgtcaatgtctctagaaactcatcatgagacccctttgaaagtagttgctgattcagggaacaatcactcgttgaacattggttcatattacaaacactcaagtcatgttgataaaccttcaagagttgacactgtttcttcaatgcctggaacaatgttggttacagatttgaatgtccaggatattatagcagatgaacatgttgggcacgatgatttctataatacaaaggaggcttctcacatgcctagtcctggaactgctggattgtttaatccaggtcctatccatatgcatctaagaagaaatgaaccttcctcctcaaacaaagcaatgatttcagacaagaatgtttcgaggaatgttgctgattatatatttagagaaagtcatgaatttcaaaatcctcatgcaaatatggataatttaagattgggacttagtgctattgaagatgtcaattttgttgagaaatcttttgagggtggtgaccgatgcaatcctgctgaagactcaccttgctggaagggagcttctgctgctcgcttttctcattttgaaccttctgcagctctgtctcaagaatatgtacacaaaaaagaaagtagctttggttctgtcattaaggagcctcagaattatctgcttgatacagaaaacaatatgaaaaaatcatgtggaaattcaaatggctttcaaatgcatactggaattgtctatcaggacagaagttcagcaggttctccaaggagattttcagtaacaaagtttgcacctgaatattgcaagtcaggtagtgctctgaatgatggtccttttcaatctaagcctagctgtgattttggacttcaacaatatgtggatattaccaaaatgaaggaaaatactgtgccaccagccaagccaactgactgtgagtctggatcttctcagatggggcttcaacttgtagatttaaaggaatttattactcaaaaacagcaagctttattatgcacaggtgatgtaaattctggatgcaatgtgaataattgctcggaatatgattcatctcacactgctgaacatgtcctgcctttaccttcttcagtattagatgcaactacacctgaaaattcagctgggaaagcgtcaactgaaaaattggatgtccaaatgctgcttgacagaatgcaaaatttatcagaattgcttctttctcattgcttaaatgatgcctgtgaatggaaagagcaagattgcaatgtccttaaaaatgtgatcagtaatcttaatacatgtgctttaaagaatgaacaaattgcccctgttcaagaatgtcttttcaatcagccagaaacttctaagcatgctggcgaatcacgcaagtttcgccagctatatgagaatgtacttgtggttacaaggattttaatgcgactttctggtgatgagtttgggataataatggattgtagtaacatagctcaaagagtgctttacctgaattcatgtttgaagaggccacaattaaccaagataggaccagagagctctaagattgagtttgagaatccacttgttgcagaggcaaacttttgtttcaggtctgggaaaccacataggaagctttctgattccatttccccaagggttgatacagaaatgacaaaggctgataacatgactaaggatctaaagaggattcttagtgagaatttccatggtgatgatgatgaaggagcagagcctcagactgtattatataagaacctgtggcttgaggccgaagctacactttgttctgtatattacagggctcgctataatcaaatgaagattgaaatggataaacattcttacaaggaaaaagtgatggagaagcaatctaaatctgaggtcattccgactttgagccagagtcagagttctgcaactaaagtgcattatccaaaccctgattcttctgcggaccttaaatttcctgtcttggatgttaccaatctagaggaactatctcgcttgaatatttccactgatatgaacaagtctaatgcaataacacctgaaggaagaggtcaaaacctggatagcttcatcgataattatcttgttccctgctcagtcaataagactgaaagaaatgatgagtcttctgttatgatggccagataccaagttctcaaagcccggattgatcagtcatccactgttactaccaatctggaggaaccattagacgtagcagacagctcatcacctagagggagggataatcaaaaccaagttaatctatgccaagattcccctattcctgaaaaaaacagtgctgaatatgaaacatctgttctggctaggtttcatattcttaaatcccgggatgaaggttcaagttctatttcttcagaagggaaacagttacatggagatgaatctgctgctgtcgaaggaatggatggcataacagttgcaacaaatgtatctgagggtaaaagtttggatgtccatgcaaatcctgttgtggtgcatctcaattcctacactgccgtggacaagtcaatcccaaaggagtttcatctggattcggaggacaatcaagaaactcagcctagcggaacctgtgagtttcagcctcctacttactactccgatggcttcgcgtcagactgggaacatgtggagaaaagcttgtag

SEQ ID NO: 17758 - DNA, 498 bp, Glycine max
  Peptide Sequence Number=SeqID_134536
atgaggcactttatagctgttgcaacattggcaagtggtgctgagggttcaaagcagagcagaagtgagaagaagagtcgaaaagcaatgttgaagctgggactaaaacctgtcaccggtgttagtagggtcacaatcaagagaacaaaaaatattcttttcttcatctccaaacctgatgtcttcaagagtccaaattctgagacctatgtcatatttggtgaggcgaaaatagaggacttgagctctcagttgcagacacaggctgctcaacagttcaggatgccagatatgggatctgtaacggcaaaacaagaagatgctgcagctgcagcagtgcaacctgaagaagaggaggaggttgatgaaactggtgtggagccccatgacattgatttggtgatgacgcaggcaggagtgtcaagaagcaaggccgtcaaggctctcaagactcacaacggggacattgttggagccatcatggaactcactacttaa

SEQ ID NO: 17759 - DNA, 204 bp, Glycine max
  Peptide Sequence Number=SeqID_134537
atgggggcgagaagcagagccaggttgggccactatggcaactgggtatgtgtaaggtatgccaagcttgtcgagttcatggagaatattgtgttcttggagttcgagaatctcttttggagccgaacagggtcgaaagggaagtggatgatgacaggaacacaagtaacagatgaatggagttcgagaatctctcaaaactga

SEQ ID NO: 17760 - DNA, 291 bp, Glycine max
  Peptide Sequence Number=SeqID_134538
atgtctccaggtcctgttgtcgacgcttcccctgaggttgaagcagagcaacaacttccctccgtcgatgacgcaacccagttgaagaaatcccaaccgcagggtttcttgggttggactcgtttctgttcaagtttcttgtctcatttccgtgattgctgtcaggaggatgatgctcccgttgtcgaggacgtgagggatgatgacaaggacgacgacgatgaggacgacgacgacgatgatgaagatgacaaggaagacgatgctctaggtcctcttctctttcactaa

SEQ ID NO: 17761 - DNA, 135 bp, Glycine max
  Peptide Sequence Number=SeqID_134539
atggctggaaattttgaattacatgcgagtgttttgaattatgtagccttcaatgctcgctcaaattcaggagcagcgctgccatttggctatctgttatgtgtagtttcaacttctttcaagcaatgtaactga

SEQ ID NO: 17762 - DNA, 252 bp, Glycine max
  Peptide Sequence Number=SeqID_134540
atgtttgcattcaaagaaaacattgttagggcaaccgggtgtggggttcagtggagttcttctctcatccacattcttttaccagcggtgggggtgcgggatttggggatgaaggcggagagggaagtggaggagggttggtgggagacggcgacgtttgtgggcggtggtgggtgcgtctcgacagaaccgccggaagcggtggaagagtggtcggagacgtggaggactatcggagaaggaaaaaggtaa

SEQ ID NO: 17763 - DNA, 1158 bp, Glycine max
  Peptide Sequence Number=SeqID_134541
atgggttcagcagctgagactcagattactccaacccatgtatctgatgaagaggcaaacctttttgccatgcaactagccagtgcctctgtactccctatggttctcaaatcagctcttgagcttgatctgttggaaatcatagccaaggctggccctggtgttcatctttcccccactgacatttcttctcagcttccaacacagaaccctgatgcacccgttatgttggaccgcattttgcggctcttggcttgctacaatatcctttctttttctctccgtactctccctgatggcaaggttgagaggctctatggtctcgcccccgttgctaagtacctggtcaagaccgaagatggtgtctccattgctgctcttaacctcatgaaccaggacaaagtcctcatggaaagctggtactatttgaaagatgctgtccttgaagggggtattccatttaacaaagcatatggaatgacagcctttgaataccatggaacagatccaaggtttaacaaggttttcaacaaggggatggctgatcactccacaatcacaatgaagaaaattcttgagacctacactggctttgagggtcttaaatctctggttgatgttggtggaggaactggagccgtagtcaacatgattgtctcaaagtatcccactatcaagggcattaattttgatttgccccatgtcattggagatgccccatcttatccaggagtggagcatgtcggtggagatatgtttgtcagtgttccagaagctgatgctatttttatgaaggtgaatttcataatccgaatccctttcaatattttacctattctagaaaggcctttcaagtggatttgccacgattggagtgatgagcactgcttgaagtttttgaagaactgctatgaggcacttccagacaatgggaaggtaattgtggcagaatgcattcttccagtggctccagactctagcttggccacaaaaggtgtggttcacatcgatgtgatcatgttggcacataatccaggtgggaaagagagaacagagaaagagtttgaggctctggccaaagggtctggattccaaggtttccgagtcctgtgctgtgctttcaatacctacgtcatggagtttctcaaaaaggtttaa

SEQ ID NO: 17764 - DNA, 915 bp, Glycine max
  Peptide Sequence Number=SeqID_134542
atggatcttgggatgcccgctcggaagaaggaagtcgtatctgttttctggattctacccctccatggcaagcgtagcaaaagtggtcaagatcttagcacaagagttagaccgagtgaagcaaaacaggaatggggtggtagggatgccaaggaagcacttggaggaaagagcagaagctttagcaaatcaaggagagtagacatgtctgccccttacaaggtcatcgcatgtgcgccgaaaagggaaaagaaaattgggaggaactcttggaaggagatcatcacacctttcatcgtacggggtttcaatgaaggcaatacaaaaatacttcagagaattcgtaaagcgtgggacacagtggaaaggaaaaataaggaacttaggggaagcagtaacggaccaagtggggaagaagctaaggtccctaaggaaaacgaagaagtgcaagccttgaaagtaaagcttgaaagaaggagaatggtcaagaaaaagctaaagatgacagtcattaggggaagcaacaacaagctcaagcttagaagggccgaaagggacgagtcaagggtggaaagcatggcattaaaggataaattgaaggcttgtcataggtcaaagagaagtttgaccgaacaatcgagtggaacggaagagaatatgttgacgatcattgatcagtataaggagaaggtaaacctagctgctagtcttaggcagagactagaggatgagcatgcgaaggtattgactctgcaaatggaaagggaagcaagagagagggtgatagaatcattacgctgggaagctgtgaaatggatggatagattcgctctcactctgaatgggagtcaagagcttccaaggttattagcaagaaccaaggcaatgacggaagtatacttgactcccgatgaa

SEQ ID NO: 17765 - DNA, 390 bp, Glycine max
  Peptide Sequence Number=SeqID_134543
atggaggccaagaaagagaaaatggccacaatgatggaggccatgatgagaatgaagaagataatggaggtcaatacgactgtagttgccactaccagcaccattgttgaggtggacctgacccccccatatggcctcaaccaaataaatcatccaacctcagatatggtaggtctggaaggcaaagagttgggagcgggtaaaatccctcctgctatggcagaaatgagaaagttggatcatctagaggaaatgctcagggccattgaaggaggcaaagattatgcctttaagagttattccaagtacccaatgtcgtcacccctctcaagttcaaggtcccggactttgacaagtacaagggaactacttgccccaagaaccatctaa

SEQ ID NO: 17766 - DNA, 219 bp, Glycine max
  Peptide Sequence Number=SeqID_134544
atgaggacgcgtagccctctaaaggcgagggcgtgcagctctttgcaggcaaggatgtgcagtcctctgatggcgaggacatatggtccgcgtaaaggtgatagattgactgtccttttgaaaaagctgggaacctattgggtgaaaacttctaatctgcccctaggttcgcttgaggtttttgcatggggcctttcatttccccaatgtagggcttag

SEQ ID NO: 17767 - DNA, 260 bp, Glycine max
  Peptide Sequence Number=SeqID_134545
agccctatgaattgattactattcatccatcctccaccattgagttcggagccccacaaattgattgcctagcgctgttcgtgcatcctccaccatcaagttcggagccccatgaattgattgccattcatgcatcctccaccatcgagtccggagccccacaaattgatttgcctagcgctgttcgtgcatcctccaccatcgagttcggagccccacgaattgattgcctagcgctgttggtgcgtcctccaccataa

SEQ ID NO: 17768 - DNA, 201 bp, Glycine max
  Peptide Sequence Number=SeqID_134546
atgagatacttacttgttggagtgagtaggagtaccaaaaatgaaattaaaatgcaaccaaaggtggcttgggggagcaaaaaccgtgagtcctgggctcctcgcccaggcgagctaacctgccattttttttacgttgtcatgagtatggccctctatgggctggcgtttgcttactcgaacccactcaaggtagattaa

SEQ ID NO: 17769 - DNA, 204 bp, Glycine max
  Peptide Sequence Number=SeqID_134547
atggagaaatggctccaaagaaactctctacgaagaggtctagaagagatgccacaggagaaaggatccagtgctgccccagagtttgatagtcatcgtttccagagtgtcgagcaccagcagtgcttcgaggccatcaggggatggtcattacacagggagaggcgtgtccagctcaggaaggatgagtatacggacttttag

SEQ ID NO: 17770 - DNA, 294 bp, Glycine max
  Peptide Sequence Number=SeqID_134548
atgtatggattcctcgagccacagtccattcagagatctggacaatcgcaatttgaatcggaaagttacatcaagagttggatgcagagttcaaaacacgatgtttaccttggagcctacctgaatggacactggcaaatggttgtcattttgcctaaggaaaacctagttgtctggtttggttctttacataataggctagacaactaccttaagggaataattaacagtataatagacaaaaaggaagcactaagtgcggctattatgtcatgcactggatgtccacgataa

SEQ ID NO: 17771 - DNA, 812 bp, Glycine max
  Peptide Sequence Number=SeqID_134549
gcctgaaaaccggcaccaccctgcagggcgacctgaaagccgctatcgagcgtgattttggttctgtggacaacttcaaagctgaattcgaaaaagcggcagcaacccgctttggttccggctgggcgtggctggtgctgaaaggcgacaaactcgccgtcgtttctaccgctaaccaggactccccgctgatgggcgaagccatttccggcgcttccggcttcccgattatcggcctggatgtgtgggaacacgcttactacctgaaattccagaaccgccgtccggactacatcaaagccttctgggacgtggttaactgggacgaagcagcagcgccaaggagagcagcaatgcattatccggtgaatgtctttgtcggcaaaatcagggactacgacggtagccgccccagtgcaattggcaaaatccaggtcgatggcgaattacagctcggcgatctcgggctggaaggggacgagcaggcggaaaagaaaattcacggcgggccggatcgcgcgctgtgccactatccccgcgagcattacctcgactggatccgcgaattcccgcagcaggccgatctgttctgcgcccccgcattcggcgaaaacctttctactgaagggctaacggaaaaaaacgtctatatcggcgatatctttcgttggggcgaggcgctgattcaggtcactcaaccgcgctctccctgcttcaaactgaattaccatttcggtattagcgatatggcgcaactgatgcaaaacagcagcaaggttggctggctctaccgcattatcgccggcggccgg

SEQ ID NO: 17772 - DNA, 348 bp, Glycine max
  misc_feature (109)..(109): n is a, c, g, or t
  Peptide Sequence Number=SeqID_134550
atgggcctctgccagtcctacggagttcccgtcacctccagtaaggccacaggcgcaccgccaccaccttggcaggttgacccagctgggccactgggcgtggagcatnatctacagcatttggtttgccagcaggcggccaaccaccatgggcaagggcagggttcctccccttttgtatgccctactccggagcattatggggctgacgtcacatggcctggagactggcccaatgcccaggcaggggaggagtctgcaggatccctcggtgaggcgggtgaatcccatatggatgaagatatgactgacctgctcaatttcttgggagagagcggagccacgtga

SEQ ID NO: 17773 - DNA, 309 bp, Glycine max
  Peptide Sequence Number=SeqID_134551
atgtcaatccttatcctcagaagcaaaaaagaagagaagggaaatttccaatcaaagaaaaagagaaggaaaatttccaatcaaaggaaaaaaggaagcaagggaattcccaatcatgagtgggagaaagaaaacagaaaagaaagaaaattcccaaccaaaggatgggagaaagtaaagaaaaaaagaagaaagctcctggtcaaagaaaccagaagaaatgtgcagagaggaaataatttgcaaagtcaagtgatgatatatctatggttcagaattagtatgaaacacttacctgtgcgagattga

SEQ ID NO: 17774 - DNA, 159 bp, Glycine max
  Peptide Sequence Number=SeqID_134552
atggcctttgtggataaatgggtggtgggtaaggaggaggtttgttattggctgagtaatgacattgttggtcgtcctagtaggatgatcaaatttgcctcttttcggacccacatcgatcctttcactggcgaagaccaaatccgcaaagctttgagg

SEQ ID NO: 17775 - DNA, 1101 bp, Glycine max
  Peptide Sequence Number=SeqID_134553
gccgcgcgcagccacgtcggtggccaccaggatttccagctggcccttctggaagcggttgagcaggctctcacgcttcttctgcggcacgtcgccggacagcacgcccacgcggtagccggccttttccagcgaacgcgccacacgctcgacgaacaccttggtgttgacgaagaccatggtgcgcgcgccttcgctgcgcgacagcaggcccagcagcagcgggatcttctcgtcgtcggccgggaagtagatgcgctggcgcacgcgcgcggcggtgatggtctcggcttcgaccaccagcttctgcggctcgttcatgtgctcgtaggccagctccagcacgcgatggctgagggtggcactgaacagcagggtctggcgggtggtgcgctccggcatgcggcgcagcaggaagcggatgtccttgatgaagcccaggtcgaacatgcggtcggcttcgtccagcacgcagatctcgcaggcgtgcagcgacaccaccttgtgctgcttgacgtagtcgatcaggcggcccggggtggcgatgatcacgtccacgccctgctgcagcagttcgcgctgcttgtcgtaatccacgccgccgtagaccagcgcgaaacgcaggcccaggtcggaaccgaacttcactgcatccttgtggatctggatggccagttcgcgggtcggggcgaggatcagcgcgcgcggatcttccggcttgcggtcggccagggccggacgcgtcagcaggcggttcacgacggcgaccaggaaggccagagtcttgccggtgccggtctgggcctggccggcaacgtcaccaccgggcagcgcgacgggcagggtcagcgcctggatcggggtgcaacgggtgaatccggctccttcaaggccggcctgcagggccgggtgcaactcaaaggaggaaaaggtcaaatcggtcagcggtttgtcgctcatgagtccgtcttggtatggccgccggcccgtggggcggctggcacttcagcgtctaggggcaccgtcgcaaactgcggcccctgcggcgggttggcaggctgggaccacccggtccgcgcgccgcacaatgccccagtttaa

SEQ ID NO: 17776 - DNA, 393 bp, Glycine max
  Peptide Sequence Number=SeqID_134554
atgacaaaagggtgcacagtgaccataatttgtctctgcgtgccatcggacacgactgtgtctgaatggcaaaaggtgtgcggaatgaccataatttgtctccgcatgtcatcgggccgccgcctctggatgacaaaagggtgcaaaatgaccataatttgtctctgcgtgccatcggacacgactgtgtctgaatggaaaaggggtgcgaaatcaccaaattttgtgtctgcatgtcatcgggcctgccgcctctggatgacaaaagggtgcagaatgaccataatttgtctctgcgtgccatcggacacaactatgtctgaatggctaaagggtgtgcggaatgaccataatttgtctccgcatgtcatcgggcctgccgcctctggatga

SEQ ID NO: 17777 - DNA, 511 bp, Glycine max
  Peptide Sequence Number=SeqID_134555
atggctgaagtaaatgaggtgcaagagctgatgaaggccgacatggaggccatgaaagaacaaatggtcacaatgatggaggccatgatgagcatgaagaagataatggaggtcaatgcggctgcacgattgcacgccctcgactttagaggactgcacgtcctcaccttcagagggctacacgccctcgcctttagagggctacacgccctcgccttcagaggactacacgtcctcgccttcagaggactacatgtcctcgccttcagaggactgcacgtcctcacctacagagggctacacgcccttgccttcagaaggctccgcgccctcgacttcaaaggactacacgtcctcgccttcagagggctgcacgccctttccttcaaagggatacatgtcctgaccttcagaggtccttaccttcagaggactacaagtccttgccttcagagggctccatgtcctcgccttcagaggactacacgtccttgccttcagaggactacac

SEQ ID NO: 17778 - DNA, 258 bp, Glycine max
  Peptide Sequence Number=SeqID_134556
atggccaaatttgaccctgagatagtcctagagttctatgctaatgcttggcccatggaggagggagttcgagacatgcgttcgtgggtgggggggaggtgggtgcggatcatgcgcaccagcaagaccactttgacccagacatggatgacactgctgctcaacaacgtcttgcctagcgatcataactctaatctccctctacctaagtgccagttggtgtatggcgcccaccaggcaccttgtggacccagataa

SEQ ID NO: 17779 - DNA, 348 bp, Glycine max
  Peptide Sequence Number=SeqID_134557
atggcgttctgtaataaggttggaaatgtcttgaggcagggtgctgctcgcagcacacatgcccctgttgcgtccatgcttaattacatccgctgcatgtcttcaagcaagcttttcattggaggcctttcatatggagttgatgaccagtctcttaaggatgcattttctggctttggagatgtggttgatggtaagttcagcctgctttcattgttgtcatatgctgtccaatttcagtccggtaccgagctcgaattcgtaatcatggtcatagctgtttcctgtgtgaaattgttatccgctcacaattccacacaacatacgagccggaagcataaagtgtaa

SEQ ID NO: 17780 - DNA, 226 bp, Glycine max
  Peptide Sequence Number=SeqID_134558
tctccgttggtggtcccgtgaagtatttgaagatttggtggtcccgtgttccgtatttgaaattttattagtggctgttgttcctatttcgtcggaggtccggaatgaccacttccggaagaaggtcttccggaagttacgaaggccaattccggaagaaggtcttccggaagtattttccggaagcacttattccggaattggccttagtaacttccggaagaag

SEQ ID NO: 17781 - DNA, 278 bp, Glycine max
  Peptide Sequence Number=SeqID_134559
gtgtcaagggaaggagcccagagtatgaagaacctcgggatttgaggtcaaatcctttccaaggtggaggggatgatgccatgagttgccgagaaaaaaaggagtgttatgaacaacaatggatcactcataaactctccccagggcaaccaggcggggatcaacacaactcccctttgtgcttactcgaggacttgagggaccaactagaggctccgaaggcagtgcaagtccctgagattgcatctaggactgaaactaggactacatctggctga

SEQ ID NO: 17782 - DNA, 303 bp, Glycine max
  Peptide Sequence Number=SeqID_134560
atggcccgcacaaagaaaacatgggagatgacgactgaggtcacaaaggaaatcgctaagaagatcgattcctttgaggagcaggcgacacagggatccttcgtcccccatggacgtcaggatgttctcactgctgctattggacgtctagagcaccctggacgtgtccgtgctgctggagccggtgtcaccatcaagcaatacttcagattggctccacggacatcccacaactcttccttactgtctcctaaagaattgcagcagctgacccagcaaatcagggaccagctagaggagtag

SEQ ID NO: 17783 - DNA, 159 bp, Glycine max
  Peptide Sequence Number=SeqID_134561
atgggtggtacaaatcaattgtgtcaactaagatttggcgagaatatactacaaaggatgggaagggaaaacagtgaaggtgactcacaattcacaggctataagctaggcataggtgcaacttcaccatcatctacacatttagtagactttctttaa

SEQ ID NO: 17784 - DNA, 450 bp, Glycine max
  Peptide Sequence Number=SeqID_134562
atggggtcggaccaagtgccaccttttaaaaagaggttctatcatgtcaaagtcaagaatctagagctagctagattgcgaaaactagggcaatggatggatcaagttcagtgccaagccttcagcaagatgcttcacttttggggactttcagttagcaccaaccatagaggagtccgaagggatctcaggatgcccgctagggggaggaagccataccttttttctggattctatccttctatggcaagaatagaaaaaatggtcaagatctcggaacaagagctagactatgtgaagcaaaataggaatggagtggcagggataccaaggaagcgcttggaggagaaggcgaaagctctggctagccaaggagaatgggcagcattcatcaacgtattagctttgctagtgtttgggacgatactattcccgaatgtagacgggttg

SEQ ID NO: 17785 - DNA, 420 bp, Glycine max
  Peptide Sequence Number=SeqID_134563
atgagattattacagtccattgatttttcgaggaatcaactttctggtgaaatccctccaagcattgcaaatttgagctttctgagcatgctagacttgtcttacaatcatttgaagggaaatattccaacaggaactcaattgcaaacctttgatgcctccagcttcatcggcaacaatctatgtggtccaccactgcccataaactgcagctccaatgggaaaacccatagttatgaaggaagtgatgggcatggagtaaattggttttttgtcagtatgacaattggatttattgtgggattctggatagtgattgctcctttgctgatttgtagatcatggcgagggagagtagctgaacgtaaagaggggaaggataggaggtgtggggaaatggaactaaggataaccaagtaa

SEQ ID NO: 17786 - DNA, 249 bp, Glycine max
  Peptide Sequence Number=SeqID_134564
atggctttgtgttcagtttttctcaatcttcatcttctgctttttgtttctagttaccttagccaggagatattggcagagcaagaagctgatagagtgcatggattacctgcgcagccttcggtgaagttcaacaatatggtggttatatcactgccaatgaaactcaaggaacaacactgttctattggtttttcgaggccactcacaaaccagaacaaaaactcgttctcttatggctcaatggag

SEQ ID NO: 17787 - DNA, 153 bp, Glycine max
  Peptide Sequence Number=SeqID_134565
atggcacccctctggcgacggtgtcattggaaagcacggaccaaaggtgacgcggaggtagctgaaggcgtcgtcggtgtcgggcatgtcgacgacaaactcagtgtatcagaaggcgaagaggagggtgcagaagccgacaatggcaattaa

SEQ ID NO: 17788 - DNA, 276 bp, Glycine max
  Peptide Sequence Number=SeqID_134566
atgatacgcggagataccttatggttattcgcacccttttgtcatccagaggcggcgggcccgatgacaagcagagaccaagtttggtcattctgcacccttgtatcatccagaggcggcgggcccgatgatacgcggaaatacccgagtggggctgacacagtcttctgcaccttttgttcctccgggaacaacaaagtcatttacatgcggaaatttcatggtcgcccgcgactctcgtcaaccgagaagagcgaaattagtgtcatacactga

SEQ ID NO: 17789 - DNA, 678 bp, Glycine max
  Peptide Sequence Number=SeqID_134567
atgacttccattgcccagtctaactcttccaaacttgggtttcctgctttgattaccaccttatgccaagcccgaggggttgtctctgacagcctcacatttgagcgcctgagtctagccattaacttggcctacatcaggaagaactgttggaatgttgatgatctaacaattgctttccggggggctaggagggcgagggcgaggccagctgatattccatctacttctgcagctccagcacctactctagcatctacttctacagcgtcttcaatcccagctcatgttgacactcagcgctttaaagccatgcttcaaagtgaaggtcccacaacccaggtaccccaacaggtacaagatgcttcctccgagaccaccattccagagccattcactcttcatcctaaggcaggggaagaacaagtgagaccagggactactgctactcctaagagatcacttgagggcacatcagagcctccttctccagtggtagacctctcctcaccacagcctgcagctgacctttccattcccagacttgagatactaggggacctggccacaccagtcctggcactgaacacctctcctccagctactctagtacttcacttgacagatgaagaggatgctcagactcaggatacccaggatctgtctcaaggattttaa

SEQ ID NO: 17790 - DNA, 321 bp, Glycine max
  Peptide Sequence Number=SeqID_134568
atgacgactttttgcaaatccagaagaaagagattccttacaatccaaaccataagcccaaatgagaagttcattttcatggggaatgaagtgaaagctccagtggcaatagttaagacttattgtttaaaatgcaacactggacatcgtttagatttactggaaactccttatcgtaatcatatcgttggtactggtatcctttatgatggtttatataaattgaaattagacagtttgtatgctgaaactgttttgactctgcatcataatgttggcactaaacatagtttagtgaatgaacgatctgctttcttgtga

SEQ ID NO: 17791 - DNA, 492 bp, Glycine max
  Peptide Sequence Number=SeqID_134569
atggtttccaattcccaacaatttagtgccagaaatgatgctattgtcattagaggagtgcatgaggtagccacaaattcatcttcatcagctgaaactaagaagcttgagggtaaactagatgccttggttaacctggtaacccagctggccatgaatcagaaatctgtacctgtcgcaagagtctgtggtttatgctcctttgccgaccaccatacagacctttgcccttctatgcagcaatctggagcaattgagcaggctgaagcttatgctgcaaacatttacaatagaccccctcaaactcaacagcaaaatcaaccacaacagaacaattatgatctctccagcaacagatacaatcccggatggaggaatcacccaaatctcagatggtctagccctcaacaacaacaacaacagtctgctccttccttccaaaatgctgctggtcctagcaggccatacgttcctcctccaatgcaacaataa

SEQ ID NO: 17792 - DNA, 195 bp, Glycine max
  Peptide Sequence Number=SeqID_134570
atggcaccactatttatgatacatatcatgagtggaaaacaatcacatttccataagttcagagtggttgttgtccgtcctggctcctgctttactttcattcttggtttaaggctccaaaaggtgttagggaagtacattgggtactatgagagcaagtgtgtaaggaaaaagaggaaggtggacttggagtga

SEQ ID NO: 17793 - DNA, 105 bp, Glycine max
  Peptide Sequence Number=SeqID_134571
atggagaattggcgaacagcgctaggcaatgacattcgcggagctccagactcgaagggctccagattcgaaggtgggggacacatgaacggcgctaggcaatga

SEQ ID NO: 17794 - DNA, 207 bp, Glycine max
  Peptide Sequence Number=SeqID_134572
atggcgtcaaggacgaccatgttggccaccaattccaagccattggtgaatggtcggaacgatgaagcgggaatcggagagaatcttgtggggaataatgggtttgcagtgagggcagtggaagaagaagaaaccctagatgatagctttgatgcaatgcgaagcacggttggagaaataatgtgtggggtttcagaaggggtttag

SEQ ID NO: 17795 - DNA, 345 bp, Glycine max
  Peptide Sequence Number=SeqID_134573
atggcgcaaggcatgaccccggtcctccgcgccggtgaacacctccgccgcgtgatgaatagcgacaactgctcccctgattggcgggtgcagttgtatgtgtctccctatgtccacacccgattgatgttccacaagcttagaagacgtttcttgaagaagaggattatcggcgtgagggaagagtcacaagttcgagaactagatttcgggaactttatgattaaggcaatggagaggggttcaaggagactaatgaacagtttcaaaggattgaagacatgtaaactgagtaattgggaaatagtcagtcaagagaggatggagacaattgcattgaaatag

SEQ ID NO: 17796 - DNA, 2004 bp, Glycine max
  Peptide Sequence Number=SeqID_134574
atgtctctcaaggttgtaacagtggtgtttttgctggcaacaatagtagtagccagtgattacactagtttcacctataatggattccaatcttctcatttgtaccttgatggcagtgctgagttcaccaccaatggcatggttaagctcaccaatcacaccaagcaacaaaagggtcatgctttcttcccaagtccaatagtcttcaagaacaccacaaatggaagtgtgttttctttctccaccacttttgtttttgccataaggtctgagtttcccaatttgagtggccatgggattgcctttgtggtttctccaacaaaagaggttccacattctcttccaagccagtaccttggcctctttgatgacacaaacaacggcaacaacagcaaccatgtttttggggtggagcttgataccattctgaacaccgagtttggtgatatcaatgacaaccatgttgggattgatgtcaatgaattgaagtcggttaaatcggcttctgcagggtattacagtgatggggggtttaagaatttgagtctcatcagtggctacccaatgcaggtttgggtggaatatgatggcctaaagaagcagattgatgttactttagctccaatcaatgtcggtaaaccggaacgccctttgttatcattgaacaaagatctttctcgaattctgaacagcagcatgtatgttggattcacttcttcaactgggtcaattctaagttctcattatgttttgggttggagctttaaggtgaatggcaaggctcaacaacttgcaatctctgaactccccatgctacctagactagttggtaaacaagagtcaaaggttctcatagtagggttgcctctgatattactaattttgattctcatggtggctctagcagtggttcatgccatcaagaggaagaagtttgtggagctgcttgaagattgggagcaagactatggtcctcataggttcaagtacaaagatcttagcctagcaacaaaggggttcagggagaaggagttattggggagtggtggatttggtagagtctacaaaggggtgatgccaatttcgaagattgaggttgcagtgaagaaggtgtcacatgaatcaaggcaagggatgagggaatttgtggcggaaatcgctagcattggccgtcttaggcaccggaatctggttccccttctcgggtactgcaggcgcaaaggagagttgctgttggtctatgactacatgccaaatggaagccttgacaagtatctctacaacaaaccaagagtgaccttaaattggagccagagatttagaatcaccaaaggggttgcttcaggtttgttttatctgcatgaggaatgggagcaagttgtgctccacagagacattaaggctagcaatgtgctacttgatgctgaattgaatgggagattaggggactttggtctttcaaggttgtatgaacatggaactgaccctcacactactcatgtggttggaactcttggttatcttgcacctgagcacactagaacaggtaaggccactacaagctccgatgtgtttgcttttggtgcatttatgctagaggttgtgtgtggaaggagaccaatagagcaaggaagggaatccgggagcgaaattctggtcgattgggtgtataattgttggaaaaagggtgagattctcgaggcaagggatccaaacttgggcgcaaattataggccagatgaggtggaattggtgttgaaactcgccttgttgtgctcacattctgagcctttggctaggccaagcatgcgccaggttgtgcaatacttggagaaagatgtgcctctgccagatttgtctatgcttagcttatcttcaattggcttaacttttggtctgcatgaagactttcaggactgtccaatgtcttatccttcatctatggataggccaatatctcatacttcttcgattgctgaatcacttctctctgggggtcgttga

SEQ ID NO: 17797 - DNA, 738 bp, Glycine max
  Peptide Sequence Number=SeqID_134575
atggcaagaacttcctccattctcttctacctggttgccttttgctccatcataatcatagatggggctcaactcattctagtgaacaactgtggggaaagtgtatggccggggatacttggcggtgcagggcagcaaacaccaaaagatggtggaatgcaccttggaagtggtgaagaagtggtgcttgatgtgccagagaagtggtcaggaagaatctggggcaggcagggttgtagctttgacaatgatggacatggtcactgtctcacaggtgattgcaatgggatgctacactgtagagggcaaggaggggtgccaccagcaacagtggttgaaatgacacttggatcctcctcctcccctttgcacttctatgatgtgagcctggtagatggcttcaacttgcccgtttcgatgaagccggtcgggggaggagtcgggtgcggagtggcttcctgtgaggtggacttgaatgtttgctgtccatcagcacttgaggtgaagaggaatggcaaggttgtggggtgcaagagtgcttgcttggctatgcaatcagcaaaatattgctgcacagggagttattctgaccccaaaacttgcaagcctaccctttttgctcatctgtttaaggctatatgtcctaaggcttatagttatgcttatgatgactctagcagccttaacagatgcagggctcctagatatgttatcactttctgccctcccccagtgtga

SEQ ID NO: 17798 - DNA, 387 bp, Glycine max
  Peptide Sequence Number=SeqID_134576
atgtcttctacttcatcggtgtcatttggtatatctagcatggagattgttcctttgactggcatacctattgtggagaaaaagacatctgtcgatgctgagatagtgaaaaatctgaacaaagcaagggagtctgggttaccatttaaacttgctgcagttgtcaaagatgcatatgaaaatttgggcattaatgctagtggtggaaaatcagtaaagatggattgtgctagactattggtgggtttccactccagtgttgggaatagaaagcttagggttgtgtatcaaaagtattttgaccctaaaaagggtgctattgttgtgctcccactagctaaaggtttcttcctctcaatcgagttaaagaagcaaagagagaagtag

SEQ ID NO: 17799 - DNA, 342 bp, Glycine max
  Peptide Sequence Number=SeqID_134577
atggtgagggtgaaggaaggacgttggggggttttcgaaccttgttgtcattgtttccatcgcaaagaagaagcgccaccacagaggagacggcttaaaactgacgagatcgaacccgaatgtgacactaaacgtgcacaagcaatgtgtttcaaggaacatgaagcaataaagagtgcaacaagaaagggaaacaaagaaggaagcatgatgggttcgatgttggagagtgaggggagagtaagaaacatagcgcaagtattactaactattcaaaccaacacaagttgttgggacatgctaggtgcacccagcaacattgctggtgcacccagcaattag

SEQ ID NO: 17800 - DNA, 675 bp, Glycine max
  Peptide Sequence Number=SeqID_134578
atggttgcaagtgcaccaacagacttcaccgaaatggtcaacatgggggtacgattagaggaaggtgtccgagaaggacgtttgactggggaaagtacccctgccgcaagtaatgccaagaagtttggaggccactttgcgaagaagaaagatcaagaggtgggaatggtagctcatggtaagcctcagcagaatttcaccccatatcgtcaggttgcgaacgtcgcatccgctatcccaaacccatcatatcaccaacaaaggccacattacccctaccaataccctccacaacaataccctccacaacaatatcatccgcaacaatatcctccacagcaataccatcagccacaataccctcaaaaacaacaaaatcgcccgcaaaacccccaacaaccatatcactcacaaaaccgccagaaaacaacctttgatccaatcccaatgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaagtgcaaaaactagtccgagccaacttgctatccttcaaagatcagaatcccaat

SEQ ID NO: 17801 - DNA, 414 bp, Glycine max
  Peptide Sequence Number=SeqID_134579
atgaattgcgttttcgttcatgtgtcctccacccacgagtttggagccatgcgtagtgattgcttagtgcaattctccattctcaaccctttttcggagcccatgaattgcgttttcgttcatgtgtcctccacccacgagtttggaaccatgcgtagtgattgctcagtgcaattctccattctcaaccctttttcggagcccatggattgcgttttcgttcatgtgtcctccacccacgagtttggagccatgcgtagtgattgcttagtgcaattctccattctccatctttttcggagacccatgaattgcgttttcgttcatgcgtcctccacccacgagtttggaaccatgcgtagtgattgcttagtgcaattctccattctcaatctttttttcggagccccatga

SEQ ID NO: 17802 - DNA, 252 bp, Glycine max
  Peptide Sequence Number=SeqID_134580
atgttggaattggagagtttggcatggcttgcctcaagcattccaatagtaaaccatagcatccaaaaggaacttctgcaaggaattaagaatgcagcatctgagtttttcaagcttccaacagaagagaagaacaagtacgcaatggcctcaaacgacatacacgggcaggcttatgtagtttctgaagagcagacagttgactggttggatgcactactgttaatcacgtataagaattcaattttgtaa

SEQ ID NO: 17803 - DNA, 204 bp, Glycine max
  Peptide Sequence Number=SeqID_134581
atggaatccgtaaagttctgggatgttttgggaacaaaacagccaaaaacacgaaagcggggggtgaacttatcaaacacagggggtgcgctcaagaaactttatccagaacattctagaggggggctgaacttatcaattacgggtgcactcatgaatcttcctcaagaagcctctgggcggcaaccatctccattttgttaa

SEQ ID NO: 17804 - DNA, 210 bp, Glycine max
  Peptide Sequence Number=SeqID_134582
atgtggaagttgagcccccttgatcatatgatagatgctcaaaaccaccccaagttgtatcagaaagtcagtttttcaatttatgagaaagggttagtaaaattcgattatagtgtcacatggagattgactctgactaggggtgggaataggtcaggccggcttacaggggcctacaacctggcctacataaagtctgacctgaactga

SEQ ID NO: 17805 - DNA, 237 bp, Glycine max
  Peptide Sequence Number=SeqID_134583
atgaatggctttgctgataaaggtaaatatccattaggaacaaaactaactctcaaagctagcaatctaagcagaacaataatgagtctcaatgtagatgaagaagatttactgactgaaatggaggaagcactcacttcttctccatttataccattagaaaatgttcaagaagtggcaaggaatagtcctttgcaggttcctaaaagatatgtgacgtgtaacattccatttttc

SEQ ID NO: 17806 - DNA, 237 bp, Glycine max
  Peptide Sequence Number=SeqID_134584
atggacgaggacgcacctcctcaaaaaagactcaaagcaccagaagttgcaattaaggggattgcagtcgttcgtgctgtgaatttgaccacattggatgggtatgatcaacttgtagatgaattggagaagatgtttgacataaagggacaacttcaaaacaagaataagtgggtagttctctacgctgatgatgatggagatacgattcttgttggtgatgagccatggccgtga

SEQ ID NO: 17807 - DNA, 2019 bp, Glycine max
  Peptide Sequence Number=SeqID_134585
atgtcgttgaactgtggtggctgcggtggagaagaagatgagctctatgagcaactatggaaggcgtgcgcaggaccccatgtggaagttccacgtacaggccaaagggtcttctattttcctcagggtcacatggaacaattagaagtatcaacaaatcaggaactaaaccaacggattccactgttcaagctttcctccaagatcctttgtcgtgtcgtcaacgtccatttactgatattcatcttggttttggagttaccaacttaccatgctgaacaagaaacagatgaggtttatgcacagattactctggtgccggaatctaatcaaactgagcctacgagccccgatccatgccctgctgaacttccaaggccaagagttcactccttctgtaaggtcttaactgcctctgatacaagcacccatggtggcttctctgtcctcaggaagcatgccactgaatgccttccagcattggacatgtctaaatcaacaccaactcaggaattggttgccaaggatctccagggctttgaatggcgctttaagcatatatttagaggtcagccacgtagacacttgctcacaactggatggagtacttttgtgacttccaagagattagttgctggagacacctttgtgtttctgagagggaacaatggagaattgcgggttggagtgaggcgtattgctcctctgcagagcagcatgccatcatctgtgatttctagtcagagcatgcacctaggagttcttgcaactgcatctcatgctgtagcaactcagactctttttgttgtatattataagccaaggacaagccagttcattgttagtgtgaacaagtatttagaggctatcaaccaaaaatgtaatgttggtatgagattcaagatgaggtttgaaggggatgaatcccctgaaaatgacaaaagattttcgggcacaatacttggagtagaggatatttcccctcactgggtgaattcaaattggcgatctcttaaggttcaatgggatgaacctgcatcttttccaagacctgatagagtttcatcatgggagatagaacacattctggcttgtgttcctactacgtcatctcaacctgctgttataaagaataaaaggcctcgacaagcaagtgaagttccggatcttggagacacaccattagctgcacctactttctgggatgctggacttacacagtgtgatatgacacaacttagggtcatgaccgaaagcaaaaggagtgacagcagttcccacatgaggcatcataacagtaaaagcaacaacaatggtatatcaatgaatcagacagaagcaagttggctatcttctcctcaattatatcaggacacaaccgatgataacaagagcatcttagcttggcctatttcgaaacctcactcagaaagattgaacaatgatcatttccttgaccaggttgacaagaacatcaacaaagtagaggctgctacaagctatagattgtttgggattgaccttattgatcatgcaaggaacaactctctttctgtagagaatgcgtctggagtcgcctctgagtgcaaaactgatgtaaaccacgagtctgatctctcaaaggcttctaaagaatggaaccaagaacaactactagtatctccaaaagagactcaaagcaaacaagtttgtagcagaagttgcactaagggggttgcggtcggtcgtgctgtggatttgaccacattggatggatatgatcaacttgtagatgaattggagaagatgtttgacataaagggacagcttcaacacaggaataagtgggaaactgtcttcactgatgatgaaggggatatgatgcttgttggtgatgatccatggcctgaattctgcaatatggtgaaaagaatcttcatttgttcaagccaggatgtgcacaaattgagctcagggagcaaactacctatctcttctatgggagagattgtaataagcttaaacacaaccgagacctga

SEQ ID NO: 17808 - DNA, 825 bp, Glycine max
  Peptide Sequence Number=SeqID_134586
atgttccagtcgtatattgttttagatgctgatggtttttcggtttatcgtagaagaaacaatggtcacacaattgagaaaaatggtgttataattgataatagtacatcaacaagagatgatagagtaactgctgttttgattcatgaagataatgatcaaactcacaatggtggcactcataatgatgagatcaaagaatatctagattgcagctacatctatcttcctgacagatacatatgtccctgtgaatctacttggagaatctttgggtttccaatacatggcagaaaacccgttgttgaaagattacacttccatcttccaggccaacatagtgttctctatgaagaccatgatgatattgatgatgtattgtctaagccaagtatctctgattcaaagtttatttcatggatgaacaccaaccaaaattctgttgaaggaaaaaatcttacttatgcagaatttgtttctaagtttgtatacaatcagaagaaaagatgttggcaccttaggaagaaaggctacaccattggcagattactatgggtcccaccaattacaggggaattattttatttgagaatgatgcttactgtttataaaggacctaccttatttgaggatttaagaacaattgataatgttcagtatcctacatataaagaagcatgttttgctatgggatttttgcaagatgataaagaattcattgaggcaataaaagaagcaaaatactggggttcagcatattatataagaaagctatttgtgttgttacttttaattgcaacaatgagcaaacctgaacaagtttga

SEQ ID NO: 17809 - DNA, 162 bp, Glycine max
  Peptide Sequence Number=SeqID_134587
atggattttatgggggagacctttgtggttgagtgggcattctctgttggatgggcgtcagactgggaggagccatgtgggagctgcagttacggcgtgggcatctccctcttttttcttagctccacccattctggtccttctattgcaagtactcgttga

SEQ ID NO: 17810 - DNA, 333 bp, Glycine max
  Peptide Sequence Number=SeqID_134588
ggcccaattggtggctagaaccacggtgttgctagcagagttctatgtcatcactgacaacaccatcatcgtcacccaacgcatcatcaagaagcttccaatagaggccaacttcaggctcacaaattgcaagtccaccctcgcaaagcctccaccctacaccctcgcaaatctggttgtcgatgtagaggcatccatcggaggaagagacagtggtgcacaggagagagaaagaggggaaggcgagcaacttgtcatcgaggttgtcatggaggtgagaggaggaagggcaagggcaagaagggttccgagtagaaatagagacggcgaagg

SEQ ID NO: 17811 - DNA, 276 bp, Glycine max
  Peptide Sequence Number=SeqID_134589
atggcaagcaaaggcggctcgtggcgatcaccggtggtcagtggtggtggaggaggagcttgggttgttgggggagggtttaggggaagagaagaaggaagaagatggctattttatgctgccaaacgtatttgtagcctgcaacactcgcccagacgagcaggatgttatattgaaaatcccaacggtcagaatatggagaattgtcttagaagccttttgaaaaaaattgaagatgatccaatggttaacaaatccaggatcgagattttatag

SEQ ID NO: 17812 - DNA, 597 bp, Glycine max
  Peptide Sequence Number=SeqID_134590
atgactggaaattcaactattctagtcatgatgctcgctgtatggtttttcatgaccggtagattgctgcccggatcattaacctttgattgtcacatcatgcactatattatcgttagaattttgcttccccgttcttctaatttggctcaagcctctgaggagtatttgattttgatgtgggctttccttaccggtcgtcagattgactgggctcacttggttaggtaccgaatgcataaggcattacgggccaatgcacctcttccatatcctcaattggtcaccctttttctccgtcattttcaaattcctcttgatgatgaaccttttgttcaagtcaagcgatcctttgctataggtgttggtgtagtcacttcatttggataccgtaaggatcgtaatggtcaatggctgaagaaggacgcgctacctccgcaagacaagcgtactccctctcctcctcctcagcgagatgattcctccgcccttctgaatgaagttcttttagagttacggggcctccgcacctatgttggtgaacgattcaattctttggatggtcgctttgaaggcatggatacccgcatcacctag

SEQ ID NO: 17813 - DNA, 597 bp, Glycine max
  Peptide Sequence Number=SeqID_134591
atgacttccgcttcatcgactgcctcaagcaaggatgccatagaaataccaggtttttataagcggcaatggctacctaattatccagaaattgtagagtttaaatatgatggggcaacttacaaaattcaagtcagattgaggacagaattgcagatttatgaatcagtgatcataaatttcctagcctgtgaccaccactcaaaatttgacctccacttcactccaccattacaccaacagacatgcaaaagacgccgcgcatcaaggaaacatatttggacctatgaaatcacccaatcaatgctaggggcaccatatccactgcaacttccaccctctatcacacaatgcctaatccactgtggtgatcacatgacaattttgagaatattcggacctccactgcaatggaatgtagttgtgcttgacaagggaattggtgataagtatatcactcagccttggtataaattctttcaagaaggtgattttagccatggaaacgaactctcattctactataggcgtgctgaaaaaatctgggaagttgttattagacgtgcaattgattgggatgacaacgacatagattag

SEQ ID NO: 17814 - DNA, 105 bp, Glycine max
  Peptide Sequence Number=SeqID_134592
atgggtgttaaacattttaaggtggttaaacgaaggtcgcatgccgacaaacaatggtccctgaatgaaattacggtcgagtttagtccaacaagaggaatctga

SEQ ID NO: 17815 - DNA, 207 bp, Glycine max
  Peptide Sequence Number=SeqID_134593
atgcagagaggtaagaggaggctatacgaggatttgggtcttgatcgtgaggatgatttccaaactgatgatgaagaaaatcaggcacaaagggtgtttgaacatttagatgatgatactgattcagataataattcacctacttcacgaaatttgtacaatgaggtttccattatctcttggcctcaaagttataggtactactag

SEQ ID NO: 17816 - DNA, 207 bp, Glycine max
  Peptide Sequence Number=SeqID_134594
atgctgcgctgtcctcaacatttttctgcaattttctacgatatcaaaggctgcggtgatgagaccgcaatcgcagattcgcagaaattaaggttcagggttttgcagtttgcttgtggttgtgatgagattgagttaggatggaagacaggaagatgggatgtcttgttagggtggaaattaggggaggaagaggatcttgtgtaa

SEQ ID NO: 17817 - DNA, 351 bp, Glycine max
  Peptide Sequence Number=SeqID_134595
atgttacttggatattttgaatcatcgaaggcatatagagtgtataactccagaaccttgactgtggaagaggccattcatgaaagatttaatgataataaatctgacactacaatgtcagagttggacgagtcttttgcagagatgaaaatagaaaatatcgtgaaatttgttgttgcatttagtcaagacaaacatgcatccaactcaccagtggacgatcaacctgaagaagtcagagaaccaactagatgtttgttgaggaaacatcatccaaagtctcatatcattggtgatcctaaggacaaagtgcagacaaggaaccctctcaagcatacaacattactttaa

SEQ ID NO: 17818 - DNA, 309 bp, Glycine max
  Peptide Sequence Number=SeqID_134596
atggggtacgaatcgtgtgatttgtggtttgaatgtgtttcggattttgattctgttggtttttttgtggttgatttgtacggtggtgggtggtggcctgagggaggctgcgttggtggtttgtggtggcttggtggtgttgggtgtttgacgcagtgcttgtggcttggccgatggtggtggttcacggaggaggagggtgttgctgagtggtggctagtggtggcttggctgttccggcattctgactgttcgtattcacctctgacgcgcacagtaattaatgcagcatttaaagggcagaattag

SEQ ID NO: 17819 - DNA, 1251 bp, Glycine max
  Peptide Sequence Number=SeqID_134597
atgtctatttcgtcaacaatagaaccttcctcctatgctgaagcttttcgccatgactgctggattaaggcaatgcaggctgagttacaggctctacaatcgaacgatacttggacactcacactccttcctcctcacaaaactgtcattggttgccgatggatatacaaaattaaatatcgtgctgatgggtccatagagagatacaaagcgcgtctggttgcaaaaggttacacgcaaatggaaggtttggattatcttgataccttctctctggttgcgaagcctaccactctaaatgtcaataacgcttttcttcatggtgagcttactgaagaagtttacatgcaagtcccactagggctctcggtcgcaaatcctcagctcgtttgtcgtcttcaatgctctctttacgaactcaagcaggctagtcgtcaatggttcacaagattatctagcttcctaatttctcatgaatttcggcaatctcactctgatcactctcttttcctacgattcactggacccatcactacggtccttttagtttacgctgatgacatcattctaacaggtaacatcattactgagatacaaggtataactgcgcttcttgatcaaacattcaagattaaggaccttggcaacttgaagtttttcctcggacttgaaattgcacgtacttctaaaggaattcacttatgtcaacgcaaatatgctcttgatatactttctgattcaggcatgcttggctgtcgaccaaactccacgccaatggattactccacaaggttacaagctacgtcaggaactcctctctcagccgagtcttcttcttcctaccgaaggctggttggtaggctcatttatctcactaatacgtgccccgatattgcgtatgctgttcaacaacttagtcaatacatggctagtcctacaaacactcatcttcaagctgctttccatgtgcttcgctaccttaaaggtacaccgggttcaagtctcttctttgctgctataggaacccctcaacttcgagcctttagtgactcggaatgggcaggatgtcgtgattccaggagatccaccaccggtttcttagtttattttggttcttcccttgtttcttggcaatcgaaaaagcaatccaccgtttcgcgcagctcttcagaagtcgagtatcgagccttagcctctaccacttgcgaactgcaatggctaacgtacattcttcaggattttcgtgtttaa

SEQ ID NO: 17820 - DNA, 510 bp, Glycine max
  Peptide Sequence Number=SeqID_134598
atgtcgggacatgttttgttcgtgtggaacggcgtggttgtggggaagaaggttcagttggaggttcacaatttgaagattctggcattatgggttgtgttggtgtggtctctatgggtgagtcgagttggttgccggaaaaggatcccggagatgataacccttagtatgcgatttaaaaccaatgaagatgcatggatgtgctctgggatcgagcttttggcggtttgctttaagggtgttagcataacacagacaaccaaaaacgcgaagattggatatatcgcatggatgtccatggagtttttcataaggggtttcgacacatgtggtctaatgaatgattcctttcgaggcataatagttatgcatgagaaactcagccccattatcacttcttatgatttttactttgccattatattgggtttcaatggatgcaatgaagttcatgatgatatgtcgggtttcggctttagtatgcatgagatgtatccatgtaaagcgtga

SEQ ID NO: 17821 - DNA, 1329 bp, Glycine max
  Peptide Sequence Number=SeqID_134599
atgagacccaaagccacacccaccatcccatatctcaagttcatcattttcttcatcatagaagcacccattggcatcttcttcaataaccattgtgaagccaagaccttagctttgccactgaaatcacaagtgatcccatctgggtatctcccaagaccccccaacaagcttcgcttccaccacaacgtgagcctcacaatctccatcactgttggcacgcccccacagaacatgtccatggtcattgacacaggaagcgaactctcgtggctccattgcaacactaacacaaccgcaaccataccctacccgtttttcaacccgaatatctcttcttcttacacacccatctcgtgctcctcgccaacctgcacgactcgtacccgagactttcccatacccgcttcatgcgactccaacaacctctgccatgcaacactctcctatgccgacgcttcttcctcggaagggaaccttgcttccgacacattcgggttcggatcctcctttaacccgggaattgtattcggttgcatgaactcttcctacagcactaactccgagtcggactccaacacaaccgggttaatgggtatgaacctcgggtcactctcattggtttctcagttaaaaatacccaaattctcgtactgcatatcgggttccgatttctcgggaattttacttctcggggagtccaacttctcgtggggcgggtcgttaaattatactcccttggttcaaatatccactccgttaccttatttcgaccggtccgcatacacggtccgcctcgaaggaattaagatttcggataagttgttaaatatatcgggtaacctatttgttccggatcataccggagcgggtcaaaccatgtttgatttgggtacccagttttcgtatttactcgggccggtttataatgcattaagagatgagtttttgaaccaaacaaatggtacattacgggcactggatgatccgaattttgttttccagatagcaatggatctttgttaccgggtgcccgttaaccagtccgaattgcccgagttaccgagtgtgagtttggtttttgaaggggccgagatgcgggtttttggtgaccaacttttatatcgggtacccggttttgtttggggcaatgactcggtttattgcttcacctttgggaattcggatcttcttggtgtggaggcatttatcattggacatcaccatcaacagagtatgtggatggagtttgatcttgtggaacatagggttggattggctcatgcacgttgtgatttggttgggcaaaagttacttggtttggtctga

SEQ ID NO: 17822 - DNA, 147 bp, Glycine max
  Peptide Sequence Number=SeqID_134600
atggaaaacaatggttgcatccctgatgctataacttttgaaatattgattcgtgctttctttgaagaagatgagaatgataaggctgataaacttctccgtgaaatgattgccaagggcctattgttattgcatagagatccttag

SEQ ID NO: 17823 - DNA, 744 bp, Glycine max
  Peptide Sequence Number=SeqID_134601
atgcatcccatggttgaggaccacacaacattcattgtcggacaatctaattattgttacaaagtcatgccatttggcctgaataacactagtgtcacataccaacacttgatggacaagatcctacccgacttgatagggaagaacattgaaacctatgtcgatgatatagtggtaaagtcaatgaaggttaaggttttccgtctctctttccattcccaagtttcccacttcccttcttctaaacccctcactcccaactccctatcctcactttcactctcacccccatcctttcaaaatgttgatgatgttcttttccaattcaatcgcatgctctgcatgcgtcatacccctcccatcatccaattcggcaagattttaggatccatcatgaagatgaagcactatcccactgttgttttcctttctaaacaaatggaactcaaggcaattgttcctaaccttgttactttgaacatcctcattaactgtttctgccatttggatcctcaaattgggttatcagccaaacaccataaccttgacaacattcgtgaaccattagtggagaaggttttggagatgcccacacttgaatgtaagcaactgtcggctgtacgttttgtttttgggaatcaagttcttgcagattttttcatcaaaagtctctgtcttaagggtcagaggtcaagaaggcactgcactttcatggcaaggtattggtacaaggatttcagctga

SEQ ID NO: 17824 - DNA, 678 bp, Glycine max
  Peptide Sequence Number=SeqID_134602
atggcagaactcgatctgtccaagaaagtagccgataggtatctcaagcgtgaagtccttggtgagggtacatacggtgtcgtttacaaagccattgataccaagacagggcagacggttgcaattaagaagatccggcttggcaagcagaaagaaggggtcaattttacggctctcagagaaattaaactgcttaaagagctcaaagatccaaacattattgagttgattgatgcctttccacataaagggaatttgcatcttgtgtttgagttcatggagacggacctcgaagctgttatacgggacaggaatattgttctttcacctagtgatataaaatcttaccttcagatgacattaaaaggccttgctatttgccacaagaaatgggtgttgcatagggatatgaagccaaataacttgttgataggatccaacggacagctgaaacttgcagattttggtttagcacgggtatttggaagcccagatcgcaggttcactcatcaggtgtttgctcggtggtatagagcacctgagctattatttggcaccaagcagtatggtcctggggtagatgtttgggctgcagcttgtatatttgctgaacttcttcttcgtcgacccttcctgcaggtccctaaactaattgggaatttttcattaggtccctaa

SEQ ID NO: 17825 - DNA, 699 bp, Glycine max
  Peptide Sequence Number=SeqID_134603
atgatgcctttgctcccagatgactccgaaacatgtgtgaatgagctgggaaaggccttggtagtgagaggggttgagctgacaaagcctaatgagacttgtgatgtggtgtattgcttctgtggcattaggctgcaccacttgacatgccctgattcattttctgttggccaaagtggggaacttgttggggatgcaattgtgagaaggttggagaagaattgcttgagtagcagcactaatgtcaatggcttaccaggtcttggagggtgctctaagtgcttaaataccctctatttgttcattattgtgacttggaatttgatggatcttattgaaaaattgaagaagatcaagatgcttaacaagaagacttcaaattcaagcaaagcagaagacaggaccaccaagatccacaacaaagattgtgagcttatgggcttgacatggcttctggctaaaaataggacagcttatatgcacacggtttctgcggttctccgtgctttgatgttgaacactgatggctcttaccctcagtcctgctctctaaacagtgatggaatgcctcttgcagtggattcatcggaaatctctgatcactcttcatcaaacaacctccaaccacccatctctctttctttgttattcctttgtttgttactactgcctatgcatttaacaatgttatcctcatag

SEQ ID NO: 17826 - DNA, 552 bp, Glycine max
  Peptide Sequence Number=SeqID_134604
atggtgtctctgactccgttatgtttcttttttaccgtgttgatcgctggggggtcagtgatccggtgtgccgcgggtgcagatgcggccgcggagcccgaaacggtgcgttttgacaccgggggtttgagcagagagacttttccgaaaggcttcttattcggaacggcgacgtctgcgtaccaagtggagggtatggcccacaaagacggtcgcggcccaagcatttgggacctcttcatcaaaaaacccgggattgttgcaaataatggcacgggagaagtttctgttgatcagtaccatcgctacaaagaagatatagatctcatggccagcttgaattttgatgcctaccggttctcaatctcgtggtccagaatttttccaaatggaactggccaagtaaattggaaaggtgtagcatactacaataggctgatcaattacttgctagaaaaaggtattactccatatgcaaatctctaccattatgatcttcctttagcacttgaggagaggtacaacggattattgagccggcaagttgtgtaa

SEQ ID NO: 17827 - DNA, 156 bp, Glycine max
  Peptide Sequence Number=SeqID_134605
atggcgggaagagcgtcaagcggcgaaagaaaaacgagtccaatgagaaatgctcatagtggctgtgaagacgtgttggagactgattggttgtttatcgaggattattacgtcatttcaatgaaaatgtttaccgggaaagagtttgaattgtga

SEQ ID NO: 17828 - DNA, 1557 bp, Glycine max
  Peptide Sequence Number=SeqID_134606
atgggcatcaaggatcttctgaggttcatgaaaccttacattgaacctgtccacatcaagaagtacgctggaaaacgcgtgggtattgatgcgtattcatggcttcacaaaggggcttattcgtgtagtatggagctttgtctggattctaatagtgaaaggaagttgcggaaaagaagggctaatcgtgaattggcaatggcgaagctcaaagaagggaatgttggtgcagcttcagagctcttccagagagcagtgagtattactcccgttatggcacataagctaattcagaccctaaaatcagagaagattgagtttgttgtagctccatatgaagcagatgctcagttagcgtacatgtctcagcttggagtagaaaatggtggagttgcagcggtgatcacagaagatagtgatctaatagcatatggctgtccagcttttcatagaagtcatgcattttggattataattcgcagtggttttgaacagattatttttaagatggaccgtcatgggaatggtgaaagaattgagttagagaaagtgttttctgctgagtctggtagaccttcatttcggagtttcaatatgaaactcctcacaggtatgtgcgtcttagctggctgtgattttcttccatctgttcctggaattggtattgctcgagctcatgctttagtttccaagtatcggaacctagatcgtatcttgtctgttcttaagatcgagaaaggtgaccaaatgcctgaagattatgccaaatcctttcaagaggctgttgcggtttttgagcatgctcaaatagaaattcctccatcaatagtcacagcaatagctgaaggaaacttgaatccgtcaactaagaaagcctttgataagtctgaatgttctagatttcctctacagcccattgatctccaaagcattgatcaagtccggaaagctgaagttcctgcaccatctagacaggggagtagcttttcaatcatcacctctcattacaccagagaaatggcaaggctttcagataaagataagtattccaatgaagcattagcacttcataaactaatcatgccattgggaaataatggaacagaggaaaagactattatatctgatttcactcctttgaagtttcctgacaacaatccattcaggataagaaaaaatgagggaacatatcagacaaaggacactgtacaaaaagtttcttttgccagcaacatgggatataccgacttatgcatgtctccagatgactttgaagaaaaggggtctgagaatctctcaaggaaaaggaaatttcagaacttttgctcagataaagttgaagccactgatgaactgttttcaggagtgactgaagtagaaaaatctgatattccatgcatggctgtggaatcccccgaaagtataaattctgatcagactaagaaaattgccgatttgaaaggaagaagtgaaagtaataagcaatccaagagaagcaacagcaagaaaacggggagtaacaacataactcttttgagtttcttttctagagtgtaa

SEQ ID NO: 17829 - DNA, 1487 bp, Glycine max
  Peptide Sequence Number=SeqID_134607
atgactcctcgcgccgacgatttcgaaaaggataatctctccgccaccgacgacgacgacgatgatgacgacggcctcaaggaggacatggacgcgctcgcccgagcctgcatgatcgccgtccctcgccccgacgataattccaccgccgaagatgatattcctgcggaggacccgctcctcctcgccggcgactccatcgttcccgccgccaccgacgacgacgacgaccaagacgacctcgagtgtctcaagagagtgcagagcctctaccagcccctgtccattcttccgccgctgacaccgcctgctgccgggtccgacgacgacgacgtggacgacctcgagacggtgcgcgccattatgaaaaggtttagtacctacgacgaaggtggaatggaaatgttggtcgagggggatcagacctccagcccaggctatgagggtgacattgctaatgactcaatctattacgaatcagacgttggtgaattatgtcctgtttctcaacataccaatgaggctgccaccaaggagttgattcagaacgttgaaatgaagcttagtgattttgttgagagttctgaacctgatgcttgtgggtcatccaaattaccacagaaaagattgagctgtcctcctgtagctaaaattgaggaaaacaaaaagatgaggaataagattaaaattctcaaggacttccaggcttcatgcactagaagaacagggaatgtgttatcactgaaaaaagacccacgtgttcagttaatatcttcaaaaaagtcatttgctccaaagaactctaagaaacctaaaaaagcatctgcaatgtgttatggcccagaagagaattctcatgtcgccaattataggatggtattggaaagatttccactttcattggatcggaaaaaatggtctaatgtagaaagggaaagtcttttgaagggaattaagcagcaattccaagaaatggtgcttcaactttcactttctgttgatagttctgagggcttgcctggagatgcaaatggcatggatgatgtaattgcatctgttaaagatcttgcaattacacctgagaggattagacaatttttaccaaaagttaattggaatctgatagcttcgatgtatgttggtggccgtactggtgctgaatgtgaatcgaggtggttgaattgtgaagatcctttgatcaaccaaggtgcatggacgaatgaagaggacaaatctcttttacttattgtccaagatattggcatcaggaactggtttgatattgccacatcattgggcacaagcaggactccatttcaatgcttagcacgattccaaaggagcttaaatccttccatgctaaatagtgaatggactgaggaagaagattctcaactctgttctgctgtggcaagttttggtgctagggattggcaatctgtggcttctgttttagaacggcggacaggaacccagtgctcaaatag

SEQ ID NO: 17830 - DNA, 390 bp, Glycine max
  Peptide Sequence Number=SeqID_134608
atgaagcaattatcgatcaatagaaagtccccaaagccagattgccactcagaatcattcttgactggcaatatcccaccccacatgaacaaagaggaaaagaccgaaacacccagcttcctctccaaaaacgctgacctcaagaaaatcctattggtccgtgatcccccatgtttcccctgcgtgttcgtttggaagctagaagttgacgtcctactcttcactctcggttacaaggaagattacccttggcacaagtatattgtttctctaagatgtggtgctctcgcgaatgatttatttttctttgcaaaaagcatgttgtcctttaggtggaaaaaaccggtggaccgttcggtcccgccaacatcctttcccggagccacgtga

SEQ ID NO: 17831 - DNA, 381 bp, Glycine max
  Peptide Sequence Number=SeqID_134609
atggctaaattgatgaaaaagcaaaagggatcttccaccaccaccgtcgctgctgaccctaagtacctagacatagctttctttgatgatgagacatttgagtgctatcaagtatttcaaaaccgtggcttagttgattttatgtctttaaagttgcctcattatcttgaactagttagagtcttttacaataacttaagaattcaggatagtacactttactttgaggtgcatggtattcctcttgtcattgatcaatctctgtttttctcatcgactaaattacccagtcaaggtgttccttttgagggcactgttgttgatgactggaagttcgattatttgagtcatgatgctcgtcgtatggtctgtaatgactag

SEQ ID NO: 17832 - DNA, 246 bp, Glycine max
  Peptide Sequence Number=SeqID_134610
atggcattagcacgtgacttttgtaaggaaacaacccatggggcattttggtttagaataggtagcaaaatacctttggcaatttacactttgggtatgatagcaaaatacttggatgtattagaaataccaagatgtgcacatgtgcaatttttggtaccccaaaatgctttgagtatgcatgtatgtaaatttagccaaggagatgtgtgtgatgtaagtaacaaatacaccttggaagtacag

SEQ ID NO: 17833 - DNA, 375 bp, Glycine max
  Peptide Sequence Number=SeqID_134611
atgttgaaagggatggatttaaaagagaaaaatcttgaagagaggaacacattgctagaattagaacctgctgcagcccaggtgcttcatgaacttgtgtctttggttcacaacagtgttagttccacccaggatgggcaatcactatcaacttctataaatgattatgagcttgctgggaatgataaacatgagaaaatagtgacttctgacttgaaagatgatccacttgctaaaattctctgggacgttgaaccacaaactctccaatgtgtttttcttgctatggcagctgtgtgtgtgcgcgtatatatgtatgttttgaagcatgttagattgtttactattttcagcataacttcccaagaactttag

SEQ ID NO: 17834 - DNA, 360 bp, Glycine max
  Peptide Sequence Number=SeqID_134612
atgaaagacttggatttaacaagttttatagaggatatgatgattcaaaatatcggatgcctaattctatggatgtgttcaacaggacatttgggatttgagattgttgggtatattggccatggtaaagccaagtcagaaataaacaaacagaatttttctgcattgccaaaggtgatggggatggctcatgacataacctgtctattgggctacgaaaggatgaaactctcgcttatagctgcagctggttactgctctcaatctccatcccttcttcttgtagttcttgatttgcagaagcaagctgcgttgagatttaagaaatcaatcatggatcggaaagtatttggcaggtag

SEQ ID NO: 17835 - DNA, 1431 bp, Glycine max
  Peptide Sequence Number=SeqID_134613
atgttggatcttaatctgactgccgagtcgactcagaacgacgagttgctggtgctgttggacaagtttcctgaagcttcgtcgggaacttcgaattcctccatcgtgaatgcggaggggtcgagcaacgaggactcgtgctccacacgcgccggcgacgtgttcaccttcaatttcggaatccttaaggtggaagccgcgaatgacgtcgttgccgcggcgacgaaggagctgtttccggtgagctcggagaattggcaggggcagagttcgacgtcgttgtttcaggcgaggaagagtttgatggatctctcactagatcaacaacacggggaggtgaaggtggtacaggttcagccacagcctaaggtgaagaagagtaggagaggtccacggtctcggagctctcagtacagaggagtcaccttctaccgaagaaccggaagatgggaatcgcatatctgggattgcgggaaacaagtctatttgggtggatttgacaccgctcatgctgctgctagggcctatgatcgagctgctattaaattcaggggacttgatgctgacatcaattttaatctcgttgattatgaggaggatctaaaacagatgaagaatctttccaaggaggagttcgtgcacatactccgccgccacagttccggtttctcaagggggagttcgaaataccggggagtgacacttcacaaatgtggccgttgggaagctcgaatgggacaattccttgggaaaaagtatatatatcttgggctattcgacagcgaagtagaagctgcaagggcttatgacaaggcagctatcaagtgcaatggaagagaggctgtgactaactttgagccaagtacatatgagagcgagatgaaacccgaagctattaatgaaggtggcagtcacgaccttgacctcagtctgggcatagcgaccccaggacatggtcccaaagaaaacagggggcatcttcagttccagtccatcccttacaacatgcatcctggaagaagttcaatgatggagactaatattaattccgttattggtgatccttctttgaaaagactggttgtaactgaagagcgtccttctgtgtggaatgccgcatattccactttctttcccaatctggaaagagcagagagaatgggcacagatccttcaaaaggagtcccaaaccccaactgggcgtggcaaacacatggccaggttactgacaccccagtaccaccgttctctactgcagcatcatcaggattctcaatttcagccacttttccatcaactgccatctttccaacaaaatccatcaactcagttccccatagcctctgtttcacttcacccagcacaccaggtagcaacgcacctcaattctataactattacgaggtgaagtccccgcagccaccgtcctag

SEQ ID NO: 17836 - DNA, 613 bp, Glycine max
  Peptide Sequence Number=SeqID_134614
cctcaccttcagaggagtacacgtcctcgcattcagaggagtacacgccctcaccttcagaggactacacgtcctcgcattcagaggactacacgttctcgccttcagaggactagatgtcctcatctttagaggactacacgtcctcgtgtttatagggctacaagccctcgccttcagagggctacacgtccttaccttcagagggctacacgccctcactttccatggacaacacttcctcaccttcagagggctacacgtcctcaccttcgtaggactacacgtcctcgcgtttatagggcttcacgtcctcgcctttggagggctacacaccctcgccatcagagggctacacgtcctcaccttcagagggctacacgacctcactttgctacacgccctcgccttcagagggctgcacacccttaactttcgagggctgcacgccttcgccttcaaaggacaacacgtcctaaccttcagagaactacacgtcctcgccttcagagggctacacgccctatcctttagaggactacacgtcctcgccatcggagggctgagtactacatgtcctgtctttaagaggactacacatcctcgcttttag

SEQ ID NO: 17837 - DNA, 984 bp, Glycine max
  Peptide Sequence Number=SeqID_134615
atgctgaacaagccgccactgaagagtctgctgtgtcttctttctttaagttgcatactgataacagcaatactgcttgtcacaataactgtctttgtgctcaaaatttttactgaagagcgaatccttgaatccaacactgcttatgcccgtaaactggctgacagtgctgataatttattccgtactgcgcagcaggagttggctttcagcgccagtcaaatcaccagtttcgcggattctcaggcgttgcggtatgaaaccgacaggctgcgcctgcagtcagacatgttcggttcggtgctcgttctttctcctgaggggcaggtgataattacttcacccttaaactttattccatccggtgcttcgctgaatgttgcccctgagcagttacaggccgtaaaaaaaggccctttcgtttcggaacctctcacgccttatacaggaaattacctcgtatttttgtcagcccctttacattcgtccacgggcaaatatctgggctatctggcaggctcaatctatctgaaaaaagagagtatgctgagccgtcttttaagtgaacatttctatgctgataaaacggtcgtcagtattgtgtcagacatcggtgaagtcgtttattcaaccgatgaatcgctgaccgggcaaactctcaacttgagttcctatctctcagcgcagcttaaacggcacagatacgggtcgctaaaaacgacattaaatcagcagcgctgtctgctggggtattccgatgttgtcaaaacaaactggcatgtctttgtttgcgtttcgccggacgtcaccagcaatgtccttgaccatgttgtccgtgatgtcattctttatgggctggtgctggcacttctgctggtaagcgcgagcatgtatatctctgcccgtatttcacagccccttgaaaagctggcccgcctgactggcactggtaccacagagcgattaaccggaaagatcggagag

SEQ ID NO: 17838 - DNA, 246 bp, Glycine max
  Peptide Sequence Number=SeqID_134616
atggcgattgcaaagttatccggaacacccattgtggctaaaaatgaggccggtaacggcacagcgtcggaatttcgaccggaaggaggggtaagcgagctggaaatcgtccgggaaggggacagcatcatcctgcgtcccgtccggccgacctggggctcattcctagagttcgaaaaagccgatccggattttatggcggagcgcgaggacgttgttagcgacgaaggacgatttgacctgtga

SEQ ID NO: 17839 - DNA, 582 bp, Glycine max
  Peptide Sequence Number=SeqID_134617
atgagcgaaaatatcgaaaaagacgaaaagggctttacccgcacgctgacggtgcggaacatcccgcttagcattgatattgaaatttccgaacaggccactgcggctggcaagtcaaaaggggattttctgcgggagtttctggcagcctcatttggtgaccttatcggcaatttcatgcgctctaacggactgctcgcgctgatggaccgggatgtggcgaaaatgatgaacgcccgtctggctgactactggtttgatgctgctcagacgctggccgagaaccgcgcctggtgccgcctgttgggaattaataaagaagaggatttacagcgtatcatgcgtgacggcgtgcccctgcttgaaatccgcgcgagacagctcgctgatgtcacgcacattcctaacggcagctcgctggcgtttgcgctgtttgccgaagcggccagacgcgacctgcgcaccctgctgcaggtgcaccgcgcgctgttcttcctgcagaaagaggaagactttctggacatggtggatcagatccgcgaggcgcagcgtcttccgccgaccgagcgccccgttttctga

SEQ ID NO: 17840 - DNA, 1116 bp, Glycine max
  Peptide Sequence Number=SeqID_134618
atgaggctattaggccataacctgactccgccgtcaacccggctcgtgagttatctgagggaagaaggaaatccgatggcgcagattgatgaatttattaacgccaagcgccttgatatttacgtaaagcatctcaaggtgaaaaaatcgcaggcaatggcggcctatcactggaacaagcacctagccgccgcgatcatgcccgcgctgcagtgtatggaagtaacgttacgtaatgccattgacctggcggtgcaaacggctccgccaaaaggcgctgtcgggctctggcagaccgatcgttggtgggtgtctattctgccggagtatatgggtaatacccttattcagcctacggaccgatataagttagcccgaaacgcacatgacaggcaggacgcgcagggttttcagcttaactctcgcggccggcgagtactcaaccgcaaacttacagaagagacgcagcccgaacaggcaaaaaatcagatccgcgctgaaggcaaagcgataacctccgagcgtatcatagccggccttacattcggattctggacaacactgatgacggacaagtatgaggacctgagcagtgaccgcctcctgtggccggggctattttctgaggttttccctcacgcacctgccggttttggaagagaggatgttaaaaaggtcattttcaggataaaggatttgagaaaccgcgtctctcatcatgaggccgtctggaaattcagtaaagacaacccagccacagggcgccccgatccaagccgtcctgtatatggtgcagcggccagctgtagcctgctgaacaagcactatgatgacatactggatgtgattggctggataaatccggaccggcttaaaaacttcctcagccacggcgcagacaggcgctttcgcgcgctgtgctccgttgacggactgaatgcttattgtgatcctgccaaaataagtcagacggctgtgattccggacgacaacccggctgaggcgatctgtcaggcacttctgaactccgggtatacccgactcatacggacggatggctcagagctgatcgttgcgggaacggacattcccgcagccaggcaccctgttcaatag

SEQ ID NO: 17841 - DNA, 564 bp, Glycine max
  Peptide Sequence Number=SeqID_134619
atgagtgaactgaagattgataatccggcgcaacgtttgctggatattcttgaagcaggaaaaacacattcgcaagccgcgaactgtcgcgcagtatgggtctcgctcctgcaggcacatcaaaataatgagcagcatcttctttcccgtctggcccgggtcatggagttgccaggacgaatagtgcagcacgcggctatccagtcagaagaaattgatgctttgctggagaggttaacagaactgcgtaatgagattcgggaggctgatctgcctgtcacgatgaaaaccctgctgctgaaacaactttcacaaatccaggaggcactggaaacatatggtatttctggcgttgagccggtaatggatgccgtgcagtcaacccttggcctggccgttctgaatccggagtaccgccaggaaatcagtaaggggacaaacagcaggttcggtgagaaaatttccgatcttctgagcgacgtggcgaatgttgtcaccgtcgcaggcgcgctgcctgcattaaccgttgctgtaagcaacgcactaacctatatcggccagtga

SEQ ID NO: 17842 - DNA, 1116 bp, Glycine max
  Peptide Sequence Number=SeqID_134620
atgactgctgcgcagcagagctttgacgatgcggttaccgatttgctcgagaaaagcaccctgaccctgaatgcgatccggtccggcgaacacttcctgacgctggagcagaccgtggagagagaacaggcaagcgtcacccgcgaagctgaatcgctacgcgcgcaggggctgaatccggataccctggatgaactgatgcagcgctgcgagcggctcagaaatgagctgaaagagtatgagggtctggatgcagcagtcagcgcgtcagaactccggatctccactctccttgatgagatggtcgcgcaccgtatggcgcttaccgaaaggcggcgggaattcctttcctccctgacgctaccgggtttggagataaaaattttaccgctctgcgcaccgcctgaggctaccgttgaggattatcagaccctgaccggtattaacagctttggcgatcgcatttatgacggtgaagagcaaagcgggctgctgcatgcctttatcagcaaccggcccttcagtccgttaccggccgcggcagaagccaagtatgccctgcttgacgcgctgaaaaatttgcatcaggcgataaaatgcgatgagaaagacgccgggcaggatcttcacggcaccttccgaaacaggatcagaagcctgccggatgagacgctcgattctctgcgctgctggtatcctgaggacgggatctatatccgctatcgctcgcctggcgggcaaatggaggatatcgcgtcagcgtctcccggacagaagggggctagcatgctgcagttcctgctgtcctatggcaccgacccgctgctgatcgaccagccggaagacgacctggattgtctgatgctgagccagagcgttattccggcaattgtggccaacaaaaagcgcaggcagctgattatcgtgtcgcattctgcaccgatagtggttaacggtgacgctgaatacgttatctgcatgacctacgatcgctccggcctccggcccgggctttctggcgcgcttcagcagaaggaaatgaaagccctcatctgcagccagatggaaggtggtgagaaggcgtttcgctcgcggtttgagcgtattctcagctga

SEQ ID NO: 17843 - DNA, 2205 bp, Glycine max
  Peptide Sequence Number=SeqID_134621
atggcggtgaaggataatgaaaagacaggctttaatcatgacggcattactgacccttcccgttattcacggcgcggaggcctccgtaacggccggcttttcgcccgggggctcggcgctggatctgatactgcagttcaccggcagcgggcgtcagagcgccgacgtggcgccctgggatttcaccagccggccggtggcacaggcgctctcgcgtgcgctggcgtcgacgtgcgcctcaacggcatgtacagcatcatgcacaacaagtttattgtggccgacggcagtgcggtggaaaccggctcatttaattacacgtcttctgctgaaaaaagaaatgcggaaaacgcgccggtgattaaggacgaacctgatattgcccgccagtatcaggctgaatttaaccggctgtggaatgaatcctcaccgggggttatgatggcggcaaagaaaacgtatccggtccggttcaccgggctgcggggctcacgggaatgcggtgcggatttccgcagcgctgagccggagcagtggcagcgctggctgaagcacgcgcgtgacaacaaggccaccacggtggtcacctgcctgtgccatcccccggaggaagacgcgcagcgccggcgcctgaaagtgcatctgtcacagaaaacagaccagtgctggctcgcctcatgggctttctccgggcacgaacacgcgccagactgccgcttttactccgtctggccggatgagcgacaggctgccatctatgcccctgacgtggtcagagcggcggcggatggccggcttgtggtccgtctgcccaccggcctgcagaagaaagacgttcctgataaaacccgtgatgcgcctccggccggtgccggaccggccctcgatgcgcctgctgggtataggggacgtctgagcatcgggagctggcagggaaatccctggcgatatgacaattcgaatcatcacgttgaactctggctgccctggcgcattggcttcgtaaagggcggtaatcattcgctggccgccggcatactggcgggtgaaggaacgctactccctgaccgggtttttgacatggatgatctactgcgccgggctggtcagctgacagtgtctgcggtcatattgattgcccgacagcccagaatagtgggccgtgaaacttcccggagaacaaagatggaaattaaggaccttctgacacccgcttttaccgttatgggcgtctgcctggcggctcactttgcgctgcgtaacgagcggagaaagaaggcacttgagatcgaaacgtcccagctggaccggctttcagtcctggtactcagctctcttgataactttgctcagtacgccggtgcacttgcgggcattatcgacgcacagataacgattttgactgagcagcttcctccgcccaaccgtgacaatgcagagatttctgtcgcagatttacataattggttagatcaaatagattcgcaccctgcgtgggggcttaaccggagcgagctgcaaaatgcctctcatggactgaggtttcaccgggaagctgactggttacgctggcaggaagccgttccgcagctgcagcgcgaaatatacgcgttcttcatgattacgcttccgggtgaggaaaacatcgagctcatgcgccgtggacggacggctgcagaggccagagcgtttgccaggactatgcgaatacgcgtcagtgaactgcgcagcttacaggaagcccttttatcctcaatgaaagacgatttcagtaaactactcatacctgagcagacaacgaccttctgctctatgacgaacagcttatgcgatcgcaacacggcggccgcttcggcaccctctctgctgaacggaaccgccagcgtcgccgccatgtccagcgcgaacactcagcatgtgcatgatataggagtggcggaaggtgtgcagcgtcactgggctggaaaaatgcacgccgtcatcattcgcccgctttacggcagccttcagccagttacgcattgtctcatcggtcgcggcccacagcgattcgcggcgccgggggcattcggtggctatccagctccggacctgatgcacgtagccgggcgtgacgccgtttgcggtggccatacgcctgagcgccaccgcggtggcaaagttcgcgtcctgcgcaaacgacagcgcggtgacgtgttctggtga

SEQ ID NO: 17844 - DNA, 936 bp, Glycine max
  Peptide Sequence Number=SeqID_134622
atggatgaagctctactcgctatgatgcgctcaaatgggcgcaataaggcctgggcagaaacgatggtgaatcttgaagcccgcaagctgattgaaacagctaaccgtgtagccggatttcacataagggatggactcacacgacttcagtttgtgcaggaaataagagatgtcattgaaggtcagtttgcgatcgccagacgggcaaagactgacgaagaatgcatggcctgcataaagaaccttcgtgaagaatctgagaatctggctgagcaggacaggttactgaggatcaagacggcgcaactgtacgcgaaggtcgaatttgtctggcagaataacaaaattgttggttacaccctgtctgctgtccatattgcgatatcgggtattgctctcttcaccgggctggcgatgataacctcaatgcctgcaatcggaatgttagccggtgctgtactggtaagcgacggcatcaatgggctctctcaggaaatcattaaccatttttcaccgccagggagtgctcattccgaaggtatattcggagatgcggcaatggccggcgctgaatttttaggattcaggcctgagacgggtctggctatatataatgcggccacattatctgccagcgtttatggtgtttttggcgcggccaggaaagccggggcatggcgcctgttcagatggatgcccagagactattaccgcaaagtagatagcataagtaagcccaaacttactatgcgtattgctggctatgggctaaaagcgaagaaaaaccgctaccgtccagagcattctgttaaatcgccttgccaggtcatggatagcaagctcaagcgtcccgccataactttcgacgttgtttttaactgcctgcagttccgcagaactgaagccggaacgcagcaacccctcttcactgactaa

SEQ ID NO: 17845 - DNA, 1392 bp, Glycine max
  Peptide Sequence Number=SeqID_134623
atgacgtcacgcggcgatatccccggcgccttttcgctcatccgcaactggagcgaaaacgtcgcccggaaaatcatgagaaaagcgggctaccctgtgacgccgcacacggggcgcgcgttctggacgtgggtgcaggagaccctgatccgggcggcccgcgagcggcgctgcggctaccgggcgcgcgctgaacgccaggcaccggtgcggcgctggcggcagcaggccgcggaagactatgatgcctgggcgcagatgatggcgtcagaggccgcgccgcaggctgaggctgccccgcctggtacacctttgccggcacgcgccgttccggtactccagttccagcacgccgctggtcggatcgtagcccgcgctgcgaaacagctgagacgtcatttcatgcctgttcatagtgtggttcctgtcagggccatcgctcacgtggccgccgtccgaaaaatctgtgaagtacgttacctttccgatcccgcctcacgcagcgctgaatccgtccgcgagcagaagatgcagatgttcatcagaacctccggccgttccccggcgccagcccgaacgctgcagcagcttatccagcgcggccaggtcgccggtgatgcgcgccggcaggggactacgctgccggccgtgctcgtcaaagccgttatccagtgcgctgcgcctgagggcgtgctggagccgatacaggtcgttctgcgcctgcaggtggccgtttcctgcgcgccacaggtaatccagcttgccgggcaggtcggcgcgcaggcccttctctcgcccttccttcagcagccagctgatgtcgctggccagcgaccggggaaagcgacgctgtttttcagcggtggccagccagcgggtcagaaacagcgcaatcaggccgcaccaggccaggtggctgacgttcagattgtcgttattcataaaccgcgaggttcagcagcacggcctgactttatccggctggctccgcaggtgttcagtcccccaaatcagggcgggagcaggcgtaatgagagcggtcctggttcaaacaatttagggatgaaggttatgttagtcagtgaagaggggttgctgcgttccggcttcagttctgcggaactgcaggcagttaaaaacaacgtcgaaagttatggcgggacgcttgagcttgctatccatgacctggcaaggcgatttaacagaatgctctggacgttcagggataaaaataattgccggcggcatatctttcctgttgggtattggctttatgatactcagccagcccccggtgctttgctacaagtcatggcgatactggcgggctgtgcagtcttagtgcgacgagttatcgaccgtcagcaggtcaaaaactaccttcgcttttag

SEQ ID NO: 17846 - DNA, 1274 bp, Glycine max
  Peptide Sequence Number=SeqID_134624
atgtcggttggatcgcgctggtacaaatttgattttcataatcacaccctggcttcacacgattacgcaaagccggacgtaaccgacagggagtggttactggcctacatgcgccagaaggttgatggcgtgatcataagcgatcataacagtggcgcgcgcatagattcgctcaaaaatgagctgcagcagatggctcgcgatgccagaacaggcgatcttcaggactaccggcctcttgcactgttcccaggcgttgaacttacagccacaggaaacgttcatatactggcagtcttccataccgacagcacgagtgccgatgtagaaaggctgataggccagtgtaataattccttccccgtgccgcgtgaggcccttaaccatcagctggttcttcagacaggaccggctggcattatcagccttatccgcaacaatcctgatgcgctgtgcatactcgcccacattgacgccccgaaaggcatactaaaaagtatgactaatcagggcgagctggaagccgccttccttgcgcagcctcacgcggttgaaatcaggttcgacccggccgatatcagcgacggcactcataagcgtctgatcaaaaatcttccgtggcttcgtggctcagacgcacaccatcctgatcacgcaggggcgcgtacgtgctggcttaagatgtcaacgcctgacttcgatggcctgcgtcacgccctgctcgatcatgaaaactgcgtgctgttcgatttaccgccaccggaagagccggcgcttcagctgcgtagcctcagcctgagaaccaagctctgtactccacctgacggtgagatggccagcgtggctttcagtcctttttacaatgccatcatcggctcccggggcagcggtaagtccacgctgattgaaagcattcgcctggcgatgcgaaaaactgagaaattatcgcccggtcttgataaaaagctgaaccagttcaggcagaccggacagggtatggatgcggattcggttatcgaatgcgtttttcgcaaggacggcgccgatttccgactaagctggcgacccggtgacgtctgcgtgctgcatactctgagcgagggtgaatggatcgaagagtccggctgggcctccgatcgttttcccatttcgatattcagtcagaaaatgctctatgaactggcctctgataacggggcttttcttcgcgtctgtgacgaaagccccatggtcaacaagcgtacgtgggcagaaaggcagaacgagctgacaag

SEQ ID NO: 17847 - DNA, 255 bp, Glycine max
  Peptide Sequence Number=SeqID_134625
atggctcaacagcagcacggggagctggagagggtttacaccatgatcggcgccgtggtcatggccatggccggcgatggtcttgaaaccacgcggctgcggattgccggctttatccgcggagaactggccagaacgcaggcatggtcgccggagatggaaacggccatgctgagtgcgatcgagacgctggaaatctatcccgaccaggaggtcgtggagaggcaccgtgatggcggcgactgggttctctga

SEQ ID NO: 17848 - DNA, 1371 bp, Glycine max
  Peptide Sequence Number=SeqID_134626
atggaatacttggtaatttacaacttggtttcatctgggagatggaaaaaatccctttgtcctgagaagaaagggagctttacacgagaggaagatatacgcataacagtagcggttatgctttttggacgaaaatggaatcaaatagctaactatgttcctggccggatccaatctcagtgtagggacagatacctcaattgtcttgatccttctttgaaatggggtggatggactgaggaagaggatttaagattagaagctgcagttgtcaagcatggatactgctggtctaagattgctgaagaagtgccacctcgtactgattctcaatgccggaagagatggaaggtgttatgtcctgaatatgttcctttgcttcaagaagcaagaaagaagcaaaggtctattattggttgtaactttgttgatcgagaatctgaacgcccagccattacactgaatgactttctacctttacccgtgccagctccaaaatctgatgttggtgcttcaaatctccgcaagaaggccaagtcaagcaatgttcccaagaaaatgagtaagaaacttgcaaaaagagctcgacttcataccaaggaagtacaagatacagaggtatatagtgatgatgggatcaagacttatggtgaagtctctgcatgcagcaatgttcccaagaagatgaggtccaagagacatacaaaaaaaactcgaaattgtcccaaggaagtagtggatatatattgtagtgagaaggtcaagacttgtattgagagttcagaaagtcaatctacctgtattgcgagttctggaaatcaagattcagacaacataactattgcatgctttttacgcgataaatcaaaggagatgctatctagatttaccaaagatttgagtcaggcttccttctcctctaggagtatagatgtttctaataagcaggttgaaagtcaagacccctttgatgaccaaatcggcttgtctaagtcatttgatactgttggaactgaaaatttgtttgtgcagcagaatgttgcttctgatagacgagtgggaaaaccagaggatgcaaacactttgacaggtggtgatcatgaggaaatgacccttgcatgctttctgggaaacaaatcaaagaaaggaagtcaagctgctaacggacgtggtgcatgctcttcgaccatcatcatacctgatgatagtggactgtcaatgtcaaagcatgttgaaaaggagactgttttgcatggtggtgttgctgaaccaatggacatcgttgtggaagaaaaggatgatgagcttcttacttccttcttgcaaaacaggccaacgaggcagcgaaaacgacccagtaggtttttataa

SEQ ID NO: 17849 - DNA, 270 bp, Glycine max
  Peptide Sequence Number=SeqID_134627
atggcgcccgtcaggtctggaggcgtaacgcctgcttttggaccccctgattctgaatcttccgccaagttgattaagcagagtcagggggtttttgcattcagagcccgttctgcgcctggcgggacgctgaaacgacagagagcacgggggacgggtaatttttcattattcagcggaacgatcgcggacgatcgctattcaggcgacgggcagggcattcaggctgaggcgtaccacagcggcgcgaggaacgaacagcctgaatga

SEQ ID NO: 17850 - DNA, 1890 bp, Glycine max
  Peptide Sequence Number=SeqID_134628
gaccatgttcagattgttacagatgacagagccggctggatggagacgctcggcgtccggaaaaacggaccggcgacggcgcatgacgcgcttatgccagagcctgagcgggatcaggcccggcggatctgggcgatggggcaggccgcgtcgaaaaccgcaattggccgtgcgtacctgcggtcaaacggcctcagcggcagtcccgttacggcacgtatcatcccgccgacgcgaaagttccctgaaccccacctggccctgccggtgtttgacggtaacggtaaaccggctggcctgacaatggttccgctgcgccccggaagcggtgacgtcgatcggggggccgagcggcgtatcgtcaccgacggcgcgcaggccgcacttgtacagaaaagccggaacggagaaacacttgtggtggccacgctggaagaggcgctcagcgcggcgcgaaaatacccgacgtccggcattctgctgaggaccggggacgccgctccgtctccgcagctgctgaaggtttccggcggcctggagccgctcgccggggcggcggtggaagaggcggtcagaagcctgcagagcccaccgcctgttccggatgaaccggtcacgccggcggcacccgccggcattggcgacgagaccatcagagacctcgtcaggcaggacgcgcatcagcctgatgtgccggacgcgccggaggtgcagatcagcgtcagagacgggcgggcagacgtggcggcagaggaaaagctcgccgcagacctcagccgtgcagttccacaggaggcggctgacattgagcagcctgtggaccctgtcgcgaagcctgccgtggacgaaacggatctggccggccgggttctggaaggcagtcggcaggcttatccggaggtcaggatgccggaggagagccgggagcagccggtgccttcaggaaaaggagaatcagaactggcaacagagcttgccgcaggttcgcggacggacaaagagattgcggcggggatcagcatgccggctcagcacgaggggcccgagcgcctgccgcccgaactttctcacgaaccgcatgcgagagaaatcatgaaacagatcctgaaactggccgccattgcgctggccatgagcaccgctttgccctcagcaccatcgaatgcggctgaggctgcagactttacccccgcgcagcaggcccgcattggtgaaattgccgctgactacctggtggcgcatcccgacgtgctcattgaggtgagcaaaaagctgcaggcgcgccagcaggcgatgcagcagcaggcttacgtgcagtctgcgcttaaagctcaccggctgctgatgcagctcgacggcgtaccggttaaggggctggcggattcgaaggtcattgtgacggagttctttgactacgaatgcatcgcctgcagcatgatggagccggtgatggaaaaggtgatggccgccaacgccggcgtacgctttgccttccgcgactggaccatctttgccgcccgctatccggaatcgcggcttgcctcgcaccgcgggctgggtatttacagcaggcagggcgcggaggcctatatggccttccacaacgggatttaccggaccgggcacaacgaggggaaactcacggcagaggatattgaaaaggtggccacggccgccggcgcaggtacggcttccggtgatgacagtgctgcctccgacaggctcatcgaaaacaacgacgcgctggcggagatgctgggactgaccggcacgccgggcattatcgtcatgccggcagagaatgccacggctgacaacaccaccgtcatcccgggcgtcgtcagcgaagaggtcctgcagcaggccatcgtccgcgcaggcggaaactaa

SEQ ID NO: 17851 - DNA, 1023 bp, Glycine max
  Peptide Sequence Number=SeqID_134629
atgacagaggcagaggttttcgtcttccgaggaacactgcgtggccacaccgacactgtcaccgcaatagccaccccagagaacaacaacaacaactccgacaaaatcatcgtcagttcctcccgtgacaattccttaatcgtgtggcgcctcactaaggaatactcaaactcttacggtgttctccaccgcaggctaaccggtcactctcactttgtcagcgatgtcgctttatcctccgacgccgatttcgccgtctccgcctcctgggacggcgagctccgcctctgggacctctccaccggcgccaccaagctccgcttcatcggtcacgccaaggacgtcctctccgtcgcgctcttgaacgacagtgttataatttccggctcacgtgaccacaccatcaaggcgtggaacacgtgcggcacgtgcatgtcgacggtggacaacggcagcggtgacggtcacacggattgggtttcatgcgtgcggttcattccggacgcggcgccaccgaggttggtgtcggcgtcgtgggacgggagcgttagggtttgggacgtggacgtggacgtggacaagggcgcgttgaggaagaggtttactctctccgggcacgagggttacgtgaacgtggtggcggtgtcaccggacgcgtcgttggttgcgagtgggggaaaggatggggtggtgctgctgtgggatatggcgggtggggtgaagatttatgagtttgaggttggttcggttgtgcatgggttgtggttttctccaaacaggtattggatgtgtattgccacggatgagagtgttagggtttgggatttggagagtaatagcattataaaggatttgaatgtcaatggtaacaacgaccactacaattatgtcaatggtgggactgagatcactgccaacaacaaggatatttattgcacgagtatgaattgggatgctgatgggaacacgttgttctgtggttacaccgacggtctaatcagaatatgggaagtcattagctga

SEQ ID NO: 17852 - DNA, 801 bp, Glycine max
  Peptide Sequence Number=SeqID_134630
atggtcttctacgtcggtcaaaaacggcattcaacgatggttgttgaccgtcgtagaaaccaacaacattttcaacggcggggggagcagttgaagatgatcaacaggtgtctcgagactttccttcaatgttttattgctgatcaacccaaaacctgggtgttgtggttgccttgggcggagtattggtacaatatcacatttcatgtctctactggtaccacaccatttctttatggacaaaaacctcaaatgctaattcttttcttaattggagaaacaaaggtggaagctgtgcaacgagacttgctggacaaagatgaagcgttacgtccagtgaagtatcacttgcagcgccatcagtgtagaatgaagtcctatgttgatcgaaaaaggacagaaaaagtttttgagataggagattggaattttctgaaactacgctctcagggacaacaaactgttgaagcgggcatttggcccaagctggctccttgttactatggtttgtaccaattaccggaaactgcacgaatacagggtagaggaggacattccctttgtgaaccagaggctattttggcaggtgaattggttagccaattgctgatacattggaagggcaagctgttgaagaagcaacctaagaagaggagttcaattttcggagtcagattttgcggttcagacttgaggacaaatctgttcctcaaggaggggacaatgttagcaccccaaatgtggactcagaggcccaatttgagggtttattccagaaggaataagaaaaggaatgaatga

SEQ ID NO: 17853 - DNA, 372 bp, Glycine max
  Peptide Sequence Number=SeqID_134631
atggcagaacaaaacaagagagagttcaatggtgcagcaccagttgttgtgagctcaaggtggaatccaaccccagagcaactaagagcccttgaagagttatatagaagaggaacaaggacaccatctgccgagcaaatccaacacatcactgcacagcttagaaggtttggtaacattgaagggaagaatgtgttctattggtttcagaatcacaaagccagggagaggcaaaagcgtcgccgccaaatggaatcagatgctgaaactccagagaagaaagatttagctgcaagtaggacagtgtttgaagttgaacggaccaagaactggacaccctcaacaaattgcagtactattgcagaggtctaa

SEQ ID NO: 17854 - DNA, 225 bp, Glycine max
  Peptide Sequence Number=SeqID_134632
atgggcaggataaggaatacaatcgtcacggacgaggtcaaagagcttgaggcggtggcggggcacatgtggtgtagaccatatggccaaggaactttgatggctctaccgccagctaaacacaagcaaagcaaattttgcatggtggtggcagagaaggtggtgttgttcatagctaaaatagaaggggcgggggcggggttgatagtgtcactgtcaacatag

SEQ ID NO: 17855 - DNA, 360 bp, Glycine max
  Peptide Sequence Number=SeqID_134633
atgatgatacgattaattagggcagaaagtgaccaaatagttagccttagagcaagtaacaaggccggtggtgtcatcaaaggcataggagtacaccttaggacaagagctcttgaagattctggaatacactgtgggcccacaggcccgcgggcttctataactgccagtgcaacagtacctcagtcttctgaaatgactaattcaaaaggtgaaattttttcaaaaagagtgcaggaaacagcttggagatgcagaaaacaacatccagcattaaagggatatccttcccatacaaaaccatcagtatcgtgtagcccaactagagaccttcccaacccatttgctataagcctataa

SEQ ID NO: 17856 - DNA, 534 bp, Glycine max
  Peptide Sequence Number=SeqID_134634
atgtccgccatggatatgattaagtccctttccagtaagcctgaaaaatttacgggtgaaaattttttctgttggcaacaacaaatgaaattctggcttactgaattggatttatactctgtgatttctaaaagagaaataaaaacttcaacttcctctactgatatagttcaaactgatgcaaccattaagcatgatgtttctgataaagatattttatgtcatggacgcattttaagtgctttggctgataacatatataagattttttgtcataccaaaacttctgttgagttatgggaagcacttgaattgaaatatggatctgctgaaaaaggtttaagtcgttactcttgtgaaaaaatgattgagtttcaaatgattgatggaaaatctatttcagatcagatccatgaatttgaaaacattgtttatgacatgaaattgaaaggaattgttttgcctgacattatgcttgtggctttcatgatatcaaaatgcctccttcgtggactgattttgctcgaagcttga

SEQ ID NO: 17857 - DNA, 264 bp, Glycine max
  Peptide Sequence Number=SeqID_134635
gtggcctggccaggagcccaaccttctccttctggagggggtggggcctccacagcccaagagcctgagccagaggagccagcagtagcagagggggaggatgagctcacccctcctgagcccttttattttgatgcaggtgtacacatggctcaggaggaggagacttccacagaccagatcccagagccatccccagtacctatacctgatgatgccataccatttgcaccatcatctgagctagagcagcctatcccttag

SEQ ID NO: 17858 - DNA, 225 bp, Glycine max
  Peptide Sequence Number=SeqID_134636
atggcgcatgctagtggaatcaaattactgaatcttgtggtaatattatatatgcgttacttctgttggagcagcgagtacgcaatgagtttggctgagttggttggtccagcaggaattggcaaaacacaggaaagtgatggacaagttgaccctgctgaactttatcctggacaaagtcaagaactagagatccaattcgaaatgtttggttctggaatgtaa

SEQ ID NO: 17859 - DNA, 1038 bp, Glycine max
  Peptide Sequence Number=SeqID_134637
atgtcagtgattactctgcaacacactgtctcctctaacgacacactcgcacaagcaccattccctgaaccaccgacggagcgagaaaaactaaccgagacagaaagtgatcgcaatgttgcgacacttgggcgttcacgcgccgcgtttggccttcaacttcaagtcgagtttaattcacgaatacagggcgtttatccggtgcggccagaaccaccggcagtgggtgggtacgaaggcgttggagaggttcactctgtgggctcctcagttacttctctctctcccggtgactgggttattccctctccaccatctttcgggacgtggcagacttatattgtgaatgatgagaaagtttggcacaagatagagaagggtgtgcctatggaatatgctgctacaattacagttaatcccttgactgcacttctcatgcttgaacactgcgttactttgaactcaggagatgctattgtgcaaaatggggctaccagcatggttggccagtgtgtcattcagattgcaaaatcacgtggcattcacaatatcaatattataagggacaggcctggggtcgacgaagtaaaagaaaggcttaagaatttgggtgctgatgaagtttccactgagagcgaattggaagtgaagaatgtcaagagtctcctgggtggtatacctgaacctgttttgggatttaactgtgttggtggcaatgctgcttctctggtactcaaatttttgagacagggaggaactatggtgacttatggtggaatgtctaaaaaacctgtctctgtgtcaacatcatccttcatatttaaggatatttccttgaggggattttggctgcagaagtggttgagcacagataaagctgaagagagcagaggaatgatagacagacttttgagtcttgtacaagaaggaaagttaaaatacaagatggatttggctccatttgaggatttcaacacagcattggataaagctctgggaaaacttgggagccaacctaagcaagtgatcaaattctag

SEQ ID NO: 17860 - DNA, 1166 bp, Glycine max
  Peptide Sequence Number=SeqID_134638
ggcagaaatatggggaagtgagcaacaaactattgctctcacactctgctgattcagaagttgcgaaagggaaaaccgttgcagcaatgagcttccaactcttaaccaaggcgagaaagcgaactgtgttttcatatctactctcacgcgcattctctcaccgatcggaacggcctacatttggcatcgctttcgacatcgacggtgtccttttgctcggaaactcccccgtcggtggctctcccggagcactgaaaagattatacgacgccgatggtggtggctatcctgaagctaaaagagcttttgaactaagtaaactgttgggtataaatgtcacaccttcgcagggccattctccatttaaacaattggtcaagagatttgagaacgatctcattgttgctgtgggaaaaggggaacctgcagctgtgatgacagaatatggttttagatatgttctttcaattgatgaatatgcctcatgctttgaaaacattgatccactggctccatacaagaaatggacaaccaagctggctgttacacagaatgcaaagttcaatgagagtgttccaaggaatgatgtcttctctaaaagggttcaagcagcatttgtagttagtgaccctgttgattggagcagggacattcaggttctctgtgacatcttgaaaacaggaggccttcccggaagaaatgttggaccacaaccacacatatattttgcaaatgatgaccttgaataccagactaaatttccttctgaacgtcttggaatgggagctttccggattgcattagaatccatcttcaataggatccaccctcaatccttggagtataccagttttggcaaaccacatccatctgtattcaagaatgcagaaattctgttagagaaacttgtggcgtcactttatgatgatttctatgatataaatcatgataacacttcatattttaaaacactttacatgattggagataatcctgcagttgatatcaaaggtgcacgacagactgggcatccttggttttctattctcaccagaactggggttttcaaggggaaggaaaatcatgacaaattttcagcagatctggtggttgacactgtagaagaagcagtggactacatattgacaaaggaatgcgcttcatag

SEQ ID NO: 17861 - DNA, 456 bp, Glycine max
  Peptide Sequence Number=SeqID_134639
atgagcataaaaaggtatcaatggaaggctagaaaccaaaggatagtgcacttacttgtatggggtggcaaggacactaaaattgaagcaaaaagcacacaatggtggcctagggtcagcaaaaaccagaatctcgtgagtgcttgcgtccttaaatgttttgatgataacaaagatgatgacaaaggtgatgacaaaaagctcaaaggtcaatcaaagaatgagttcaagatgttcaagatagaatcaagaacacttcaagactcaagaggaaagttgaagaacacttcaagattcaagaggaaagttaaattcaagaatcaagaatcaagattcaaggatcaagctttcaagactcaagattcaagaatcaagagaagacttaatcaagataagtatgaaaaggtttttctaaaagtcataactcttccaaatggttctcttgaccagacatga

SEQ ID NO: 17862 - DNA, 972 bp, Glycine max
  Peptide Sequence Number=SeqID_134640
atggttcatgagctacctttcagcattgtcaaggatgaagtatggatgtgggcattccaatatgcaaattctaaatttcaaaaaataagtcgaaaaacagtgagaagttggaatcttcaaaaaaaagtcttgagttttgtgaaggtgcctgctccacagcgaggaattgatgtggctgatgccattttcaagtgcttaaaggcacgggggattgaagacaaagtgttttttgtgtctgtcgataacgcttcttacaatgactcatgtttgaagaatcttaaagaaaacttatcattgagcaaaatgctgattttgaatggtgatctgtttcatgtcagatgttgtgcacacatattaaacttattggtgcaagatggcctcagtaagattaaggatatcattcagaatgttcgtgaaagtgtgaagtatattaaccataatgattcaagactaaaggcattttgtgatgttgtagaacaaaaacatataaaagaaagaaagctcatcattgattgtcccactaggtggaattccacatttcaaatgttgtcaacaatattgaagttcaaaactgcattttcagcctataatgaaagagatccacactatacttatgcaccttcacatgaggattgggaaaaagtgcaaaaggtttgtacacttttagaagtttttaatgtagctacacatataatctcaggcagtgagtatcctagtactaatttatatcttgtagaagtttggagggttaagcaactaatagacaatgcattagaggatacaacttttttcatgagagaaatggcaggttcaatgaaggtaaagtttgacaaatattggggagaatgtaatatgttgatgtccattacaagtgttttggatcctaggtgcaagttccatgttgttaacatatgttttccattgatatacaagtctgaagaaattgcaaaggagaatatagagaaggtatga

SEQ ID NO: 17863 - DNA, 420 bp, Glycine max
  Peptide Sequence Number=SeqID_134641
atgggtgaagtagacgagctgcaagagtggatgaaggctgacatggaggccatgaaagaacaaatcaccacaatgatggagaccatgatgagcatgaagaagatgatgggggtcaatacggctacagttaccgctaccagtgccattgttgaggtggagccaactcccccatctggcctcaaccaaataaatcatccaacctcaaatatggtagggcagggaggcaaagagttgggaagtactggcagcccccattttgtgcaaattcaaaacaagcacgccttcccgccatatggcttgcctccgaactatactccacccaatgagaatgtcaataactccactcccatactcattgagagccaacaacctcaatctgatcatgcacatgtctctcaacccatggggggagacacatga

SEQ ID NO: 17864 - DNA, 204 bp, Glycine max
  Peptide Sequence Number=SeqID_134642
atggatgccgccagttctactggtgagaagcttgtaccgccattgctgatgacgagagagcacgatgctgagcccatgccgccattcgtactggcgggacatgccaacgtggacagtcccgccattggctcctgcaaaaccaatagagagaaaaaaaaattaaagcaaagaagaatccgccattggctcctgcgagaccaatag

SEQ ID NO: 17865 - DNA, 261 bp, Glycine max
  Peptide Sequence Number=SeqID_134643
atggctgtggctgatgcatttgatgagcagtgtgattacttgttcaaggctgttctaattggggactcaggagttgggaagtcaaatttgatatcaaggtttgcaaaagatgaattcaggttggattccaagccaaccataggtgtggaatttgcatacagaaacatcaaggtcagggacaagctcatcaaagcacaaatatgggacactgccggccaagagaggttaaccaaattaccaaattcttgtgctaagaaatag

SEQ ID NO: 17866 - DNA, 783 bp, Glycine max
  Peptide Sequence Number=SeqID_134644
atgaaaagattgaggcatccaaatgttgttctcttcatgggagctgtaactcgacctccaaatctttcaattgttactgaatttcttcccagaggaagtttgtatagattacttcacagaccaaacagtcaattagatgagcgaaggcgtttgaagatggcccttgatactgctcgaggaatgaactatttgcacaactgcactcctgtggtagtgcatcgtgatttgaagtccccaaatcttctcgttgacaaaaattgggttgtgaaggtatgtgattttggcttatcgcgtatgaagcatagcacattcctttcttccagatccactgcaggaacagccgagtggatggctcctgaggtgctgagaaatgaaccttcaaatgagaactttggggtcatattatgggagctctctactttgcagcaaccgtggggagggatgaatccgatgcaagttgttggtgctgtgggcttccagcatcgacgtcttgacattccagatgatatggacccggcaattgcagatattatcaggaaatgctggcaaacgaaaaagaaagacaatcgtgagcagtatatccttagtgacctaacaattactccaaattgtggtaggactgtagaagtagatccaaagttgagacctacatttgctgaaatattggcagctctgaagccgttgcagaagtcagttattggttctcaagtgcctcgaccaagtgcatcggggaagcatgagaaggttcagtcattgcgtgttgcagaagactcagcaagatag

SEQ ID NO: 17867 - DNA, 510 bp, Glycine max
  Peptide Sequence Number=SeqID_134645
atgaagtcctacatggagtcttttgatttgtggaatgttgtggaagaggattatgaagtgtctctgctgcctgaaaattcatccatggcccaaataaagcatcacagggagaaaaaaaccaagaaggaagagtatgaaggggatgatcacgttcgtggcatgcaagtgcttaacatgatgagggaatttgaggagcaaaagatgaaggaattcgagacaattaaaaggattccagtttttagaattgttgaaaaaattctggttagagtgcctaggagatatgaagcatttataatcactttggatattacaaaggatctgaccaagatctctttgacagaggtgatacattccttgcaagtccgggataagagaagattgacgagggaagaatcaacagttgaaggagctttaccaaccaagcaccagaatgcgaccaaatacaagaaaaacaagaactttgatggaacacaatcaagttcaacatcaaccaatgcaaaaggaaattga

SEQ ID NO: 17868 - DNA, 177 bp, Glycine max
  Peptide Sequence Number=SeqID_134646
atggagggtgctggacgaagcagaaacgagaatgttagcttgagtaacgcaaacattgatgagaatctaatgcctcgaaaacccaagggttcttccgcaaggttcatccatggaggacccttaaaggttgtgccaacatgcactgcaacaaatgtgactgactgccatatgaaatga

SEQ ID NO: 17869 - DNA, 1344 bp, Glycine max
  Peptide Sequence Number=SeqID_134647
atggttctagctgatagtttgggcatcccatgtcggttggtgaaggggctgcaatatacaggctctgatgatgtggcgataaactttgtcaagattgatgatggaagggagtatattgttgacctaatggcagatcctggaacacttattccttctgatgcaactggatcacatatagactatgatgaatcttcgtatgtggccagtccttcatcaagagaccttgattcctcgcatgtagcatcatccagcagtggtgttggaagttcatatgaagaaacttcagatttggggatgttggacaaaggaaacagatcaaaacatttttgccatacagggaaagaatatgatgtaagcaggccctccacaggaaatgaaggatcaatgagacccttaaatgaatttaaaagtccttacaatgttgagaagatcacggggcaggaagctcctggcagacctaatcatccacatgtacatgcaagatctccttggactgaagggataagttctcctgcagtacgtagaatgaaagtcaaagatgtttctctatacatgattgatgctgccaaggagaaccctcacttagcccagaaacttcatgatgttttacttgaaagtggtgtagttgctcctccaaatctattttctgaaatttatgatgaggaattaggttcctcaactgaggccaacttactaactgaagaaaaagatgaacataaacagggaagtggactgcaagaagctgagatttatggaaatcttagtcctgctcaaattttgcctcctagagctcttcccaaagcaagttctagcagtcagctggagcattcaaaacctgtagaaggtttaggaatcaaccttcctcttcatacgagggaagcaactggacagcatataccaactcaggtaaaatatgggcaaaatgtcccagttgctgccgctgccgcagctgctgctgctgttgttgcatcttctatggtagttgcagtggcaaaatctagcattgactcaaacatagagcttccagtagcagcagctgctactgctactgctgcagctgtagtaactgctgctgtcagtagacagtacgaacagggcagtcgaagtgatggagatacagacagtgctggttatgacctgaagggtagtggtgatggggagcatatagctttaggagcaaattcagaaggtgacagaagatctgataggtcagtagtaagtaatgatagcacaaaatctgattctgcattagatgatcatgaagtcgctgaggttgacattccatgggaggaaatcacgctcgggtcgtatggggaggtgtaccatggtgaatggcatggaact

SEQ ID NO: 17870 - DNA, 978 bp, Glycine max
  Peptide Sequence Number=SeqID_134648
atgaagaaccttcttaagaagcttcatatcatgtctaaccgatcagagaatgaacaagggtcttgttcgtcaaagggaaacaagtccaatcttggttcatcttcatcttccaacaagaaggttttgggctcaaagtcccctcaaagttctgggctctccagttggttgcattcagttgctaataggcagagtgctggtcctcctccatctctgacccaggcaaggggcgagagaatggagccatctgatgcagtgagcagtggtggttttgatgctgtgtcagattcagctaggcttgattcagggtctagtgcttccagggatcctgaagtggaggaagagtatcagatacaactggctttggagctgagtgcaaaggaggatcctgaggccgcgcaaattgaagctgttaagcagatcagtttgggatcttgtgaccctggttacacaccagctgaagttgtggcctaccggtattggataagagaagtttgcctttggacttcagagttaagatttatccgtgcttcacagaattacaatgctcttggttatgatgacaagaccttagatggtttctatgatctgtatgggagcttaactgagtcaacccctgcaagaatgccttcccttgtagatctgcaactgcaaggaacaccaatctcaggtagtggtacatgggaagctgtcttggtcaatagggctgctgattctaatttgttgaaacttgtgcaaaaggcccaggagttgactgacaaatcaagtccagattttgaagtagttatagatagcaatttggtgcgcaagcttgcaatatttgtggctgactatatgggtggacccgttggagatcctgaaagcatgacaagagcatggaggagtcttagttacagtctgaaagcaacccttggtagcatggttttgccacttggatctctaactattggattggctcggcatcgtgcattgttatttaag

SEQ ID NO: 17871 - DNA, 159 bp, Glycine max
  Peptide Sequence Number=SeqID_134649
atggcaaacttgtcctcgaatggcaaacttccggtagcttctccggaagaagcatgtaagcggtgtggtgactctcgggttttacaacgcagcttttcatcgttcagtctaaggcacacgcacaccatcaagtcatcttctggtctgctgatatctatg

SEQ ID NO: 17872 - DNA, 258 bp, Glycine max
  Peptide Sequence Number=SeqID_134650
atgtacaaagataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcagcaagataccttggacatgcatggcatcccctttatccccgaaccgctggccaaaccctgacatatatcatgaccagccgttctacaagccttga

SEQ ID NO: 17873 - DNA, 522 bp, Glycine max
  Peptide Sequence Number=SeqID_134651
atgcggtgcacatggttctatgcaaatccaacggataaaagtacgttgaaagtaaaaatatatattttttctatgaatattcctaattacttgctattgcctcagattgatgttaatgatcgagaactgattgcacttaaagctgtaattaagtgtattgaagatcacaaacttgatgaccagtaccctctggatcctctccagaagcgagcgacccaactcgagaaggccaaggctgacaagaaaagggtaactgaagcaacaaagcctcaacccaagagaccccgtgctaatggtgtgggatatggcccgcgtgtcactaacattctatctgacaaaacttcttatgctagagttgctgacaggtatcctcaatacgtgtatgaccgaccttacatgtaccctgcaccaactgacaatcactgccctcctctcatgggttctgcaacttataacatctctcctaatcctggcaactactttggaaatggctatcagtaccaagctacatatctccactag

SEQ ID NO: 17874 - DNA, 261 bp, Glycine max
  Peptide Sequence Number=SeqID_134652
atgaccatattggtctctgcgtgtcatcgaacttgccatctctggatgacgaaggggagactgcaacagtctcggttaagcataaatgacaggggacttttgactcctatgaaagataggcagagggctttgagccctctgaaggtgaggactttgagccctctgaaggcgaggactttgagccctctaaaggcgaggaccttgagccctctgaaggcgaggactttgggtcctctaaaggcgaggactttggtcctctga

SEQ ID NO: 17875 - DNA, 380 bp, Glycine max
  Peptide Sequence Number=SeqID_134653
atgactatgaaaacctatgaacaaggaagatgggtgatgaaattgagggaaagatcctcccaaatgccaaaagggatgggtaaaggttgtaagagtttgacgagccatcaggtgacaggtttgaattgtggcaatgttttagcgatacccaaatgggcgatagaggtgtatgcaatgggatcacctaaactgaagcaagcttcgattgaaaatctgggctctcctgaaggggtgaggggaaaggtaaaagagcttcttccaagaaggaaaatgcatgggagtcgccaccaacattcattcgaggaaaatgttagaaaaatcaaaaagaggtctgcgaatattgaaaataagggtttgggagttgtttacgcatggggaag

SEQ ID NO: 17876 - DNA, 213 bp, Glycine max
  Peptide Sequence Number=SeqID_134654
atggaaagcaaagaattcacagcttcattgttagatgacccacctccggatgtgatgctcatgcgtaaagaagtaccattgagtttgaaaagttccctcctaaaggaactaatgaagatgggatcacggtcagagaccagactgcaaggcagaccatggagtttgcaaacagtgcccagaaatagagttgccaccttgaacacagtgaattag

SEQ ID NO: 17877 - DNA, 420 bp, Glycine max
  Peptide Sequence Number=SeqID_134655
acttatcaaggtaatccttgtggcgtctaccctgacttatcttccttcactggaagtggcgtcatccaaatctccgtagcttgtatcaaacgatccgctcctactcaggttcacatcacctctcctccgcctcaacgagatgattcctcaaccctcatgaatgaagttcttttggaattacgaggccttcgcccctatgttggtgaacgctttgattccttgaatggtcgcatagatgccattgatgctcgctttgaaggaatggatacccgcatcactcagcttgaagaggatgaattaaattgtcatcatcaaaaaggaggagattgtagaagcaaagactttgatgttttgatgatgccatgtgatcatgtgcttctcaagtttaattcaagaggatcatgcgcttctcaagtttaa

SEQ ID NO: 17878 - DNA, 1059 bp, Glycine max
  Peptide Sequence Number=SeqID_134656
atgctgatgtctgtaaataatgagaatgcgacgggtggcgagagcgtggtgctggaacgtccggcagccggtggggtgtatgccaccctgtttgaaaaaatcaatcttaacccggtttctgagctgagcgcgctggatatctggcaggatgcgcaggcgatgtcggatgcaacggcggatgagcgtttaaccgccggcatgcaggtatttctggagtgcctgaaaaaatcaggcgcaaaagttgaaaaactcgacaaaaacctgattgaccaccatatcgccgcgctggatcaccagatcagtcgtcagctggatgcggtcatgcacagcgaagagttccaggcagtggagagcctgtggcgcggcgtgaaatcgctggttgataaaaccgatttccgccagaacgtgaaagtcgaactgctggatatgtctaaagaagatctgcgtcaggacttcgaagacagcccggaaattatccagagcggcctgtataaacacacctacattgatgagtatgacacaccaggcggcgagccgattgcggcgctgatttccgcttatgagtttgatgcgtctgcgcaggatgttgccctgctgcgcaatatttcaaaagtgtctgctgcggcgcatatgccgtttatcggctctgccggcccgcaattcttcctcaaggattcaatggaagacgtggcggccatcaaagatatcggtaactattttgaccgcgctgaatacatcaagtggaaatccttccgcgagacggacgattcgcgctacatcggtctggtgatgccgcgtgtgctgggtcgcctgccgtatggcccggacaccgtaccggtgcgcagcttcaactacgttgaagaagtcaaaggtccggatcacgacaaatacctgtggaccaacgcctcgtttgccttcgcatccaacatggtgcgcagcttcattaataatggctggtgcgtgcaaatccgtggtccacaggccggtggtgcggttcaggatctgccgattcatctgtacgatctgggcaccggtaatcaggtgaagatcccgagtgag

SEQ ID NO: 17879 - DNA, 132 bp, Glycine max
  Peptide Sequence Number=SeqID_134657
atggcgagtcacagcaactcaggcatgcacttttcacaagtcttcgtatttcaaaggtccaaagcagagtttcctgaaagcttcatggggtttcctgaattgggttatcaaaaaactcaggtggttatttga

SEQ ID NO: 17880 - DNA, 717 bp, Glycine max
  Peptide Sequence Number=SeqID_134658
atgcaggttcttattatcaattcctgcaattctgttagtgttactaatctgaacatgattaatagtccaaaatctcacatacacgtaaatggttgtgagggtgccacattttctcatattaatattagtgctcccggtgatagtcctaacactgatggatttgacatttctacttccaaaaatatcatgatcgaagattcaactatagccaccggtgatgattgtattgccatcagtggtggctcctcctacatcaatgttactgggattgcttgtggaccaggccatggaataagcctcggtaaaaagtttgatacagtccaagaagtttatgtacgaaattgcagcttcataagaactacaaatggagcaagaatcaagacatttccaaatggaatgggttatgcgaaacaaattacttttgaggatatcaccttagaacaaactcgcaacccaataattatagatcaagagtatcgtgatttaacgaatcaagcagttgaagtcagtgatgtgacatacagaggaattcatggaacatctctagatggaagagctattaccttagattgcggcgagtctggttgttatggaattgtattggatcaaatcaacattgtctcttgtttaacaggaaagtctgcttcgtgtttttgcaataatgctcatggaacagctacagctacaaatccaaattgtacttgcttattaccatga

SEQ ID NO: 17881 - DNA, 264 bp, Glycine max
  Peptide Sequence Number=SeqID_134659
atgttgctaagtagcaacgtcatccatatctatgtaagagtggtcatgccggtgtgcatgattcgcactcgtctccttgcagcggttgggttaaatcttgcccagatgtggagccctctgaaagcgaggacgtgcagccctctgaaggcgatgaccagtagtcctctgaaggcgagggcgtgcagtcctttgaaggcgagggcgtgtagccctctgaaggtgaggacgtgtagtcctttaaaggtgaggggtgggatcctctag

SEQ ID NO: 17882 - DNA, 342 bp, Glycine max
  Peptide Sequence Number=SeqID_134660
atgccgatctccccctgcagaaggatcttgcccacaagacacccagtggactcgaaggagtccaacaaggccctaaggtttccagctctggttacaggcctctatcagtcctacagggtgcccgtccccccagcaaggtcatgccatcgtgacattgggatcgcacctgcaagatgcccagtggacccgaagaagtccaacaaggtcctggggtttccagctctgattacgggcctttgtcagttctacggagtgcccatcgcccccagcaaggtcatcaggccccctactaaccgagctttcatcaagaaatacttgcgcccacaggcaggcgcagggtga

SEQ ID NO: 17883 - DNA, 456 bp, Glycine max
  Peptide Sequence Number=SeqID_134661
tcgtttggggttcctgtcacacctagtaaggtgattcaaccgccgatcacccgatctttcatagagaagtactgcatagctagacaagcacagggtggcgacccgcaggccccagacgcactgccgccacctcctcaggctgatccagctgggtcatttgacacggagcggtatttacggcaattggttcgccagcaggcggccaaccacagggcgcacgtgcagacccatggctgcctctaccagctcagccttagcctgcagagccagggtttccctccttttccatgccctactccggatcagttcagggcagaggttgcatggcctggagattggcctgaggcccaggcaggggaggcacccacagaggctctcggcgaggcagatgaggcccgcatggatgaggagataacagatttgctcgattttttgggagggagcggagccacatga

SEQ ID NO: 17884 - DNA, 228 bp, Glycine max
  Peptide Sequence Number=SeqID_134662
atgccgccgcacaaaacgtttcataaccactgcatgcaatttaaaaggggtatcttaaggctttccatctctggcctccacaatgttccagtcccctttctaagcgtggtaatcgattacacccccttggtaatcgattaccagaagccctcatggcttcctgacctcgttttcaagcctggtaatcgattacaccccgttgtaatcgattaccagagaccatcttag

SEQ ID NO: 17885 - DNA, 300 bp, Glycine max
  Peptide Sequence Number=SeqID_134663
atgcaaattcagcatgtgaattccagtattgagttgtgttgcagcatctcttgtttgaataagcaagcgaggagtagagttcatgatttgcctaatctcgaaccagattctgatgcggccttggggtgtattgtgtggttggagtggcccaggatggtggccatggttgagtgggttaagcaagctcgcaaacccagtaagtcaactgctctaggcatcccagaaaatatcttctaccaagacattcactggggaagcagaagtccttttgaagtcccctgcttacaccggagtgaatga

SEQ ID NO: 17886 - DNA, 1824 bp, Glycine max
  Peptide Sequence Number=SeqID_134664
atggccatgtcatcaagaaacgatgatattgggataagggaaggggaaaaggaggaggtgttgcaagttgtggaggatgttgatacttttctccgtagtggtggggatcatgttcctgattgtgttcatgtgttgcccaaattgttagagcgtattgtggataaatacaacgatgggagaaaaaagttaggggaagagccagaagatgacaagtccttcctaaatgttgtggaacgcatcttcaagctttccacttgcgatacatgtgatattgccttggaccaaactagttctgtcctagaaaaagcaatgtccctgttagagaaagacctctgttctcttctagaggaacccaaacaaaaagcaccaaagaaatcattctcctttggttctcgttctgatttatctctcattccctctaagtccccttttttggaacaagatcaggataaccatgacttcccttttaatttctcctcacaaaaaatttccattttaaacaagatcaccactaccatgatcacaaccggttaccagatcgaatgttgcatgacttttgccaattttaggcgaagtgcttttacaactgcattgcaaagatttgggcataggaacatgaaaatggaagatgtgtacaaaatgccatgggaatcactcgaaggagaaattgcaacatggaaccaagtggtttggcattgcaccaccgtgcttttcaacgctgaacaaaggctttatgactctatcttccccaatcaaccttctatatctcaaaaattgtttggtgatcttgcacgatatgtcatcattcgtttacttaactttgcacaaggtgcagttttaacgaaatggtcagcagagaaactattcaaattcctggatatgtacgagactttgagggaagacattgttgggggttcttatttggagtcgtgtgcaaaagagttagcatacgagacaagcactacaaaggacatgataatagaggctattgtggccatgttttgtgatttgaaaacctctatcaagaatgataatgaaaggattcctgtccctaatggtgcagttcaccccttaactcgttatgttatgaactatcttaaatatgcatgtgagtacaaagataccttggagcaagtattcacacaaggtcaaggtgccaacattgaagggattgagattcaaaatcacaaatccatccatgaggaagtggaagatgtagggatgcccaagaattcaccttttgcacttcaattgataaccatcatggaccttttggatgcaaacttagaaaggaaatcaaagttgtacagggatcttgctttgcactatttttttctaatgaacaataagagatacatagtgcaaaaggtcaaagggtgtgtagagcttcatgaattgatgggtgacaattggtgtaggaggagacaatcggggttgaggttgtaccataagtgttatcaaagagaaacttggagtaagatattgcagtgccttaagccagagggtttgcaggggactaggaacaaggtgtccaaacaacttgtgaaggaaaggtttaagtgcttcaattccatgtttgaagagatacacaaaactcagtgtacttggatggtgagcgatgagcaactccagtccgaactcagggtttcgatttcaactttggtgatcccagcatatcgctcctttgttggaagattcaaacaacatttagaatcaactagacatattgacaagtatatcaaatatcatcccgaggacattgaacttttaattgatgatttatttggtggtaatgctacgtctatgactagaagaagaacatga

SEQ ID NO: 17887 - DNA, 1536 bp, Glycine max
  Peptide Sequence Number=SeqID_134665
atggcaggaggaggttatgtagattcgggaaatgcaaagcaatttgaagggaaggtcactgcattcgtattggttacatgctttgtggcagccatgggaggcttactcttcggttatgatcttggaataaccggaggagtgacttccatggaaccatttctcatcaaattctttcccggtgtctataaacaaatgcaagatgatgtcggccatagaagccaatattgcaaatttgacaacgagctccttacactatttacctcttctctgtatcttgctgctttagtagcttctttctttgcttcttccaccacaaggatgatgggacgcaaggcctccatgtttttaggaggtttgtttttccttgtgggcgcattgttgaacggtttcgccgtcaacatcgaaatgcttatcataggccgtctcttgcttggtttcggtgtaggatattgtaatcagtctgttccagtatatttgtccgaaatggctcctgcaaagattagaggtgcacttaatatgggcttccaaatgatgatcacaattggcatcttagctgcaaaccttatcaactatggaacatccaaactagaaaatggatggagaatttctttgggtactggagctattcctgcagtcatgttatgtgttggagctcttttcttaggtgatacacctaattccctgattgaaagaggccaaaaggaagaagctaagaaaatgttgcaaaagatccgcggcattgacaatgttgaagaggagttgcaagctcttattgatgcaagtgagtcagctaaagaggtggagcacccatggaagaacttcacacaagcaaaatacaggcctcaactcattttttgcaccttgattccatttttccaacaacttactggcattaatgttgtcatgttttatgcccctgtccttttcaagactttgggctttggcaacgatgcttcccttatgtcttcagttatcaccggaggtgtaaatgtggttgccactttggtttccatcttcactgtggacaaggttggaagaaaaattttattccttgaaggtggtgttcaaatgtttatttgccagattgctactggagtcatgattgctatgaagttcggggtgagtggcgaagggtcattttcttcaggagaagccgaccttattttgttctttatatgtgcatttgttgctgcatttgcatggtcatggggtccactaggatggttggtgcctagtgagatttgctctcttgagattcgttccgcaggtcaagccaccaatgttgccgtaaacatgttgttcacttttgctattgctcaagttttcctagccatgctttgccacttgaagtttggccttttcttcttctttgctgcatttgtgctcatcatgaccctcttcattgccctgttgttgcctgagacaaagaacatccccattgaagaaatgcatttagtgtggaggtcacattggttttggtcaaagattgttccacaggttgataatgatcgcaagccaactactgctcagagttga

SEQ ID NO: 17888 - DNA, 1560 bp, Glycine max
  Peptide Sequence Number=SeqID_134666
atggaggtggtttgtcggggaatgttgaaacccagaaagttcatgcagaggaggaggaaattcgaggttttcaaggatgctgcagatgaagctgaccagaagaattggaggagaatcatgactgaaatcgaagaatcgggttctgctgtctctgttctctcttctgagaagattaataaccaaaatattcctaaagaccttcttgttggtaccttgattaggtttaagcaactcaaaaagtggcaccttgttgttgagattcttgactggcttcggactcagaactggtgggattttgggaagatggatttcttcatgcttatcacggcttatgggaagctaggagacttcaatggtgccgagaaggtcttaggattgatgaataagaatggttatgtaccaaatgtagtgtctcaaactgcactcatggaagcttatggaaaaggaggcagatataacaatgctgaagcaatattccgaaggatgcagaaatggggtcctgaaccttctgctttcacataccagataatacttaagacatttgttcagggtaacaagtatagggaagctgaagaattgtttgacaatctactgaatgatgaaaattcacctttgaaaccagaccagaagatgtttaatatgatgatttatatgtataagaaggctggaagttatgaaaaggctcggaagacatttgcactgatggctgaacggggaattcaacaaactactgtaacatataatagcttgatgtcatttgaaacagattacaaggaagtttcaaacatatatgatcagatgcaaagagctgatctcagacccgacgttgtgagctatgccttacttgtaagtgcgtatgggaaggcccggagggaggaagaagcattagctgtatttgaggaaatgcttgacgctggtgtcagaccaactcggaaggcttacaatattttacttgatgcattttctatatcgggaatggtagagcaagctcagactgtgtttaagagcatgagaagggatagatactttccagatctttgctcatacactaccatgttatcagcttatgtcaatgcagatgacatggagggtgctgagaagtttttcaaaagattgatacaagatgactttgagcctaatgttgtcacttatggaaccttgattaaagggtatgctaagataaatgatcttgagatggtaatgaaaaagtatgaagaaatgcttgttcggggaatcaaggccaatcagacaattttgactactatcatggatgcatatggaaaaagtggagacttcgacagtgctgttcattggtttaaggaaatggagtctaatggaattcctcctgatcagaaagctaaaaatgtccttctatctttaccaaaaacagatgaagaaagggaagaggctaatgagctcgtaggacatttcagtgaaaataacagtttatctaaagttaatggtattgttaaacttgttgacgaagatgaagaaaataaatatgaatattttgatgcccagctcgaaagggcttatgaacattctacagagttaagttga

SEQ ID NO: 17889 - DNA, 141 bp, Glycine max
  Peptide Sequence Number=SeqID_134667
atggaggagatggagaggttgcagttcctcaatatcacacacaaccctaagtatcatttccttaatgaaggatttggtcatggtggtggaagtggtgatgctctgatgatggtgtcgcggtgttgcacgtactatgtttag

SEQ ID NO: 17890 - DNA, 558 bp, Glycine max
  Peptide Sequence Number=SeqID_134668
atggttatggctcagaaagtttttgagtccatgttagagaaggatgtccggtcatggagctctttgcttgatggttatgttaaggctggggaatacagggaagccatggctgtctttgaaaagatgcaggctgttgggcccaaagccaatgaagtaaccacggtgagtgtctcgtgtgcctgtgcacacctgggtgctttagaaaaggggagaatgatacacaagtacatagttgacaatgggtggccactgacattggtcttgcagacttctcttgtggatatgtatgccaaatgtggggcaatagaggaggctttgcttatattccactgtgtctctaagagtcaaactgatgtgttgatttggaatgcagtgattggaggtcttgcaacacatggattggttgaagaatcccttaaattgtttaaggaaatgcaaatagttggtatctgtcctgatgaggtcacatacttgtgcttgttggctgcctatggccatggagggatagttaaagaagaagcatggtattctttgagagtcttagtaaatgtggcatga

SEQ ID NO: 17891 - DNA, 948 bp, Glycine max
  Peptide Sequence Number=SeqID_134669
atgatgttgacacattgccatgaattgtgcaagccagtttccatcatgattctagttaacttgactctagcttttgtcaatttacttctgaagaaggttcttaatgaaggaatggactacatgtgcattataacatatcgacaggcaatttcatttatcttcatggcacctattgcttgcatctatgaaaggaaatacaaactggaggttcacataatatctctccttttcctcagtgctcttctcggagtaacaattcctcaatacttatttcttcttggacttaaatatacgtctgccacattctcatgtgcgttcctcaacatggtgcctgtatttacgttcattatggcagtgccatttgggatagagaaggtgaacgtgcaaagcaagagtggtaaagccaaagtcatgggaacttttgtgtgcattggtggagctttgttattggtcctttataaaggagtgccccttatcaacccacaatctcaacacatagcaaacaaaattacaagcacacctccaactgccaagttagagaaatggattataggttccatacttctgacactaggttgcctcctgtggtcttcttggttcattatacaagcaaagattagcaaaaaatacccatgtcaatactctagcacagctattttgtcactttttgctgccattcaatcagcaatattaagtttggtcttcaagagaaataatgcttcgtggattctcaaaggaaagcttgaaataattagtgttgcatatgctattccaccatttctactttccaccgcatctaatgtatctccatctgcaatgagcagtgttgcaggatctaccttggttattgctggcatgtatattcttctgtggggaaaaagcaaagaggaagaagggcaacatgttctgaaggatacacaaacaaatcaggatgtagaatgtcaatag

SEQ ID NO: 17892 - DNA, 345 bp, Glycine max
  Peptide Sequence Number=SeqID_134670
atggttcaacaaggtttccttcctgatgtagtttcctattctgcatcaataaggggattgatcaagattcaagaagtggatcgagcgttgaaattgttcacggatttgtgttctcgtggtcatcgtcctgatgagagggctctgcaaggccaacaaaatagttggtgcaaaaatggatttgtagataagattatggcacttctttccagaatgtctggagaagacagggagcccaatgtcatttcttattcaactttggtggaagggttgtgcagagcagaaaggcctgatgatgcactcttggtttggaatgagatggaaagaaaaggttgttctccaaattga

SEQ ID NO: 17893 - DNA, 684 bp, Glycine max
  Peptide Sequence Number=SeqID_134671
atgtcaaacaaattttcaaatgtattgtcaggtagactaatatgcattgatagccgtgaacgtcaggataaagagtcaaaatttcaggggctcatctttttcttatcaccagccaccaccaccaccctcttcccacttcacttcaactcttgctctgcctctcatgccgcttccactttgatcctcactcactcatcaatcaatggcttcctcttcctctttactcccactctagctcaaatttcttgcaccgcaaattacccccaaacggcgtcattgacagagtggacgacgtcaaatggagttgccgccagcgaatacagtggtaacggcttcgttaacggttacgtgaacggcgtctcgggagttatggagatttttactattttcgtgctcttgcgcttcctttctttccccctttgcagcgccgctagtttattgactcgatgctcttcttccttcactgatttctcttttgctagattcaattttatttcattgggtttgcggaaaaatctgggcaagaggctagtttggtgttccatttctcatattcttccctcactcccacaaaacaaaaaattagtagcgaacgaaagcttagtaaagtacgtgaacggcaatggtgtagcggcaggagtgatggaagattttgcaggaagctttgaagcggaaggaagatga

SEQ ID NO: 17894 - DNA, 672 bp, Glycine max
  Peptide Sequence Number=SeqID_134672
atggaggacctaccttttaggaaattcagatttgttgatttttcgactgtcattgttggtgatctagaaattggactcttggttggatcatatttagcctcagtcagtaattttttgaaggcgtctaaactaattatcaatgggcttgtgtttgaaattcaacaattcagagacaggcttttggattcggggattgaggtgagatcaattttgatccctagcgggcaagggagttcacaggtttcaaggtatagaattgaagttatggttgatcacaggggcgagcagacgaaatttttgctctgggaccatgaatgtgcagagttaattggtcaatcaacggatgaagtcaacaggctcaaaatagcagatggtgatgttcatttgaatgcctctcctcaagcactagataggctactcggttgtttccttgcattcaaagttaagccatcttgcaaaatggagagttcaatgctggagtcaactgatgctgcaaagcttgaatctcaatatgtctttgttactgcggatcatgatcctcttctcagggttccattaacaccgactaagtgcttatcgtctgatgaattggatgatgaacccaaaaatttggagatctcgcccgcacaagtttcctcaaacaaagtagccaggcattatcagcctgaatga

SEQ ID NO: 17895 - DNA, 630 bp, Glycine max
  Peptide Sequence Number=SeqID_134673
atggcgtgtcttcccgataagataaagtccattgatggttcaagagaagctctcaaacttattgtaaggatcaccgatctttggttcattgggatcccacacaaaattgaacaagccgaaatgggagatgaaattcatgttgtttgtaaacaagatcagctaaaggtttggaaggcggatttgaaggaaaattgtatctatgtgatgcataattttaaggtgctgaagaataatgatgtcattggggttgttgatgaagtggtgttccgttatgtctcatcgaaaaatacaagggttgttttgaaagttaaggatttgagtggtcaaatcctatcttgcacgctttggggggattactgcttacagttcttggcttacttggatgttgttgaaaataatgggcctgtggttattcttttgacgtatgctagaatcaaagaagtcgagggatcatacccaccctcagtgagtaattctttgaaggcgtcaaaactaatgataaatgagcttgtgatggaaaaacaagaattcaaagagaggcttgcaaattcagggattgaagttagatcagttttaacacttgttggccaaggggcttcggaggtttcaggatcatctcaaatgtcatga

SEQ ID NO: 17896 - DNA, 636 bp, Glycine max
  Peptide Sequence Number=SeqID_134674
gattgtatggtcctggaatatgggtgtccgatccttatggactaactggaaggatacaatccgtaaatcccgcgtggggcgtggaaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtag

SEQ ID NO: 17897 - DNA, 614 bp, Glycine max
  Peptide Sequence Number=SeqID_134675
atgctggcgcagttcggcaaggacgtgcctgaccaatgctaccgggtggaggcatggttgctgcgcggccaggccgatcccgccaatgcgggcacgacggtggacatcgcgtcgcccgacttctcgccgctggtgcgctgccagcagctgacccatcgcgcgtccagcgcgggcgtcgagtgcgcaatctccgtgcaggaggcacaggggctcgctgcattcaccgctgccaaggcggagttcctggctgagtatcccggcttccccgacgcatcggtagagaagatgcgcaacgaggagtacgcacggctggacgagcagcacgtcacgtatctggatcatgtaggcggaaccctgccacccgaaagcctgctcgaacaggacctgcaggcgttgaagcacgcaatcctgggaaatccgcatagcggatcgaaggcctcgcaggcggcataccaggaggcgcgggatgccatctacgccttctttgactgctctccggacgagtacgaagtgatattcactgcgaacgccagcagcgcgatccggcttgtggcggaatcgtttccgttccaaccgttcacgcagctgctgttaccaaggacaatcacacgtcg

SEQ ID NO: 17898 - DNA, 360 bp, Glycine max
  Peptide Sequence Number=SeqID_134676
atggcctttgtggataactgggcggtgggtaaggagaaggtttgttattggctgagtaatgacattgttgcgttggtgggaaacttggctgtattggaatggcagtcacagcacgggatgactaaatttgccttttttcagacccacatcaatcctttcactggcaaagaccaaatccgcaaagctttgaaggtgccacttgagctgccaggaatggactcgggaaggttccaagttagtgtaccaggtaacaactaccccagtgtagctgggggtgatactgagggccttccgaagttttttcaaggggtataccaccaactgcttgcccttcattggcatatccgagccaaggcttga

SEQ ID NO: 17899 - DNA, 525 bp, Glycine max
  Peptide Sequence Number=SeqID_134677
atggatttcttttctgatgagagtttcaaatgcattcaagcatttcataactcaaatctcattccctttatgtctttaaaactgcctgtgtattctgaattggtaaaagccttttattctaaccatgaaattcaagaaagtaccttgatttctaaggtctatgggataaagatggtcattgaccaatccctcttttatgatttgacccaattgtctagtgacggtgtaacatttgaaggtgcactggatgatgattggaagtttgatttttctgtgcatgatgcccgtcggttgccaaatgatgatgaaggacacttacctgttgaaggagactcttctctccttcagagtattttggacaggtttgatggacttcaaacctatgttggtgagaggtttgactccttggaacgtcaagtgggtgcacgattcgaggagatgaactcaaggattgcaaaggttgaagaagatgtcaccatcattcatgactgccttggtttacctccaccaccaccaccagtttag

SEQ ID NO: 17900 - DNA, 360 bp, Glycine max
  Peptide Sequence Number=SeqID_134678
atgtgggccatcatcaaccaatacaaagagaagctaaatctagcttcaacccatgagcaaaggtcaaaagacgagtatgcgaaggtatcggtcctgcaagcaaaaagggaagcaagggagaaggtgatagattcattaaacagagaagcaataatgtggatggataggttctctttcaccttgaatgggagtcaagagcttccaagactgctagccaaagccaaggcgatgatggacatttgccactaccagcaccgtcgtggaggcggatccaagccatccatccgccataaaccaagccaaccaacccatcccggacatggtgggtcaaggaggagaggtgttgggcagcaccggtga

SEQ ID NO: 17901 - DNA, 249 bp, Glycine max
  Peptide Sequence Number=SeqID_134679
atgcaagaaataacttggctccagaagctaaagctctcaagtgaggaagaggctgaaacccctaaggaaagcgaaaaggtgcaagccttgaaggtggaacttgaaaaggtgcaagcggtcaaggaaaggttcaagacaacggccatcaaagtccgaaaagaggtcgacgagctgagagacatcaacatggccacaactgaagcattggaacgggaaacaaagagggcccgaaaggaagaatggggctga

SEQ ID NO: 17902 - DNA, 1751 bp, Glycine max
  Peptide Sequence Number=SeqID_134680
cgtcgcgccagattgcggcgcaggaaaccctgcatccgcacagcgtgtcgccggacggtctgccggacgaagtgctgccgctggtcgatgcctataactcgctactggataaactacgcgcggcctggtcgtcacagcgccagttccttgaggatgccgcgcatgaactgcgcacgccggtcaccgccgtcacgttacagctggagaacctgcgtcagcacatcctgccgggcgaagccagccgccagtttgatcagctggaagcgggcgtcacgcgcacgcgccatctggtgacgcagttgctgaatatctcacgccaggaggatcagtccgtggtcgccagcgtcgagaccattgagcttgatgacctgctgaaggagagcattgagcaactgatggtggtggcggacaagcgcggcattgatatcggcttcaacggcaccgcgcactatcgtctgcacgccagccgatccgatctgcgcagcctgttcgataacctgatcggcaacgccatgctgcacacgccggagggcagcctggtggatgtgctgctgcatcgcgtcggtcatcatacggtagtggatattgtcgataacggccccggcatgccggagtcgtttatcgagcgcgccttcgatcgctttacccgctcgccggatgtccaggcgcagggcagcggcttaggtttgtcgatcgtgcgcagcgtggcgcaaaagcatcagatgcaggtggcactgtcgaattgccttaacccgcagggtgaagtgtgtggcctgcagttctctgcgtatcccgacaacgtaaacggttgcggggttccgttcgttacacgacctttatgtgatcaagcacattacgcgggcctgaaaatccggcgcgtcagaccggcgacaacagcacactgcccatcccctgggatcgatttcacccgatcgcagcatttgcgcggcgatcacgagcaagtggcggcggaaagcgatccgcagtacctttctgactggtggcatcagagcgtgaacgtggtaggcagttatcacacccgcttcggacctcagttcaacaatgatgtgtatctcgaatacgaagcctttactaaaaaggactggtttgatttctacggctaccttgacctgaccaacttctttggcgtgggtaacagcaatgccaacggtatttttgaccacggttcgccgatgttcatggaaattgagccacgcttctccattgataagctgaccggcaccagcctggcgttcggaccgttcaaagagtggtacttcgctaacaactacatctacgacatgggtcgcaacagcgacagccgtcagaacacctggtatatgggtctgggtactgacattgatacccatagcgatatcggcctgtcactgaacgtgtacgcgaaataccagtgggaaaactacggcgcggcgaacgaaaacagctgggatggttatcgcttcaaggtgaaatactttgtaccgattaccgacctgtggggcggcaagctgagctacatcggtttcaccaactttgactggggctccgatctgcgtgacaagtctgaccgctcacgcaccagcaactcaattgcctccagccacattctgtcgctgaactacgatcactggcatgtctctaccgtggcgcgttacttccacaacggcggccagtgggctgatggccaggagctgaacttcggcaacggtccgtttgaagtgaaatcaaccggctggggttactacctggtg

SEQ ID NO: 17903 - DNA, 435 bp, Glycine max
  Peptide Sequence Number=SeqID_134681
atggatttcgtgaaagatttgggtacattgggtggtaaagtggtgggttctaaggggatcaaggaggttgcaatgagggcttggggggagaataaagtgcaggtggccattgtcgatgtgtacaatccttgtgagctgaataggaaaaaagaggggggttatggggttagaagagactgggttaagaagtctttagtaggaaggtggggaatagacaagcctagcacatgggaagctttcttgagaatcaaggaaggtagcttccttgggaagctagaggaagaaagcttccttgagaagctagagggggctactcacacccctccaatagctaagttcacccctatgccaaaatacatgaaaatacaatgggaagcttccctaagaagcaaggaaggtagcttccttgggaagcaaggaagaaagattccttga

SEQ ID NO: 17904 - DNA, 279 bp, Glycine max
  Peptide Sequence Number=SeqID_134682
atgtctcaaattgcatatgaaagtatggtaaatttgacgtttatcaatactccaaacttagaaccttgcttgtcctcaagcaaccctaaactaaacaaactgactactcaatgtggagcttgtaggccttggatcttcttcatcaatggaatcctttgcttcttcaatatcatggcagaggaatggagaaggaagaaatatgattggagatgccacttcaaggagaagatgagtcaagaagaagttcaccaccataggaagccacgaataagagcttga

SEQ ID NO: 17905 - DNA, 279 bp, Glycine max
  Peptide Sequence Number=SeqID_134683
atgtcttccgacagcgatagagacatctataacaagttcttgagattcctctggctacaatgcgaagggtattcctctaagcttagaaatgattttaaaattctcaacggtgagaatgctcggaattgggctgagaacatggttcttaaatttcacgatgatccaacggttaatgagtccgagatcattttttttctaagatatgtttggtggtctgtgggaaaagagaggttgagaagggagaacgaaattgagaggcggaggaggcggcagagttag

SEQ ID NO: 17906 - DNA, 369 bp, Glycine max
  Peptide Sequence Number=SeqID_134684
atggcagaaagaggatgctcccagaaatattggtacatagatccacagttgaaggaaccaaagacagcctggtgctgtcttcacatattcacctaccttcagctgatccaacaaggtgaggaaacaccaataaataagagactgaatgccacatggcagtcagaggtgatggtggagacaaaatgtgtgcactcaagacacaacagccacagaactggtgcaaatgatgtatctgcagaaccagttgaaagacaagcatttgaccaagtaaacagagaagggaactgttgcattaatgtcccctataatttggagatgacgataagagttgacgcagatagttttctcattatcaacggtcaagattga

SEQ ID NO: 17907 - DNA, 336 bp, Glycine max
  Peptide Sequence Number=SeqID_134685
gatggtgatgttaatctaaatgtttcccctcaagcgcttgatagactgcttggttgtcttcttgcgttcaaagtcaaggttcagccaaagttcgggaatgctgttgttctcaaatattcacctgatttagatttgatcaatttcgtgctggatatgctgcctgatattgttgtcgtattagctatatattggactttcattattttgaatttgagggtggcaatgcacgttcatatgtcgtacgttgagaaaccgcgacaatggtggtggtgttgttgtggtttggggatgacggctctcaagagtgttcttccattcatctatcctgaagagtga

SEQ ID NO: 17908 - DNA, 822 bp, Glycine max
  Peptide Sequence Number=SeqID_134686
atggtagaagttcaacataaattcacaattactgcactggtggaggagcctggatgtgtcctgtttaccttgaggaaccatttgtgggttccacaaaatgctaatcctctaaggccattgttgtcaggctcaacagctgcttcaaatggaaatccacgccttccagattctttgcattatattgatccttcaggacgaccaaatgcataccagagggcaattgtcgaggttggggaagtgttactgttgtatgattcagacaaacgatttcctacttggggatttggagcacgaccaattgatggtcctgtttcccattgtttcaacttgaacggaagtagtcattactgtgaagtggaagggatccaaggaattatgatggcttacacaagtgccctgcttaatgtatctcttgcaggacctacactttttggaccggtcataagcactgctgcactgattgccagccaatctgtagcaaatggtggaagaaagtactttgttttattaataatcacagatggagtagtgacagatctccaagaaacaaaagatgctattgttaaagcatctgacctgccattatcaatccttattgttggggtaggaggagctgatttcaaagaaatggaggttttggatgcagacaagggagagaggctagaaagttcatatggacgcgttgcttcacgtgatatagtccaatttattccatttcgggaggttcaaagtggactttcagttgttcaagcatttctagcagaattaccggctcaatttttaacttacgtgaggagcagaaatatccagccgaacctctag

SEQ ID NO: 17909 - DNA, 366 bp, Glycine max
  Peptide Sequence Number=SeqID_134687
atggcttgcatgtggctcaagaatgcccgtggtggcagtgggaagaagccgccgacggacgtcccacgtggccacttggcggtgatcgtgggagaagcaaagagaaggtttgtgataagggctgattaccttaaccatccactgcttcaacaactactagaccaattatatgaaggttatggcttcaacaagagtggtcctctggctataccttgtgatgagttcctttttgaagatattattcagaccctgagagatggaacatcctctagccatgtgcctctcaagaagctagacttcggcttttccaaggactctatgcccttacttcagggccttgaaagcaaaaggaggagcagcaactaa

SEQ ID NO: 17910 - DNA, 1956 bp, Glycine max
  Peptide Sequence Number=SeqID_134688
atgaatggaagaacactcttgagagccgtcatccccaaaccacaacaacaccaccaccattgtcgcggtttctcaacgtacgacctaggaacgtgcattgccaccctccaatcatgtgctcacaacgcaaacctctccaaaggcaaggaacttcacacccacttgctcaaaaacgcgttcttcggatcccccctcgccatcaccagcctcatcaacatgtactccaagtgctccctcatcgaccattccctcagagtcttcaacttccccacccatcacaacaaaaacgtctttgcctacaacgcgctcatcgctggcttccttgcaaacgcgcttccccaacgcgcccttgctctgtataaccaaatgaggcatctgggtattgctcctgacaagttcactttcccgtgtgtcatcagagcctgtggtgatgatgatgatggtttcgtggttacgaagattcatggcttgatgtttaaggttggcttggaattggatgtgtttgttggcagtgcgctggtaaatacttacctgaaattcaggtttgtgggggaggcgtaccgggtgtttgaggaattgcctgtgagagatgtggtgctttggaatgccatggttaatgggtttgcgcagattgggaggtttgaggaggctcttggggtgtttaggaggatggggggaaacggggtggttccttgtagatacacagttactggggttttgtcgatattttctgtgatgggggattttgacaatggacgagctgttcatgggtttgtgacaaaaatgggttatgaatccggagttgttgtttcaaatgcactgattgatatgtatgggaaatgtaaatgtgttggtgatgcgttgagtgtgttcgagatgatggacgagatagatattttttcgtggaactcgatcatgtcggttcatgaacggtgcggtgatcattatggaactttgaggctttttgatagaatgatggggagcagcagggttcagcctgatttggttactgttacaacagtacttccggcttgtactcatctagcagcgttgatgcatggtagagagatacatgggtatatggttgtaaatgggttggcaaaggaagaaagtcacgatgtttttgatgatgttctattgaacaatgctttgatggacatgtatgcaaaatgtgggaacatgagagatgcgcgaatggtttttgttaatatgagagagaaggatgtggcatcatggaacatcatgatcactggttatggaatgcatggttatggtggtgaggcgttggatattttttctcgtatgtgtcaggctcaaatggtacctaatgaaatcagttttgttggattgctatctgcatgcagccatgctggcatggtgaaagaggggcttgggtttctctcagaaatggagtcaaaatatggtgtttctccatccattgaacactacacctgtgtgattgacatgctttgccgtgcagggcagctgatggaggcttatgatttagttctgacaatgccgtttaaggctgatcccgtaggatggaggtctttgctagcagcctgccgtctccacaacgacacagacttggctgaggttgctgctagtaaagtgattgaacttgagccagaccattgtggaaattatgtgttaatgtcaaatgtttatggagttgttggtcgatatgaggaagtattggagtggaggtatacaatgaagcaacaaaatgtgaagaagagaccaggctgcagttggattgaacttgtgaatggtgtgcatgtttttataacagttgaatgcactatgcagcagtcacagctgaagagacaacagaatggcaggtcaagccttcaacagagggaggcctctgtcagaatcaagacgaagaagcctcagatgtttcattgtgatacggagctggctgaaggaaacatgtctgagagagccttgaattag

SEQ ID NO: 17911 - DNA, 716 bp, Glycine max
  Peptide Sequence Number=SeqID_134689
atgggcgcgtcgctgtcttcgaacggttccagtatcggcccgggcctcggggacataccggagagctgcgtggcgtgcgtgttcctccacctgacaccgccggagatctgcaacctcgcccgcctcaaccgcgcgttccgcggcgccgcatcgtcggactccgtctgggaggccaagctgccgcgcaactaccaggatctgctcgatctcgttccgccggagcgccaccgcagcctctcgaaaaaggacatcttcgcgctcctctcccgacccctacccttcgaccacggtcataaggtgggtgctgctcttcaggaagtgtggctggatagagtcaccgggaaggtttgcatgtccatttcggcgaaggcgatgacaattaacggaattgatgaccggagatactggaattggattcctactgaagaatctagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 17912 - DNA, 2184 bp, Glycine max
  Peptide Sequence Number=SeqID_134690
atggtgatgatggtgacggagggaaacgacagcagctgcggcagcggagtgcagcaccatacgatgtcgtcctcgtcctcgccggcgcagagccggcagcagcggcagaaggtggaagtgtacaatgagattctccgccgcttgaaggattccggccacgaagaagctatgcaacctggcttccacgatcagctttgggctcacttcaatcgcctccctacacggtctgtgattttgggttttggagagagatttgaggatattctgcaatgcaggtatgcgctggatgtgaatgtggaaagggcggcagatgttctcatgcacaagagattgctgcatttggcgcatgatcctgctaataggccttcaattgaagttcgattagttcaggtttatcccataaccgatggaaactcagctgacacttttgaatcagatgatcctgggatagaatctggacaaagttcttcaaagtactcaagcagacagagtatacatccacctcctgcttttggttcttctcctaatcttgaagcactggctcttgaagcaaataattctgaagaagacatagaagaggaacaatctgtacatgccaatgttcaatattcacggcccatgcatgaaatcaccatctcaacagatgacaagcccaagcttctcagtcagttaactgctttgcttgctgagattggactgaacatccaagaagcacatgcattttctacaactgatggtttctcattagatgtgtttgttgttgaaggatggccctatgaggaaacagaaaagcttaaagcagctttggaaagtgaagtcttgaagaagattgagagacaggtgaggtctagtccacaatccgtatcttcagttgacgagcctgatcaagcaaagttgtacagtgaactggatcatttgacaataccaaatgatgggacagatgtttgggaaatagatcctaaacatttgaaatatggaactcaaattgcatctgggtcatatggtgaactatttaaaggtgtatattgtagccaggaagtggccatcaaagttctcaaggctgagcatgtagattcagaattgcagagagagttcgcacaggaagtctatatcatgagaaaggttcgacacaagaatgttgtacaattcataggagcttgcaccaagtccccacgcttatgcatagtaacagaatttatgtctggtggaagtgtgtatgactacctacataagcagaagggcttttttaaatttcctacactgctcaaagtagcaattgatgtttccaaaggaatgaactacttgcaccaacataatataatccatagagacttgaaggctgccaaccttttgatggatgaaaattgtgtacaatgtttcctttatctgttgtttcttaaaatgaattctataaactgggcatacagaactgaaagtagtacatttgttccattgcagactgtaaaggtcgctgattttggggttgctagagttaaagctcaatctggcgtcatgactgcagaaactggaacatatcgatggatggctcctgaggttatagaacacaagccgtatgatcacaaggctgatgtatttagttttggaattgttttatgggagttgctcaccggaaagcttccatacgaatatttaacccccctacaggcagctataggagtggttcaaaagggtttgcgacccaccatcccgaagaacactcatccaaagtttgtggagcttcttgagaggtcttggcagcaagatcctacattgagacctgatttctccgaaattatcgagatcctgcagcagttagcaaaggagaaatgcacgagacatggaaacaactttgctccatgttttaggtcaaaattgtttccctcttcactgtctgattggtgttttgataagttcagcattgataatgagaataatcaccagaagaagggtggtatggtggtggaaactgataggagtggaggagggttggaattgaggaggacaaaggactatgtgttagattgggtcaggagtgagacgaaggagagacccaagagagagtgggttgattctttttcttctcctggatattctagaaaaactggatttgtgcaagtgccaaaggtggaggcaaaggtgtgctggaaggggaaagttttgtggggagcttctcaagaagagtaa

SEQ ID NO: 17913 - DNA, 1011 bp, Glycine max
  Peptide Sequence Number=SeqID_134691
atggcctcttgcgacgacgacgacgacttctctctcctccgcgacgacagccaccaccacctccaccaaccctacgcgccgcaccaccaccacttctctccctccgccgtcgccgcctccgtgccgcccaagcccgttgccgaagctgaggacttcgccaaccccttcgaagacgacgacggtagcgccagcgagaagcgcaaggagtgcgacgagatcggtgagggagccgcctcgtacggattcaacaacaagagatctaaggcgactccgtcgaacggcgccgtgtccggcggcgccgagtaccgcaaggaccgggaggagtggagcgacacggcgattgtgtgcctcctcgaggcgtacacggagaagttcacgcagctgaaccgggggaacctgaggggaagggattgggaggaggttgcggcggtggtgagcgaacggtgcgagaaccaatcgaagagcgtggaacagtgtaagaacaaggtcgataacctgaagaagaggtaccaattggagcggcacagactgagcagtggctgcatttccaccagccactggccttggttcaagcaattggagcagatcgtcggaaatctcttccggcgaagttctccgacgaggataaagcggtggtttccgccggaactactcccaggcaatcgaagagtggcaacacccagcactggaggtcaagcaaatagcatgaagtccaaagcattctcaaacagatggcggagggtagttttcaaaattagtggggcagctcttactggatctgatacctgcaatattgaccctaaggtggccatgctagtttcaagagaagtttccatagcttcccaccttggtgtggaggtggcaattgttgttggaggtcgtaatttcttctctggagatgcatgggtaaatgcgacagttctggagaaggccaccgctggggagcgaactctgacttggccagtatgggatattggtagtggcattgtagagcacttgtctgggtcataa

SEQ ID NO: 17914 - DNA, 6712 bp, Glycine max
  Peptide Sequence Number=SeqID_134692
atgggaaaggcaaacctgtcgagtctagttcacgaactccgcatagcagcagcatcctcttccactcccagtcccaacaatacctcagacgacgacgctttggaagtcaggttccgcaccgttctccccaatcttctccacgcctacgtcctcccttcttcctcttcctccggcaatgagagagaagtcattgctgtagtcaagcttatctctcacaccgccagaaacttccccggagtcttctaccatggcaaggctacctcctctattctacccatcctcgctcgaattcttcccttcttcgccgaacctctcttccgatctcgccacggtgtcttcttcgaagctaccggttctcttctctccttgcttcgctccggagcacgagatgcttaccgccagttttttgtcgattccatgtcgctcattcaagatattccatacgtggcttcactcagtgttaatgttaatggatcctccaggtccagggtgacgctcaagtgtttttgcgactccttctctggagttgaagaccttccatccaccaacaggctggtcgatggatgtggtttattgattgacctcaccgcccgaaccagatggcaaccctttgcaacttggattttgaagcttgccagtaaatgtctaactgaaggaacactctatgttgagggattgatccacgcatcctttatttctgctgtgtgttctcttttatgctacggggatgctgacctgcatgtggcatgctttgactttgtacatatcattgggacggtcacaaactatgatgtcattccttatcagaatttaatcctgtcaatagctactatcttgaatttggacaaggaggggcttcctgttttcagaaacatggcttatgattcatcgttgggtatttgcctgaatacactttactctagctgtcctgaagatgttgtcaaattaacagctgctgatttagtcagtgtattccttcaatcgatgtggagaaccaaaagccagcaacttaaggcagcaaatggttcaagaggatctaatagtattccttttcaggttgcgttatgcggtgcctatgctaggattgctcaatgcttccatgtagctctgtctacacttggcccacatcttgtagggggaattcgaggaaacattaaggatttaaccattttagcatctggagataagtcaactgaaagcatgaggatttgccaaaaaaggcccattcaggatatagataatttaagtatcaagagacaaaaattgaatgaagaaattgttgttgcagatgccagtcttgaggtggaatgtaaaagtagttacattgttacttaccaaagagtagaaggttatgctagccatatgaataaatctcttctttcatttgttgaatcattaaatgctcctactatcagacccggttctttgaggccagatattgctttatctgcacttagcatgctatgcattgccttttctatttatccagagacagatctgtctctcagaatctttgagcagatgcttgcatggcttccatggatagctgatcaggcaaaacaaggaaactcaattaccatagatatttccacatacctagaaggaattcacagtgtgttgcttgtgcaaaatgcctctctcaaagaacacaacccgttagatgatgagaattaccatgtagaccttatacttgtgcttaaacttccatggactcatatgcttgttggtattgataataattgcccatggaaaacaaaatgcctttctcttcaagtagtatcaaagctaggcccaagcttgaacagcaaagttgttcgtgaagttttagatctgggtcttcatgatgaagctgaagaagtcagaactgaagctgccatttctattccagtgatggtttctgctgttcaaaatgcaatagcaattttatttgcaatctcaatgagcagcaagctccaatcattcatcgatctgtcatcagaagatgtccaaatttcctgtgtgagagttattcatcggatccttgcacatggagcctctgatattcttctcaaaacaaggagcaaggaattgagagaagcattttgcagtcagattagattctttgtggacgatcttattttgagttcaattttttctggaaatgctgacaaaagcaaggaacaaaaattcctggatacaattaaacatgccatgacagtagctgatggtccacatatattggagactttaatggaatgtacagctgaaataatggtcgctgtcagtatagatagcaaactgttcttatgttctcttatactgttggttgatcaacttgatagcacacatgtgactgtgagaatgaatgcatccagacttgccagccgcccagtcttagtgagggagtttgcagaagctgtttttggtgttgagaccaaagaacttgtcaagaaaatgattccttttgttctcccaaagcttgtggtgtctcagcattataatagtcaagcagttgacactttatatgagttggccaagtgtttgaacactgatatggtgcctctgatagttaactggctaccaaaagttcttgcttttgctcttcatcaaactgatgaccagcagttaatttctgccgtgcagttttaccatgcacagactggttctgacaagcaggaaatatttgcggctgctttacctgctcttctagatgaacttgtatgctttacagattgtggtgattcagaagagataaatagaaggttagcaagagtacctcaaatgattaaaggcattgctaaagttctcactggtgccgaagatctcccagggtttttgaggaatcattttgttggccttcttaacagtatagacagaaaaattctccatgccgacgatttcatgcttcggagacaagcacttgaccgtattgagatgctgattagaatgatgggttcacatcttaatacctatgtgccaaaattgatggttcttcttatgtactctatagataaagaaccactgcaaaaggagggtctgtctgtcttgcattttttcataaagcaattggctaaagtatcaccatctagcattaagcatattatttctcaagtttttgcttcccttcttcccttcctggagagagacaaagaaaatccctcaatacatttggataaagtggtaacaattttagaagaacttgttcttaagaacagggttatcctaaagcagcatatatgtgagttccccccgttgccctgcatacctgctttgatagaagtgaacaaagcaattgaggatgctcgtgggacaatgactttgaaggatcaattgcgagatgtagttgatggtttaaatcatgagaacttaaatgtgaggtacatggtagtgtgtgagcttcgtaagcttctgaactcaagatggaaggatgttactgctcttatcactgctgaagcaggttcagacttggatgtcttgagttctttgatcacatcattattaagaggatgtgcagaagaatcaaggaccacagttgggcagcggttgaagctagtctgtgctgattgtcttggagcccttggtgctgttgaccctgcaaaagtgaaaggtttttcatgtcaacgtttcaaaattcaatgctctgatgatgatctcatatttgagctgatccacaaacatctagctcgggcttttagatctgcacctgatactgttattcaagactctgctgcattggctatacaggagttgctaaaatttgctggttgtgaggcatcactggatgaaaatgcttcaactactacatcacaggcacaaaaggatgaagataatcacaaagctgtttcatctaagatcaagagtactaatggtagtaaagggatgaataatagggggcagaaattgtgggatcggttctctaattatgtgaaagagattatagccccatgcttaacatctaggtttcagcttcctaaagtagctgattcaacatctgctggccctatttaccgcacttctatgtcttttagaagatggattttcttttggataagaaaactgactgcacatgctactggatctcgtgcaagcatctttaatgcttgtcgaggtattgtgcgccatgatatgcaaacagccatatatttgcttccatacttggttctcaatgctgtttgtcatggtactcaggaggcacgtcaaggaataacagaagaaatcctgtcggttctcgatgcagctgcatcagagaacagtggtgcttcagttcatggattcagtggtggtcaaagtgaagtttgtattcaagccgtgtttactcttcttgataacctaggacaatgggtggatgatgttgaacaagatcttgctctttccagttctcaaccaatggtttctaggcagcaaaagtcaaagggtctaagttcaaattccttgacagatcaggaccaactacttgttcagtgtaaatatgtctcagagcttctgtgtgcaattcccaaggtgactcttgctagggcatcctttaggtgtcaggcttttgcaaggtccttgatgtactttgagtcctatgtgagggaaaagtcgggtgctttcaaccctgctgccgagaggagtggcatatttgaggaccaagatgtttcacatctcatggaaatatatagctgtttggatgagccagatggactatctggcttgtcatgtttaagtaaatttttgaggttacaagatcatctattaatgaacaaaaaggccgggaattgggctgatgttttaacttcctgtgaacaagctttgcagatggagcctacctcagttcagagacattctgatgtccttaactgtttactaaacatgtgccaccttcaggccatggtcactcatgttgatggtttaatttctaggatccctcagtacaagaaagcctggtgcatgcaaggtgtgcaggcagcctggaggcttggcaggtgggatttgatggatgagtaccttggtggagctgaagaagatggtttagtttgttgtagctctgaaagtaatgcttcatttgatttgaatgttgcaaagattctccaggcaatgatgaagagggaccacttctcagtagcagagaaaattgctttatcgaagcagtcactaattgctcccctagctgctgcaggaatggattcttacatgcgagcctacccatttgttgtaaaacttcactttctacgggaattggaggacttccattctattttgggtgatgactctttcttagagaaatcgtttgacttagatcatcaagctttctctaaattagtggacaactgggacaatcgactaaggtttacgcagtcgtcactctgggctagggagccactcttggctttcagaagactggtttttggtgtaagtagtcttggtgctcaagttggcaattgctggcttcaatattcaaaactatgtcgcctggctggtcattatgaaacagccaatagagcaattttagaagctcagtcctctggtgcaccaaatgtccacatggaaaaggcaaaacttctctggagcacccggcggtctgatggtgccattgctgtgttgcaacaatctctcttgaacatgcctgttgaggttttaggctctaaaacaatatcatctattactagcctttcccttttaccacttaatccacagcctattgtttgtgaaagtcaggccatgaatgagaatagagatattgcaaagacccttcttctgtactcaaggtggacgcattacactgggcagaaacaaaaggaagatgtaataagtctttatactagggtgagggaactgcaacccaaatgggagaaagggttcttttatattgctaagtattgtgatgaagtgcttggtgatgccaggaaacgccaggaggaactgcttggtgatgccaggaaacgccaggaggaaaattctaaacttggtcctagaagggttccttcagcaactattgctgttggttcatcaaacttgaatggtgagaagccttggtggtccgatgttcctgaagtgctgttattctatgctaaaggacttcacagaggacacaagaatttatttcaggcacttccaaggttattaaccctgtggtttgattttggaagcatgtatcaaagcagtggttcatcaaacaaggatttaaaggatgtacatgcgaaggtaatgagtattgtaagaggctgtttgaaagaattaccgccataccattggttgacagtgctacctcaattggtttcaagaatttgccaccagaatgaagaaattgttcgactcgtcaaacttatcattacctctgttctccgccagtatccacaacagggcctatggattatggctgcagtttcaaaatccacggttccttcaaggcgggaagcagcagcggaaatcatacaagctgctcgtaaaggtttcagcccaggaagtaaggagaacagtttgtttgttcaatttactaccctgattgatcatctgatcaagttatgcttccatgctggccagtcaagagcaaagacaattaatctctcaactgaatttagttctctaaagaggatgatgcccctgggaattataatgccaattcaacaatctcttactgttaatcttccaacatatgatgggaatctgggtgattcaccggctaagaagatgttaaaattttctacctttcttatttttgctgatcttgatagggagtcgcttatttgtgagg

SEQ ID NO: 17915 - DNA, 1437 bp, Glycine max
  Peptide Sequence Number=SeqID_134693
atggaacccaatgggctaggtagtggaatgttctctgggttggtaggagtggaaaaccctttacaacaacagcagcaacaacaacaacaacaacaacaacaacaacaacaaaaccttcaccatttgcaacaccaccacccccaaatggttccctatgccacacaccatgacactgaaaaccctcatcatccacaccttcaccaatcaatcaaacaagggtaccctcccttttcatcccagaccaaacaacaacaatctcctctcagtgatgatgatgagccagggttccctgctgatgaggaccccaagagaaaggtctcgccatggcagagaatgaagtggactgacaccatggtgaggctcttgataatggcggtttattacattggtgatgaggctggctctgaagggactgataagaagaagtcatctggtttgatgcagaagaaagggaagtggaaatcggtttcaagggctatgatggagaaggggttctatgtttctcctcagcagtgtgaggacaagttcaatgacttgaacaagaggtacaagagggtgaatgacattcttggcaaaggaacttcctgcagggttgtggagaatcagagtttgttggattcaatggacttgtctccaaagatgaaagaggaggttaagaagttgctcaattccaagcacttgttcttcagggaaatgtgtgcttaccataacagttgtggacatgggaataacaatgctccacagcaaggagagtctgggggtgaagtgtctcagcctcaggctcaacctcatcatcatcagcagcagcaacaacaaccgcaacaacgatgttttcattcatcagaggttgggaatttggggggctcaggtgttgagggtttgaggatgttgaaagtgggaaatggggaagagggtgatgatgactccgaggatgatgatgactcagaggatgattcggacgaggacgaagatgattcgggagaaggtggttcaaggggtcatgtggggcatggacatgaagatattgaggatgagaatgatggaaggtcaatgagaaagagggcaaggaaagtaggaggggtttctatgtcaccacagttgatgcaacaactgagtgctgaggtgagtggtgtgttccaagatgtaggtaagagtgcttgggacaagaagcaatggatgaggagcaggataatgcagttggaggagcagcaaataagctaccatactcaagcttttgagttggagaaacaaagattaaaatgggcaaggtttagcagcaagaaggagagggaaatggagacagccaaacttgaaaatgaacgcaggaggcttgagaatgagagaatggttttgctcattcgccagaaggaatttgaattgatgagtcttcaacaccaacaacagcagcagcatcaacaacaacattcttccacctag

SEQ ID NO: 17916 - DNA, 822 bp, Glycine max
  Peptide Sequence Number=SeqID_134694
atgccttttacagaaacaggaaatcagcaaagagaccgtgaaattcgttgtgttaaaagaaagttactgttggaagctcttgccaacgagcttccaagtggcaccatcagatacttgtcaaaggttgttgccattgtggaatctggcttctacaagatactccatctggctgatgggacaaccatcaaaagcaaggtacatggatgtttgcaattgaaaaagatattgattgggtttgatggagtgaactccgtagtggcaaagtggctaggcttcaagaatgcctcttttacagggagatattcagtcaggggctttgcagaggttcagaacaatcacaggttagaacccaggttccttgtgatgggaaggctgtttactgacaaagagctagaagataaccctaccaaactgaaagaatatgtgttaaatacgcttgagaagatgccaagtgatgttagatactacattgaaaaaatcaaactagatgtcttcctattagctccattgggatatagacacccctgggaactgatgtttgggaatattagtaaaggcaatgcttgtgttggtggagatgctttccatcccatgactcctgaccttggccagggagggtgttgtgccttagaggatggagttgttttatccgggtgcttagctgaggccttctccaaaccaagcacacatatcaaagagaatgataaagaagcgaaccaatacagaaggattgaggaaagcttgaagaaatatgcaaatgagagaagatggagaagcattgatgtcaatgctacaacttatatggtgggttatattcagtag

SEQ ID NO: 17917 - DNA, 1053 bp, Glycine max
  Peptide Sequence Number=SeqID_134695
atggagttcactgcaatgatcaaccggttgctatccaaatatcctgagagtcgacgaaggaagctctatattcgaacatttgctgtgattcctctgacagaggactgtggcatggtagagtgggtgccccacactcgtggacttcgacaaattcttcaagacatatatattacatgtggaaaatttgataggcagaaaactaatcctctaattaaacaaatttatgatcaatgtcaaggtaaaaggccagaggatgagatgctaaagaacaaaatccttccaatgtttcctcctgttttccacaaatggttcctgacaacattttcagagcctgctgcatggttcagggcccgtgttgcttatgctcacacaactgcagtttggtccatggttgggcatattgtggggctgggtgaccggcatggtgaaaatattctttttgattctaccagtggtgattgtgttcacgttgatttcagttgcttatttgacaaaggcttgcagttagagaagcctgagcttgttccttttaggctaactcagaacatgattgatggcttaggtatcactggatatgagggtatcttcttgagggtttgtgaaattacactttcggtactgaggacacacagggagactctcatgagtgtgcttgaaactttcatccacgatcctcttgtggagtggacaaaatctcacaaatccagtggcgtagaagtgcagaatccacacgcacagagagcaattagtaatattgaggcaaggttacaaggagtggttgttggtgttggagctgcgccgtcattgcctcttgctgtagaaggtcaagctcgtagactaattgctgaagcagtctctcacaagaatcttggaaaaatatttggatgggtggagaaattcctcccatattattttaggcagcaatcgaaggaaggtatgaagtggcatacagaatgtacaggacttgaagaggcaaaacttttggaagcagagattcgacctcatcataaagttgggcaaggagtggctgaacgggaggttgacgcttcatag

SEQ ID NO: 17918 - DNA, 579 bp, Glycine max
  Peptide Sequence Number=SeqID_134696
atgctcactgccttgagtgcaaagaacaaggtcgagttcatcgatggctcaatctctaagccagctatgactcatgctctattttcaatgtggaaaagatgtaacaacatggtgattatcatacggaggagaattgttagaaaaagcatggttatcatcccaatttctcttctagcagaggaggaaaaggggttagaggttctggtagaggaaattttggaggtagaagtaataacaatggtaaagtgtgcacacgttgtggaattaataggtacaccagttgaagaatgttataggaaacatggatatccacctgggcacaagttgtacaggactcaaaatggttcgatcaataatgctatgagagaggagtctaatgcctcggatttaaatgatagtcaagagacacagaatcaaaatatcagagtcatgccacaacaatatcaagttttgatgtcactgcttcaacatcaatctaataatggaggattcacttcaggcacgtcacacattaatcaagttggtactgttactaaacctcacatagggactttacagattgatgttgccgtctgctga

SEQ ID NO: 17919 - DNA, 1200 bp, Glycine max
  Peptide Sequence Number=SeqID_134697
atggaggccaaacgtgacgttcacacgaaggtgaaagttgcatgcgattgctgtttgctgaatgctccccacaacgcaatgccaacacaatacggattaggaggactgggccacctttttgtgacaatgtttgtgacggggtttggtggtgtcatagttcttccggcaatcaccgacgttaccatggctgcactttgccctggccaagatcagtgttcccttgccatttacctctctggcttccaacaagctatggctggagtggggtcagtggtgatgacaccattaataggaaacttgtcggaccgatatggcagaaaagcgttgctcacacttcctctcactgtctctgtcattcctcaagtgatattggcatatagcagggatacccaattcttctacgcgtactatgtggtgaaaactctggctgccatggcaggcgaagggtccttccactgcctggctcttgcatacgtggcagacaaggttccagatgggaaacgaacatcagcattcggaatacttgctggtgttggatcagcatcgttcgttggtggaacattagctgctcgtttcctatccactgctttaacatttcaggttgcttcagtcttgtcaatggttgcattggtgtacatgagaattttccttaaggatagtgtacctggtggtgccatcagacagccattattgaaagtggtcgaggaatcatgtgctgaggatgattcaacaccaaagtcagcaggaacatttaagaaactgccctcactgggggattttatttgtttgctcaagtgtagccccacattctcccaagcagctattgtttcgttcttcaatagtcttgcagatggtggcttgatggctgtattgctggcacgttttcaattcaacaagaaccagtttgctgatttgttgatgattactgggattggagccactcttgcacaagtcttcgtctacagcatagcatggacagcatgggtaccttatgctctagcaggttgctctgtgtttgcagtttttgtgcgcccaagttctaatgtgccttgggctagcactggtaagattatctttccacctcagcattcatcatttaatgttggtgcattaatcattgatagtctaatgattcgtgctgttcctcctattgcgggtggcaaaattagcggtaaccgctgcacggataccttggtctga

SEQ ID NO: 17920 - DNA, 195 bp, Glycine max
  Peptide Sequence Number=SeqID_134698
atgtcaaggggggtggggggggtgggaggggtgaaaggtctcgttggggaagggctaatgatgccgatgatggtttgtcatagccacaacaaaggtgctcaatgtggtgttcattggccacacatagagggaggtgaaggacctcctcaagaaaggagtgatgcggcttgctgtggtttgaattgtcattgttaa

SEQ ID NO: 17921 - DNA, 1458 bp, Glycine max
  Peptide Sequence Number=SeqID_134699
atgagtgggttgcagggtattgggcatccgaaaggctatgaacagtttgataatgttcttatgggtcttctacgaagaattttggatgataataagcgggttcaagaggctgcttgttcagcttttgcaacgctggaagaggaggctgctgaagagttggcaccacgcttggaaattatactaaagcacctaatgactgcatttgggaaatatcagagacgaaacctcagaattgtatatgatgctattggaactctagctgaagctgttggaggagagctgaatcagcctgtttatcttgacattctcatgccaccattaattgagaaatggcagcaactttcaaattcagacaaagatctttttccactcctggaatgctttacatctatatcacatgctctgggtactggtttcactcaatttgctgaacctgtatttaggaggtgcataaatataatccagacccaacaatttgctaaggttctggctgatcctgccgccaccacaggggttcagtatgacaaggagtttattgtatgctctcttgatttgctttctggactagcagagggtcttggcagtgggatagagagtttggttgcacaatgttctttgagggacctacttctgcattgttgtgtggatgatgctcctgatgtaagacaaagtgcctttgccttacttggagaccttgcgcgagtgtgctcggttcatttggactctcgtttgtctgagtttcttgaggctgcagccaaacaactggagatttctaaggtaaaggaggctatttcagtagcaaataatgcatgctgggcaattggagaattagcagttaaggcttgggttcctatcaagactgcagcaagtctgatctggaacctagtgcttgacatcattaatttaggggcagataaaaccgtcccacaaacactcctaattgagatacttagggttcatcaagaaatttctcctgttgttttaactgtaatttcatgcctggtcccaattcttcagcatgcggagggactcaacaagtcgcttatagaaaatagtgcaataacactggggaggcttgcatgggtctgtccggagcttgtatcaccacatatggagcatttcatgcaatcttggtgcactgctttgtcaatgatacgagatgatgttgagaaagaggatgcttttagaggtctatgtgctatggttaaagctaatccttctggagctctaagttcgctagtttgcatgtgcaaagccattgcaagttggcatgaaataaggagtgaagatttacacaatgaagtctgccaggtcttgcatgggtataagcagatgctgcgcaatggagcatgggaccagtgtatgtctgctttggagcctccagtaaaagaaaagctttcaaaatatcaagaagttccacaagccttcaagatctcatttgatgggagtttcccatga

SEQ ID NO: 17922 - DNA, 843 bp, Glycine max
  Peptide Sequence Number=SeqID_134700
atgggtactatgttcccagaaactggtggctatgtggcttgggtttcatctaactgggctttccaactagcaattcctagaataaaaccaactaggtggatcatggtggatttgaacaaagtaaactggggtttgtacatgaacactctcttctggaatttgaactattgggactcaattagtaccctttcaggagaagtggataatcctggtaaaaccctcccaagatctcttttctatgctgttatgttggttgttttggggtactttttaccacttctggtgggaactggagttatgctagttaaccgtgagatatggtatgatggttacttctcagaagttgctagagtgattggaggggtttggttaaggagttgggttcatgcagcatctgctttgtcaaatatggggatgtttgtggctgagatattttgggaatggcagaaagaggcatggttcctgagcattttgttctctgcatctggtgtggttttgctctcatggttgagctttcaagagatagttgctgctgagaactttttgtactgttttgggatgcttatggagtttgtggcatttgttaagttaaggaggaaatttccatatgctgagaggctttataaagtgcctgttggggaaacgggagcaatattgatgtgtgtgcttccatcactactgatatttgtggttttagctcttgcttctttcaaggtatccatcataagcttctcagctgtgatcacagggcttgttttgaggccttgtttaaaatatttggagcagaaaagatggcttagattctctgataatcctgatcttccagatatttatgctacctag

SEQ ID NO: 17923 - DNA, 405 bp, Glycine max
  Peptide Sequence Number=SeqID_134701
atggagttaaaggctgcttcattgaggagagggtatgagttgttgaaaggtcatcagaagcaaaagaagaatagattagcaaagggtgtgttggaaagcaatattgttaatccaaagggaaatggaggggtaggtgtagtttcatgcacagaggaagttggaggggttgtgaggatgaagattgtggttagaaagagcgagttaaagcagctggtggaagtgatgaatggtggtgtcaagtcaaaaatgtctgtatcttgttcagtggaacaacgattgaatctgttgaggaagaaaaagtatttgtccagagccaatgggaatcaccagaagtgctggagtcctgggattcttgatgttccagttcctgatctcactttcacaattactgttcagttgaagtag

SEQ ID NO: 17924 - DNA, 579 bp, Glycine max
  Peptide Sequence Number=SeqID_134702
atggcagaatcgaacaacaacaaaaatgtgcaacctgcaatccttatatttgatgggcattatgatcattgggcgaaactcatggagaattttcttcgctctaaggagtattggcatttggtagagcatgggatctccattgttacaaataaaacaactgcatcagaagctgaacttaaggccatggaagaacaacaactgaatgacatgaagataaagaactatctatatcaagccatcgatcgtgaaattttagatactattcttaatgatgatacatccaaagacatttgggactctatgaaacaaaaatttcaagggtctacaagggtgaaaagagcacaattgcaagctttgcgtcaagaatttgaaatgttgcaaatgaaggaagatgaaacagtgaattcatactttgcccgcaccttgaaaattgctaaaagtatgaaggcgtgtgaagaaagaatgcgagagaacattattgctgcaaaaatcttgcggtccatgattccgaaatttaattatgttgtgtgcttgattgaagcatccaataatttggacactatgacgatcgatcgatga

SEQ ID NO: 17925 - DNA, 372 bp, Glycine max
  Peptide Sequence Number=SeqID_134703
atggtgaatggattgcctactgtcaaagttccaagagagatctgtacgcactgtttggttgggaagcagcatcgaaagcctatgcctaggaaaagcctatggagagcatcaaacaaacttcaacttgtgcatgcagacatatgtggacctatcaatccaatatcaagcagcaacaagaggttcaaggtgctggttgaaaaggaagttggtgtaagcattggatgtctgaggacaaatagaggaggtgaattcacttcaaatgaattcggtgaatttcgtaaaaaccatggcatacgtaggcagctgactgtagcctacacacctcagcaaaatggagtcgtcgagaggaagaacaaaacggttatgaatatg

SEQ ID NO: 17926 - DNA, 1575 bp, Glycine max
  Peptide Sequence Number=SeqID_134704
atgtgttattacgaggataccttcacaacacaagaacgtggcagttctaatgattttgacaacagatcgggaattccaacgcttcttgtgcaaaggcatcgccgcttttggcttttccacgggagaaaaaagcaggtttggttcctcgctaacagcgaaatttcttgtagtgaaagaagaaacaaagggaaaaagaaaaacatgttgagccagaaagtgtcaccaacaccatcatcaacaagcagcccaaagaaaaacccaaaaacactccatgaaatgtttctgcaggagagtcctcatttcatcatcccatcttctccttcaggaaatgaagaacttctctccgccatttcttactgcacctttgttttcaccttctctgacccttcagaatctcctgcacaaagagactcaaagaggcttcaactcacaagactagtctccatattgaagtcctccaagaagccagtgcatgaaaaagttttggggcctctagtggccatgatctcagcaaacctcttcaggccactccctccaccttccaaccctacttctaattccatcacagaattgccagaagaagaagaccccatctctatattttcacccctttggtcacatctccaaatagtttatgagatacttctgaagcttgttaacagcacagaccaaaaagtactgagagaacatatgaatcattgtttcctccgcaatctccaagcactttttcagtctgaggatccaagggagcgtgagagtttgaaaaacgtgtatcacaagatatactcgaagttcatcgctgatcgttccttgatgaggaaatggatgaccgaggtgctcttgaactatgtgtttgagacagagaagcatccggggattggggacttgcttgagatatggggaaccataatcaatggctttaccgtgccactcaaggaagagcacaagctgttcctcatgagagtgcttattcctctacacaagacaaaggggatgcaagtgtaccataggcaattggcttattgcgtgtcacaatttgtgcagaaggagcctatgcttggaggagttgttgttagaggaattttgaagtactggcctgtcacaaactgtcaaaaagaaatcttgctaattggggaattggaagatctggtcgagaatttagaccctgaccagtatcgtaaattggccttgcccttatgtacccagatcacaaaatgcataaacagttggaattcccaggtagccgagcgtgcactctatgtgtggaacaatgagcagtttgtgaaaatggcattaataggaacagtagaagtatttactgtgattgtagaaggcatggaaaagaacctgaagtggcattggagcaagagtgtgaggcaactaacagagagtgtgaaggtgatgctggaagaaatggaaccagatctgtattcaaagggtctcatggacatggaagctaaagaatcagtggcacatcaagaagatatcaagagaaaaaagagatgggaaagaatagaattggaagctgccaagaatcagtttctcaatccacgttatatacgtgtctcttactaa

SEQ ID NO: 17927 - DNA, 327 bp, Glycine max
  Peptide Sequence Number=SeqID_134705
atgaagataggggaggaagaggacgaggacgaggaagaggttctttccgtggcagaggaagagggagacaatcaatcaacgaagctgaaattgaatgcttcaagtgtcacaaacttggacattttcaatatgaatgtcctatctgggaaaaaattaaattatgctgaggtggaagacaagcaaggaacgacagaggaatggtttctcgactccaggtgtagcaaccacatgagtggtaacaaagactggttctcagaattagatgagaactttagacatgcagtaaaacttggcaatgacactcgaatagttgtaaaggggaaatga

SEQ ID NO: 17928 - DNA, 300 bp, Glycine max
  Peptide Sequence Number=SeqID_134706
atgggacctctccaaatgcaagccttccgcaaggtgtacgaaaagatcttagatttgaccatagcagagatatccacagaagccattgcatcactcacccaatactatgaccaacccttgaggtgcatcacgtttggagacttccaattagtaccaaccgttgaagaatttgaggagattctaggatgtcctcttgggggaaggaaaccgtatcttttctccgggtttcttcactccttgagcaaaattgcaattgtgcaaagagagcctggtggtagctgtcttggcggacttatttga

SEQ ID NO: 17929 - DNA, 249 bp, Glycine max
  Peptide Sequence Number=SeqID_134707
atgttgtcaaaatcgagatcctacttaagattgggaagggggtccaagatgcccctgccccactatcaacttgcccagcagaagccatttttcagtgattacaaagcaaaccaaaacattaaaccagaaccagagatagggaagatgtgtgaagatgtacagggaatcagcaaggcagcaaaagagaaagtcaagagagatggggaaggaggcttcaagacagcaaaggcagatgtgcaagagagatag

SEQ ID NO: 17930 - DNA, 960 bp, Glycine max
  Peptide Sequence Number=SeqID_134708
atggaggcagagatcgatcactacgcggtgctagggttaccgtccggcgaagaaggcgcgaagctaacggacaaagaaatcaacaaggcctaccgatggaaggctctcgaattgcaccctgacaagaggcccgacgacgccaacgccgccgctaacttccaacaactccgcacctcgtacgacatcctcagggacgacaaggcccgcaagttgttcgacgacctcttgcgcgtcaagcgcgaccgcgagctccgcaattcgcagcgcgacggaaagcgccgcaagatggtctccgatctcgagcgccgggagcgcgacgccaacgcccccgatcccgccgcgaaggaacgcgaagaggaggccaggatcgcgaggcagctcaaggaggagattgcgaggattcgtgctatgcacgggaagaaggaggaggcggcggtgaagccggcggcgaagaagaaggagagtggcggtggtggtgggggaggtggagtggatcaagagaaggttctgaaggtttcgtgggagaaggtgggtgaggattatgcggctgataagttgagggaattgttctccaagtttggtgcagtggaagatgttgtcatcaaagggagtaagaagaagggttctgctcttgttgttatggccactaaagaaggagctgtttctgctactgggagtgtgattggccatcttgctaatccgttgctggttttacctcttaaaccagcaactgtggcggattcttcgagtgttccaaaatctgctgaaaccaccaggatgagtaatctggtcggtgccgggtatcaagcttttgaggattctgttctgaagaaactgcaaaaggaatctgtcgggggatcagttctgaatgtttttactctagttttgatgaataaactgatcttctcagtaatcggtgttcctgtgcctcctaatactatttatgacacttgtcactga

SEQ ID NO: 17931 - DNA, 189 bp, Glycine max
  Peptide Sequence Number=SeqID_134709
atggagtctgttatggaggggaaagtcacaattttgggcacaaatatgggtgcgatccagatcaggacagggcagaaggattgtaagatcgcacaatcttacaatctagatatcaatttagtaacatttagcatgaatttgaaattgcaactcgccgagaaagaatcacaagcatgtaacagtgattaa

SEQ ID NO: 17932 - DNA, 369 bp, Glycine max
  Peptide Sequence Number=SeqID_134710
atgggggcatactccagggacgagaagctgttaatgcatttctttcaagaaagtttggccagggtggcggtcgtctgggacttggcagcacaggtggcaccccccatggtagaaagagagatgaccactatgatagtggacacgctgccagtgttctactatgaaaagttggtaggttacatgccctctagcttcacagatttagtatttgtgggtgagaggatcgaagtaggcttgaaaagagggaagtttgattatgttgctcctaccaatatgagcaatagaagatttggagcaagtggggcaaagaagaaggaaggggatgcccacgctgtgacttcagctcctacttggccaaaacctcagtaa

SEQ ID NO: 17933 - DNA, 204 bp, Glycine max
  Peptide Sequence Number=SeqID_134711
atgaatggaagaaaagtgcttgatgaagtgaagaaccctgctttggctaaatgggctgaaacgtttgttgatccagttgtaaagggccttctaccacagacagacaaacttattgagtttgccaaggctcttataaaaaatatgctgcaaagtaaatggaattatattagttgcaagatgacatggaatttcgaagttgtttaa

SEQ ID NO: 17934 - DNA, 1035 bp, Glycine max
  Peptide Sequence Number=SeqID_134712
atgaaatggagaaaagcatcggggatgttatgtgatgcaaaggtaccgatcaagctaaagggaaagttttatcggactgcggtaagacaggcgattttgtacggaacagaatgttgggcggtcaagagccaacatgagactaaagtaggtgtagcagagatgaggatgttacggtggatgtgtggtaagactcgacaggataaaattagaaacggagctattagagagagggttggagtagcgcctattgtagagaagatggtgttaaaaactcctgtctcactagacatgcttggacgcatatttaatggctctggaaaaccaattgataatggtccaccaattttacctgaggcttacctggatatttctggaagttccatcaatcctagtgagcgaacctaccctgaggagatgatacagactggaatatctacaattgatgtcatgaattctattgctagaggtcaaaagatccctctattctcagcagccggtctcccccataatgaaatcgctgcacagatctgtcgtcaggctggcttagtcaagcgactagagaaatctgataatcttcttgagggtggagaagaggacaattttgctattgtatttgcagctatgggagttaacatggagactgcacagtttttcaaacgtgactttgaggagaatggatcaatggagagagtgactcttttccttaatttgggactaaaagtggtgaccaagaaaagaatctatgaccttaaaaattttaaagtcgactatcatattgtatatgtagaactcaaggcaaatgatcctacaattgaacgtattatcactcctcgtattgctcttactactgctgaatatttggcttatgaatgtggcaagcatgttcttgtgatactcacagatatgagttcttatgctgatgctcttcgtgaggtatctgctgcccgagaagaagtgccaggaagacgtggttatcctggatatatgtatacagatcttgcacaatttatgaacgaagctgggagaattgagggc

SEQ ID NO: 17935 - DNA, 333 bp, Glycine max
  Peptide Sequence Number=SeqID_134713
atgactgccattcctacacggccaagtttcccaccaacccaacaatgtcattactcaaccaataacaacccttctccttacccaccccccaatcatccacaaaggccatcactaaatcagccacaaagcctgttgtcgcaacctacccttttgcgggtgagcaaggcgaggctcacgggtgtgtcttccaagaaaggaaaatgcacggagtcgccaccaacgtttattgaaaggaaaacattaggaaaaccaaaggacaacagcctctcacatttgaggaagggctcttgctcctacgtaccctccatcgaagaggaaatcagacctacgtag

SEQ ID NO: 17936 - DNA, 984 bp, Glycine max
  Peptide Sequence Number=SeqID_134714
atgccgttgcgcccgtcaaagaggaaccagggataccgcgaagcgccttacctcgacacgcaggggtttcccaccattgcgggcggtattcgcatcgggccgaaaggcgcgtcgctcagccactatatcttccgcgtgccgcgccgcgttggtgacgtgtggaagcagtgcatcgttgagggcaaggtgcaggagatgcagcagcgcgcgctggtgcagcaggcactgagtcaatgcaacgaggcgcgcagcgatgtgctgatcagcatggcctaccagatgggcgtcgacggtctggcgctgtttcgcggcatgctcaccgcggtgacgcaacgtgatttcgacgcggcggcgaacgccatgctcgatagcctgtgggcgcggcaaactgcggggcgcgcccggcggggctgttatgaacatgcgctggctgttgttcgttatcgccgtgctggcggccatcatcctgctgctgttgctgcagcgcttcaccacgctggacgcctgggtgcagtcgtttccctcgtcagcgctggatgcatggaacgcgctgccagcggatatcaaagagattctgccgcacaactatctcggcctgatcggcgccttcatggtggcgatgggcgtactggcgcagttcgtgcgtcagaagaacctggtggagcagagaaaaacgctggaggacaaaccatgagctttcttctttctcagcttgccggcagctggcactggctggcggcgattggcggtgtgattgccgcgctgattgccagctacgccggcggcaaaaaaatcggcaaggtgcagcagcaggcgaaagctgatgttgcgcaggccgaaaagaccgccgcgcaggcggttgaagttaatcagcagcagcaacagctgcgtgaggaggccagacgtgtggaaacccgcaacggtaatcttgatgacgctgctgctcgtgacaagctgcagcagtcgaaataccaccaaccctga

SEQ ID NO: 17937 - DNA, 237 bp, Glycine max
  Peptide Sequence Number=SeqID_134715
atgaacgtggggcaaacagcagttatcaaagctggggttgtcgttgcagggccgcgtgggcgccagtactgcgcggtctacccgggagcggatttcccgctggcagatgcgctcggcggtgcgcagggtgatctcatcacactccaggcccagggcactgtcgatgctgcgcttcaggcggctgagcggctgacgccgccggtggcgacgggtgcgcgcgtttccgctaaagactga

SEQ ID NO: 17938 - DNA, 387 bp, Glycine max
  Peptide Sequence Number=SeqID_134716
atgcagagtgggtcccaatctgaatcgtttgatgtagaaatgggagatcgcttagaggatataatttatgatcttggacaagagtcttttcagcaagcacatgcccgtatgtatgatacattgaaagctaattcaaagaaacctttgtatatgggttgcaacaattcgttgacgttgttgtcaacgaatctacaccgtctagaagcatctattgtggaaaggtacattccagaagaagctattgaattttgttcagagtacattgaaagggcaaaacctgttgggcttcccgagtctcgccatgaggaaagagtgagaggtaagggttcaagaggactgcatgttatcactccaagtgtagaagatttgcaactagcttatctgtat

SEQ ID NO: 17939 - DNA, 327 bp, Glycine max
  Peptide Sequence Number=SeqID_134717
atgggggtgcaaataaaaattttcaaattttcgaatcttggccctttcaaaacatttttgaagctgggttgcttaaggaggaagcaacctacgtcgcctgggcgagctgggcggcaacttcctcccccttttcctataaataggcgaatgggggttgttccaaaagctattatgggtgaaaaacgtgttttccgtgaagaaaatccaagccgaggtgcttctgtaatgcttctgagacgtttccgtgagcaatttcgtgaagattttccgccgttcttcaccgttcttcgttcgttcttcgtgcgttcttcgttcttcaaccggtaa

SEQ ID NO: 17940 - DNA, 195 bp, Glycine max
  misc_feature (35)..(35): n is a, c, g, or t
  Peptide Sequence Number=SeqID_134718
atgtcggccttcaccttctcttgcacctcctctgnctttacccattactctagctctagcacaggttcggatatggggttgaatcaatttagattttcaacatggtccatgatatcttgtcaaggtggaactggaagtaacagggacatcgacattcctaaaatgtgtttggcagtagacgaagcagcgatgtaa

SEQ ID NO: 17941 - DNA, 225 bp, Glycine max
  Peptide Sequence Number=SeqID_134719
atggctttagtgatgggtcccctccttgggaggattgcatcagactttatgaggggtcgacaatcgttcacaacatccctttgtgccatgatcaagtcaaggttggtgttgaggaagttagagatgcagatgctcccattcctgtacccactcaagagggatttgtgggaccggcgaaacctgcagatagaccggatcatgatgtcgatgatctcctatatctga

SEQ ID NO: 17942 - DNA, 825 bp, Glycine max
  Peptide Sequence Number=SeqID_134720
atgggcttgttcgtagttgttgggcaaaatactatgcttgcgggcttgggaaaagtgtttgagaattcatccaccatacataatgttcgttatgaaaatgatgttgttaaggttcaggttgtcagaacatacatgcctcacgctgaggtccctattcctacatcagaggttcattatcttgagcaggccgttggcacattcgttgcatggccgacacatcttgttagggaagtaactaatgaggtggtcgtaggacccgataagcctccatcaaagtctgttggagaaccgaacaggttaacatatgtggccacagatgacccactgggagaattggttaagaagtcatatgtagtttacacaaagccaatggagttggcatgggatggggcgaaatttgggttacctaatgccacaaatggttttttcgtcacacatgcagctgtgactgaaatcattttaggtgacagatgtttaaacatatctgtactgcagctgtggatgatgtttatgaatgattgtagtacaaacattgggttttctccagtgtacggtttccttgagccccagtctatacgctgcacaaaggacacgcgtgaagaatgtcaaaagtacatagaaacgtgggtcaaggagtcacatcgagaaatctacttaggaccttacttcaatcatgcaatgaagaaaatatgcagtaatctccaaggcaaggacaatgcacctccacctccacctcagtggattgaggctaagcatttattgagcgcttatattgcatgtagagccatgtacaacaaggagcatatgagtgtggatattatgtga

SEQ ID NO: 17943 - DNA, 297 bp, Glycine max
  Peptide Sequence Number=SeqID_134721
atgacaatcgtcgtcgttagtgtcataactgtcaccactatcaacgacggtgattgtgacagtaacgacgacaatcgtcatgacaacaaaggtgcttatacccttgggaagctaatgaatgtcaaagaagatgaatgccacgatgattttttctataattcatgcaaaatatccaaggataaccacagtgaagtgaagatggagaatggtacttgtagacacaatttacagattgttgcacatcccaacagagagtatataagggtccttcaagaaatattgaatgttagacattga

SEQ ID NO: 17944 - DNA, 1086 bp, Glycine max
  Peptide Sequence Number=SeqID_134722
atggcagcagccactctctccgttcgtcccgaccgtctctcgcccggtgcggcgtttcccagaccgccggttcagcctccgctgcgaaaaccaatcgcggcgcccgagccgtggcgcgccgtgccgccacgtatacgcatcaggacggtggcgccggtccaggcgagctcgcgcgccgatgactccgcgccgttcgagatgtcggtggagaacgcgctgaagctgctgggcgtgtcggagggcgcttccttcgacgacatactccgcgccaaaaacgcaatcgttgccaattgcaacgatgaccaagatgccattgcgcaggaaagtgaatatgtgaatatcacatttcttggtttggtggatatcttatatttctatggaatgaataatatttgtgggcataatattgacggaaatgtgatttctgggaatgcatattataccttgaaacaaacaccccataaagaaaaaattaagaaggttgaagctgcatacgacatgttgcttatgcagagcctaactcagcgtcgggcagggaaagtagtgaacagtagtgttcgttatgctgatgtcaaacgtgttaagtccccagctgggggatcaatgcctcaatggttgaagaattcacctgtatctattgagtcaccttccactagtgatttgggtttacaagctggagtgtatggtgtattgatgggtttaacttatcttaatggggcttctgcacccgccgcaggttatgctggggctgatgttcctggactcctcttggctggtagctttggagcttccctgtacttcatgaccaaaaagaatgttaagttagggaaggccactgtcataaccataggagggctcgtagctggtgccgttgtagggtcagctgtagagaactggttgcaggtagatatagtcccattcctgggcatacactcccctgctgctgttgttagtgaaatcattattatatctcaatttttggtttctctgtacctaaggacacgtagctggccccctgtggttgtgtcagctggagagaactgttataccattgctgggcatacactctcctgcttcttctgttag

SEQ ID NO: 17945 - DNA, 222 bp, Glycine max
  Peptide Sequence Number=SeqID_134723
atggatgcaaatcagaggtgtttagtcatgatgtcggtgagaatgcacaacggcgcgaacggaggtgcaaagctaaggggtcatgcggtgtttcggtgttgtagtggttgggagcgatgcatgagattgttgggacagtgggcaatgagcgacgtgcaacattgttgcagtggcattggggtcattgggtttagatttgcggcagagttggtgtggtggtga

SEQ ID NO: 17946 - DNA, 1503 bp, Glycine max
  Peptide Sequence Number=SeqID_134724
atggaaggtgtgaaattggaggacagatggggataccaggttgcaacttcttctcaggcctgcgtttcagccatcaactcctactaccatcaggttctcatctatggtagagagaggtctgtgattctggaagcagtggcacatgacaaacactgtgtcttggccaacatcttggcagcacatttcctttactcctctggttcttctcgtgctctcacttgtcttcatgccgctaagtcccaccttgaacatgccaccttgtacgagaaactagttttcgatgccatcagttatatgctatctgaagatagagacgatgatgtagctgttgaattgcattctaaggaggtgtgccccctagggcattggatagttgatcgtgtgggtgccattaggctaggatccgataggtacctactagtccagattagttttctgcttctaaaggagttcccaagagatctgctttctctaaagagagcacaagtcttatgcttctacatgggtctgcctggtctttctttatctcttattcagcagattctgcctcacaatgaaggagaaaattatatatatggcatgcttgcttttcctttgttggagcttggacggatggaggaagctgaggaagctgccaaaaggggatttgaaatcaataagcaagactgctggtcacagcatgctttatgccatgtccttcagtataagtgctgttttagagaagctgttaagttcatggaagaatgttcatcatcatggggttcttcttcatcttttatgttgacacacaattggtggcatgtagcactttgttacttagaaggtaatgctccgagacaaagagtgctagagatatatgacaattatatatggaaggagctagaaagaaatgattctatgagtgcagacgtttacttaaatgccgcggctctgcttttgcagttgtatgtacgtggtgaattggatattgttggtgatcgtctcaagattctatcagaatgcctaactaatcaagaaaactggtatatggaatggcactttgatgtattgatagtgtggactttggcaaagaccggagaaatttctaaagcagaagatcttctaaagggcttaaaaaacaggcttttgaggatgactaaaaagaagcaacaacgaatgcagagaggaatgatgcttgcagaagcactctacgcttatggaagagatgacgacaatcgtggactggaactacttgatccaaattttgatgccactgattacaagatcattggggcatctgatgaacaagtcgacgtattcaatgaagtttggtataacatgttgctgaatactggaaaaccgttgaaggcaattgaagtgttagagaagcaaatcaagaagagagatggcgtcccctacttgtggcgtctactagagagggcatacaaactagctaacaaagaagaagaagaaagaattgcgaacgagaaggccacggctttggagagtcgttacttcaattaa

SEQ ID NO: 17947 - DNA, 2304 bp, Glycine max
  Peptide Sequence Number=SeqID_134725
atgggatgtgttgcctccaaactagaggaagaagaagaagtggtggctatttgtagagagagaaagcgtcttttaaagcaagctgtggagaaaagatatgcacttgctgaggctcattgtaagtattttcactctctgaatgcagtagctgcggccattaagctctttgttgcacgccactcttcaccttcatcacctttcctcataactttccctcctccttgcccttcttctccttctccacctactgagaatgtcattacgaaccccatgttcctccagcagacaccctcagaaaacaagcatcaagcgattgctgcttgtgactcatgcatctcttcaacaacctccgagtcttctgaggaagagagtgaagaaaaaagggaaggagaggagggtgaagaaggtaagggagaagaagaccaacatcaacaacaaccatgtgggtactattgcatgcctatgactatgtccatgtccatgtccatgtccatgtctatgcctatgccaccttcaatgccatcccctcagagagattttggatgggacttcttctaccctttggacagtatgaggagtgaggtcatgagtggctaccacaggaactcagatgatgatttaagggcagtaagagaggaggaggggattcctgaattagaggaagaagtggagagagaagaggttcagcacaaagtggtgagtgttgaagagaataatagcaataatcataataataagagtaataacgaaggtgctgttgagcaagtgttgagtggtgttgaagcagttaaggtggttgatgtggccactgaaaaccaaggggagcaaagggggcttgcagttcttgatacaccagcagaggggagagagttgcttgaagctttgaaagacattgaggaccattttctcaaggcttacgattctggtaaggaggtaaccagaatgctggaagctaatagaaccccccttcattctagtttggatgaaataaaagaaagttcgactaaactcattcttgcaataacatggaagtccatttcatctaggcaatcatcatgcaagagtcttatggttccaaatgtgaaaaattcttcaactcgggtggaatataaaaatgatctgtttgatgattatggaggaatggattcgggaagtcatttattaaccttaggaaggttatatgcatgggaaaagaaactgtttgaggaggttaaggctggagatagcacacggaaaaattacgaaaaaaaatgcacacagttgagaagtaagaatgttagaggagatgatctactaagcacagacaaaactaaaactgaagtgaaagatctatatgctgggatcttggttgcaattcggcgtgcagagtcaatctcaaagagaattgagaaaatgagagatgaagaattacaacctcaaattcttgaactgttaaaaggcctgactcagtcatggaaaatcatgttggagtcccatgaaacccagaagaagattctatctgaagtcaaatacttcacatgcgccacgtatggtaaattctgcaaccaatctcatggatttgcaactcttcagctcgaagctcagcttcaaaattggcgggactgcttcaaagagtacaccgcagcgcaaaaggcatatgttgaagctctccatggatggctgagtaagttcatagtccctgaagttgagttttactcaagaagcaaaaatgttgcaatgcaataccaagtcaacgggccaccgctgcttgtgatatgcaacgactggttagcttcgctgcaaaagttacccgataaaatggtaacagttgcattgaaaagtgtagtgaaggatgttagaactttgtggcttcagcaaaacaaagagaaacagcagaaaaggaaggtagataggttaacaagagatttggagagaaggtattcttcagcatcatcgcataaagtggtggagactaggatgctcgagtatcacgtcacggaccgcgaatcagaggccggaaatgatcatcatcaagaggaggaggagtgcatgatggagaagagtgatcatttggagacactgaggagaaaagtggaggcggagaaggagaagcaccacagttgcatgcaagaaacacagaggatcaccttacatggattgcaatctgggttttctctagtgtttgaatcattgacagagttctccaaagcatcacaaaaaatgtacaatggccttataacttatagtgaaaacagtgacaaggttgggaacattacgtatatagagggtggtggctgcaatgttgaaaattgcaacggacaatag

SEQ ID NO: 17948 - DNA, 369 bp, Glycine max
  Peptide Sequence Number=SeqID_134726
ggaagcgctaggaggctggtaaaagctgcgcttcaagaagctgcaaagaagagagaaatgagatattcagatttaaagaaaattgatcgcggagttcgtcgtcatttccatgatgataccacggtgattgttgtgtatcttgactcaaatctcgtgagtagggccagcactgtgaagttccctggcatttctgttagagggggtggtattaacctgcctcataacacactggcaccttgtaccacaccaacagagattggtgattgtgatgtgggaagtgttgctgtattgctgaggatgttcttagtcatagataatgcaatcaatgcatttaggtgttggagaggagagaggaaaatcgtcatgtaa

SEQ ID NO: 17949 - DNA, 699 bp, Glycine max
  Peptide Sequence Number=SeqID_134727
atggagtttttcacgaaaacgagcgtggtgaagctgaggagccacctggacaagtacctcgtggcggatgccgacggcgcgcgggtccgccagagccggaggagctccggcagggggacgtggtggacggtggaggaagtggcggcggaaggagggattaataataaggttcgcctgaggagctgccacgggaggctcttaacggcgacagagacgccgtttctgctaggcatgacggggaagacggtgctgcaaacggagttcgaggccggcgcggatttcaagcacgagtgggaagtgatacgcgacggatttcaggtgaggttgcggagctggagcgggaagtttctgagggccaacggagggacgccgccgtggcgcaacaccgtgacagtggacgaaccgcacagctcggcgacgagggattgggttctgtgggacgtggagcctgtggaggccatggaggagctggtggatgagtttttgtgtgagaacgacgacgtcgtttcttcttttgcttcggatgatgtattatcggtggattcggagccggcgtcgccgatgtcggttttctcgctccggtcgccgccggttagacggaactccaagctgctgctgatgcagcccctaaaactaaaaacagaacaaacagaaaaagagtactactttcaaccgtcgatattttgggaacgtaattga

SEQ ID NO: 17950 - DNA, 1437 bp, Glycine max
  Peptide Sequence Number=SeqID_134728
atggaggaggaggatgagattcaagcacagaaggtgagaagaagaagaggcagtgatggagagagcacgaacaggttccacagcagctggcaccaccaccaccaccactcttcgaggatcataagggtgtctcgtgcatctggtggcaaagacaggcacagcaaagtgatgacttcaaaagggttgagagatagaagggttaggctttccgtgaccactgccattcagttctatgaccttcaagatcgcttgggttatgaccaacctagtaaagctgtggaatggcttatcaaatctgcttctgattccatttctgaacttccttctttgaacaatttccctgacacccccaaaagtgatgatcatgagaagagagcaaacactgatgttgctgctggggcagtagatggtgagaattatgaaaatgagaatggcaataacaataaccagagtcagaacatgtctttgtctaaatctggttgtagtagcacttctgagacaagcaaaggttctggcttgtccctctcaaggtctgatattcgtgtgaaggctagagagagggcaagggagagaacaacaaaggaaaaggagaaagagaaaaatgagtctcatcatcatcacagcaatgttgttgttcctcatcatcgtcatcatcatcatcataaccccgtttcacaaacagcttctttcactgagcttctcactggtgggattcccaaagggtgtgatgatgaggagcctaataacatgatgatgttcaacaaagaagctgcagcagcatcatctggtagacagcaatggtgttcatcatcatcagcagcagcagcagcacctatggactactttctggggccttcctcttctagaacaacaacaacaccaccacacaatcaccatcaccatcatcatcaatattcttcttctggtgggttctcattggcacaaatccaactaggacattctcttcctgaggcaatgaatcacaatgtttcagcattcaacaataatgtgagtggtgagaaccaaaaccactcatcatcagatcctcatctgcaacagcagcaacacttctcattcataccggatcatcttatgtcagctgtggttacttcttcttctcatcatcaacctagcgggagcgactacaatctgaacttcaccatgtcttcgggcctcgctggttacaatagggggacccttcagtccaattctccgtctcttttgcctcacttgcagaggttttcgcctctagacggatccactgtacctttcttcattggagctgctccttctgctgcagttgctgctcctgccatggagaacaacaccaccaccaccaacaaccatcaccaccatcagttctcatctggtttcgatggcagccgcttgcaactctactatgggcattctgaccagaaggggaaagccaaaaactga

SEQ ID NO: 17951 - DNA, 846 bp, Glycine max
  Peptide Sequence Number=SeqID_134729
atgttatcggggttgatgaacttattgagggcctgctttcggccgggttcagatggatttacacttgcaggttcggatgctggaggtagacaggatggactgttgtggtacaaggactcggggcagcacttgagtggtgaattttcaatggctgtaatccaagccaataacttgctggaagatcagagccagattgaatcaggctgtttgagctccaatgagtctggcccttacggtaccttcgtcggtatctatgatggccatggagggcccgagacatcgcggtttatcaatgatcacctatttcaccatctcaagagatttacttcagagcaacaatcaatgtcggtggatgtaattcgcaaggcactccaagcaacagaagaggggtttatttcagtggttgccagacagttttctctgtcaccacaaattgcggctgttgggtcatgctgtcttgttggtgttatttgtaatggaaccctttacatagcaaaccttggggattcccgggctgttttgggaagagcagtcaaggcaactggcgaggttttagccatgcaattatcagcagagcacaatgcatcgatagagtctgtaagacaggagctgcatgcttcgcatcctgatgacccaaatattgtggttttaaagcataatgtatggcgtgtgaagggtcttattcaagatatgaagaattacttcagaaagacagagctatgccgagcattagtaaaacagacctgggtgggggtggagagagagagagataaagtcaatttcaaatttatttgtggaaaggacttatttttctcaacttcactagagttttatgttattgaatag

SEQ ID NO: 17952 - DNA, 3540 bp, Glycine max
  Peptide Sequence Number=SeqID_134730
atgggagccaacttatccaacgtggagaatgctcataaatcatccggccaccttctcaccttccattccaccgctaaatggaagactcactttgatgcctccaaacaaactaacaagttgatggtgatcgatttcacggctacatggtgtggaccttgcaaatccatggacccaattatccaagagtatgctgcaaagtacaccaacgtggaattcatcaaaattgatgtggatgaattgatggaggtctctcaagaattcaaggtgcaggcaatgccaacattcatattgataaagaaaggcaaagttgttgataaggtgagcgtgcgtgcgtcactgtcgaagctccacctcacaccaccgctctaccgtcgcgtttggggtttcgccaccaccgctgcagagggttgttgccgccgccgccgccgccgccgtgtgacgatggataatgatgacagtctaaagaattgggtatccgacaaattgatgtctctattaggatattctcagcccacccttgttcggtacatgatcggactatcccaccaagcttcttcaccggctcatttggttgacaaactagtggagtttcggatcccatcatcaagcgacactcgcgcattcgcggaggaaattttttctagggttcctcgtgtaccatcgagtttgaatcagtatcagaaacaagagagggaggctgcaatactggcaaggaagcagaagacttacacaattttaaaggctgatgacaatagtgaccatgcatatgcatataaatctagaaagcctgataatcgtagcaaacgtttcaggaagaaatcagaagttcacgatgatgagggaattgcgagaaaggagagggggagacaagttaagagaagaatttcccctcataaagataatcattcagattcagaagaagaagaagaaatattggaagatcaaagagagaagaaggaattagagcggcatatgagagaaagagacgaagcagtgacacggaagttggtgactgaaccgagattaacgcgaaaggagaaagaagaggccattcgaagatctaatgctgcagagaatgatgacattcaaaccttgagaaatttttcgaggcaagaatacttgaagaaaagggaggaaaagaaattgctacaactgagagatgatatagaagatgagcaatatctgtttgaaggtgttgagctttcagaagcagaattatgcaaactgaggtacgataaagagatgtatgagcttgtgaagaagcggtcgaaagaggatgataatgtgaatgagtactatagaatgccagaagcttatgatcatgaaggcggtgttaaccaggagaagaggttttctgtggctatgcagcgttacagggatccaaatgctgaggataagatgaatccattcgccgaacaggaggccttggaggaacgtcaaattcgaaaggcaacgttgaagtttgactcaagaaatagaaaacaagcctttgatgagtatcagtttgtgtttgatgatcagattgattttgtcaagacatcggtaatagatggagataagtttgattatgaagagatggtggaagattcacatgaaaagtccagagcaaagacagctagggaagcacttcaggaagagagggaaaagctacccatttacccttatcgggagcaattgctccaagctgttcacgatcaccaggtacttatcattgatggtgaaactggttcggggaagactacacaaattcctcaataccttcatgaagcgggctacacaaaacatggaatggttgcgtgtactcagccgcgacgccttgctgctataagtgttgctgctcgagtttccaaagaaatgggtgttaaattaggacatgaggttggctactccatccgttttgaagattgtacaacagataagacagtgattaaatacatgacagatggaatgttgctgagggaattccttggtgaacctgatttggcaagttatagtgttttgatcgtggatgaggctcacgaaagaacactatcaacagatattctgtttggattagtaaaggatattgctcgtttcagacctgatctcaagttgctgatatcaagtgctacacttgatgctgacaagttcagcgattactttgattctgcaccaaaattcaaaattccagggagacggtatccttatgaaatatttaactttaccgaagcaccaagtgactacttagatgcagcaattgaggcctcactcaaaatccatgtcactgaacctcctggagatatattggtattccttacgggtcaagaagaaattgaaacagctgaagaaaacttgaagcatcggatcagaggcttggggactaagattggtgagttaaaaatctgccctatatatgccaacctaccaactgaacttcaagctaaaatatttgatcccactcctgaaagggtgcgaaaggttgtccttgctactaatattgcagaaacgtcattgacaattgatggcatcaagtatgtcattgatccaggatattgtaagatgaagagttataatccaagaaccggaatggagtctttgaaagtaactccaatctcaaaagcttcagctatgcaaagagccggtcgttgtggaagaacaggtcctggtaagtgcttccaactgtatactgcatatacttttcacaaggaaatggacgataacactgtaccagaaatacagcggactaaccttgcaaatgtggttttaactttaaaatgtcttggtattgacaatgtaatgcattttgattttatggatcctccatctgatgatgccttattgaaagctcttgagcttttatatgcattaagtgcattgaataagtttggtgagttaactaaggttggtagacggatggcagagttccctcttgatcctacattgtcaaaaatgatagtggcctcagaaaagttcaagtgttcagatgatataatctctattgctgctatgctttctgttggtaagtcaatattctaccgtccaaaggataaacaagtatatgcagacaatgcaatgaggaattttcacactggaaatgttggagaccatattgcattactaagggtctacaattcatggaaggagaccaattattcaacacaatggtgttatgaaaattacatacaggtaaggagcatgagacaggctagggatatccgtgatcaacttgcaggtcttttagagagggttgagatcgaactaacttcaaattctagtgatttcgatgccatcaagaaatccattacatctgggtttttcccacactctgcgagactgcaaaagtatggaatatataagactgttaaacaatcacagaatgttcgcatacaccctggttcggggctggcgcaggttcttcctagatgggttgtataccatgaactagtactcacaaccaaggaatatatgaggcaggtgacagagataaatccagggtggctggcggagatagcccctcactattaccagctgaaggatgttgaagattcatattccaactag

SEQ ID NO: 17953 - DNA, 834 bp, Glycine max
  Peptide Sequence Number=SeqID_134731
atggttgctggtgactactacaggatactgaaggtgaagcatgatgccacggatgaagagttgaagaaggcttataaaaagttggccatgaaatggcacccagataagaaccttgaagaccctcttaggaaagaagagtttgaggccaagtttaaacaagtttctgaggcctatgatgtgctaagtgaccccaagaagcgccagatctatgacttgtacggtcactatccccttaactctcaacgcttcaccaaggaatatggtggtgggaacatgaaggatgcaggggtggttgaaagcagcttgctttgtacccttgaagaactttacaacggttgcaaaaagaagttgaaggtctcaaggattgttgctcctgatgaattcggagagttgaagtctgtagaagaaattttgaagatagacataaaacctggttggaagaagggcacaaaaatcacttttcctgggaaaggcaaccaagaaccaggatttgctccagctgatctaatatttgtgttggatgagagtcctcatgctattttcaagagggatggaaatgatcttgtggcgatccagaagatattacttgtagatgctctcataggaaagactctcaacttggctaccttggatggaagagatctcacaatccaaatggctgatattgtgaaacctggctatgagctggtgatcttaaatgaaggcatgccaatctcaaaggaacctggcaagaaaggaaacctcagaatcatgtttgatgttatttttccatcaaggctgaccacacaacagaagtgtgatctgagaaggattctcagtgatgtttattactaa

SEQ ID NO: 17954 - DNA, 737 bp, Glycine max
  Peptide Sequence Number=SeqID_134732
tatgaaagctaagactaataatgctgaagctttcttcttctctgttattgttgacagtaccttcggtggaaatccactggccagtgcagttgcaattgcctcactagaagtgataaaaaatgagagactcgttgagagatctgcccaaatgggagaggagcttgctggtcagctgcttaagattcagcagcaatatccagactacgtgaaggaggtacggggaagaggattgttcattggagtggagtttaacagcaaaaatttgttccctgtatctggctatgagctatgcaaaaaattgaagtatagaggagtccttgccaagccaacacatgatacaattatccgctttactcccccactttgcataagaggttcttcgctatgcgaaggtatgagggagggatgttgtacgcagccttactcttgcatatgcaaagaggctgtttccggattcgaacccatgaccaacaagtcaccaaggcacaactttaccgctgcaccagggctcgccctccatgtacatggcaaaacattaggaaaaaaaaaatctgctgacaagcatggtagtatgggactacactttaaatttgttaaacagttgaagtatagtctggatgagatccaacaaggttccaaggtcctggctgatgttctggaaattgatctaccaaagttgcagaagacaaagccaaaagatgctgctccggttgcctctagtgcatgtgatcgttgtg

SEQ ID NO: 17955 - DNA, 303 bp, Glycine max
  Peptide Sequence Number=SeqID_134733
atggagaaaagagttgttcatcagcacactaaatttctaaacaatgtctgcaatacaaaccggtgtgcctattgggttccaaccgatccgattattaaaaacactgataaggagcataggaaggagaaagaaatgaaggggtttgctcagctcatgcagttgaatttgtggggtattcttaaaagtcaggaaattgctttgagatttagattctggaatattatagtggacagtgactcagcttcaagaatagctacacttagctcagttgtcttcctttttgaagaacaaaacttagcataa

SEQ ID NO: 17956 - DNA, 485 bp, Glycine max
  Peptide Sequence Number=SeqID_134734
atccatcatgagcggccaaaggtgaagcttgtaaggcatggtgttcaagtgctaccataccctactcatccgcaagagacgtcttccttccacttgcctgttggagagatgaacatcactctggatgatgtgtcctatttgttgcatttgattgtgacagacaaatccattgatcatgtcgcctcactctttgacaaagaggtggtgaagatcctcctgatgagtcatttgggcattctaacagagacaaaggcttctatagcggcaaatgcaagtgtcaggtcatgggtgtttgcacatttatcaactattggctatttagagtcgggggattatgttgtggaggacctggtagccactagatggaaatcgttgagaggaaccgggccttattgtccggagaaggtgttgaggaagtttgaccatgtccaaacaattctacgccggccacctcctcgtcctacgtatcagctttgtgatcgggc

SEQ ID NO: 17957 - DNA, 696 bp, Glycine max
  Peptide Sequence Number=SeqID_134735
atggaattgctcaagctttcgaagctgaagctccaactacaagccctcgtcgccgaagttcgtgatctcaggaagctgaagcggaacgaggaagagtgcggcagaaagatacaggaattgcaggacgagttggcttctgtaaaagaggaacgccagaaactggagagaaaggtgatttatcttgagaacgataatgtgctgcttgagaacaagcagaaagagttgaagggaacgctgaataatttacttcagtctagggaaaactttgtgaatgcttacgaggaatctacttctcaaatgaaacgttcaattgaagccaaagataggatgctcggtgtactttcagagaaaataagctcttatgtagcattgtttgattcaatagagaaggaggcgttttctatcaagcaaattgtggataaagtccagaatgttgtcaatgatagagagggcattgtggccagcttgagaaacaaaatggattgggtctctgcatctgaaaaagaatttgttgaaaatatctctgatctaagaaataaactggaaaacaatgaggctgaattaagaagaaaggatagaatcatctcagaacttgaagcaaagctggatgtggcaaaagtttgcaaccacaacctagctaaaatggaagatatatccatacctgcattgaatatttgtctttatcaaataccataa

SEQ ID NO: 17958 - DNA, 294 bp, Glycine max
  Peptide Sequence Number=SeqID_134736
atggagtgtgctctgttcgtatgctatcgggcggaacaagaattggagttagcttctttgaagctattgaagttgaagatagtgatcttcgagtcactgttgctgctccttctgcccgtggagagttttgggtttgaggatggaataacaagtcaaagctgcttgtgctctactgttgcttacttagatacaaaccagggcaatacgttgcaattgaaagtcttacctcctatgatcatgtactatataacacatgcccacatctggctcatgggtaaaataactcaaccttga

SEQ ID NO: 17959 - DNA, 2475 bp, Glycine max
  Peptide Sequence Number=SeqID_134737
cactgttgcattgatctttttcatgtgattgtggtatttatagttgttctgataatggtatctactgataagagacaatcttttatacttttccagaatatggatgctgcagcagaatcaactgctgccacagaagaaggacttgaaagtggcctcaggaatgatgctccagattctgcaatagctatgcgtcaaaagtggcgcctctgtgagattggacttgaggattactcattcgttcttttaagcaggacacatgttgcaaaaagcatggggtacttgttaactattaagacagtggacacatggggtggacacaaggggggtgttatgtttgtgtttgttaacatccagaacttgtttgactttgatggagttatagaccgttctcttggtagcacattaacttctgaacacatgaatagatttctcaatgagtttgaagttatgggaggtgctcatcggctggctgaaagcattcagtcaaaaaatctaaactcatggaatgatccacttggagcacttattattggagtccaccagctgaagttatctggttggaagccagaagaatgtggtgctattgaaaatgagctcatcacctggagtaaaagaggcctttctgaaacggaaggaaatgaagatggcaagactatttggacattgagactgaaagctactcttgatagatcaaagaggctaactgatgaatatactgaagaacttcttaagatattccctcagaaagtccaggtttcaaaactatgtactcttcttctaaaagcagttagaaacacacttggttctcaaggttgggatgttcttgttccaggaactgctttaggaaaacttgttcagggaccaagtcacaactatgacgggaaatggtacagtcagcgagcagcatggaaaggagcagcaaggcaaagggatgtggaaattagtaactggagggatgcaacagacgtccactccttctacttcacacgatttccggaggaaatgggggagaaggatatgtggctgaagtttaagacatggggagatctagacagcatggttatcggtggccttaaactccatgctatcctccctaagcacggaaggcagaggacgacagctgggaaatctaactcgaagggaggggtacaagcatcaaacatcaataacatctcactcatcactgcagttgagcatacccatggaacaggagttaagccaaactatcttggggatgacatggtcctagtgaatggcttaataaatggcagggtagaagatggcaggctagacaggatcctagatcaaagaagaggcccgtcaagacttcttgttgatggttgttggatagaagatcccaacaggatcaaagaagaggtccatcagttctttaggaagagatttgaggaaagtgaggaggtgaggccgaggctagatggggatgggctttttggagggcagcactctggtgctttgtatgtatctctagtaccactggagttctgggatgtaattaaacctgaggtgcttagattcttggacgagttctatgtaaatggcagattttcgaaggaaacaaatgcttcgttcctagcactaatccccaaagtacaggatccacagaacctcaatcagtacagacctatatccctgatagactacatctacaagattgacattgctaatgaagcggtggaggaagtgaaaagaggttctaagagctgcttggtgttcaaagtcgactatgagaagccatatgattcagttagttgggattttctggtctacatgctttggaggatggggttttgtcctaagtggatcacttggattgaaggatgtcttagatcagcctctatctccatattgatcaatgggagcccttcagctgaattcattccccaaaaaggacttagacaaagggatccattagcccccttctgtttaatattgtggcaaagggttgaaattagtatcatgcagtatacagatgataccattttctttggggaagcatcgatagaaaatgtgagagttatcaaggtgatgctaaggagctttgagatgatgtcaggtttaaaaataaactttgcaaaaacacagtttagggtgattggaatgccattgcattggacgaagaatgttgcaacctaccttagctgcagcctgctgtctataccttttacctacttgggtatcccgatcggggcaaacccaagaagtagtgtgactgaggatcctattgtcaaaaaatgtgagcgtaaattgatctcgaagaaggtggtacataagctggtgaaactacagagatggttcttgtggggtggagatacagagcagaagaagatcgcagggattagctgggaatcagcatgtggaatctgtttcatcatcaaggagagttatgggctagagtgctggattcaaaatatggtgggtggaggaaccggaatgagaatagaaggaattccgtag

SEQ ID NO: 17960 - DNA, 2673 bp, Glycine max
  Peptide Sequence Number=SeqID_134738
atgggagcgtgtgtttcaactccacaaggttgcgtgggagggaggttgagctcttccaagaagaaaaccaggaagaggaggagagagggactcagaagaagagttacttctcggttgtgtaaggaatcattggagaaaattgatgtggcagggttgcctgattgttcctttgccaatcccactttccaagttggagaattggagttttacacactggggaatgttgttggtggagttgatcactttgtgtgtataggattgggaggtgttgaaattcaacttttggagtgtgatgaacgcaataagacttccggaagtattgaagaggcatggtttgattcggttgcagtatttgactctgactgtgatgatgattatcagagtgttcctgatgatgttgtatctctgagtgggattgaaggtggatctgtatcaagttttccatcttcaggagatgccaaccatggagtttccacagatcatgttcagaaacagaaggagttgttggcaggatccgaagcagccagaagttcagatgtccaatattttgtggtagatgccattgattctcaacatgagcccgtgttccttgatgaaatttcctcagtggacgcgaactccaacaaggatgatggacttttggataattgtgggattcttccgaacaattgtttgccatgtcttgtatctaccattccttctgttgagaagagaagatcaacaagttctagtcctcctaatgcaaggaagaagcctacaacaaaactttcctttaaatggaaagaaggacatgggaatgctactctattttcctcaaagatgcttctacaaagaccaattgctggttctcaagtgccgttttgtccaattgagaagaaaatgcttgattgttggtcacaaattgatgcaagcactttcaaagttcgaggagtaaattatttcaaggacaagaaaaaggactttgctcctaattatcctgcatattacccatttggtgtagatgttttcttgtctccacggaaagttgaccatatagctcggtttgtggaacttcctgttatgagttcctccgcgaaatttcctcccatactagttgtaaacgttcaggttccactctatcctgccacactttttcaaggagaaactgatggtgaaggaatgagcattgttttgtactttaaactttcggaaagttactccaaggaacttccacagacttttcaagaaagcatcagaagattgatggatgatgaagttgaaaaggtaaagggttttcctgtagatacaattgcacccttcagggaaaggttgaaaatattaggccgtgtcatcaacctggaagatcttcatttgagtgctgcagaaaggaagcttatgcaggcttacaatgagaaacctgttctttcgcgtccccaacatgagttttacatgggggaaaattactttgagattgatttggatatgcatagattcagttatatctccaggaaagggtttgaagctttcttggacagattaaaggtttgcactctagatgttggcctcacaattcaggcaaattctatcaagaacatggtcaacaaaatcaagattgagaaattcacagggaagaataaatttgaccttcgacacatcaagatgcgagccttgttgaaagaacaaggcatctgggctcctttcttcggtcaattgttgaagattgataagtcaacccttgggttacaagaggaagaggcgaattcactaattctcttatctctatctgatgaggaaggtacaccattgaaggaacatcttcatgagctaaactttgttttgatggaactacgcaacattgatgtcaagatagaagatgaagatctaacaacgattctattggtctctcttcctcctttttatgagaattttgtgagttcttttagtatagagcttcgactaaaggcgtttaggaatggtgatgaagcctttacgttcgaactattggtgactaattcttctaaaggacagaaggagaagaaagacaaatgtggtaagaaaagcaaagcttatcctaaggacatatgcaattactgtaaagagtcggcgatttggttttggttgttggtgaacaactacaacaacattttgaacaatgggtactggactcagcagagcgtggagctctcgcctaatcagtatgatgaattctacgatgagctgaagcggaggcaggttaaggggaaactcattaagtttgacgctcagacattgaacgctttccttgagaccccgatcatcattccaaaaggggagcaactagcctcttacgcccagtacctccacacctacctcgaccatcacaccatcacggtgatgctatgcactttgggtgatggacttggatttgggcagcctcatctctttccagattacacagattgcccagcccagtttattgcagttgggcttccctgtgctgatcataactctttgcgatgcaaaggcgccactctcgatgttccaccagtcgctcctccacctgtggtccctactccagccgtctctcctctacccgccgacccaccttctctcctttcttctcagccagaccagctcctccctatgctgcagagtctccaacttcaatctccgtctctttcttgctctcagattcttagatacgtttttgattaa

SEQ ID NO: 17961 - DNA, 2253 bp, Glycine max
  Peptide Sequence Number=SeqID_134739
atggatcagtcaccattcctggctcagagaggatctgtgtcatccagccttggaaactctgcagaacttgatgccaatctcacactcagcgataagctcaaggttttcaaaagctccacctttgatcccaataactatgttgcctccaaatcccgcagcatgaacgagaaggagataagacacttgtgtgcttatcttgttgatctgaagaaggcttcggcagaagaaatgcgcaaaagtgttcttgctaattactcagccttcatacgtacatccaaagagatttcagatcttgagggagagctgctttccatgagaaatcttctaaacacccaggctgctttggttcatggtttagcagaagggtgcatgcttagttccatgattagtggaaatgaagattcagacatggatgatttactagctgaaaaaacagatatatccaatacagaaaaatggctaataggatatttagaaacccttgaagttctattagcagagaaaagagtggatgaagctatgactgcattggacgaaggagaaaaaatggcaaaagaaattagtgaagggaaaactttaagtccaagtttattccaggcattgcaagatgccattaatgaacacagaaaaaaactggctgatcagctagcagaaactatctgccagccatcgactcacagtgcagagattcgatcaacagcattggcattgaaaaatcttggggacggtcctcgtgctcatacattactactaaattctcaccaagaaacgttgcaacgtaacatgaaaaaccttcaatccagcaattctggtggagttggagcatttactgctaccctttctcagcttgtattttcaaccatttcacaagcagcatcagattctttgtcagtgtttgctgaagaagaacctgcctatacatctgagctagtaacttgggcagtaacacaggctgagaaatatgctgttctccttaagaaatgcattcttgcctctacagctgcggcaggaggtttgagagttgcatctgaatgtgttcatgtttgcatgagtcactgttatcagctagaggctagtgggctggccctttccccaatcctaataaaatattttaggccctttgtcaagcaagcactgaacacaaatttgagaagaattgaacaaagtagttctgcactagctgctgcagatgattggtttcttgcttatgcaccaaccagcagcaggcattctggcctacctccatcttcttctcacagtaacttaagttttcaaccaaagctttcaagaagtgctcacaaattcaactcaatggttcaggagctatttgaagatgtaggacctcttgaaatactacaattggacgttcttgcagttgaaggccttctacaagtgttcaacttctatgtcaatttgctaataaatgcattgccaggttcagtggtaactgagaatctggaagggcacaaaattgttaagattgctgagaccgaagaacagcagatagcattgctggctaatgcaatgttgctggcagatgagcttctcccgcgtgctgtcatcaaactttcaaatagcaccagaggtgatgactctcacaggagaggatcagacaaacagcgtgaactgaagaaaaggctccaacgtgaagttgatcgcctgcgggacagcttttgccggcaacatgctcttgaacttatcttcacagaagaaggagaagctcgtctaaatgcattaatatatttgggaatggatggtaatgtagaacaacctgaatggtttccttctccaatttttcaggagatttttgcaaagcttacggatgtggcaagcattgcagcagatctgtttgtgggaagggaaagatttgccactgttttattgatgagactcgcagaaacagtgatcctgtggctttctgatgatcaaaccttctgggaagaggttgagacaggatcaacacctttaggtcccatcggccttcaacagctttatttggatatgcaatttgtgatgatattttcatcccaaggccgttacttatctcgtcatttgcatcaagctattaaaaacattattgaaagggctattaatgctgttgccgctacaggtctggatcccaacagtgtcttgccggaggatgaatggtttgttgaagtttgcgaaatagctataaagatgttaactgggagagcagcctttgacaacgtagaggatgatgttgctagccccacttcatctgtccaaacataa

SEQ ID NO: 17962 - DNA, 1761 bp, Glycine max
  Peptide Sequence Number=SeqID_134740
gaaaaggtcatctttgtcacgtgtgaagatgatgaaaaggttgctgatatacaaaggctgattgggtcatatgtgagattggaagcatcaactgctggggttaatctgaagttgtcctcttcagttgacatagaagacaattcttccattagaagttcttctgatgactgtgtctctggagttgaggttccttctttttcttctggtagaatctccaattttgatcagggtgcttcttctggaagagttatcttgcttcctgatgcagagctacagacttcaggtgcaaaggctgctgcatgtggtcacttatcatcattgtctgcagtttctgataaagtttacagtgatcagggagtgcctgcttcttttcgagttccttctggggcagttttaccatttggatccatggaattggagctagagaagagcaattcgactgaagcattcaggtctatcctggaaaagatagaaacagccaagctggagggtggtgaacttgatgttctatgccatcaactccaggaattaatttcttccctgaagccatcaaaagacataattcaaagcattgggagaatattcccaagcaatgcacgtttaattgttcgatccagtgccaatgttgaggacttagctggaatgtcagcagctggactttatgaatcaatacccaacgttagtccttccaatccaacagtttttggaaatgcagttagccaagtatgggcttcactgtacactcggagagcagttttgagccgccgtgctgctggtgttcctcagaaggaagcttcgatggcaatactgatccaagaaatgctttcaccggatttatcatttgtactacataccgtgagcccaacaaaccaggataataattgtgtggaggctgaaattgcttctggccttggtgaaactctagcttctggaacccggggtacaccatggcgtatatcatctgggaaatttgacgggcaagtgcaaacattggcttttgcaaacttcagtgaggaattgctggtacgaggtgcagggcctgcagatggggaggttatccgtttgactgttgattacagcaagaaaccactgacagttgactcagttttccgtggacaacttggtcaacgtctttgtgcagttgggtttttcctggagagaaagtttggttgcccacaggatgtggaaggatgtcttgttggaaaagacatctttatcgaagcacatgcttatctattgcaccagagctatgttctccagcatgtacgtgatggaaatggaatgaagttcgacttcgacaaattgttggatatgaaatcagccgttacggttgaaaggaagccaaatttgaaggatttgaataggtttggtttgattgaagggatagaggataagaagttgagagaattatgggagggacaggaccttgttattgtgaatgtagatgactccagagctgtattagctgcccaagatcgtagcaatggttctcttattgctgtccagttgagcactgaccacaagccacatcttccaagggaagcagagaggataaggatttgtaaaggaagggtcttcgccattaagaacgaaccagggattgctcgagtatggctccccaacattgattcccctggccttgccatgtcacgtgcttttggagatttttgtctcaaggactttggagtcatctctgctcctgatttctcatatcaccgcctcactcaaagggatcaatttgttgtcttagccacagatggg

SEQ ID NO: 17963 - DNA, 291 bp, Glycine max
  Peptide Sequence Number=SeqID_134741
atgcagaagaagcaacgagaatgcaaacatagttttatactggaagaagttatccaatcaggtggtcagattgagccgcctggaatgcacataatttatcttccatattctgatgacatcagacttgttgaagagcattattcagatacaagtgggatggtgaatatagcaagtgatgatcaaataaaaaaggctgctgatctaattaagcttattgacttgaaagatttttcagtatgccaatttaccaacccaggcctcacgtgtaacatcccaattttttgtaaataa

SEQ ID NO: 17964 - DNA, 300 bp, Glycine max
  Peptide Sequence Number=SeqID_134742
atgattcttgttgttaacaaaaagttttacttttcagccttgcagagacactatgcagtattgcaggcattggcactggaagaggatgatattccagaaatgaaagatgaaacattacctgacgaggaaggtttagccagaccagcagtggtaagggcattagaagaattcaaaacctctgtatatggggataattatgaagaggaaaataagcctggcactgggaagcctactgaagcctccaagaaacaaaaagcaattgctgagtttgcaacaaaagagtgtgaaaactatgactga

SEQ ID NO: 17965 - DNA, 618 bp, Glycine max
  Peptide Sequence Number=SeqID_134743
atgcagtggggttctgctctcaggtgtgaggggtggaagtctcgtgcggatgaagaaactgttgacccaacgtcctcacccagcgggataaaatttctgttggttttgacaaagggggcactcttttacattggagttgattttggagtggggactgtctgtgcttggattcgtgatgacaataatcgttctgaagagtggaaggcgacatggtggttaaacagattgatagggcgaaaaaagaaggtgacggtagactggccatatccttttgctgagggcaagttatttgttctcaccataagtgctggcttggaaggttaccatggatttgctcttgaggatgctactggactatctattaatggggatgttgatgtgcactctatatttgctgcttccttacctacatcacatcctagctttgctccacagatgcatcttgaattgcttcctcagtggaaagctcttcctcttcgcaatatgaatgtggagcttttcattggtatcctttctgctggaaaccattttgctgaacggatggcagtgaggaagtcctggatgcagcataagctaatccaatcttcacatgttgtggctcgattttttgtagccttg

SEQ ID NO: 17966 - DNA, 372 bp, Glycine max
  Peptide Sequence Number=SeqID_134744
atgttccaaccatatgggatcagcatagacttaaaggagcactcaaacccggtgacccccaaggcctacactccgaagagtccgtcagggcctctccctcctgattcagacagctctgggtttctgcgggaaagaaaaaggctacaatgcgaagggtttttctctcagttcagacatgatatcgaaattcccaacggtgagaatgctcggaattgtgttgcgaacatgatactcaaatttcacgacgatccaacggtgaacgggttcgagatcgtcgtttttctgagactggtttggtgggctgcgggaaaaagaaagggttttgagaggagaaggggaaaaacgaaaatgaggccaaaaggaggcagctga

SEQ ID NO: 17967 - DNA, 543 bp, Glycine max
  Peptide Sequence Number=SeqID_134745
atggatcattatgaccttgttgtgttgaagaccatagctatctgtgaatatgggattcatactgtggcttctaagtatatcatgaaatgtgatgatgacacatttgtcagagtggattctatcataaacgaagcaagacaaattcaaagtagaagtctctacatgggaaatatgaattatcaccacaggcctcttcgccatgggaaatgggctgtaacttatgaggaatgggtagaggaagaatatcccatctatgctaatggtccaggttacatagtctcagctgacatagctcagttcattgtatctgaatttgagaagcgcaaattaaaattattcaaaatggaggatgtgagcatgggaatgtgggtggagcagttcaacagcacaagaccagtggagtatgtgcacaacttgaagttctgccaatttgggtgctttgaagagtactacactgcacactaccaatcaccaagacaaatgacatgcatgtgggaaaaattgcaacatcaaggaaaaccactctgttgcaacatgagatga

SEQ ID NO: 17968 - DNA, 741 bp, Glycine max
  Peptide Sequence Number=SeqID_134746
atggagagaagaagtctaggagttacaccaagaagaagaagtggttgtggagcacagggagagctttccctcttactccagatttcactcattgctcagtccaactcctcgcggctaggatttccaaccctgattactgccttgtgcaaggcccgaggagtcacctcaaattctcttacctttgagtcacttagcccagccattaatttggcctatattaagaagaattgctggaacctggatgaaccttcgattacttttccagggacccaaaaatccagggctagaagatctgaggcctcatcttcttcagctgcccatgctccccctacccttgctccctctacttctgctctcccttcagtaccagcagctccagttcttccaggtccctccgttcagagcttagagcctttcatgtctatgctacagagcttgcatcagggcgagctcttgatcatgcagagtttgcaggatgtggtccagcagcggccagttatgagcctgaaggagtttgttcagaaggtggcctggccaggagtccaaccttctcctttgggaggggtagcagctactccacaggtgacaccagagccttccactacagtgctggacatgtcttcttctcagcctgagtcatctgcaccagtgccataccttccactttctcaggattcaccatcaggcactactgcactggacctgaataagcatgccatggactctgcacaggatcattga

SEQ ID NO: 17969 - DNA, 1286 bp, Glycine max
  Peptide Sequence Number=SeqID_134747
cagataaggcctttgaagccttgaaattggcccttactacagctccagtgttggccatccctaattttgctgcaccttttgttcttgaaacagatgcttctggttcaagcataggggttgtgctgagccaaaacaaacaccctattgcatacttctctaagaagttgtccctaagaatgcaaaagcaatctgcttatgctagagagttttatgcaatcactgaatcattgtctaaatttagacattacctactgggtcaaaagttcattataaagacagatcagaaaagcttgaaagaactacttgatcaaacattacaaactccagaacagcagcagtggttacccaaatttataggatatgatttcataattcagtattctccaggaaaagagaatattcctgctgatgcactatccagaagctttgctatggcttggtctgaaccttcaaatacatggcttcaaacagtggcagctgcaacaaagaatgatgagtctttgatgaaaatctatcagctctgtagcaacaatgctgggaagagtggcgattatgtattacatcaggatgtgatcatatggaaagggagaattatgttgcctaatgatagtcaattgcttaagatgattatgactgaatttcatgcatccaaggtgggaggacatgctggaaccactagaacaattgttagaatcaatgctcaattttactggcctaagatgagggaggatattaggaagtttgtacaggaatgtgtcatatgtcaacaagccaaagtcactcattccttgttgcctgctggtcttcttcagccattacctatccctaatatgatctgggatgaaatcgcaatggatttcatcaccaatctaccattatctcatggttactctaacataatggtggtagttgacagactatcaaaatttgttcactttattcctttgaaaccaggatttaacagcaagattgtagcagaagcattcatacataacattgttaaattgtatggcttccctaaatcaattgtgtcagatagggacagggtgtttatcagtagtttttggaagcaaatgttcaagtcacaaggcactaatttggctatgagctcctcttaccatccacaatccgatggccaaacagagaatcttaacaagaggctggaaatgtatctaagatgctttgtctttgttcatcccaaaaactggttggagatgctaccttgggctcaatactggtataattcatccttccatcatagcattagatcgctccataccaagtag

SEQ ID NO: 17970 - DNA, 543 bp, Glycine max
  Peptide Sequence Number=SeqID_134748
atgaattgcgttttcgttcatgtgtcctccaccttcgagtttggagctatgcgtagtgattgcttagtgaatttctccattctcaacctttttcggagccccatgaattgcgttttcgttcatgcgtcctccaccttcgattttggagttatgcgtagtgattgcttagtgcaattctccattctcaacctttttcggagccccatgaattgcgttttcgttcatgtgtcctccaccttcgagtttggagccatgcgtagtgattgcttagtgcaattctccattctcaccctttttcggagccccatgaattgcgttttcgttcatgtgtcctccaccttcgagtttggagccatgcgtagtgattgcttagtgcaattctccattctcaccctttttcggagccccatgaattgcgttttcgttcatgtgtcctccactttcgagtttggagttgtgcttcatgattgcttaagtgcggaccctcaaggcaattctccattctcccccttttttcgaagccccatgaatgttattgcctag

SEQ ID NO: 17971 - DNA, 117 bp, Glycine max
  misc_feature (50)..(50): n is a, c, g, or t
  Peptide Sequence Number=SeqID_134749
atgaaatatgatagtgggatcgtccaagttctaagcagttcttctttatncggtgatgagggctgggaagccgagccgcgaggagttggactaggccatctgagaaatctggtgtga

SEQ ID NO: 17972 - DNA, 523 bp, Glycine max
  Peptide Sequence Number=SeqID_134750
ttcttaccgttttatactacttgcgcgatccggtgcacttgccgagttcgaacagaaagccacaacatcttggccccacaagccctatgagaccaccaggtttacatctgagggtgcctgggagcgatattctcaaaacattcactcccggaacatcctttcagagaggaatgttaacctctttgtgacagagtacgatgaatttagacgagagctaatcagaagaaactgccacaaggccttgacccagcacatggacgggcacattgatgtggccctggtcaaggagttctactcgaacctgtataaccctaaagacaaatcaccaaaacaggttcaagttaggaggaagctgattaagttcgatgcggcatcactgaatgcctttctggagacaccaccactcattcagccaggggagcagagcaccctggaagctcttgaggaaggatctgactacactagcccagacctggagtgtgttatcatactccaaccttgccccaacttctcatacgtctga

SEQ ID NO: 17973 - DNA, 708 bp, Glycine max
  Peptide Sequence Number=SeqID_134751
atgcacaattgtattgtaagcctcgctttaagaaagcgtccaaaatgtggtcagaagactctgaatttacctatgtttggggaggtttctattttctcgctggtagtgttactattctgcgtgatatttgcggttgtatgggttgctactcggcgtgaatcattttcatggtttggccaagatgctcttggcatcggtttgatgataacagtcctacagttggctcggttgcctaatattaaggttgcaactgtactcctatgttgtgcatttgtatacgacatcttttgggtattcatatctcctgtgatattccagaagagtgttatgattacagttgctcgtggtgacaaggccggtggtgaagcaattcctatgcttttgagatttcctcgtctttctgatccttggggtggctatgatatgattggatttggagatattctctttcctggtttgcttgtttcctttactcgtagattcgacaaagctaataagaagggggtcgtaagcggatattttctttggttggtagttggctatggttttggcctcttcttcacatatctggggctatatatgatgaacggtcatggacaacctgcactgctctacctggttccatgtacactaggtgtgcatttatatagcttgcctgatccaattatgaacaggagtaactgtggtattgggatgcaaaagaggtga

SEQ ID NO: 17974 - DNA, 276 bp, Glycine max
  Peptide Sequence Number=SeqID_134752
atgaggatgcagaattgcagatattcttcttcggtcggtgatgatagtgggtgtggcattggtggtggtggtggtggtggcggcgttgatttcggtgaatgggcaaagcagtacatgcaacgtatcgatgtcagatttactgacatgcaaaccagcggtgacgcctccaaatccaccgccacccaccccagagtgctgttctgtactctcacatgcagacttgccctgcctttgcccttacaagaactccccactcttgccttctctcggaattga

SEQ ID NO: 17975 - DNA, 981 bp, Glycine max
  Peptide Sequence Number=SeqID_134753
atggatttcacttacccttcacttctctccattttccttctcctactacttccttctctgatctcatcacaaatctgccagaaaaactgtggcaaagaaactgtcaagtacccttttggcagtggtcctggttgtggagaccctcgtttccaaccacatgtgacatgtagcaaccaaaagctcacattcaccactcacacaggctcctaccctgttacctcaattgactacaccaaccaagtcatatacatctcagatcccaccatgtcaacatgctcttgcactgtccctagcaaaggctttggccttaactgggatgcaccatttacctttgctgatagcaccatctttgctctagtagattgctcaatgaactcatcatccatatgccaatcaaatggctatgatgatgggagcaattctaagcttttatgtgatcaagggacaccaatttgtagtcttctatattcatgcagacctattagcaccatcaaccttccaatctcaacgtgctgcgtttacacgccggttaatctcggtccggcttttgagatggatctgcagaagctgcaatgcccttcttacacggggttctacaacttcaatgatcaacaaacggatcctgaaaagtggaactatggaatagcactcaaatacaagttcagtgtcacaaatgactatcctggctcgtgtgatgcgtgtgaaaggagccatggtgtgtgtgggtatggtggagcctataactcgtttgtctgcaattgtcctaatgggattaacactacaacagattgtttcttcatatcatcttataacaagggttttagaaatggggttgcttggttgatctatcctgtagcatggtttcttgtttggtttttcttgtggaagcttcgtgggccatcatcagcaattgagttagtgatatacagccagtacattagtgaatctctaaagtgtgaacatgtagaagtagaagactag

SEQ ID NO: 17976 - DNA, 510 bp, Glycine max
  Peptide Sequence Number=SeqID_134754
atggcgtcctccccttctttggcggtggccgtcgtcgtccttctattgttcgcagcagcagcggccgccgatgacgcctcctgccatcattccttgcaattgaccaagataaaaagctggatcgatgggaataaagatgtggactataatggtatgactgcaaaattcggctcttatttgcctgaagatgccgatcaagctgccaaaactcctgctcttttttctgatcctatagactgctgttccgcttcagcttcaaagttatccggatcagttgctctctgtgtacggggcacttgtgacttcacaaccaaagctgcatttgcacagtccgccggtgctactgccgccttgatgatcaacgacgccgatgaactctttgagatggagtgctccaatgacactagcgtaaatatttcaattccagttgttgagataactaagtcaacaggagacgctctcaacaaacttttgacgtctaaaaggaaaggtcagtcctgcaatttttag

SEQ ID NO: 17977 - DNA, 183 bp, Glycine max
  Peptide Sequence Number=SeqID_134755
atggctccggcgatgaggatcgttttcggtcttctcacttttgtcaccgtcggaatgattataggtgttcctttttggaataatgacaaggaagcagaaatcttacgccttggatatgtcaaacctgaagtgcttaactggtctccacgaattattttacttcataacttcctgagcatggag

SEQ ID NO: 17978 - DNA, 526 bp, Glycine max
  Peptide Sequence Number=SeqID_134756
aagtgctaaagttgatgtctcgctaagtgagctcaatgcgcttagcgagtgtcatccgctaagcgaggcatcaacgcccttagcagataggaggaatctagaagggaatctgtcacgcaggcacgcgctctgtgacatcctagaatttctacccggaatttttctaaaaattatcgttttgcgtgcaactaaaaatttaacaaaaccaacctctgaaccatgctcaggatttcattctgagcgttttgatatatatattgcctactttcaaaaacgggccccgacgagtgcagagaaatgcgaggaactggaaccagagagacgaaatttcagcagctcttcttctcccttccacgtagcttttcttcttccttcttctccaccattgaagcctccattgaagctccaaaattgctcatcatttctactccaaaatgcaaagagaagccattttcggagtcttgaagcacacctctacttcatgaggcttcaaatttcaagtatgggtggacttcttctcacatga

SEQ ID NO: 17979 - DNA, 540 bp, Glycine max
  Peptide Sequence Number=SeqID_134757
atggggtcattggcatctatgaacatgtgtttcttcatgaaacatgatatttctatcttgtacagggaatcaagagtgatgtcaggactaagctctggtatgtttttgaattctaaagagagaaaatatcctatggtacaagcaattgaaaaaagaatttctgtctattctcaaataccaattgaaaatggagagcttatgcaagtcctgagacagttcaacttgaagcgtggtgggcagcgaatagccacaatgcttatgtatttaagtgacaatattgaaggaggagaaacatattttccattgttgcttagaaatggaatgccaaattattatgatgcccgtgattatgtttactgctgtggtgggaaacttgtcaaagggctatctgtgaagccgattaaaggaaatgcagtgcttttctggagtatgggactggatggacagtcagatccgaatagtgtgcatggaggatgtgaggtaatctctggggagaagtggtcagctaccaagtggttgaggcagacgactcacacttga

SEQ ID NO: 17980 - DNA, 289 bp, Glycine max
  Peptide Sequence Number=SeqID_134758
atggctggggttgatggggacccggtgctgagaggaacgaggataagggctacatgggggtacgtgagctcagttgaagagttgatttgcgccatcgcccgatcgccacctagtaccacatatgacggagtggtacctggagatatgtcgcgggggtcaggagaccttggggacgtcaggcgagctcctggcagtcaaccaataaaagaacaaagaccacaaagcaaggaggcttgtgtggtggctggccagctatggatcttgagtgatatctggaatatgacctctg

SEQ ID NO: 17981 - DNA, 279 bp, Glycine max
  Peptide Sequence Number=SeqID_134759
atggggctaacaagcaagctggagtttgtccgagacagattaatggaggtatatttctgggtgctgggaatggcacccgaccctcaattcagtgaatgtcgtaaagttgtcactaaaatgttcggactagtcaccatcatcgatgatttatacgacgtctatggtactttggacgagatacaactcttcaccgatgctattgagaggggctttcgctctatgactaaacaatgtcatgctgcaaagttattctcaaagcatatgaagtttgatgaacag

SEQ ID NO: 17982 - DNA, 1290 bp, Glycine max
  Peptide Sequence Number=SeqID_134760
atggggtgtgggtgtgggtgggtgggtgttttggtttgttcaggggtaattgctatacgaggaactgaaaccccagaggacctaataactgatgggttatgcaaggaatgcaccatgtctgtggatgacctggctggcttgataaattgcaactacattcattctaatataaagaaaaatgtgacttcgccattcccccactatgggcattcaggcatagttgaggctgcacgagagctttttatgcagattgaaggaaatcctgaagggcctgactcggaatcctacggacttctttctaaattactgggatttggttgtgaatgctttgggtataatgtctgcatagttgggcattcgcttgggggtgctatagctgcattgcttggactgcaactttataaccgctaccctaatcttcatgtttactcatatgggccactcccatgtctggatttagttgtggcaaatgcatgttcagaatttgttacaagcattatatttggaaatgaattttcatcgcgcctttcaactgtgcggctaagggcagctgcaatcacatcactatcacaagatcctaaagcagatagtgccatgattttcaaacttgcccataggtttctagatgtaagcaaatatcagagaaataagtccaaggcagaggatgaacctgagtatcattcaggggccatccaggcagatctaaaccatcagatccgcagaagccagtgtgagactgataataaagcaggtagcatcgaacaagaggttcaggctattagaagggatcttgttactgctgactatggtgaatatatgaatccttttggaagtgaagattgcctcaacaatgggcatgaacaatgttctctttggtctgacactagggcaagggatcatatcattgaaattgatagttccgaatttccaaatccttttgctatagatgcacattcaaatcatgatccagtgtctcagtttatagatactgttccaaattctgaaaatccatctgcggatgatcccccagagctgtatctgcctggttttgtaattcatgttgtattggagaagaaaagacctcaaactgatcttaagacatcgtggagaatgctagagagggaaaaatgttatagagcttacatagcaaatagagaaagcttcaaagatattattgtttcaccatccatgttccttgaccatcttccttggagatgtcacgatgccttgcaaaagatattgaaagctcaaactgctaaagatcaagtaacggaacctcacatcatctga

SEQ ID NO: 17983 - DNA, 397 bp, Glycine max
  Peptide Sequence Number=SeqID_134761
atgtccagacaagaaaaatactttgtagaggttgaagctcaagaggaaagccctgtaaaagagcatgagtcaagagaaaaagatgaggaacaagtacaacaacaatgggagaagtactcaacagtagaaaaccaacaagaaagtattcttcaaatcaataaccttcctcatcaactgattgtcaaaaaaggaaggcaaggagagcatgaggaaaccttaagtgccattctttctttaatcactaacacctttcttgaaatgatttggaatgtacttccagactatatgaagttcatggaatttctagctaaaagtcctttcgctaagtgccaacttcacgctaagcgcatcttaggtcatgcgttatgccaagagtctaaagcgcttagcccccaat

SEQ ID NO: 17984 - DNA, 483 bp, Glycine max
  Peptide Sequence Number=SeqID_134762
atggctggaaattacatcttcggcaaggatgttcttaaccatggcatgagccgttttgtgttcattgtttaccgaaatgctatggctactattgcccttgccccttttgcattttttattgaaaggccagtttttaaccaaagcttcaattacttggggatgaagtatacttcggcttcattcacatctactatagtgaatgctgtgccctctattacctttgtgcttgcagtcttcgtccggttggagcatctaagacttagggaggttcggagtcaagccaaagtgattggaacattagtaacctttggaggtgctttgctaatggcaatttacaaaggtccggcattcaacctttttcagtctggaagcacaacccatcatgaaaatggaagcacctcctctcacaacagccaccaaactgctggtgctatttatatactaatgggttgtgtggctttgtcgtctttctacattttgcag

SEQ ID NO: 17985 - DNA, 212 bp, Glycine max
  Peptide Sequence Number=SeqID_134763
tgagtcacatgttatcaaattggggtgctggttgcatttgctttgcattatggaacactttctctggcaatgtcatggatttgatcaacgatgcccacaaatggtttgagcgtaagcatggtaattctctccgcaacttggggattcctgtgggaactgtctcattcggggttctacggtcggagaaaaattctccgtggggacagggatga

SEQ ID NO: 17986 - DNA, 495 bp, Glycine max
  Peptide Sequence Number=SeqID_134764
atggtggtcggaagtgctttgggagcgtttgcagtggcaaggccttcctcgccactttttttgttaagaggacaaacggctttcaaattcagacccctctcatcttcttcttttggtgctgcaccttctagaaagctcgtcctctactccaaacccggttgctgtttgtgcgatggcctcaaagagaagcttcaagctgcattcttactcttgggcactgattcacttcacggcgttgatttgcaggcaactctctttctctctcgtaccttggatataactaccaatcctgagtgggaaaacgcttaccaatatgagatacctgtgttggctaaagtgctttccgatggcaccgaggagccacacagccatgacaaagtgaacataggtggcaagattatccctgaaagaaggcaaggtaatatgattagagacaatagcagccagaatagggatgatgttctgaggcttttgagtcaggttgtcttcacttaa

SEQ ID NO: 17987 - DNA, 555 bp, Glycine max
  Peptide Sequence Number=SeqID_134765
atgtttcactgctattggatcaagggttcaagtctcagaagcactgcttcttccatccactgtccaatgacatgtctatatgccaatcctaaagtgggaaaagatcaaccccctgatctagctgcactagttccatctggtttgatagtcttacccgatcaaccacaaaaacaatcttcttcacaggttcctgaggatgcaaaccatgtttccatggataatggaaccaatacagtttctgctaaagttgtcaagccatcctctggcaggaaaagttcaaaggggacaccagcaaaaaatgttaattcatcaggctcctttgcagatgctgggcaattcgttgaagagatattgcaaaaaacatcacagttattgctttcagaggtcaaggatgaaaatataaagttacatggggagcagctcggtactgtgttatctgacaaattactgaaaaacctcaatgcagagtttaagaaccttgctatgatttttaagaacacagcatatacggaagggttccatgccggtactcattataggcccccgctcatgtga

SEQ ID NO: 17988 - DNA, 1575 bp, Glycine max
  Peptide Sequence Number=SeqID_134766
atgaatgaaaatacagaactattccctctagctttcttcttttcttcttcttcttcaggaggtgttggccctcgaagccagttatgcaagcttaacgtatcattttggtgctttctggggcttgctgggttttaccgccgtttcatccgtggttacacttcaatcgcagcacctctggtccacctcaccacattggaccactttgaatggacaccccaagcacaaacgacttttgaccagcttaagcacgctctcttcgaagctcccgttttagccttgtcggactttcagtttcctttcaccattgataaaaacgcctctagtgttgggatgagggcaatcttgtcacaatgcaaccaccccatcgccttctttagcaagcctttcagtccaaaattccaacgagcattagcgtatgttcatgaactatttgcgataacggcgacggtaaagaaatggcaccagtacttgcttggccatcgtttcactatcatcaccgatcaccgcagtctcaaggaactcttgactcaggtcatacagaagctggaacaacatatgtatcttgcgcggttgatgggttatgactaccaaatccaataccattttggcgtacacaaccaagcggcagatgctctctccagatgttttgatcatgactcgtccacactgatgagtctatccgttccttgcccattgttcttcgaggaactacgtcgccagctagatgatcattctgagggacgaatttggctaccgaaagggctatccttgattcccacattacttattgagtatcattcaacacctgccggcggtcacatgggaatcgcaaaaacaatagcccgtttgttggaaaactttgattggccaggactccgggaaaatgtcaccaattttgtctcgcaatgcattgactgtcagttccccatcggaatccaccttggcatgcttccaccaactcacacatctcatgcagtagtcttcttgttcatggaaattatgggaaagcttcacggtctccctcgtagcctggtcattcgcaagaagcttttgaaggtacaagaacgtatgaagaccattgcgaatgcgaaaccgagagaagtgacctaccaaccagatgactgggtcatgcttaaactacgtccgcaccggcaagcttcagctaagggaccacacgcattcatgggaaaattagttaagcgattctacgatccatttcaagtcctggaacgcatagggaccatagcatactgcctgaatttaccagaagggcccgtaattactcctctagccatattagattatcggcgaacatcggcacaaggaccttgggaagtgctcgtgcaatgggaagggttatccccagatgatacttcctgggaagactggactcaattatgtgaagactatcaccttgaggacaaggtgcggatagaaggaaaagctaagagggccatcacaaagccctcttatagtgataggaagaaggtattgcagaaggaagaaacaagtctgctaaggcctaaaaggaaaacagaatcgaggctaagctggaagtgggaccttgttgtgtag

SEQ ID NO: 17989 - DNA, 711 bp, Glycine max
  Peptide Sequence Number=SeqID_134767
atgccatctatcatggttaagttagagcacaagatcaaaacagaaccatcatcaaaggaaatgcggttatcttcactctcatcatcagcatcaacatcatcagattgcaagaagaagaagtacaagggagtgagaatgaggagctggggatcatgggtgtctgagattagagcaccaaaccagaaaacaagaatatggttaggctcttattcaaccccggaggctgcagctagagcctatgatgctgcacttctatgccttaaaggatcctcagcaaatctcaatttccctttaagctcttcacaacaatacattccaggagaggctgtcatgtcccccaaatcaatccaaagagttgctgcggccgctgcaaatagtttcattgacaatgccaacactcccccttccccacctcctgcttctaacccatcatcattggcctcatccccctcattggtctcttctccctcggatcaaatcgacgacaacgcatcgctgatatcgtctttcgaagcctacactagttgtgaccaagcaaatcaaccaatgactatgaatgtgatggaaccttggtacacctttgctgatggtcttcaatcccctaagtatgttgatcagatgctaagtggtgctttcttcgatttcgattcgtctcatctgtttgatgatctatacgaagaaagtgacattcgtttgtggagcttctgctga

SEQ ID NO: 17990 - DNA, 1002 bp, Glycine max
  Peptide Sequence Number=SeqID_134768
atgtcattgagtcctcccagagagagaaacaacaatgggaatgcccaagcgaggacgttccagctctactattgcttccagtgcaaccgcacggtccgcgccgcacccgataacaacaaccccacccaaatcacgtgcccgcgctgcttcggccaattcatctgcgaaatcaacatgccgcgtccaaggctcgtcgtggacttcaccacaccggacccctccccagaagcgcgtttgctcgaagcactttccctcatgatggacccacccatccgccgcttccccggtttaatccaaccccaacccgaagagctccccgtctaccaccgccaccgccgccctcgtcgccgccaccccgaacccgaacccgaaccccaacaccgcccccgcacctggatcgttttccagcccatggacccatccaaccccttcgagcccattaacatcccaaaccgacgcggcccaggcccaatccacggcccgggcccaatcccgcgcggactggacgcgcgagattatttcttcgggccagggcttaacgaactcatcgaacagataacagaaaacgaccggcagggtccggcgccggcgccggaacgggctatcgaggctattccgacggtgaaaatcgagagcgcgcatctgaaggagaattctcagtgtcctgtttgtcaggaggagttcgaagtgggtggagaagcgagggagcttcagtgcaagcacatatatcactccgattgcattgttccgtggctgaggctgcacaattcttgccccgtgtgccggcacgaggttccggtgccgtcgtcgtcgtcgtcgtcggagggtgatgaatgcgttggtgacggcggagaaggtaggttgcagaggtgcttgaggtggactcgtcgttttacttcgctttggccattcaatgcaaggtatcgtcgacgggttcaccctcaaggaaataatactactgttgctgcttcttcttcaaggggtgaatcatactttatttaa

SEQ ID NO: 17991 - DNA, 198 bp, Glycine max
  Peptide Sequence Number=SeqID_134769
atgtgggctgtcttaattcgcatttttgcttaccatgagaaggttgattggatgtactatgtggcctttggtgctgttgttgttggtctcattatctactctggtggtgacggagatgagaatcaagaccctcatcatgttgctgaagatgctagccaaagacaacatgatgaagaagctacttcagaaaatctataa

SEQ ID NO: 17992 - DNA, 1962 bp, Glycine max
  Peptide Sequence Number=SeqID_134770
atggtggccggcacagagaatagaacttcaaacagtgatgcttggtggtgcctggctcagacgttggaagaagagcagtggttagggatagggcattctggagttataaggttgacttggtggttgaaagaaggagggagggagagaggtagcagtgctaaagccgaagaccattcactggaaggaaggttagagcggaaactttctgagcaaaatgtggatgctcctcccagttatgaagaagctgtttctcaaagccctttacactatgaaagggatggggaaatttcagctgcatctgccccaaaaggctcttctcctaaaagtgacaacccacaccaaaaaacctctgctcctacaggatcttctcttgtaagcgataatccaatagaagcaactgctgctgccagtactggtacatctgaaaaccgtgaagttgaggcttttgatgaatttgatcctcgtggtcatcttgtatcagctgccccagctcctgctaataatgttgaaatggacttgttgggctccctatcttattcattctcttcaaatgcattggctcttgtgccttctgcatcagaaaccacaacctctcaaggaaatgcaaaccttgagtcaacagcgtcatttgcactgccgccatctgcatccaataacttcaatccggtgtttgaagacccatttggtgattcaccatttaaggccggtccttccactgaaactgctccatctcatccccagactcatcagggtcttgcgccatccctgtcaagtggtcctaatacagaatcggtctccaactttaggtttggagtctcattttcagttcccagtgccaatgagactaagcttttgtctatgtcgccgccatcacaggaaactgatattcttgcagacattcttccccctgcaccattacctgggacaacctcacagcagaacttttcagctcctcctgatgctcaattcttatcctccttttcagcttcatcagggcaaatggcaccacagtctttttttacacagtctggtcaacacgtgcagcaagatttctcagctgtaaccagtcaacctgcagcacaatccttttcagctcctggtggccaacctctacaacccccaccatcagttcccactagtcaacatgcacagcaaccctttccatctcacactgatcaatctgcacagtcagttagtcatatatatggtggatttccttccctggctgctggctctatgactcaagaagcttcttcagccatgttccctcaatctcaaggtggacatatgaaccagacctatgaacaaggatctatgccacttatccctttacacacggctccccaagcttcaacaggacagagtgcaaactatttgtcttctcaatcccccattgatcaagcatcacagtttaacagtgggaacttgtcgggacagtcatttaaccatcaaccacttggtcaaggagtacatgcttcacagaatgctgtttctcagccacccaaggacaagtttgagacaaaatcgacagtttgggcagacacacttagcagggggttggttaatttgaatatatctggacctaaaataaaccctttagcagatattggagttgactttgatgccattaataggagggaaaagaggatggagaagcccaccacgacaacggtaacgtcaactgtaacaatgggtaaagctatgggatctggttcaggtatgggccgggctggtgtgggtgctcttagacctccaccaaacccgatgatgggtcctggtgttggtatggcacatatgggtatgggaggctatggaggcatgaacgtgcctatgggtatggtgcagatgcagccaccaccttttggatttccgcctgggtccaacatgcctggaaattataactccatgatgagaagaggtggttatcctcaacatccgtacagtggtggtggctaccgatga

SEQ ID NO: 17993 - DNA, 726 bp, Glycine max
  Peptide Sequence Number=SeqID_134771
atggccgtggcgtgcacaaaaagatgctgccgtgactgccctgccctggcaacaggcgctggggcagccgatcttttctctgctgaacagcgacgaacagcaggcgctggtagcgctggcgcaacgcttcctgctgcagaaaaaaatcaccccgctgcaaggactggaactcagcgagctgcgcctgactcgcctgtcgttgctgttttgcctgccgtgctgatctacccggagccgttcagcgttgacgatcgctgggaggacgacagcggcctggtgcaccacgcgccggccgtacatgccggccagagctggacgcagggaccggtggtgctgaacgcgctggacatccaggactcatacgatctctctggttacaacctggtgatccacgaagtggcgcacaagctcgacgcgcgcggcagcggttacaccagcggcatcccggccatcgcgctgcgcgatgtggccagctgggaaaaagatttactgcaggcgatggccgagattgaagcggaagtagagctggtgggtgaacaggccgcgaccctcgatccctatgccgccagcgatccggcggaatgttttgccgtgctgtcggagtactttttcagcgctcccgacctgctcgccagccgttttccggccatgtatcgccacctgcagcagttttaccatcaggatccgctggcgcgtctggcgcagcaggcaccggaatctgcttaa

SEQ ID NO: 17994 - DNA, 237 bp, Glycine max
  Peptide Sequence Number=SeqID_134772
atggcggaaggcgtgcagaccgattcgcacttcctcaataatttcttcacgatgaacatgaattccgaatcgccgaaagaagcttaccgcaaggcgtggcagaagcagtacggcgccaccagctgggagcccttgccccctcgccggcgggacagcgcgccccctttcccacctcgccagtttgcaatccctgtcacagacaaatccgccgctaacaggttgaataagcggctttga

SEQ ID NO: 17995 - DNA, 501 bp, Glycine max
  Peptide Sequence Number=SeqID_134773
atgaagtacaggatcactcagtgctttgatcaagaatacaaaaggataccaaggaagggggcaaaagggtattttcttgttttttctggaccccaggtcgcccaggttctactcgcttgggcgagctgcaactacccccaaagtgaccctttgcctataaataggcgtcctaggggtgttttaaagggttctaagggtcagaagtggagacaattgagagaagagagaaagaagaagaaagaaagaagaggaaacgaagctgaggcactaccgaatcgcaactgtgatcattccccacgtcgttttcttgttctgtgttcttcgtgcgaccgtcggttagttttatttttagggattgaatgtgatctatgtacccttatgatgcaatcctaccccgcaagggcattggatagaagaccccaagtagaatgggccaaagatgcaagagaaggtcctagggttcttatgagccttagggtagatttcgggcccatgggctaa

SEQ ID NO: 17996 - DNA, 423 bp, Glycine max
  Peptide Sequence Number=SeqID_134774
atgctacaatgcgaggggtatttctcttatctcatacgtgatatcgaaattacaaacggtgagaatgctcggaaatgggttgtgaacctgttgtttaaatttcacgaagatccatcggtgaatgagttcgagatcgtcatttttctgagacagacttcaatgtcttcagtcatttacgctttcaaagactacattgtcttcatttacatttcaaagacttcaatgtcttcattcatttatgctttcaaagactacaatgtcttcatttacatttcaaagacttcaacgtcttcaatcatttacgctttcaaagactacaatgtcttcatgtcttcagtcatttacgctttcaaagactacaatgtcttcatttacatttacaagacttcaatgtcttctttcttttacatttacaagacttaa

SEQ ID NO: 17997 - DNA, 246 bp, Glycine max
  Peptide Sequence Number=SeqID_134775
atggagaattggagaacagcgctaggcaatcaattcgcggggctccagactcgttggtggagaatgcatgaatgctacaatcaattcatggggctccgaataaaaggctcaagactcgttggtggaggatgcatgaatgacaatcaattcatggggctccgaataaaagtggagaatggagaattggcgaacagcgctaggcaatcaattcgcgcagctccagactcgttggtggaggatgcatga

SEQ ID NO: 17998 - DNA, 264 bp, Glycine max
  Peptide Sequence Number=SeqID_134776
atggttaatctagctgtggggaaaaagctgtggaagcctattcagatctctagaggtgacctgaccttttcacaccttgccttcacatacaacctcattttgtttgcaaaggcatctgttgaccaggtggatgttataaactttgccataaggaacttttgtgagagttcaggagcaaaaattaaggagaagatttcagcagactttggctttcaatgcactgacaacttgggaaaataccttgatgtgcccatctttcactaa

SEQ ID NO: 17999 - DNA, 1524 bp, Glycine max
  Peptide Sequence Number=SeqID_134777
atgactgaactcgtaaagaacaccgaacagtttcaaaccatgggcgaggacgccaacttgaagagatggagggaaacaacgaaatcactgttagatgctgtagacaatttatactgtcaaccctacagcatttgcgtggttccggaggaactccggaaacagaacgagagtgcttacgagccaaaggtggtgtcaattggaccccggttcaagggcaaaagggagctacaacaaatggaagagatcaagtggcgttgcatgttgtgtctcctttcgcgaaccaaaggagacggaacgaaaatcctcgaaacctgcatgcgcgaaatgttggagctagacgcaacagttcgcgcatgctacggggaggaaatcaagctcaacaggtatgatctggccacaattatggtgtatgacggctgttttctcttagagctcgccatttcaaaagaaaaagactggagcgcggtgttcccgcaacagtctgtttctgtctcagtgagcgatctagggactaaagtcggggaaatggaagcagtattgactgacctcacgctgttagaaaatcaaataccctttttcattctggataagttgtttcaaattcttttccccggtagcaatctcagcagcagtatagaaattatggttttgctcctttggcaacaacaattgcccaagcgaatttaccctgctcatgttgttgaacttgttcattccacttttctatggatgcatgatattccaatccgagatgcttcttctgttgttgtagatgttgatgattatagtgttattatcaaacaagtaaaactgaatcgctgtgctgctaggctcatagctgctggtgttacgatcagacttcaccctggttctgacaattcaataatgtttagaattcatgattttagtgttcaattcagctacaacaacggggtgctgctaattccgcaccttcgtatcactcaaacaacggaaccaaagtggaggagtttcattgcgtgggagcatcatagaaacaagtccaaaaatgaagagtttggaaacagcactgaacaggatggtatagagtatgcaaacgtgttcacttttctggccttgctcttcaatgatttgatatgttgcgccagcgatgttcaaattcttaagaacaagggaatcatcaaagatgagttgggtatgagtaatcacgaggtggtggatttctttggttccgtcgctaatggaattgaccggggccacgttggttcgggttacagcaacatcattgatgccttgaacacattttcggcaacaaattttgtcacgaggtttcccataattgcgtgtcatgatttgagccgaataacagaatggatttacggccttcaaaagtttttgaggcgcggttacaacttcgctgcagcgttgataactcttctcactgttgttcagacttgttatgcagtcctcgcttatcattatccacacgaggatgacaacaaaaacctgtttaacaccacccagattcatgctaaaataaattga

SEQ ID NO: 18000 - DNA, 588 bp, Glycine max
  Peptide Sequence Number=SeqID_134778
atgaaaataatcaggatcctctattcaaggcaatttggtgacggaagggaccccaaagggttaggcttcacctgtggaaagttgctcggggtgctactcatgaacaacaatagacacggaagggttatatctaattctgctttatgtccgatgtgtaatgtggaatctgaatctatccttcattgcttgagggattgtgtgattgctaaggatgtttggagtaaaatatcagataattggttgaatgaggacttttttctgatgagcttaaaagaatggctattgttcaactttgccaaccagaaggagataaataatgcagcgtggagtacaatttttggagtgaatgggtgtccatgttcccataattgttactaccaactggtgaaagccattcatgatgtatcttccgaatgtgttatcttaggttgtaggcatatttatgggaaagccaatcaaatggccgatgtgctttcaaagcatggcttaacgctgatgggtagcagaattttcgagtgggttcctgactttctatctgtttgtgttttagctaatgtaatatcgacaagcttccctagtggattctaa

SEQ ID NO: 18001 - DNA, 369 bp, Glycine max
  Peptide Sequence Number=SeqID_134779
atgggcctgggcctgggcctgggattgggcttgggcctgaacgtggggtttcttgggcttcttattcttgtcatcgtggtcgtcaacatcgaggaggagttgttgttcgtgttcgtgttcgtgttcgtgctgggtgatgatggaagagaggctgtgaacggaggaacggagaagggaggagtgggttctgagagtgaatcagatcaagtattccggtcagcgccggcgacatctacgggaaccattcaactgtcaccacattgcacgaaatgggaagaacttagattcatcattcgccgttggatgctgcgattctggccgttggatcccggtcttgacgggtatatatggtcgtcagatcgggattga

SEQ ID NO: 18002 - DNA, 370 bp, Glycine max
  Peptide Sequence Number=SeqID_134780
atggccactttcgagcaattttggagcagaaaaacgttactaggtcttgctttgggacagtttctttctctcctcatcacttccactggtttcacctcttctctattggctaaaaaaggaattaatgcaccaacttctcagtcgtttctaaactatgtgttcttggcaattgtctatgggattattgttctatacagaagggaagcactcaagattagacgacaggaagctattggtggtggtatgtttataattatcaatcctttcattttaaatgataaacatctggtgaaacaaggtttgatattggtggcaaaatggtattattacatacttcttggattggttgatgttgaagcaaattttcttg

SEQ ID NO: 18003 - DNA, 168 bp, Glycine max
  Peptide Sequence Number=SeqID_134781
atgacaatcaacaagaatcaaacagtgaacaacccagtgccaggatccggaaagtgtgatgatctgaaaagggagaagaggttgaacctgcaaaggttgctgcgttttgtggatgacggtgtcgttctgagtggaaaaagtggacatggtagcggaaatggaagatga

SEQ ID NO: 18004 - DNA, 297 bp, Glycine max
  Peptide Sequence Number=SeqID_134782
atgacaaaaaaagttattgaaattgatgaggtagctatccaggatgttgtttctctgttcgaaggggatgtcgatgatgatgacgtggatgcgattttttatcagtggtttgagaaggtggtggcgattttgaaaggtctagaaagctatgatgatgatggtgctgagaaatgtggcgtcgtttcgaattccgaagatgagtttagctggactgaaatccttgacattgggccaaggtcccttgataaccctattctgtattcatcctatactatttgcctcggtcaatgttcttaa

SEQ ID NO: 18005 - DNA, 105 bp, Glycine max
  Peptide Sequence Number=SeqID_134783
atgtcggctgaaaatatcagtcgaggaaatgttcgatcggcgtcatccgatgatgcttccgttttaaacctcgatcgcttaactttcctggccgacgtcggctag

SEQ ID NO: 18006 - DNA, 906 bp, Glycine max
  Peptide Sequence Number=SeqID_134784
atggctgacgccagtcctagaactgatatttctacagatgttgacacggatgataagaatccacggtttgatagaagtcagtcccttgttgctgtggcttctgactccagtgacagatcaaaggataaatcagatcagaagagtctccggaggcttgctcagaatcgcgaggctgcaagaaaaagtcggttgagaaagaaagcttatgttcaacagctcgaaagtagtcgcttaaagttgacccaactggagcaagagcttcagagagctaggcagcagggaatctttatatcaaactcaggtgatcaagcacattcaatgagtggaaatggtgatacagaacttcgcatgattatcgatggtataatggcacattatgatgagatatttaggctgaaggccaatgcagctaaggctgatgtcttccatttgctgtctggaatgtggaagacaccagcagagaggtgttttctatggcttggtggttttcggtcatctgaactcctcaagctcctggtaaatcagttggaacctctgacggagcaacagttagtgggtatcaccaacttgcagcaatcttcccaacaagcagaagatgctttgtctcagggcatggaagcattgcaacagtccctttctgagacattatccactggatcacttggctcctctggttcatcaggcaatgtggcaaattacatgggtcaaatggctatggccatgggtaaactagggacacttgagggattcattaagcaggctgacaacttgcgccagcagacgttgcatcaaattcaccgcatattgacaactcggcagtcggctcgtgcactacttgcaatacatgactacttttctaggttgcgtgcccttagctctctttggcttgcccgcccaagagactga

SEQ ID NO: 18007 - DNA, 1524 bp, Glycine max
  Peptide Sequence Number=SeqID_134785
atggaatacgaggttgtgagtttgttggcattaaccattttgattttggtctggagaatgttaatggaccgtcggaggcagcatggtaagcttccaccaggaccaagatgttggccagtggtgggcaacattttccaactagcagggtggttgccacacgagtccttggcaaaactggctcataaacatggtccaatcatgaccctttggcttggctctatgtgcacggtggttatctcatccagccaagtggctcgtcacatgttcaaaaaccatgacgtgattcttgctggaaggaagatttacgaggccatgagaggagaccatggcagtgagggctccctgataacatctcaatacaactcacactggcgcatgctcaagcgcttgtgcaccactgagttgtttgttaccactcgcttagacgccatgcagggtgtgcgtgcaaaatgcatacaccgcatgctgcacttgatacaacaagctggtcaatctggcacttgtgctgttgatgttggcaggttctttttcttgatggattttaaccttattgggaacctcatattctcaaaggacttgttggactctgaaatggagagaggggattgtttttattaccatgcactcaaggttatggagtatgctgggaagccaaatgtggcagatttcttgccaattctaaaggggcttgaccctcagggtataaggaggaacacacaattccatgttaaccaagcctttgaaatagccgggttgttcatcaaagaaaggatggaaaatggctgcagtgaaactggatcaaaggaaaccaaagactacttggatgtcctcttgaactttcgtggggatggtgtcaccgagccctatactttttcttcaagaactataaacgtcattgtctttggcattgggacagacacgacaacaagcacaattgaatgggcaatggcagaacttctgcacaacccaaaagcactaaagaaagtgcagatggaattaaggagtaaaataggaccagataggaatatggaagaaaaggacatagagaatcttccctacctccaagcagtcatcaaggagacactgagacttcacccacctcttccttttttggttcctcatatggccatggactcttgcaacatgcttgggtacaatattccccaagggtcgcaaattttagtgaatgtttgggcaattgggagggaccccaaagtgtgggatgctcccttattgttttggcctgaaaggtttttgaagccaaacacaatggattacaaaggacaccattttgagttcattccctttggttcaggtcgaagaatgtgcccagcgatgccacttgcctctcgtgtgcttcccctggcaataggctcgctcttgcactcctttgattgggtcttgccagatggcctcaaaccagaggaaatggacatgacagagggaatgggaataacactaagaaaagctgttcctttgaaagtcataccagtgccttacaaagaaccggctgcaaatgaataa

SEQ ID NO: 18008 - DNA, 411 bp, Glycine max
  Peptide Sequence Number=SeqID_134786
atgatgatcttcctccttcccatcaatgtcgaaatagatttcaacgacaagaacatgctgctggaactggaaatggagtggagaaaaggaaatgggctccaacctggaacagtaagtactgcccaaaaagttcatgatcgcaataccagccctaccgtttcagcatctcataagaaacaaaagacatcaaaatctgtggcttcattatccttgggtgcactatctcctgccgttgatccatctatgcaaccatcatcattcgcattgaagcatggacctccatcaggaactaagaccaaaaagcaaaaatcacaaaaggacctgctgaagcagcttcttatgatccctgaattggaagcaaagtttggacaaggtggcctgaagacaaccacttctatgaagctgttataa

SEQ ID NO: 18009 - DNA, 168 bp, Glycine max
  Peptide Sequence Number=SeqID_134787
atggatcatgtaggtgttgatacagagggttttctagacagaccccaagatgcatcagtgttgacgtcatatgctgattatatgttaaagttggcctctcgtgggaggaaggtggagaaatttggaagacctgcacatgagattgaaggcataatgactgctacatga

SEQ ID NO: 18010 - DNA, 1788 bp, Glycine max
  Peptide Sequence Number=SeqID_134788
atggccacttcattttctgccaactctcccaatattgcagcaaacaagttaatagaaggagatagcagcaacagagaagaatcagtaatcatgaagagaagtagcagagcgggtgaaaagaaaacaggaggagccaaagttgcaagactcttgctagtgaatcaagcactagctactctagccttctttggagttggagtgaacttggtcctgttcctaaccagagttcttggtcaagacaatgtgaatgccgctaataatgtgagcaagtggataggaactgtttatatgttttcattgatcggagcatttctgagtgattcatactggggtcgatacttaacctgcacggtctttcaacttgttttcgttctgggcttagcactgtcctcattgtcatcttggcgtttcttgatcaacccagttggttgtggtgatggccatactctttgtaaaccctcatcaattggagacgagatattttacttgtccatatatctagtggcttttggttatgggggccaccaacccaccttagcaacatttggtgcggaccaatatgatgagaaaaatccaaaagagaagagttcaaaagtggctttcttctgttacttttactttgcgctcaatgtcggttctttgttctccaacactgtactagtctactatgaggatacagggatgtggacaatgggtttcttggtatcattggtctctgctgtcatagccttcttggctttcttattgggaactccaagatataggtatgtcaagccatgtggaaacccagttgtgagggttgcacaggtattcactgctgtttttagaaaatggaaggtgtctccagcaaaggcagaagaactctatgaggtcgatggtccacaatctgcaataaaaggcagtagaaagattcgccacaccgatgattttgaattcatggacaaggcagcaacaatcaaagagactgaggagcatagtccaaagaatccatggcggctttgcactgtgactcaagtggaggaagccaaatgtgtgttaagaatgttaccagtttggctatgcaccattatatactcagttgtgtttacacaaatggcttctctttttgttgagcaaggggatgtcatgaactcctacataggaagttttcatttgccagcagccagcatgtccgcgtttgacatcttcagtgtccttgtctgcactggaatttatcgccaaatcctcgttccattagctggaagattgagtggtaatccaaagggactaagtgagcttcaaagaatgggaattggcctaattattggtatgctggcaatggttgcatctggtgccacagagattgcaaggctgagacgtattagtcatggccagaagactagttccttgagcatattttggcaaatcccacagtatgttctggttggtgcttcagaagttttcatgtatgttggtcaattggagttctttaatgggcaagccccagatggaataaaaagctttgggagctcactttgcatggcttcaatttctcttggtaactatgtaagcagcatgcttgtgaacatggttatgataatcacagcaagagggcagaataaaggttggattccagagaacttgaacacagggcacatggataggtttttctttctccttgcagggctagctgcctttgactttgtgctgtacttgttctgtgccaagtggtacaagaacatcaatattgaagatagtgacatgggagaccaagaggaggagctggaggatgtaaatagcaaggtttga

SEQ ID NO: 18011 - DNA, 1116 bp, Glycine max
  Peptide Sequence Number=SeqID_134789
atgactggttcgcgcagaggcaatggcgatggcggggaaaatgtgaggaaagcggcgagcgagcagaacccggccactcgcagggtcatacgctcccagttcctccaactcaagaatctcatcaatgagaaaagagacgatttgatgaacacggagtctgacaagttcgacaccatcttggatgagttcgacaagttacacctccacacgacatcgacatggacatttgcagttgagaagccgagggagcaagttgcagatgcagaggcactgctggatctcacacgcactctagtgggatctgttaagtcgttggcgaacgagggtgtgaccccttctcaatttgtttcatctttgctcatacgctacgcccatacccaacactctattgattggcacaaacttggccttgccgcctccccaatcttcctctccgttcatggctcttctaccatgcttggtcccatggacaaccagtttaagcaacgcaaaatgggagttcgcaggaaccgtgatcctcgtcaaattgcaactactagacctcaacagcttgatgaggctgttacagaggaaaaaactgataccgacaaaaacatggccactatgtttcacatcttaaggaggacaaagcgtgtcccacttgaaaatttaattttgaacagggagtcttttgctcagagtgtggaaaacttgtttgccctatcattcctagtgaaagatggccgtgctgagatcagccttgatgaaaatcgcttgcactatgtttcacctaaaaatgctccagctgccaacttagtatcatcaaaagaagtttcttatactcattttgtattcagatatgattaccaagattggaagttaatgaaagatgtggtgcctgatggaaaagaattaatgccacaacggactcaaatttgcactgtagttgcatctcaagaaggaatgggtggtgatgattcccaacctgctttggctgtaacacccatcaggaagctatcacggaaccgaggtcgggttgtgcaggaggaaggtgttgtagaagaatctcctgaatgtgatgaggaaaatgcttccagagaaggggcaattcgtaggtgtaagcgtaggcttcgttaa

SEQ ID NO: 18012 - DNA, 234 bp, Glycine max
  Peptide Sequence Number=SeqID_134790
atggagcaaccaattgatcagcaaaacaaagagatacatgtagaggaccagaccaacttgtctttgatcgtgcggagaatacaaactcaagtctcaaaaatgcaaatggatcacactgaagaagtcatttccctttggcgcaaaaatgcgcatctacgagaatgtcacaggtcatggcaacctgaggctaatctgcctgaagaaggagaagctgagttaaccaccgtcaactaa

SEQ ID NO: 18013 - DNA, 483 bp, Glycine max
  Peptide Sequence Number=SeqID_134791
atggactatccagacccaagttttcatgatgccaaagtagaatcaaacaaggttggttcaacaaacatccaaaggttaagcattgcttcaagattaatacaaggttgtttcaacaaacattcaaagaatacttgtttactccctcttccaaattggtattacttgtttctatatgggagtggtcttaccggcaagcgcaccaggtcaccaagaagctccttttacactgaagaagaggaatcaagagaaattgcttgcttacaaaggagtgggatgtctcctccacctctaggaatctcgcagtcactcaaaaactcactaatctccctaaaagatgaaaacttggccccttgctctgctctacgctctttaaaattcacactcttcaggcctctgagtagtgaacagttctctttccactccccttgctctgtgcaaatcaggcttaaaaagtattggaacaagtggtcttggaataattaa

SEQ ID NO: 18014 - DNA, 117 bp, Glycine max
  Peptide Sequence Number=SeqID_134792
atggcttttgttcattccaggtcaaaggaatcctttataaatatggcagctggagcaaatgaggaggccactcatcgagttggacatgatgagagacagccacttcttccctcctag

SEQ ID NO: 18015 - DNA, 1020 bp, Glycine max
  Peptide Sequence Number=SeqID_134793
atgggttgctatgggattcaaatagtggagtgtttttcaatagcagcctttgtggctgcaattggggcttttcacctaccgttctgccatggaaatcaaaaaggctcaaaggtgtcagctcctgtcaagcctgaaacacaaaaggcacctccacctattgaagctccagccttatctttagatgagctgaaggagaagacagacaactttggttcaaaggcattaataggtgaaggatcgtatggaagggtttccatggtctcaagattgaagaatggcaattttgttgagttgcatggttactgtgttgaaggaaatcttcgtgtacttgcatatgagtttgctactatgggctctcttcatgacatattgcacggtagaaagggagttcaaggtgctcaaccaggaccaactcttgattggatacagcgagttagaattgcagttgatgctgctcggggattggaatatttacatgagaaagttcaaccaccgattatacacagggatatcagatcaagtaatgtgctaatctttgaagattacaaggccaagatagccgactttaacctttctaatcaggcccctgacatggctgcacgccttcattcaactcgtgtattgggaacttttgggtatcatgctccagacttcttctgtgttgccaaactttacagatatgcaatgactgggcagttgactcaaaaaagtgatgtctatagttttggtgtggttcttcttgagcttcttactggcagaaaacctgttgaccataccatgcctagaggacagcagagtcttgtcacatgggctactccaagattaagtgaagataaagtgaaacagtgcgttgacccaaaactgaagggagaatacccccctaaaggggttgctaagcttgcagctgttgcggcgctgtgcgtgcagtatgaagctgagtttaggccaaatatgagcattgttgttaaagcactccaaccacttctgaagtctcccgctcctgctgctccagaaagttga

SEQ ID NO: 18016 - DNA, 1680 bp, Glycine max
  Peptide Sequence Number=SeqID_134794
atggctgatgtttcagattcacgagaacaccccgttcttggttcagcgcaactgttggtggagctggaatctgcgctgggcggtgagaaaacggtgacggcgcaggcttcttcttcttccttaggcttggggattgaggttatcgacgaaacggcgttgctagactccgttgcgaagaagaacggaggaaccaagaacaatcaccagaagtctcagccctcaaataagattgggaacagaaagtactcgcgtaaggagttggagggtctgagattcctgaacatggcccgacagcgcaagttctggaaagcaattcacgctgcctttcaaagcaccgtggccatcgaggatagtgaaaaagggactcctgttgacccttcttgtagtcataatcttgtgagtgaggatgggtgctcagttgcaaaagagtgcagtgaagaatatgatggtagtgacgatgattatgctagcatccagaggcctgcctttatggttgatggagaacctaattttgattctggtccaccagaagatggatgggaatatcttaggcgtgtcaggtgggaggcacatcaaattccgaaagtgaaggtagcaaaacttgatagaggtaaacttaacaaggaacaaagtgcatacatgccccagattcctgatattgccaattgtccagagtatctgctgccattgaaagagtgggaggatgtgtttcttgctgagttttctgcactgagaaggaatttctcatgccttgatggttcaagtgccatacattctgaaaatcttcatgttcattcctcacaactagttgggaacaattgtggagaattttctagtgctatgagcagagatgtgttacttaataatcatttgagaattgggaagacaaatgatcaaccatctaactcgactgctgaaaataacgatagaacattgtctccagagaatcctgaagcaaaaagttcagccgatcaaacttgcagcagcagctcccccactctgccattgctttctgtaatcttagcaatggactctgtagcccgggtatcaagtttgttgaaacgaattaggttgctagaggctgcaggcactatgacaaggaatgattgcatgtggctttttgctctctgtgcaacagttgatgctccactagatgctgacacttgtgcttctctcaggagtctgctaaggaagtgtgccagcatacgtgccggaaaggctggattggatgaggaggttgtaatgttgaatatattggctacaatttcggggagccgaagatgcgataacaaactctccctccccacctccacctcctcctcattcgaaccgaagctggaagccgttatagacctgactctcctaaccgctttccaatctaaacttgggcggttcctatcttccggcagagacgcttaccacaaacgcaggctcgtcgtttcgtgccgcccttccaccttgcatttcctcggaacttcagcggctttgaccttcctagccgtttctgttttcacggttttggctcaattgatttctaggttttcgtcttggcgtcgcaacgcttctagctatatgcctgttttggtgcggagggaccgaagcctcggtggaaaagaggtggttgttgcgtggggtcagagaagcgacaccaatccattatctccgccaagaataaggtga

SEQ ID NO: 18017 - DNA, 429 bp, Glycine max
  Peptide Sequence Number=SeqID_134795
atggtaggtcagggaggcaaagtgttgggaagggagacacataaagtaccctaccacactgtagccaacttcgagcctcacctcgaatatgccattgagtggcagacatttggtggcatacccctgctaaacactctggggggccttcagtatcgcccacaaccacaacccttgcattttgcggtgggaaaactgcctcctgccatggtggaaagggaggaatttgatcatatagaggaaaggttgagggctattgaaggaggtagagattatgcctttgctggcatggcaaaactgtgcctagtgttcgacgtcgttatccctccaaagttcaaggtgccggattttgataagtacaaggagactacttgccccaagaatcacttgaagatgtacagaaggaaaatgggggcatactcgaaaaattaa

SEQ ID NO: 18018 - DNA, 918 bp, Glycine max
  Peptide Sequence Number=SeqID_134796
atgaagaacctctccgccaacgtgtccgtgccgtcgattccagaatccattcgctacttagatgaagatttgcagagagcgagatgcatcatcgttgacggtgacgcctcttcgctcctccctggccatgcacaaggtagctttttgaggatgtttcttggtcctatcaatgttcgtgcctccaggaaggatgttcaactcaaggtcaaagaggaatacaacagttacagggatagaactgccctgctattcctgctttttccagcaactctgcttattctaagatcgtggatttggtcaggatgcttgccaacttttcctgttcagatgtaccaggcgtggctgctattcctttacaccggtttggcattgcgagagaacatattgagagtcaatggaagtgatattcgtccctggtggatatatcatcactattgtgctatggtgatggccctcgtgagtctcacttgggagattaaaggacaaccagactgtgcaaaaaagcagagaggtgtacaactttttctacagtgggctatgatgcaaggagttgcaatgcttttgcaaaatagatatcaacgccaaagactttatactcgtattgcattgggaaaggctaagaggatggatgttgtgtggggggaaacagctggtgtggatggccaactgtggctgttgtgtcctatacttttcacattgcagggatttgaggcatatgttgggctgttgttgctcaggactgcagttgttggggttgtttctgagtggcagaagctcttcgggcaggtaatattttgcggtgttctgttggtcttaatggctgttgggaactttgcaaatacagtacagactctgatggcaaaatcaagatttaaggcaaagatgagaagaagcaagagcaagcaaaggctgaattag

SEQ ID NO: 18019 - DNA, 288 bp, Glycine max
  Peptide Sequence Number=SeqID_134797
atgttacggagatatgaggatactggtttcattaattgcaaaccagcaattctgccaatggatcctaatctcaagtgcatcatttactctcaaaggagaaccctgaccaaggtcagctattttcctcttcatccgctctggcatcttaaagcttatgcagatgctgataggagaaatcgtccagatacccacagattaactacagattcatgcattttttttttgggaattcactcattacctggaaatctaagaagcaacacagttactagatcctcagacaggtag

SEQ ID NO: 18020 - DNA, 240 bp, Glycine max
  Peptide Sequence Number=SeqID_134798
atggagagtgttattgaggagtcaatcctcaaagtaatgaatgattatcgagtgcctaccatacaccatggtgaaggtgtactcctaacaatcatccaagctaaaaagcctaagaccatagtgatttgggagttcaaatggcaatgggccaatcaaaagctcacccatacaatcaagatcttttcaggtcatcatggcacaaccaaggttgaggtgccacatcacaacgtggatgcttga

SEQ ID NO: 18021 - DNA, 235 bp, Glycine max
  Peptide Sequence Number=SeqID_134799
atggatgttgatgaagggatgagtagaaaaacaaatgaagtggaattcatgggtttaggtgttactgctgctatagacttagaagaaccaagctctaatacaaaagaaaaaagacaaggttcaacttcttttggcacacattctcacaagagaaagattggagaaaaagaaggaatagtagcttctttggataaaatgacgaactcttttgatcgaatggtagaaaaaatggatg

SEQ ID NO: 18022 - DNA, 1299 bp, Glycine max
  Peptide Sequence Number=SeqID_134800
atggccaccgtgatccgcaaccctatcctcttcccttccacctctcaccaccccaaccaaaaccacacattcctcactctccgcttctctcaaaccttacgctcttctctccgctccaaatcccgattcgccgtttcctgctcccaatcggaacctcctcctcctcatccttcttcttctcggcggcgtcctccgtacatccccaacctcattccggacccttcctatgtccgcattttcgacacgactctccgcgacggcgagcagtccccgggcgcctccatgacctcgaaggagaagctggacgtggcgcggcagctcgccaagctgggcgttgacatcatcgaggccggcttccccgccgcctccaaggacgactttgaggccgtgaaaatgatcgcccaagcggtcggcaacgccgtggaaaacgacggctacgtccccgtcatctgcggcctctcccgctgcaacgagaaggacattcgaaccgcctgggaggccgttaagtacgccaagaggcccaggattcataccttcatcgccaccagccccattcacatggagtacaagttgagaatgtccaaagacaaggtcgtcgacattgcccgcaatatggtcaagttcgctcgcagtttgggctgcgatgacgtcgagttcagtcctgaagatgctggaaggtcggatagggagtttctttatgaaattcttggagaagttattaaggtcggcgccaccacgctcaacatacctgacactgttggtataaccatgcccagtgaatttggaaagttgattgctgatattaaagctaatacccctggaattgaaaatgttattatttccacccactgccagaatgatcttggactttctactgcaaacactatagagggtgcgcgtgccggtgcaaggcaactggaagtgacgattaatgggattggtgaaagggctggaaatgcctccctagaagaggttgtgatggccttgagatgcggagcacatgtcaatggcaatctctacactggaattaatacaaagcacatctttctgacgagcaagatggtcgaagagtacactggtttgcagatacagccacacaaggctcttgtgggagctaatgccttcgcccatgaaagtggcatacatcagggtgaaactctgcggataatgatgattcttggcctgctttattttgatgctcagaagcatcctacttgttcatcttatctgttccatgcctggtggttgactatcaggaatgttttagttttgacacttgacagcagtgtggaggattga

SEQ ID NO: 18023 - DNA, 354 bp, Glycine max
  Peptide Sequence Number=SeqID_134801
atgtcgtcgtcgacgccggactcagacaaaacgacgacgtcgtcgaagaagagcgcgttcgacgcgttagcggcgtcgcggctcgtgacggagctcaggggaaacttcgcttcgggcaaaacgcgtagttatgagtggagattgttgcagctcaacgcgattgcgaaactcgtcgtcgatcacgagcaggagatcgtcgacgcgctccgaaacgacctcggcaagccgccactcgaaaccgtcgcatacgaggggaatttctgtttaattagattggttggtgatttgtctgcgtggattgcggttcgagtttctctttgcctacggtggaggacacgttgccgtttggtgtga

SEQ ID NO: 18024 - DNA, 237 bp, Glycine max
  Peptide Sequence Number=SeqID_134802
atggatggtaaaactgatcaagctgcacctcaacggattgaagcaaagagtcatgttcaaagtggaggttacgagtgtagctattatgtcatgcattggatgtggaacatagtaagtggaggtttgaagaatgattgggccatgtggtttagtgatggcacaccattagacaatgagaccataacaacaatttgcaacaaatggacaacttattttgtaaaagttaaagtcaactga

SEQ ID NO: 18025 - DNA, 1497 bp, Glycine max
  Peptide Sequence Number=SeqID_134803
attgctatgttgaaaaactcatgtagaatcgcactcaaggaattgaaacattggatgactcctgaaaaggtcaaaacttcaatcgcaacttttccttcttcagctgaaatagtatctgaaccactgggggttgtgttagtcatctctgcatggaactacccattcttgttgtcacttgatccagtcattggagctattgcagctggtaatgctgttgttttaaaaccatcagaaattgctcctgccacatcatcactgctggcaaaactgctcggagactacttggataactcatgtattaaagttgttgagggagcagttgatgaaacatctgcattactgcagcaaaagtgggacaaaattttctatacaggtaatggacgagtggcacgcattgtgatggctgctgcttcaaaacaccttacaccagttgtgctggagcttggaggaaaatctccagttgttgttgattcaaatatcaatttaaaggtagcaacaagacgaataattgcaggaaagtggggttctaataatggacaagcctgcatttctccagattatattataacaactaaagactatgctcccaagttggtggatgccctaaagactgaattggagaaattttatggaaagaacccattggaatcaaaagatttgtcccgtattgtgaactccaaccactttaatcgcttgacaaagctcttggacgatgataaggtttctggtaagattgtttatggaggcgaaaaggatgaaagcaaattgaagattagccccactgttctattggatgtcccacgggactctttgattatgaatgaggagatatttggtcctttacttcccatcctcacggttgataaaatagaagaaagctttgacgtaatcaattcaggatcaaagcctctcgctgcatatatatttacaaataccaagaagcttaaggagcaatttgttatgactatttcagctggcggtttggttgttaatgacactactttacatcttgcagttcatactttaccatttgggggagttggtgagagtggagtgggtgcataccatgggaaattcacatttgaagcttttagccacaaaaaagcagttctatatcgcagatttattggtgatgcaccagtaaggtacccaccatacacaaatacaaagatgagattgctgaaagctctcataggtggtggcatacttggtattattcgcgccctgaatcaaattgcaattgaagctgaaaggcgtccaccgatgttatcagtgtttgaacagcaaggtcgtccttctgggaaagagttaattcactggttaactgacgatgagaaagactcagtcataggtggtgttgaagaagtaaaccctgctaatttgttgacaaatgaagaagaatcaactaatttgaatggagaatcaaacaatattgaacaagacaatgaaggggaattagaagatgactttgaagtttacaattctgaagagaattag

SEQ ID NO: 18026 - DNA, 246 bp, Glycine max
  Peptide Sequence Number=SeqID_134804
atggtggaacaaagaagcagagaagcacaacgcgatgaggatgtgagggaggtgagggacgcgctgacatgtggagcgcgaacaaggaaaggttcaaagaagtatttacgaagtacaaagctaagacaagaaagaggacttcgagctattgggcaattcgaactggtgtatggacgagtcgaagtcgaggcagcaagagttctggacttagcgacacttggcattaggatagcgttcgaccgttag

SEQ ID NO: 18027 - DNA, 753 bp, Glycine max
  Peptide Sequence Number=SeqID_134805
atgtcatcaggtggcactgaccctcctcgacccccgtcgcatgactccagtgggaaagggacaactgcgaagaaaagacgatacatagttagactattaccatctcgagatagtctgacatcatttaccccatcctcgtcttctatgtctatcctagttaggcctcctgatgttgcacatacaccatctccacctccacctccgactgaagctaggccatcttcatctcatgttaatacacgtggaccatcttcggtatctgcatccacaccatctccatcctccattgatgcacgtggaccgtccccagtacctacatccacaacttccccatccccgcctacgggcaacatgcctacaaatgaagatgctacaaatttggcgatggaagacccccccttaatgatcgtcctatggtttcatccatctaaggtggtggcaaaggctgtcactttgtccattaggcaacaatttggtcagccttggcctacatggggaaaagaatttgaggctagactatctcaagctaggtctgatgttgcatcaagtgttggtgaatcccaactcactcccttagaccctattgaagaacaaaaacttaagattcgatgttgggttacaattgtaggaccaaagcgtaagggacgcctttatggtattggagaccttgctcatacttacaaatacagaacatgcagcatatgcaagaatcttccaatcgcgctgaagatgctgcagaggttaaccgcatga

SEQ ID NO: 18028 - DNA, 288 bp, Glycine max
  Peptide Sequence Number=SeqID_134806
atgggaaaattccttttaatagggaaagaaaggaaagcacagacaggtaaggaagaaagtgtgaaatggagagcacttacagaggagcatgcacgagacagctttgaaaaccttctatttagtgtttgtcgattccgggagcttactggcacctatccccaaaatataactgtatttcgtgatggaaaaccgagtgggagcgttggagaaattggccagcgatcaaggggagaaactgacagatgtgatgtgacattgcccacatcaaggacaatatgcgagagatga

SEQ ID NO: 18029 - DNA, 594 bp, Glycine max
  Peptide Sequence Number=SeqID_134807
atgggtgaagtagaggaggtgctagagcaaatgaaggccgacacggaggccttgaaagagcaaatggccacaatgatagaggccatgatgagcataaaggagataatggagcaccattgctggggtggacctgacccccccatatggcctcaaccaaataaatcatccaaccttagatatggtaggtctggaaggcaaagagtaggaaggtacgggcgaccctcatttagtgcaaaaaacaagcatgccttcccaccatatggcttgcctcccaactatacaccacccaatgtggcatacactcctagtgaggatgtcaataactccgctcccatactcattgaaagccaacaacctcaatctgatcatgcacatgtctctcaacccatgggggagacacatgaaacgccccaccacaatctagccgacttcgagccttgcctcggatttgccactgaagggcaagcaattggtgatatacccctgcaaaacactttggagagccctcggtatcacccacaaccacacctcttgcattccacaacaagtaaggggcttgaatctttcaaagaatatgtgcaaaaaggggcttga

SEQ ID NO: 18030 - DNA, 437 bp, Glycine max
  Peptide Sequence Number=SeqID_134808
gtgggcaactggggatggtggatttatttgtggatgtggagagtcgacttgcaccatcgcccgatcgccacctagtacaacatatgacggagtggtacctggagatatgtcacgggggtcaggagaccttggggacgtcaggcaagcacctggcagtcaaccgataaaagaacaaagaccacaaagcaaggaggcttgtgtggtggctggccagctatggatcttgagtgataattggaatatggcctctgtgcctagagagagtttgggagacccacaaaggcaatgcaaggtgccgattccggggcacgattcgattcacggctacttcattggtacatccagaggaaccagcacgcacgcttcagcgcactgtggagtggatattacctacaccaactccatatcgactagtggagctagtccaagtgatagag

SEQ ID NO: 18031 - DNA, 1029 bp, Glycine max
  Peptide Sequence Number=SeqID_134809
atgcaggttttacatgtctgttcagagcttttcccgctgctaaaaaccggcggactggctgatgtcgtcggcgcattgcctcaggcacaaattgccgaaggtatggacacgcgggtgctgattccggcgtttccggatctgcgtaaagggattcctgataccgaagtggtggcggagctgcaaacctttgccgggccggtccgcttgctgtttgggcccttcaacggcgtggggatatatttgattgatgcgccgggactgtacgatcgtcccggcagtccgtaccacgatacgtcgcagtttgcctatgtcgataactacctgcgctttgcgctgctcggctggatggcggccgagctggccagcgggctggatacttactggcagccggacattgtgcacgcgcacgactggcacgccggtctggcaccggcctatatcgccgcacgcggacgtccggcgaaaacggtgtttaccgtgcataacctggcgtatcaggggctgttttccgcgcggcatctggacgaaatccagatcccgcgcgcctattttgaaatgcacgggctggaattctacggccagatttcttacctaaaggccggcctgttttatgccgatcatataactgccgtcagcccgacctatgcgctggagatcacccggccggagttcggctacggcatggaagcgctgctggagcagcggctgcgcgaaggacggctgagcgggattctcaacggcgtcgatcccggcatctgggatccggcacacgacctgctgctgaccgcccgctacgaccgcgacacgctggagagcaaagcggagaataaacgtcagctgcagattgccatggggctgaaggtcgatgacaaagtaccggtgttctgcgttatcagccgtttaaccaaacagaaagggctggatctggtgctcgaagcactgccgggactgctggcgcaggcgggcaactggtgctgctgggccaggcgatgcggaactgcagcagggcttcctcgccgcagccgctga

SEQ ID NO: 18032 - DNA, 531 bp, Glycine max
  Peptide Sequence Number=SeqID_134810
atggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggatcataaaaaaatgggtccagacctcttgcgggaataa

SEQ ID NO: 18033 - DNA, 243 bp, Glycine max
  Peptide Sequence Number=SeqID_134811
atgacattctctactggttttgcatatttggagggagaatgtctaaataatgtggtctgggctctcgaacagtttcgaggtatttttttgagacatgatgccctccctgttgtcaccggcagagacctagcattgatgaatgccgtgaaaactgtattccctgagtgtaccaactttttgtgtaggtttcacatcgacaagaatgtcaaggcaaaatggttgaatctgctcattgagctttaa

SEQ ID NO: 18034 - DNA, 432 bp, Glycine max
  Peptide Sequence Number=SeqID_134812
atggatacctcagagccatacactggggcaatgaggggcatcatgcatgaacctcaagatggacccttgggtactagtaccctcacctttagaggactacacgtcctcgccttcagaggactacacgtcctcgccatcagaggactagacgtcctcgccttcagaggactacacatccttaccgttagaggactacacgtcctcacctttagagggctacgcgccctcaccttcagagggctacatgtccttgccatcaaaggattacacgtcctccacttcagaggactacacatcctccacttcagaggactacacatcctcaccttcagagggttgcacgcctttagaggactacacgtcctcgccgtcagaggattacaagtcctcaccatcagaggacttcacgtcctcatcttcagaggattacaa

SEQ ID NO: 18035 - DNA, 796 bp, Glycine max
  Peptide Sequence Number=SeqID_134813
aggctaccattaccttcacacactttgtgccacgggtattgtgattgggtcactaaagaagagggatgttgtgaaagaagaaaagtctaaaaagaagaggaagaggttagaatacagagctcctacatttttcactaacaagaagttgaaggagaagtttgatagaagatgggttgggaaagaagtgaatgaaccattctacctaaggtgggtgagagccttctttactactactaaagtggatagcagcaacttcacactaaaggctacattgaagggaattgagattttgatcttagaacaactcatagcatacctgttgggagttcttgttgatagctcaaggctctatgatgattggtttgaaatcatggggctaaaaatgaacgagattcggaagaaggctagtaccttccaagaggtaaatgaccatgatcttttgatcatttattatctttggaggaaaatccctctcagtctaccctatctaatcatcaaccatatgatcaaggtaagcaagcgtatcaagtccacttctagtgttccttatgggatgctgatgactatgattttcaaacactttggagtgtctttaaaggatgaaccaaggtataatgaggcatctaaaaaggaaaaagtgagttttaaggaggataactctaagaagaataggtcttctaaagactattatgaggttgttgaagctcataaccccaagggttctgcacctacacaggaagatctcaatgttgagattattgatgatgtgttggccaagctcaagacagatgattag

SEQ ID NO: 18036 - DNA, 423 bp, Glycine max
  Peptide Sequence Number=SeqID_134814
atgtggcggggaaatttacttttcttctctgtcccgctgtcgaagctgcaaccatacccgtcatcaccaccaccaccggcgtcgaataggtttttgattcagccaacatggacgcagaaaatgatacagagaggaatttggatggagagaacagtgttagacgaaggagcagcaaaaaaatccatgtctgggagtggagcacgagagcataaggaccaattacacaaacttcaggagaaggacccagaattttatgagttcttgaaagagcatgacaaggaattgcttcaattcagtgatgatgatatagattatgtaatgtcttccaatgccatatttgtcaaaggagtaagtaccaaacatcatcgagagttggattacttcaacccttacctataccaaatgccatttgggaatatataa

SEQ ID NO: 18037 - DNA, 573 bp, Glycine max
  Peptide Sequence Number=SeqID_134815
atgggccgtcactccagtaaccattctccctcctcacgccgccaccgcagtagtatctctccgccgccgcgagacaagcacgagtattccggccgcagtacagccaaaccggttcggcccggttcgccggattctcccccttgttcgcgctctccgtctccgcgaaccaagcggttgaagaaagctcaatccgaacgcgagcgtgagcctcgcgagagcgagaggaaccatggcggtagcagagggagaggttcggagaggggcgccggtgagcggagggagaagaagagaacggagaatgatgagggtaacggaaggagtaacaaatcggggaagagaatggagtacgaagacagtggcggaaggagtagcaaatcggagaagggaacagagaacgaagacggtggcggaaggagtaacaagtcgtcgcggtcgaggcaagagaggtcgccggagcgtgaccgcaatgggaggagccggcataggtcagagtctccgccacgtcaccacgcttccgccgcggatgcaaaacctcgtgatgaggtgtccggtgatatccaacctccattataa

SEQ ID NO: 18038 - DNA, 225 bp, Glycine max
  Peptide Sequence Number=SeqID_134816
atggctgaacaagctccaacaatttttatatctaaaggtgttgtgtttggcaccgattatagtgcaaggccaaagggtcacacagggttaacatctagcttgcttgggccaagaaaaagcttcaggcctaagaaagctactcacctaggcgagctaatgacttcaagcctaagcaagcagctcacctgggagagcttaccttgcaccaaatggctttttctataa

SEQ ID NO: 18039 - DNA, 303 bp, Glycine max
  Peptide Sequence Number=SeqID_134817
atgaaggctgctgaggaggctttggaagaaaaacagaagatgtttgtgaaagaaccacatctgaccaaggtgtcctttttctttatgggggctagagtgaggcatcctggtgagactttaccattcaaaaggaaaattgaaagacatcaaaaaccttcatttgagctatctggaaagcttgcatctgaaacaaatcgagttagaggtgttactttgttattcaatgaacccgcagaggctcgcaaaccagatattaaatggagactttatgttttcaaggctggtgaagtgctaaacggttag

SEQ ID NO: 18040 - DNA, 231 bp, Glycine max
  Peptide Sequence Number=SeqID_134818
atggatgtaatcttggcaaggtctggggcaaagctggaagctgacacaatgtgtctgaggggagtgaaacaagagacgaggttggtaatagaggaaggaagagggacatcgcctggaagggaaggggatgatgggatgtgggctgaagcaagcgctggcctaaaagggacatcagcgtgcaactggacgggaaggcccaattgggagaaagacataatgaaggaggcgtag

SEQ ID NO: 18041 - DNA, 897 bp, Glycine max
  Peptide Sequence Number=SeqID_134819
atggtgtccaaatttcacgacgatccaacggttgacgagtccgggatcgtagttttactaggacaggtgattgctaaattaacagatgaaaatgcaactcatattccttatcgagattcaaagctcactcggttgttacaatcatcccttagtggccatggacggatttttctcatatgcacagttactcctgcttctagcagtagtgaagagacacgcaacacattaaaatttgcacaccggagtaagcatgttgaaattaaagcttctcaaaataagattatggatgagaagtctctgatcaagaagtatcagaaggaaatttctgagttaaagcaagagctgcagcagttgaagcatggcatggttgagaatcccaatatggccacatcttcacaagaagatctggctaatttgaagcttcagcttgaagctggccaatccaaattgaagtcgagattgcaagaggaagaacaagctaaagcagcattgatgggaagaattcagcgactaaccaaattaatcttagtttctacaaagaatgtaatgtcatcaagcattcctgaaaggcccagccataggcgaaggcattcttttggtgaagatgagctagcatatttaccagatagaaaacgtgagacctggattaatgatgacgcagggagccacgcttcagttctttcaccggaagaaaaggatgacattaccaatttagatgaattggggaaggattatagaagaagcaaaaggcgtggaatgctcggttggttgaagctgagagaggacatgcataagttgaagggtgaaattagccaaaagaagaatcaaatccgtatcctagagcaacggatgattggatcaataggacctgcaccacgtaactgcgaaatgtctcag

SEQ ID NO: 18042 - DNA, 876 bp, Glycine max
  Peptide Sequence Number=SeqID_134820
atggcttccttacatcatggactgccatgttgcaggttctcgagtccatattcgcatcgttatactatgatgaccctcatggtgctcttttcaaagtgcaatagcgaggttcgctctatcgtgaggttcaagcccttcaacccctatcgcttccctaggtcgctgctttggccaagctttaggaagataagttgcacaatcaccatcatgttggtcgtggctcatattttcctccgcaacctactctatcttaaccaacccctcctccgtgaggttcaagccggcagagctcgtattgacctcgctctgccatttctgctaagttctttcatctctggcataactcccgagcttcgctgtgaggttcaagcccttcagcccttgtcgcttccccagttgcacgatcgtcgttgtgccggtcgtggctcgtattttcctccgcaacctacttcgtctcgaccaacccctcctcgttcacccagagtccccgtcaaatgcctttcatcggaggaaattgcggttcacagagacaagggtctctgttaccactgtgatgataagtggacgatgggtcaccattgcaagcctcacattcaactatttattgataatgatgacagtgacaatccttattcgtcacctaattctgaatcaccagatgtgttacctactccaacaccacttcccagagaccctcctcatttaagcctcaatgccttgttgggaatgttgacactcgagacagtttgcgtatacgggtatatcaaccaccaccgtgtcacgattttggttgacgatggtagtacccataatttcgtgcaaaccaggattgccaaattcctcgaacttgcttcctctccgataacccccttttag

SEQ ID NO: 18043 - DNA, 483 bp, Glycine max
  Peptide Sequence Number=SeqID_134821
atgggattgagggagactagtgataaagtcgagggaaaggtcctcccaaatcgtagagggaattggaagaggctgaaggagaccggccgattttttggtctcgtatttcttctgttgacagatgaggcattgggatacataacggtggacatcatccatcattccagtccagaagaaattttgttggagccgttgcagggtttttgcaattcccatgtggccgcccaaaggggtggaatggaattccccaaacaatatggaagtgaaggggctaacttggccggtattggatcgagtaatcatagcccaacaacttggataaataagtctattgctccggtagtgtctccacttgcgggtcgtggatgtgataacatgcaattcgcggacatatgtggaagcctgctgcagtcgaggacaaaagagtttgctatagaacacgatggggtgtcattgctggaggagaactgctcccatggatga

SEQ ID NO: 18044 - DNA, 336 bp, Glycine max
  Peptide Sequence Number=SeqID_134822
atggatcctaaccatcaaatcgtggaacatctagcttcatatgaggctggctgggtggaggtgaaggtagggacggtgacggaggggatttcggagcgggccgggacagagaagcgtggtacgggtgagggtgttttggccctgagtcaagcgtgccactgcttcttcaagatgatccatggtggtctagcgggtgttatgctagggcatgatggagaaggcagcagcaagatgagcacggtcactcaaaggccagctgcactagaagacaagcaccaggaatttagcaaaccagaactctgcaacaacataacagaattgggaaaatatcagtag

SEQ ID NO: 18045 - DNA, 244 bp, Glycine max
  Peptide Sequence Number=SeqID_134823
gttggaggttgcacttctgttgatagtatatcttgcttatggctctaatgaaggtggtgcactctcatatattcttttgagtataagcagttggtttatggctctatcctggttgtttgctccatatttattcaacccgtctggatttgagtggcaaaaagattggacaaattggctactctaccgaggtggaattggtgttaagggagaagaaagctgggaagcttggtgggaagaagaactg

SEQ ID NO: 18046 - DNA, 747 bp, Glycine max
  Peptide Sequence Number=SeqID_134824
atgaaacttcctttttaccctgaattggttgaagccttttattcgaacttggaaattcaagaagattccttgatttttgaagtttatgggattaagatggtcatagaccagtcccttttctttgaactcactcaattatccagtgacggtgtaccatttgagggtacacttgatgatgagtggaattttgatttttctgtttctgatgcccgccggatgctttgcaccaaccaaacggatatgaccggaaggcttcttgtcggttcattggcattcgaatgccgcatcatgcactacttaattatgcgcatcctactccctagatcttccaaccttgcacaggtttctgaggaagatttgataatcatgtgggttttcttaactggtcgtcaaatcaattgggcccatcttagatccttctctattggtgcgaatgtaatctcctctttcggataccgcaaagagagggatggctcttgggtgaagaaggatgctccagtacaggccgctgaagaccgctctccatcaccacattctcatagagatgactcttcatctcttatgcacaacattcttgacaggttggatggactccacaccttcgtcggtgaacgctttgactcattggatagtcgtattgatgccatggatgcacgatttgcaggaatggacacacgtatcaccaaacttgaggaggatgttagttatgttcgtcagtgctttgaccttccaccaccatcctcatag

SEQ ID NO: 18047 - DNA, 345 bp, Glycine max
  Peptide Sequence Number=SeqID_134825
atggtacaatgtactcatataagagtgcaaatacacacctcttcttcatgtgtgttggttgctaatgaggtggcggatgatgcaaaaagaaggaaaaagtgttgcctattatttaaagcggactttgaaatggcctacaattcgatctcatgggactttcttctatacatgctaaagaggttgagcttccatgacacatgggacttaattgatgctatcctcccaaggaggggacccatcactagagccatggctaggagactccaggaagactgggccagagatgcaagagaagacccttgggttctcatgagccttagggtagattttgggcccatgggctaa

SEQ ID NO: 18048 - DNA, 459 bp, Glycine max
  Peptide Sequence Number=SeqID_134826
atggcttcactcagatattggtatcccgatttgcaccttaatccagcctattggtggcctgccctttgcgtggcccgactttcaacaaaagcaccaattaaagataatgtagctaatcagcatgaacacatagttcacctgcttgcaaatgaacaatctcggcttagaattccagaggatgctgaacctgatcctttgttttatactattattgcattggaaaatgtgggctatgggctgaaattggatgaagctgccgtgcaggcaatattcctcaagtcccttcagaattacataaactggtgcgactatttaggcattcaacctgtttggagcagtttggaggctgtcagtaaagagaagaaattactatatgtttctttgtacttcctaatatggggtgaagcctcaaatatcaggtttctcccagaatgcttgtgctacatattccatcattaa

SEQ ID NO: 18049 - DNA, 855 bp, Glycine max
  Peptide Sequence Number=SeqID_134827
atgcaggtgcatgacccaaaggagataacgcgagcagtggagatagcttgtgcgattgagtgggttggaaaagagaggtggctggcaacaataatgcttcacaatcgaattcaagctccaagattgggagggagtacagagcctcattcagatcatagtaagggtgccaaacagttaccctacaaccagtacatgcacagaatggaagagggggaagatgaacaagaaggtgaaggaataaataatcacatagtggagattttgggttcagaggatattgttcaagatggagggattgaatccacacaaaagctgactaaaagagaagctggaaccatagatagaagtcaggacatagcacggttacaagagttctacaagagttacagggagaagcataatgtggataaattatgtgaggaagaaatgaagttaagggaatctggtgctttcagccgggatcttggcgagttggagcgcaagactctgaagagaaaaagggtttttgctaccttaaaggttttgggaacagtactagagcagctgtgtgaagaagaaattcctgatgagctgaagcggctcatggactcagattctgcattgacagaagatctgattgcgtacaacatcatccccttagatgcttcctcttcaacaaatgctattgtttatttccctgaggtgcaagcagcagtttcagctttgaagtatttcaatggcttgccggagttgcctaggggctatttcattcaacctacaaggaatgctaccatgtttgattttttgcagtgtacttttggatttcaggtctgtataccagggtttctgtgtgctgtcatgtcaagattggtgtga

SEQ ID NO: 18050 - DNA, 1155 bp, Glycine max
  Peptide Sequence Number=SeqID_134828
atgggaggggaaaggcgaatcaaaggaaacatattgctaaccaaagcaagtaggagggaggagcagacaagaatgacggaacaacagcaactccacaatcagagacacacactatggcacctcaaaggacatacgcgggtgttgttgctacacgcacaaacaaggtcggacaaagaaggaacaccatcaccccccaggttgaagaaacacgagcctttcgaaagagttgacgaagaaatcccatggatcttagggtcagatgagatacctaagtatttaggtgatgatatggtcctccttcttggcctcacaaacacaaaagccgaggagatgattacagaagaaattgagcatggtgcgtccctatttcacaccttagaaaaatggaatccagatatgaggcctggaaataggatggtacggatccaatgctgggggattccattactcgcttgggacatcgggaacataagtaaaattgttgcagcaatttgtgacttggtggacatcgatgacgatgtggaagaacggcggaggttggacagggcaaggatccttatcagaaccccttggcaaccattaatccaccattcagtagcagtcctcatcggtggcgaaacccacatagttcagttggtggaagaaactcacagcgcagaaggaaggcgaacccgacactggcggagcttctttgggtcatcggaagaaatcatatccgacggtagtgacttcgacacaccattgacggggtacagcagtccttcgccgaggtttctcgccgccgattccatggatggaagcaacatccgttgggtccagaaaatacccagcggtctcccagggaatgaatacccagcgggtattgaaggaagtagcaaggcacacggctctatacttgacatgcgcatgacagaatgtgataaggggacaaccaccgtgctcgaagctggcccaatgtcggaagaaattgccattagcggtgaaggtgcaggcgggaacgcgaaaagcactgccaacgtaggggaaaaaaaggaaagtgtgttatgtgagctggcggggtgcagggaaagcatttatgggaaagcagaacatgtcttggagactggtcaacaagaggttgagggtcaaaatctcaacgggtcacaaaaaacttaa

SEQ ID NO: 18051 - DNA, 171 bp, Glycine max
  Peptide Sequence Number=SeqID_134829
atgtcctcctttcgcgatttggagcagaaatgggcaccaaaggttgaagctttgtttggagcttcaatggagaatgagggagaaagaaaggcaacttcctcgcgtttctctgcgtccgtcggggccagttttcgaaagcaagcaatatatatatcaaaacgctcagaataa

SEQ ID NO: 18052 - DNA, 6759 bp, Glycine max
  Peptide Sequence Number=SeqID_134830
atgtggcatttcaaccaaggttttaagttctggtcgccgtctgtcgcgctttttgatattgtgggaactttcgaacaaatcagcgtatacggccacaattgtggtttcgctcaggtgtcctgcaaggaaggtaaactggcgaattggtgcaaatgtcaaagtctccctctcatgaacaacggcagtccaattattctgcctcccagattgggtcaggagtttaacgaggcaacaggaatggatgatccagaatctacaatggcaacggttgctaattttgtggagcaactgcatgccaacttgtcatcacctgttgagaaagaaattattacagcacacttgctaggtatggccaggagaagaaaggatgctagagcactcatcggttctcatgcccaagccatgccattgttcataagcattctcagaaatggaacccctcttgcaaaagttaacgttgcttccactctcagtgtcctgtgcaaagatgaagacctgaggttaaaagtacttcttggtggctgtatcccaccattattgtcacttttaaattatgaatccaccgatgccaggaaggcagcagctgaagcgatatatgaagtttcctcgggtggtctttctgatgatcatgttggtatgaaaatttttgttacagaaggtgtagttccaaccttatggaatcaactaaatccaaagaacaaggaagacaaaattgtggagggttttattactggagcattaagaaatctttgtggggacaaggacggctactggaaagctacattagaagctggaggcgtggatatcatagtagggctcttgtcttcagataatgctgtttctcagtcaaatgcagcttctctattggcacgtttaatgctggcattcagtgatagcatccccaaagtaatagactctggagcagtcaaagctttacttcagcttgttggtcaggaaaatgacatttctgtaagagctagtgctgctgatgccctagaggccctctcttcacagtctaccaaggctaaaaaggtcattgttaatgcagatggtattccaatccttattgcagctatagttgctccttctaatgagtgtatgcaaggtgatggcggccaggctctgcaggagcatgcaactcgagctttagccaatatctgtggtggcatgtctgctttaatactatatcttggagaactttcacgttctcctcgccctgattcaccagttggtgatataattggcgctcttgcttatacactcatggtctttgaggaaaaagttgatgttgatgagaaacattttggtgcaactcagatagaggatattctagtaactcttttaaagccttgggacaacaatttaattcaagagcgtgtcctcgaggctatggctagcctatatggaaatgtctgtctctcaaagtggctcattcaggcagattcaaagaaggttctgattggacttataaccatggctgccactgatgtgcaagagtatctgatactttcattgacaagcttgtgttgtgataagattggattatgggaggccattaaaaaaagggaaggcatccaattactaatatcattgcttggattatccagtgagcagcatcaagagtactcagttcagttgctagcaatcttaactgaccaggtcgatgacagcaagtgggcaatcactgctgctggagggattccaccattggtgcagttgttggagacaggatcacagaaagcaagagaggaagcagcaaatgttctgtggagtttgtgctgtcacagtgaagatattcgtgcttgtgttgaaagtgctggagccatcccagcatttttgtggcttcttaagagtggtggaccaagaggacaggaagcttctgcaatggcactcacaaagcttgtccgagtagctgattctgccacaattaatcagctattagcattgctcctagggcattctccaagctcaaaaacccacataatccgagttttaggtcatgttcttactatggcttcgcagaatgatctccttgaaaagggttctgcagctaataaaggcttgagatctctagttcaagtcctcaattcatcaaatgaggaaacccaagaatatgcagcttcagttctagctgatttatttattacaagacaagacatctgtgatagtcttgcaactgatgagattgtacttccttgcgtgaagcttttgactagcaaaactcaagttgttgccactcaatcagctcgagccttaagtgctctgtctcgtccaacaaagaacaaggctgctaataaaatgtcttatattgtagagggtgacgtcaagccactaatcaagttagctaaaacatcctctgttgatgcggctgaaactgctgttgctgcattggccaatcttctctttgatccttttattgctgctgaggctctagcagaagatgttgtttcagctttaacaagagttctggcagaagggaccttggaaggtaaacgaaatgcatctcgtgcacttcatcaattattgaagcattttccagtaggtgatgttctcaagggtaatgctcaatgctgtttcactgtgcttgcacttgttgattccttaagagctatggatatggacggaactgatgcagcagatgctttagaagtaattgcactgctagccagaactaaacagggtgtcaacttcacttaccctccatggtcagctctggctgaaataccatcaagcttagaacttcttgtctgcttcctggctgaggggcattcccttgtccaagacaaggcaattaaaattctatctagactttgtggggatcagccagttgttctcggtgaattgttatctgctagttccaaatccattggttcattggctaatagaataatgaactcctccagtctagaagtaaaaattggaggttcttccttattaatttgtgctgcaaaggagaagaaagagttttcaatggattcacttgatgcttctgggtatctaaaaccattaatatattctttagttgaaatgataaagcagaattgtagctattcttcattagaaattgaagttgtcacttctaaaggttttatggagagaaattcttttcaagaagttgatgaatttgatattcctgatccagccacttccttgggaagcactattgccatgtggttgctttcagttattgcttctttccatataaagagcaagctcacaattatggaagctggtggacttgaagctctctttgacaaacttgcaagacatacttcaaatccacaggtactcacatctatacctgcagaatacgaggatacagaaggaatatggatcaatgccttgctcttggccattttatttcaagatgaaaatgtcattctatctcctgtcacaatgcgcataataccttctatcactcttctgctaagatctgatgaagtaattgataaatattttgctgcccaaactatggctagtcttgtttgtaatggtaataagggaatagatcttgccattgcgaattctggtgctgttgctggattgataactattattgggcatgtagagtcagatatgcctaatctcatggctttatcagaagaattttctttggtacaaaaccctgatcaagttgttttggatcacctttttgaaattgaagatgtaaaagtggggtctaccgccaggaaatctatacccctcttagtggatctcctgagaccaataccagaaaggcctagtgctccaccagttgctgttagactcttgttatccattgcagatggaagtgatagcaataaattaatcctggctgaagctggagctctggaagctttgaacaaatacctgtccttgagtcctcaagactcaactgaggcagctatttctgagttattgagaatattattttgcaattctgaccttattaaacatgaagcatcaactaattcattgaaccaactcatagcagttttgcgtctcggatcaagaaatgctagatatagtgcagcaagagcacttcatgaactttttgatgctggcaacattagagactcagaattagctaaacaggccattcaaccattggttgacatgcttaacacaacatcaggtaatgagcaggaggctgctctcatggccttgatcaagttaacttcaggaaattcttcaaaagtatctcttcttactgatgtggaaggaaacccacttaaatgtttatacaaaatactgtcttctgcttcatccttggaactgaagagccatgctgcgcaactctgctttgctctttttggcaatagcaagatcagagcagatccagttgcctcagaatgcctagaaccctttatatcactgatgcaatctaattctgagactgcaatagtatctggggtttgtgcttttgagagattattggaagatgaacaacaagtagagcttgcagcagcctacaatgttgtggatctccttgtgagcttggtttctggtacaaactatcagcttatagaggccgccatatctactcttatcaaattgggcaaagacaggactccaattaaactagacatggtgaaagctggcattattaataattgtctcaatctactacaattagcacctagctctctatgctccacaatagctgagctgtttcgcattttaactaatagcagtgcaattgcgagaagttcagatgctgcagaaattgtagaaccacttttccatgttttgctccgccgagatttcaacttatggggacagcatagcgccttacaagcacttgtaaatatattggagaaaccgcaaagtcttgcaaccttgaagcttactccaagccaagttattgagcccttgatttcttttctggaatccccatcccaagctattcaacagcttggcacagaactgttatctcatcttcttgcacaggaacattttcagcaagatattacaacaaagaatgcagttgtgcccctcgtacagcttgcaggaattggaatattaaacttacagcaaacagcaataaaagcattggaaaaaatttccacaagttggccaaaggcagttgctgatgcgggaggtatttttgagcttgcaaaggttattattcaagatgagcctcagccaccacatgcgctctgggaatcagctgctttagttctctctaatgtattacattccaatgccgattactattttaaagttcctgtagtggttcttgtgaaacttttgcactcaacacttgagagtacaattagcatagcccttaatgctttaatagttcatgacagaagcgatgcttcaagtgctgagcagatgatggaagctggagttatagatgctctgttggaacttttaagatctcatcattgtgaagaagcatctggtagattactagaagctttatttaacaatgtgagagtacgagagatgaaggtgtctaagtatgctatagcacctttatcccagtatctattggatccgcaaaccagatcacagtctggcaagcttcttgctgctttagctttgggagatctttcccagcatgaaggacatgctagatctagcgcctctgtttccgcatgtcgtgcattgataagtttacttgaagatcagccaactgaagaaatgaaggtggtggctatatgtgcattgcaaaactttgtcatgaacagcaggaccaatagacgagctgttgcagaagctgggggcatattggtgattcaggaattgcttctgtctccaaacacagaagtttctgcacaagctgctttactgatcaaatttttgttttctacccatacactgcaagaatacgtgtcaaatgagttgatcaggtctttgacagctgcactggaaagagagttatggtcaactgccacaatcaatgaggaggttttgagaactctacatgtgatattcatgaacttccctaagctccacacatctgaagcagcaactctttgcattcctcatttggtaggggcacttaaatctggtggtgaagcggctcaggactctgtacttgacacgttttgcttgctaagacaatcttggtcaactatgcctatagatatagctaagtctcaagctatgattgctgcagaagccatccccatattgcaaatgctcatgaaaacctgcccgcctagtttccatgagagggcagatactcttctgcactgcttaccaggttgtttgactgtcaccattaagcgtggaaacaacctcaaacaaactatgggaagcacaaatgcgttctgccggttaacaataggcaatggtcctccaaaacaaaccaagaagcttcatgtttctactattcctagttttcatgtagtgaatcatagtacttctccagaatggaaagaaggattcacttgggcatttgatgtacctccgaagggccaaaagctacatatcatatgcaaaagcaagaatacttttggaaagacaacacttggaagagtcactatccaaattgataaagttgtatcagagggggtttatagtggattattcagtcttaatcatgatggatttccaatgatgacatttgaaaagtatagcaagctactttttgggtggaagcatagaaagaggcagcaagcgtttgaaaaggatgctcccacggtaaagtcaaaaaatgtttgcaattgtacaggtcagtccacagtctctgatgttgggatgtacactagcatctgctgtaaagtggctttgttttatgtttgtaagccacaagagatgataaactga

SEQ ID NO: 18053 - DNA, 279 bp, Glycine max
  Peptide Sequence Number=SeqID_134831
atgaagatgagggtgttgctggttcatcatggactagagcaggctcttaaaagagaaaaggggttgcctgcaacaatgtcagaaagggagaataaggaggttcttgacaaggctcatagtgctttgatcctgtctcttggagataaagtattgagggaagtttcaaaggagaaatcaactgttgtgatttggaacaagttggaaaacctgtacaagaccaaatcgttggccaacaagttatacaacaacaacaacaacaacaacgccttatcccactag

SEQ ID NO: 18054 - DNA, 234 bp, Glycine max
  Peptide Sequence Number=SeqID_134832
atgccgcagagctccttcctcctcgcactacctccaatgccgccgcatcctcaattcacttcgaatttcccgcgaaaccgatccgaccgagcgaaaaaccctgcgaaaccgacaccggatcaaacacgggaccgagttcagatcttcgcgaagaacaattggaaaaaatcagatccaacgagcagagatcggttgcagaagctagggcacagcgagagagagagagaggaataa

SEQ ID NO: 18055 - DNA, 2749 bp, Glycine max
  Peptide Sequence Number=SeqID_134833
ggatgcctatgggtttactgtgaggcctcagcacctgcaaagataccgtgaatatgctaacatttacaaggaggaagaggaggaaaggtcagataggtggaactcatttctcgatagacaggctgagtcttctgaattggtcacagacggattaattgtgggggaggggggtgagaaggttttaggtgatgaagctgctgagcaagaagctgatgctagctcggagaagggtgttgatggacatgaagcaagcaaccaggtgcctggtggttctgacagtgcagcggaacatggtagtcagaaggaggaggtactgctgtctgaggagacaaaagttcacagagtccagttatggacagagataagatcatctcttcaaactattgaggatatgatgagtgttcgtgtaaagaagaacaccggatcagtaaaagatgaaagagtcaagaaaggtttgttaaaagatgaacagattattgaaactgcaaaatcaccatcacattctgatgatgttaaatcaccaaaaggagcagcatgtgaggaagactctgaggaggagttctatgatgttgagaggttagatcctagtccggatatgcctgttgttgatggcacaaatgccttggcaaatggtattactgctgatgctgcacaaccagaggcttcatttccttggaaagaagagttggaagttctggttcgtggtggagtaccaatggcattgaggggagagctttggcaagcttttgttggtgtaaaagcaaggcgggtggagaagtattatcaggatctgctatcctcagaaagtgattctgaagttaaaactgatcagcaaagcatggagtcaactgacagtaatgggaaaacaggtgcagattttggacatatgccagaaaaatggaaaggagtcaaaggacagattgagaaggatctgcctcgaacatttcctggtcatcctgctttggacgaggatggtagaaatgctttgagacgattacttactgcatatgctcgacataacccctcagttggttactgccaggcaggagctgttttgaggttggatgcccgactgaaggtgcatagggcccttatgcctcgtgggcacctttcatatgccatgaatttttttgctggcttattgctacttttgatgcctgaagaaaatgccttttggaccttaatgggcattttagatgattattttgatggctattattcagaggaaatgatagaatctcaggtggatcaacttgtttttgaggagttggtgagggagagccaatcatctagattatctgggagtgcaggtggcatgggttactggaccatggttcctgtccatttttgtgaacatgcttccttgggaaagtggtcagttcttcgagtgtgggatgtgcttctttttgaaggaaaccgagtcatgctctttagaactgcagttgctttaatggagctatatggtcctgcgttggtaacaacaaaggatgctggagatgcagttactttacttcagtcgttggctggctccacatttgacagcagtcagctggtactgacagcttgcatgggttaccaaaatataaatgagactcgtttgcagcagctgaggaataaacatcggccagctgtaatagcttccgttgaagaaagatcaaaagggcttaaagcttggaaggattctcagggactagcatcaaagctagctgatatgcaagtgcttggcaatttatctcgtacagaatctggttccactaatgcagatgaaattctgattagtctgactggagagggtgagatagattccgttccagatcttcaagagcaggttgtctggttgaaggttgaactttgtagattactagaggagaaaagatcagccattcttagagcggaggagctggaaacagcattaatggaaatggtcaggcaagataataggcggcaactgagtgctaagcatatagagtgccatcatcatcatgtcttctctacaatcttccaaatggtagagcaactagatgaagaggttgctcagcttcaacaggcacttgctgataaacaagaacaagaaactgctatgcttcaggtcttgatgcgggtggagcaagagcaaaaggtgactgaggatgctcgtaggtttgctgagcaagatgcagccgcacaaagatatgctgcgcaagtccttcaggaaaagtatgaagaagcaactgctgcacttgctgaaatggagaagagagcagttatggcagaatctatgctggaggctacattgcagtaccaatgtggccaagttaaagttctacaatctccacgatcttcacagttagattctccagtatcgagaaacaatcaagagcctgatatccctgctaggaggataagtttgctttctcgtccatttggacttggatggcgtgatcgaaacaaggttagctttatcagccattccggaaggggaaacccactaatgaagagccagctgagggaaagcccagcgttgaggaacaaaatacgatcagtgaacaagacgtcaatggccttaaagtacaggaggagagtagaaaagaagtcagtgcctagattttctttatatgcttctcaagacaatttgacgaggaaaaagttggttccttcttccttgtctaataatagtaattggaaaaataaactttatgatggcgacggaaacattctaagtatgtttggatggagtaccaaaagaaaccggggtggtggaaaatactaa

SEQ ID NO: 18056 - DNA, 111 bp, Glycine max
  Peptide Sequence Number=SeqID_134834
atggcgacctcaatccctacattaaaagacttaccttactcagttgtggtgtatctacggaaatatattaggaaatttatcttggctagcagtttttcttttgatgattaa

SEQ ID NO: 18057 - DNA, 303 bp, Glycine max
  Peptide Sequence Number=SeqID_134835
atgtcagtcgatcatgtgcctggtaacatggcattttcaatgattttttttgtccaaaaatatcattcgtttcttcttcttcttggtattaatcacaagatcaggcgagtccgcggcggcacaaacagagaacagttgatgcctagaggttcttcctttgggggcagcgtaggccgtagatccgacaaagaacgacaacaagtgagcacaacagaggacaatttggtggcaaagaagatgagatctatatctgattcatggcgaaaggtgaaagtggaaaagacaaagagggatgaagattag

SEQ ID NO: 18058 - DNA, 210 bp, Glycine max
  Peptide Sequence Number=SeqID_134836
atgggttactttttgagagaaaaaaatgatattgatgaatgtaagacaaaaagtcatacgttcataactgagaatcattgtcgaaacaccgatggctcttatgaatgcttttgtcctcgtgggcaagttggagatggaaaattcaacaaaggatgcaggccaatccagcggaaaaatattctaaccaagtatgttattgataaggtctaa

SEQ ID NO: 18059 - DNA, 360 bp, Glycine max
  Peptide Sequence Number=SeqID_134837
atggaagatatagctccaaataagttgtggcttagtgtaagaatggaagaaggtcatttcttgatgctaggccacgatgcttatccttgtatgttgcacatgtggttcgtgcttgtaatgattctgaacttggtgtatgaggaagcaaatgatgttcagatatgtaacaaaggcgggttgttacatgttcttcaacccactaggttagagactaattctgcttgcgatgcgtggttgtcattggttcaagggaatttaacacacagcgggaatggaacacaagttttcctgctaaatagatcgttccctacatatgaacacaatgagatcttacgccactatgttgatcttatgggttaa

SEQ ID NO: 18060 - DNA, 525 bp, Glycine max
  Peptide Sequence Number=SeqID_134838
atggacaatagtattctgggtcttctcaaacttcgaattaaaagaggcactaatcttgcaatacgcgatgcaataaaaatgcatgccagcgacccttatgtcatcatcaacatgggtgaacagaagctaaagactggtgttgtaaaagacaactgcaatcctgagtggaatgaagaattcaccctttccataaaggacgtcaaaaccccaatacatctttcggtttatgacaaggacactttatctggagatgacaaaatgggtgaggcagatatagacttgaaaccgtatgttcagtgtgtacaaatggggttgaacgagcgcccagatgattcttcagtcaagaggattcaaccagatgacactaattgccttgctgaagagagcaactgcatttggcaaaatggaaatattatccaagaaatgattttgaaattgagaaatgtcgagagtggggaagtagttgttgaaattgagtgggttgatgttattggttgcaagggcttatcacaggtagaactttaa

SEQ ID NO: 18061 - DNA, 429 bp, Glycine max
  Peptide Sequence Number=SeqID_134839
atgaaggcccaagtggagaaagatgaaggcctagaggcagaggcactatcaagacaattaatgttgctgaaggccgaaactaatttgaagacccaatttctctctgggttccttgttgaaccaatatcagacttatcaagtggcgtctacccagacttatcttcctttaccggaagtggcgtctaccccgacttatcttccttcaccggaagtggcgtctaccctgacttatcttccttcaccggaagtggcgtcatccaaatcttcgtagcctgtatcaaacgatccgctcctactcagtgtaataagcaaaaagaaagcactgagtgcaaggactacataatgcattggatgtcaacgaaaatcttaggaagtttcaagaataattgtattttaatgatgcaagaccattggaaccagcgagaatga

SEQ ID NO: 18062 - DNA, 598 bp, Glycine max
  Peptide Sequence Number=SeqID_134840
cattgtgctgggttcgacgggatcattcgtgatcatgaaaggaagttttattgctggcttcaatggtagttgtggtgctacagatatcttgcatgctgaaatcctggctctttatcatgggattcacatttgtaattggaataatttagagataccagaggatcttttggctaagcttggtacttctactgaagctgagtttctaccctcctcctgtcctgacatagaatctctagtgcagctgaaggatgttctagggttctcgatcattcggattcagtctttgtttcttattatgcctaaggttgatgctcaagtgccagactggtgcaacaacatacgtggattcatgggattcaaattcccgtcacgctgtgggttatttggagggctaggaataaaattatttttgaggaggagatggggacaactactcagtgacatgcgcaaggcggtgacattgaaggtagatggtagcatgatgggtagccctcctaggacagggtttggaggactttgtagggttcaccatggaagctttcttgtgggcttatatggtcatgttggagggcaagagatcttatatgctgagatttaa

SEQ ID NO: 18063 - DNA, 135 bp, Glycine max
  Peptide Sequence Number=SeqID_134841
atggctaaggaaaggcaaggaggtcgccggaaaaggccatgttcgaatgaaccggtgtctcctgttatttttttggattcgttgacgtgcaaacatgagaccgaccacctttggagagtctcacggctttcctag

SEQ ID NO: 18064 - DNA, 777 bp, Glycine max
  Peptide Sequence Number=SeqID_134842
atggacgattacacgagggaaatgatggacctgaagacactggtcactcgcactctcgagaagaaaggcgtcctcgccaggatccgtgccgaactcagggcgagtgtgttcgaagccatcgaagaggaagatcgtgtgattgagaaggaacaaggtctacctcctgcattgctaggtagttgcaacgatcgagctaagcagcttcacgcttctcctccagggagacttcttacggcaatgatatgtgaataccttgactgggcgcagctcagtcatacgctaaaagtttatcttccggaatgtaatttggagaaagatttttggaagacagagcttaaggaatttagtaccaaaaatggatatgatctcaacagaaacagagatagtcctctgctcttggatgtgcttgaaggattcttgaagctcgagaatttatcccaagcaagagctagtggtaggagatttgccacctcagaaactgagcctttaccgaactcagaatcacagaatccccgaaggcattcttcctcatctgttgccggtggcttacctccactaggaagggctgttccttcatctcaggcatctggtgggtatttcctgaaggatgagtacaattggcgatatgacagtgatgaacttcctgaggacataattcaagcttcaagtgctttggaaaatcttcaattggacagaaaagctcggaatctaacatcttcttggcgacacgctggagatggtatcaatgaggatgatggcagggctgatcacgtgtag

SEQ ID NO: 18065 - DNA, 444 bp, Glycine max
  Peptide Sequence Number=SeqID_134843
atggcaaagatcaaaagcttcactacttatgcggagaggaggattgtggaggccgtacaaggagaacagagagccacgttgaatattggaattggttggaggggtttgaatgaggatgttgagaggttcaaggacaacttagagtttacaaagctaaaaaataatcaggaaggaattgaccctgataatgtctattctcaggttccctatgagaaagccaacatccgtggcatagagaaccagattgacctagtgctgtggacgaaaggtactggcattcctcctgatgcctatgaacctgaatccactgcttataaaacgattgtgtcgctggcaaatgagttcacaaatgggaggatgaagttgctggctgggagctctacttggacaacttaccaaaatccattgaagcttctcagtttaatactgttttctcaactataa

SEQ ID NO: 18066 - DNA, 285 bp, Glycine max
  Peptide Sequence Number=SeqID_134844
atgggcatcactgacttcataaatccaagggatgatgagaagccagtatatgagaggatcagggaaatgacttgtggaggtgtgcactatagttttgaatgtactggaaatttaaacgttctaagggatgccttcttgtcagctcatgagttaaaaatttctaaaaatcttgatgctgtggtcacaattatggttggagactactttttaaaatcttggtatatgttgcaatatttcttcacaaacattgcttctcttctcacccctaagtacaatgatgaataa

SEQ ID NO: 18067 - DNA, 354 bp, Glycine max
  Peptide Sequence Number=SeqID_134845
atggagtttctgaagtactccatcaccacctccttgtcacctccactccagggtgttacatgtcctccaacttccacttggtttgctcttaaatcacatcgtactagaggagaggtttgctctgataccatttgtagcgcccctaattgtcgacctctcagtgactctcacactacgacacttcacacggtgacactttactcaacgttgcgatctcggaaatggttacctccaaagggttttgaccggtggagggtgtcaaagtttagagttggtttgggtttcgatgaagaggacgttgttgtcgttgtagtggacaacgacgacttcatggaggcgttcaacaatttgtaa

SEQ ID NO: 18068 - DNA, 309 bp, Glycine max
  Peptide Sequence Number=SeqID_134846
atgacgagtggggatgtgcactatagttttgaatgtgctggaaatttaaacgttataagggatgccttcttgtcagctcatatggattggggattgactgtgatattagggattcatccatcaccaaaattgcttcccatccacccaatggagttgttccaaggtcgcagaatagtaggatcggtttttggaggcttcaaagggaagactcaattgccacgttttgccaaagaatgcatggatggagtatggactaccgttctttacatgtgttctttagggttcaattcactacttatttcaaaatag

SEQ ID NO: 18069 - DNA, 414 bp, Glycine max
  Peptide Sequence Number=SeqID_134847
atgtctactcgatcgcattttcgtctgatcatgttggagtgtctttcaagattgaagcttgcagcggtgcgttgctcatatgcgtattcgtctccacggatggagttcgtgacccgatataataacccaaaaatattgtggcctaaaaaagggatatgccagtggaaccttagggtagaagacgccggaaaaaatggcgacaacttggtgacggtggcgccttccggaagacccgttaggggttcttccggaacttccggaagaattcttccggaagatttccggaaaaagggttcttccggaagttgtgaaacgtcttccagaagtactggtctttcggaaagctcccagaacacctcttccggaaagttttcggaagaagtagttcttccggaaagtttccggaagaagtag

SEQ ID NO: 18070 - DNA, 222 bp, Glycine max
  Peptide Sequence Number=SeqID_134848
atggcacacaagtatgagataacagcagagcacaaggcctatctctttgtaatttgtgtttgtgcctacctttttaagagacctatctctgtcataacatctagtctcaacaacaacaacaacaacaatgaaagctggacaagatgcttgaagagaataggaggagagtggaagaatctcagagaagagaatataagctggacaattttgccaaagctttaa

SEQ ID NO: 18071 - DNA, 1311 bp, Glycine max
  Peptide Sequence Number=SeqID_134849
atggctagaacacgaggtttaggtcgtgccataggtagacttgtaggcagagatagacatgatgatcatgatgcagctgatgttcccgagaggagtaggcctactgccttagcccgtacgcaacgggttcaacatatgattgccgagggacgtgatatggctgaggacgttgctgacatgactgacgatgtccctgtgctggctgcggaggcacctgagatgcatgcggacatagagggtgctgatggtgctgaggggtcagatgctgatgatgctgctgagggattccctggtgggccacgtgactcatcagtgctgacatcatttgccgagcatgttgcacatgctgtttggagtgaacaggaacgtcctgatttgaagttaatgtcacatgggaggaaggtgacactgattgggaggctagtgcctgagattgaaggcctcgtggctgccacaggattaagtccactgatcgattgttcagttattactggcgatcctggactgatatccgcattcgtggagaggtggaacggtgagaccagcaccttccaccttccggtaggagatctgacgatcacattggatgatgtgtcgtcactccttcatttgcccatcactggcgccttgcacagtttccatgctttttctacggaggaggctagatttttgctgacagggttgctcgaggtgtctaccgaggaggctagagccgagacaacactgacacgtggggcatattgctggatctatgagcacttccctagtgtgcaccaatgcgtgacagatgatacataccaggagacgtccccacgtgcttctcggtggttgacgtcgaaggcacacatgaagagaatcacaggagcaccttacagggcacgttgtgatggtttgaccgtcacagatgtgtcctggttgctgtacacggaacatcggggggttagggcctttcaggagatttcatcattccagggtcagctgagatggggtcctatggtgtttggttacatccagagcatccctccgccgcctgttggtgctcgattgtcacacgatgagatagatgacaggtggatgcagtttgcggagcacttactacctgcgggtcagctttgtctagtgcctgagcaggatgattacgacggatatgaggcgattgcacagaggttggagcgtgtgctcaaccttaggatagtcactgcagacacagagttatatgacattatgcaggattgcctgacgatcgtgagaaggggatccagtgctgatggaactgtcagggctcgtcagagacgctgcatggaccattga

SEQ ID NO: 18072 - DNA, 291 bp, Glycine max
  Peptide Sequence Number=SeqID_134850
atggggttcttttggttttatttccggcatggggtagttttgtacgtgaacagtgcgccatgcaggacccaaaccgccattgccaatggcgagtttggtgtcactgagcaagctgcaaatggcactggcgagacgtgcctaaaccgccattacaggtggcgatttgtacaagcccagaaccgccagtcaaactggcgagttcctttgtcagctaggttgcagggttgcaggagctgtgtgttttctgaatgcataacgagtagcagaaatagcttagacgaaaggctttga

SEQ ID NO: 18073 - DNA, 372 bp, Glycine max
  Peptide Sequence Number=SeqID_134851
atgacttgtctaatgaagaagtacaagaaggactccaatttcctcttgcatgaagtactatcttggccatcaccaccattatcacatgcaaaactcaatgtacctcaaatgcaagtttttttttgtcatatatgcctcctctctatctctattttctttgtcttattcgcgtttccgctgtcgccgttgttcactgccaccgccattagcgccaatagtgacaaatgccgccattccattcgtgtttccacgacagagatccatcgcgccgagattatggttagatctagaggtttgggtcgaactttagacagggttataggaagagccttagggagagaagttaatggtgatgtggatgaagccccctaa

SEQ ID NO: 18074 - DNA, 468 bp, Glycine max
  Peptide Sequence Number=SeqID_134852
atggaggttcgaatcaaaatcctcttcacttcaatcagtcacaccgatctcagttcttggcaaggcgagaatgaggctcatcgtgcttatcctcggattttcggccatgaagcttccgggattgtggagagtgtgggtgaaggtgtgagtgaaatgaaagaaggggacttggtcgtgccaattttcaatgggggatgtcgggattgcaaatattgcatgtgcgaaaagaccaacatgagtcagagatttggggtgaatcctatgaagaaggtgatggccagtgatgagtacacagtggtggattcagcatgtgtcgtcaagattcacattgatggtgatggcgacctcaatccctacattaaaataaaagacttaccatactcagttgtggcgtacctacgggtgttgggactgcttggaataccgctgatgagcattttggttcaactgtatcaaagaaaacaatag

SEQ ID NO: 18075 - DNA, 813 bp, Glycine max
  Peptide Sequence Number=SeqID_134853
atggcccaatataccatgcttggctcgccgaatcaaaatggtgtgactgaaagaagaaatcaaacattaatggacatgataagaattatgcttagcaattccaaacttccttgttcattatggaatgaagctcttaagatagctacgtacatactaaatcgggtaccaacaaaggcagtccctaaaaccccatttgaattattgaaaggttggaagccaagtttaaaacaggtgcgtgtttggggtttcccaactgaagttaggatttataatccaaatgaaaagaagctggacccaatgaccattagtgcatatttcattggttacgctgaaaggtctaaggggtatagattttatcgtccaactcatgacactagaattgttgagtcaagaaatgcaaagtttctagaaaatgatgtggctagtgggagtgatttaactcaaggcattggtcttgagaaaaatcaatgtgagggagcagttcctacatcaagttataagctagtgatttttggtgatactcaccaaaatcgtgtaacacaagctccacaccaagtggatcctatcctagaagatccagttgaacaacatcaaacaccaaatgttaagcaacctaaacaacatcaaacacaagatgttgaacaacaaccagaaggtgtggatgtaacattgagaagatcaactagaataaagaaacctgcagttcctagtgattatcaattgtatttacaagagtctcaatatgactttggagttgaaaatgatcctaagtcctttttgcaagcgattaacagttgtaattctatgctatga

SEQ ID NO: 18076 - DNA, 198 bp, Glycine max
  Peptide Sequence Number=SeqID_134854
atggagatatacatgcatactatgctaccaatgtcagggttcagtcataggttacataggtctgtgaacagtgcatggggccagagccctgagcttgctttgtttgatgggttcttgctgttacatcctcgttatttcaccaccacccgttcaccctttgtggggtgtttcagtcctgaatctgctgctgcacggtga

SEQ ID NO: 18077 - DNA, 384 bp, Glycine max
  Peptide Sequence Number=SeqID_134855
atgcccttccgcgaagaccattttcggaagacactttttccggaaactttccggaagaaccttcttccagaagaagattttgtgattccggaagaactcaggaagactttccggaagaacgtcatccggaatgtttctagaagaaggtgttctgtatttgaagttttgttagtcgttgttcttcctatttcgtcggagtacaggaggaagaagttccggaatgagaatgttgtatttccggaaatacttcttccggaacttcttccggaagtaactatggcccattctggaagaagtagttccggaagtacttcttccggaatgagccttagtaacttacggaagcacttcttccggaatgttaccggaatgttacattattaa

SEQ ID NO: 18078 - DNA, 924 bp, Glycine max
  Peptide Sequence Number=SeqID_134856
attgagacactcatgagagctcaagctcaattccccaacactacacctccattcccaacacgtgatatatatggaagtgtgcataggccaagagaatgcactgtagattatgagctagttgtagccatggatgagatcaactttgttacagactctgatgagaaaaaacattctccaaaagatgcaaatgatgtccttactgaaaaggaccaagcatcggagaaggttgaggttcctactgatgggaactcaatgctaaagaaggaaggggataataagaaagagatattgatatctcctctgcctacaaacatctctcttcaccttgctgatcgttcagttgtctatcctagaagggcgattaaggatgtgcttgttaaggctgatgaggatgtccctaccatatttagacgacctttcccacttgtgatttacttgttgaggttaggcttgggtgcattcccaagtgtggggacacctaatccttttgagaggattctcactaatgaggatcttgactgggaactgaacctaaaagtagaagagatactttcattgcatcactctcatcatagtcccaaatcatccaattttgagaggttggaatatgactatggcactaaaacaaagccttctgttgaggaacctcttgaattggacttgaagcccctcctttccaacctcaaatatgtcctaagggacaacaaggaagtctttggatggagcattcatgacataaggcttaaccccaacatgatggaagtagttaaaggaaaggttagtcctgttcaatgtgtccctaagaaagggggcaccactaacgtagctccatatggagcttgtaggccttgggtcttcttcatcaatggagtcatttgcttcttgaagatcaatggcggcggaatggagacggaagaaagatga

SEQ ID NO: 18079 - DNA, 654 bp, Glycine max
  Peptide Sequence Number=SeqID_134857
atggcgtctgttattcctcgatgccttcctcccccaattccaattgcacaccgacgaaaggcgcaggtggtgaaatcgtgtcaccaaaacgagagctctgcttcggctcacacagaccactcctcaaatccaaagcaactgaaagttcatcctctgatgcaggaactccgagtaacagtttccaggcgtaattgtctctcatgtttgtgttctactatagttttgattagtgattgcgccatgcctatttttttaccaaaggcatccgctgctgatggaaatggaatcatggaaaaacctgtgtgcagaaattgcttgggaagcggtgctgtgctttgtgatatgtgtggtggcacaggaaaatggaaagctcttaaccggaagcgagctaaagatgtttatgaatttactgagtgtccaaattgttatgctataagaggtgatgataatggcatgtgttatcaatggcggaaggccgaaatttccccatctaaacacgccattgcatcttatggtgctgccatgatgggcctcccttcacaaattgtctatggcagttggcaaaaaatcatttatgccattccaccatggctgctatttaacaacactggtgtaaaccaaaatcatgaaccaggaaccgacttggaaccatga

SEQ ID NO: 18080 - DNA, 615 bp, Glycine max
  Peptide Sequence Number=SeqID_134858
atggcaacatcatcttcagcagactctacagtgattggagtgatcgatcagaaatttgaagggggctatgtagttaccgtgacaatgggttctgagcaattgaatggtgtactttattatgctcaagaggactctgtattattgcctgcaccatcccataacaacaacaatgctgctgctgcttcattgcagaagaagaagagacgcagaagcaaatcggaaataaaaaggagaaaccctgctcttccaaaacccaaaaaaactggctacaatttcttctttgctgaagaacatgcaagattaaagccatatcaccaaggaaaggagacagatattgggaggatgattggtgaaaactggagcaagttaacagagtccgaaaaaatggtgtatcaagagatggccaataaggataaagagagatacttaaaagaaatggaagaatatgtggagaaactgaaggcggaccaagtcatcgttgatgctgtgccacttcgacaatggcctcctcaacaggatacagacattcaaatggaagaagctgaggctggagagggaagttttgatatgaatgcaatgtctcttatggattcagaagagaggttttcttattag

SEQ ID NO: 18081 - DNA, 138 bp, Glycine max
  Peptide Sequence Number=SeqID_134859
atgggagagaaacacctccttaagaaggcacttgtgcactggttccatgtagcgatgttgttctcagctctgacagtagttggtattggtatcctccaaggtaggagtgaggttccatcaatgtctgagcctaattag

SEQ ID NO: 18082 - DNA, 1249 bp, Glycine max
  Peptide Sequence Number=SeqID_134860
atgaattcgtcaactacagtgaggaagttgcaggtggtgtcccctgttcctgcggacatagacattgcaaactccgttgaaccagttcatatctcccagattgccaaagagctcaaccttagtcccaatcactatgacctttacggtaaatacaaggctaagctgaagagtgatttggatgcacatgcacaggttttgttgtcggttcttgatgagcttcaaggatcagaagatgggtattatgttgtggtcggaggcattactccgacgcctctcggggaaggcaaatctactactacagtgggactttgtcaagctttaggtgcttttcttgataaaaaggatgtaggaattgttcgttcatttaggtcttcacaggtagttacctgccttcgtcaaccatcgcaaggacctacttttggaattaaaggaggcgcagctggtggtggctatagccaagttattcccatggatgaattcaatcttcatctaacaggagatattcatgcaataactgcagcaaacaatcttctagctgctgcaattgatacccgaattttccatgagtcaacacagtcagataaggctctttttaaccgtttgtgccctccaaataaagaagggaaaaggagctttagtgatgtcatgttcaggcgtcttaagaagcttggtatttcaaagatcaatccagatgatcttacaccagatgaagtaaataaatttgctaggcttgatattgaccccaattctatcacatggaggagagtaatggacatcaatgaccgattcttgagaaaaattactattggccagggacctgacgagaaaggaatggtgagagaaacaggctttgatatttcagttgctagtgagataatggctgttttggcactgacaacatccttagctgatatgcgagagaggcttgggaaaatggttattgggaatagcaggagtggtgaccctgtaactgctgatgatctaggtgttggaggtgctttaacagttttaatgaaggatgccattcaccctacccttatgcagactctggaaggaactcctgttcttgttcatgcaggtccatttgcaaatattgctcatgggaattcttctattgtggctgataagattgcactaaagttagttggaccaggtggatttgtagttactgaagctggttttggtgctgatattggagctgaaaagtttatgaacattaagtgtcgttatagtggtttgacacctcaat

SEQ ID NO: 18083 - DNA, 468 bp, Glycine max
  Peptide Sequence Number=SeqID_134861
atgtctatgaaaaaggaacatggaggaatagacttcaaacaattgcatggttttaatcttgccatgctagggaagcaaagttggtgtttgatgtccgaccaagatactatgaatcattatgtgacatccactagcaataacggaaaccagaacttaagagttggagaccttattgaccatgatttgcatacttgtaagattaatgaagtggctgccaatttcaacccaaatgatgctcaacaaattcaatccattcctgttctcaacactaagagaatgaatgacattttttttgcctgcgactttgcaaaagaagttgggacaacagggaatttgttgcatctggtcgataattgttggaccacaacggataactttcatgactttgtgttcaagttgttgcaggactctatactgagcatcagatcacgcataagagtgattctttgttggaacaatagtttatag

SEQ ID NO: 18084 - DNA, 288 bp, Glycine max
  Peptide Sequence Number=SeqID_134862
atggctcttgaactcttggaagagattgaaagacaagtgaaggagttacaagaaacagggctagcctctagctcacctgggcctccagaagacttcaacctgaaggaaccagctcgctttggcgagccaattacttcaggtgtaagtcttggttcaccaagtagtgaaggaaattcagagaatttggagagaagaaaaagaaatgaagttgaggcgctatcgaatcacgattgtgataaacctctacatcattcctcgttcggtgttctttgtgctatcgtcgattag

SEQ ID NO: 18085 - DNA, 549 bp, Glycine max
  Peptide Sequence Number=SeqID_134863
atggctaccgcacctgtctcgcctcctcctcctcctccttcagacgcatcagcatctccgtctaccatgaagcggacacagagaccagtggtcaacgttgatccagctaccagcaaggccgacggtccccacaagaagaaattaagagcatatttggggattgtcgcatgtgataaggtggatgtcacatacgagacctggaaggaagtccctgctgctcataaggatttgatatgggaggatattcaggcgaaatttcaaatccctgaagcttctgacagtaggacaaagaagaaaattcttcagactgttggcgagaggtggaggcagtttaaatcggacttgaccaggaaatgggcccttgcagccaaccaggacggtgttgatgacactgtttgtgaaaaatgcgacattagcaaggagaaatgggcaatgggcccaattttgtcagacacgcagagacccttcttgggaggatgtgcggaaaaaggcacaggccatccagaagcaaaacactgccccccacgtgttgtctcgtgggggttatga

SEQ ID NO: 18086 - DNA, 348 bp, Glycine max
  Peptide Sequence Number=SeqID_134864
atgacaaacatccagagtcaaatacccctgtccaaacataaagggctagggggtgttttggattctacaaaaaggaaacatcattttggaattccgatcacgccaatgcgactggggttcagtgaaggtcacaaaaataacatcaatgagaagggtttagaaatcaagattacctcagagaagctatgcaatggaggattgggggattttctccaccgaatccttggggaggattctaaggatttcactccgattaaagtgttcctcttggtgtggggttcgacggcaaggaatgatggctcacggtggccacctgtggtcgtgggtggtggaaaaatgaggtgttag

SEQ ID NO: 18087 - DNA, 501 bp, Glycine max
  Peptide Sequence Number=SeqID_134865
atggcatacatacaagaattttttgctcatctgagaccttctaaagattgttgggacgacctctttgttgttaataaaggtgagggtggtgatcaatttaagtctaactttgagctttattggtcctccactcattataataagttggttaattttaatgggaaacaagaggaagagttgtctacaaaaaagctcgcttctacgaattccattgtcgaattggttaatgagaaaggagatgcaatcacttgtaaattgcttttacaaaccgttgatgaagattggaagtcagttttagaagtgctcatggggaaatcaaagaataagcctatgtcaatcgctcctctttatactgaaaataggggtgataagaagaaacttttgaataagtcaaaagcgtctgacagagggaaaggtcttgctatggagattcactctaaagcttctcatgatatacctcatcctccttcttcgaaaaggaaaaaaggtcgtcaatattga

SEQ ID NO: 18088 - DNA, 756 bp, Glycine max
  Peptide Sequence Number=SeqID_134866
atgaaatcaagttctcaatgctcacaagctgataattattctgacagtgaaagcacattccagaccaatctgagaactttgttggattctcttgcttctaatgtggtgcaaaaccatggcttttaccaaaccattgtaggaaaaaaagccaacagggtttatggcacagtattatgtagaggggacatatctgctagcaattgttctgattgcacccttaattctacaagagtagcctcaaatgattgtcctatgagcaaagatgtttcaatttggtttagatggtgtttcctaaggtattcaaatgtaagcttctttggagatatgcaacaaacagctgtagcaatcacaaatgaaactgattttgatgatccatctgtggtttctgaagggcttcccttcatgagtggactagcagctgtggctccagacaagtcattcatgttccacacagaagtactgaacacaagtcaaagtggacagaagaggtatggcatggctcaatgcaccagagatatcagcagggtggactgcagaaggtgcttggattctcagttggaaaatttcagaactgtaattggaaacaaaagaagatgggaaatttatggatctaattgtttcatgtggtacaatgactaccagttttattctaatggctctactcttctaagtgctgcttggaggccctcttcttacacaacattaataattggcatgactcttgctgtctcagcggcccttttcatgcttttctaa

SEQ ID NO: 18089 - DNA, 798 bp, Glycine max
  Peptide Sequence Number=SeqID_134867
gagttggatgagagaatggaagccacaacagagcagaacaattcaaaggtggtgctgattgattctttgcaatcttgggagttccatgtcaaccaggcctccaatcagaatagtcctgttgttgttcacttcactgcttcatggtgcatgccatcggtggctatgactcctgtttttgaagaactggcttcaagctatccggatgttctgtttctcactgttgatgttgatgaagtcaaggaggtagccaccaaaatggatgtaaaggcaatgccaacatttttgtttctgaaggactgtgccgtggtggagaaggtggttggtgctaatccagaagagataaagaaaaggatagatgggcttgctgagtccactcgtgtctcactggcgtttatggaactgtggtctatcgtgggccctggaatgcctctcaaaatggacaaggctgttatattaagtgacgcagttcgagtggtgtctcagttacaagaggaagctcaaaagctgagagagtcctctgagaatctacaagagaaaattaatgaattgaaggccgagaaaaatgagcttcgggatgagaagcagcgactaaaagcagagaaagatagcattgagcagaagcttatagccttgagttcacaacctagctttctgcctgcgtttccttctgcaggacaagttgttggtagcaagctggtgccattcatgggctatccaggagttgccatgtggcagtttttaccacctgctgctgttgacatctcacaggaccatgttctcaggcccccagttgcataa

SEQ ID NO: 18090 - DNA, 840 bp, Glycine max
  Peptide Sequence Number=SeqID_134868
gtttaaagctaatgacatgttggagatgctaagagggaaacgtttaatttttgttggtgattccctcaataggaatatgtgggaatctctggtttgtgttcttagaaattcagtggaagatcagagcagattgtttgaagcctctggtagagaagaatttcgaactgagggttcgtactcatttatcttccaagattacaattgctcagttgagttctttcgttcggtgtttcttgttcaagagtgggagactccagacctgaagggatcaacaaaagaaacacttcgtcttgatgtgcttgagagatcttgtgataagtacaaagatgcagatgttcttatctttaacacaggtcactggtggactcatgagaaaagaatagaaggtaagggatattatcaagaaggaaatcatatctatggacaaatgaatgttgaggaggcatttcataaagctttgttgacatgggcacagtggatagattctaatattgatcctaagaaaactacagttttcttcaggggctattctccatctcacttcaggggtggagaatggaattcaggtggtaagtgtgacaatgagacagaaccactggaaagtgagtctgacttagaaactcctgaaatgatgatgaccattgactctgtaattaagaaaatgaagactccagtcttctatttgaacatcacgaaaatgacttatttcaggcgtgatgctcacccttccttgttcagaaacgagaatatgacagaagaaacaaaaagacatatgctcatacaccaggattgtagccattggtgtcttcccggtgttcctgatttgtggaatgaattagt

SEQ ID NO: 18091 - DNA, 1065 bp, Glycine max
  Peptide Sequence Number=SeqID_134869
atgtgcatcacaagtcctaaattcggcggcaagtcattgattgactatgacatagcactttcatccgaaccatgcatgttgttgggagtgagtcttggagttatttgtaaccttgtattcccagaatggttgattacagtactctttgcaatctttcttgcttggtctacctcaaaaacttgcaaaagtgggttgcttttttggaaggctgaatcagaagtgataaggaaaaatggacttattaatgaggaacttgaaaaggggctgctagaaaatgagactattgaacaaaggaaagtgtacatagaaaataatgagccaaaaagtattgaagtgtctcttctggctcctcaaggaaatagcaaagtgaggatcccttggttcaaattggcggttttacttttgatctggttctccttcttctctgtctatcttcttcgtggcaatagatatggagagggaatcattccaatggagccatgtggtgtgggatactggattctgtcatcggttcaagtacctcttgctgtggttttcactgcttggattgtgtttaggaaagaaagccttcgagaccgaactcttattccaaagctacctgatatgaaggtgccaggtctcaccaaaaaaagaccatcaaatatacttgtttttcccttaatggcactactagcagggatattgggtggtgtctttggaattggaggtggaatgttgattagtccacttcttcttcaggttggagtaactcctgaggtaacagcagcaacatgttcattcatggttcttttttctgctaccatgtcaggattgcaatacctgttgttgggaatggaacatgtacaagctgccctcgtcttggccataatgtgttttgttgcatcactgcttgggttattagtggtacagagagcaattcggaagtatggaagagcctctattatagttttctcggttagtatagtgatgtttataagtaatgttctaatgactagctttggagccataaaggtttggacagactatgaatcaggagaatatatggggttcaaactaccgtgttaa

SEQ ID NO: 18092 - DNA, 852 bp, Glycine max
  Peptide Sequence Number=SeqID_134870
atgtctcagcagcaaaaccaaaaccaaaacctacccgcggtttcgcaatctctgccacaacaaacggtttctgaagctgatgttaaacccttctcaataagacagtatgttcttgcatctcgtcacataaatatccttcataactggccatttcctgagaagcacttgcaattgtgttttaaagatggtctgaaggaggtgttgccaccatttggaggccaaacttcacttgatgaaccactcaaaggttgttccaacttgatgcattcactaaatgataataataaagaagctgattcttgcatagctgaagttccacatctcattgatgatgatcaccgacaaagtactactaacaatgagtgtgtctacaaagtcactaaccacccttcatcacatggagaggaaaatcactcaaatcagcatagctgcagcatttctgacaatttatctcaaccagcagacacatgtaccctcctaagttcaattcatgttagtaagagtttgccatcatccaaggaagtgaaagataaacgcaaaaagcgtaaaggaagatgtaagaaacgctcaatggtggatattttagccgtggcacagcacagtacattagaggagatccataggatgaacaagttttattatgctgaaactgtgattaatggatgtcagcaaacggtgcctcatgaaaatattcccaggtctgaggtcgtgggtgtggattcatgcagaaaagctgggagtgaagatcatggtgtagctaatgttgatatgacaccaaaaaggccattgcttcttaagttcaagctcaatggatgtaatgttaataggaattgcaaattaagcatgaattga

SEQ ID NO: 18093 - DNA, 228 bp, Glycine max
  Peptide Sequence Number=SeqID_134871
atggagaggataatgaaagtgattggcgaatttgcctcttgcattcccaaatcgccagtctctcactcactccaatttgcagcgactcagaggacatttcttgtctcattaaagtgtgcaaaagcaaaagaatgcagcatcagctggagcaaaattgttttgctttcctggcccttctcttatacagatacaggtcaaaattttcctcttctccatttctttcattaa

SEQ ID NO: 18094 - DNA, 483 bp, Glycine max
  Peptide Sequence Number=SeqID_134872
atggtgattttcagccatggagttgcaacagaagataaaggagaagagcctaggtcactagcacatggaagcttccttgagaagcaaggaggggtgccattaataaatggccaaaatacaaggcccaaaagaaggaaaacctattataatatttataatgaaaagtggaccctaccttggcaaataggctcagaaatctaccctgaggttcataagaaccctagggccttcttcagcagctctagtccaatcctcttggagccttttgctcaaggctctggtgactggtcctttcctagggaggattgcatcagtcgtagtctccacactgcatttgaaaatgaaattccttaccctaaccaaggagattgtaatcgtcaaggcaggccaaaagcaagcatgacaatgctatgcaaacagcctgaaggtagcaccttatcctcccaccaggaagtctgccaagcctcaccgcacaacaattga

SEQ ID NO: 18095 - DNA, 951 bp, Glycine max
  Peptide Sequence Number=SeqID_134873
atgaatcttgcaaagtatcaagacctttttttcaaagccatgcacacgcaaattgccctggtgttagtgcttgcattggtaaatgtagcaattattgtaagtgacattaccctgaatggctgcatggacaattgtggaaacgtgtcaattccatatccatttggtgtaggcacttctaaagaaacaagtgagaattgtttcttggaagacaaaatgaatctaacatgccaaaacaacaatttatatttaggtgttaatttgctagttttagaacatgttatggatgtgttgttttatgtctccaaaatttgcaacacccccaacagagtggccaatgacctctttcttagaactcctagtaatttcaccatttccagcaaagaaaacaatttcataagtgttggttgtgagacttatggctacctcaatagctttaacaatggtgtgcaatactcgaccgagtgcttaaccagatgctccaagttccctaatgatgttgtaaccaatggagattgttcagggatagggtgttatgaagtggatattcctcctaacatgaagaatatcactatagaagcatatagattcgatgtgtcttccaattacttccaaagctgtggtcattcctttgctgccaaacgtggctcctacagctttgacattagtcatttggagaatttgcaatttgacaccatccctatggttgttgattggagtgttggagatgagctgggatgtgaggatttcaggaaaggatttcgaaaaggtgcttgcatgaacaatagctattgtcatgacattgacattagttatggataccaatgcaaatgtgaagaaggttatgatggaaatccttatcatcccaatggtttccaagtaaataattatatgatgccaggtaatggtggtaaagatcattacgccattgaaatagaacaattggtgacttga

SEQ ID NO: 18096 - DNA, 387 bp, Glycine max
  Peptide Sequence Number=SeqID_134874
atgcctataaaacccaaggtcagctcactcacagcaactacaacgaccaaagtccaaggtcaaggctccacaggtcaagacgacatacccccagactggttggcaagaccttcaaccaggggcaagctaaatgacttagaagcagtggcaactctagaagaagaacctcgatctttcgaggcatcttctagctttcctattccagggcaatctcatacagatttaattgaagaagttatcatggctgaagagccaaggagagtgaccttagaagattactcaagttcaaaagctaagaggtggcttcacttgttcaaaggcaatagtctcaagacttgggatgaagtagttgagaaattttctgaagaagtatttcccggagtctaa

SEQ ID NO: 18097 - DNA, 291 bp, Glycine max
  Peptide Sequence Number=SeqID_134875
atgagggatagacgggggaggtttgccgtaaatcacttggaatggagtcacgccggtgctagagtggatggtcgtgttgtattgttccaagacgcggttgaggacctccgtttggccatccgtttgtgggtggtacgcggtactcagttggattttggtgccactcaattgaaacaactcatgccagaagttgctgacaaaaatggagtctctatcagacaccaggctttgcagaaatccatgaagcttgcagacaatgtcaatgaaaagaagagcgaccttgtaagctga

SEQ ID NO: 18098 - DNA, 768 bp, Glycine max
  Peptide Sequence Number=SeqID_134876
atgttggtgggagatggtattgggaagaccataatcacaagtagcaaaagcgttggagggggcaccacaaccttccgttcagccactgttgctgttgttggagatgggtttataacacaagacatcacatttagaaacactgccggtgcaacaaaccaccaagctgttgcattgcgttctggatcagacctatcagtattttacagatgcagttttgaaggttaccaagacacactatatgtgtactccgatagacaattctatagagagtgtgatatatacggcacagttgacttcatctttggtaatgctgctgttgtgttccaaaactgtaacatttatgcaagaaaccctccaaacaaagttaacacaatcactgctcaaggaagaaccgatccaaaccagaacactggcatttccattcacaattcaaaggttactgctgcctcggacttgatgggggttaggacttaccttggaaggccttggcaacagtattcaagaacagttttcatgaaaacttatcttgatagtttgatcaatccagagggttggttggagtggagtggtaactttgcattaagtactttgtactatggagaatacatgaacacaggaccaggttcctcaacagcaaaccgtgttaattggttgggttatcatgtcattacaagtgcttctgaagcctcaaaattcactgttgggaattttattgctggaaactcatggttgcctgccaccagtgtgcctttcacctctggtctttga

SEQ ID NO: 18099 - DNA, 624 bp, Glycine max
  Peptide Sequence Number=SeqID_134877
atgttgacagacagagatattttgcacgttgttctacaacgccggttacgcaaagctcaagaggccatgaaactcaccgcaaacaagcatcgtcaggatgttcaattttctttgggagattgggtttacgtcaagcttcgtccgcattgccaaacatttgtggcccaggctcataccaaattatcaaaacgatattttggcccttttcaggtggcggaacgtatcagacccgttgcgtacaagttgcatttactggcgtcatcccggattcatccagtattccacgtttcccttctgaagccacatctaggaccagtacttgagaccccagctcggcttcctccatccaccgcggatgaccaccctcttttggtcccactctcctttctcaattggaattgggatacttccgtctctcctttggacaaactggtcctagtccaatgggaagtttcacacaaccttgaggacaaggttgtttttggatatgagggtgttgatagcataactcctatatcagataacacacgagaggccacaccagacaacataccagaggaaaataatatcaacaggccaaggagaaccattaagaagcccaattacctcaaagattatgcatag

SEQ ID NO: 18100 - DNA, 774 bp, Glycine max
  Peptide Sequence Number=SeqID_134878
atgtctcagcagcaaaacctatcttccgtttcgcaatctctgctacaacaaacaatttctggagctgatgttaaacccttctcaataagacagtgtgttcttgcttctcgtcacacaaatatccttcaaagctggccatttcacgagaagcacttgcaactgagtcttaaccaaggtctcaaggaggtgttgccaccatttggacgccaaacttcacctgctgaatcactccaaggttgttccaacttcttgatgcattttcgaaatgttaatgatgataaagaaccagatttttgcaaagctgaagaagtgccacaaaatattaaaaatgagtactgtgactacaaagtcaccaaccaaccttcatcacatgaagagggaaatcagcagcacaagtgcggcatttcaagttcaagtaatgttcataagagcaatccagtagtactattgccaccatcgaaggcagtgaaagataaacgcagaaggcgtagagggagatgcaagaaacgctccattgtggatattttagccgaagcgcggcacagtactttagaggagatccataggatgaacaagttttattatgatgcaactgtgattgaaggatgtcagcaaactgtggcttatgaaaatatttccaagtctgagctagccggtgaggatggaagtgaagatcgtggtatgcctaataatgttcatatggcaccaaatgggccattccttcttaagttcaagctcaatggatgtagtgtaaataggaatttcagaacataa

SEQ ID NO: 18101 - DNA, 2901 bp, Glycine max
  Peptide Sequence Number=SeqID_134879
atgaagaaattcttctttttcaaatcttctgcatctagcagtggaagtaacaacgatgcagctccgccaaaatcaacaaataagcaaacggcctgggatagtttttcagacattggagtgaataataatcgggcttacggtaaaactgaggattacttccagagccccaagggcttcttctcaaaatctcgaaagcatgtttctgatacccagagttcttctgctggtccagatcttagaaggagcaggtcattgtcatcatctgcctaccagttcagagatccaaccaggtctccttcaagtagcattgtcagtgatccatatcaacaagttgggcattcatctcgttctcaggctcccaactatgagaaaccaaagcgagacaagccagcacaagttgcagtgtcttctgtccaaaattcacacagatacgagagacctgggtcttctagttcttcaagatctcatcatgagtcatcagggaactcttcttccacttgttccagcaacatttctagtaagattgtggatcgttacattgatggagagcagcatccagaggaaagtagacccaagaacaattcacaaagaagtaatagtagacatgggaattatggtgtgaagcgtcctccaaaagtacagcttacagcacctaattcaccaactcatggagtcaaagataaaccaaggactcattcatttagagaagctaaagctacccgccttcgtttctcatcccgagattggacagaaaatgggtttggaccagagtctccgaggagtcttgcgaagaatgtgattgagagactttctcagtcttgtgatctcccgaagccatgttcaaagaatgttaacatcgataatccaatcaccattgaagatatctattctagatctgtgaatggacactatgactctgattttgatgatgctcaggcaaaaaatgatttgtcggatgaaccctatagaatggcaaatggctatcatggcatggatgtcaattttgagggtttaagctgtgatgaacctgaagaggatgcggatgcagaactaattagaagatcaaaggaggctgaggagagggttattcttctctcaaagaaactggaacgagatagcttttttcctgatgatggttatgatgtgtcagcactgattcggacaatcagacatctactagaggaaaaaataagcttggctctggaagtttcaacccatctaaggtctcaaattgccgacagagtctctgccagggatgaacttagccgtgtaaagacagaactggagtttcggactcagagactagaaaaagaaaagaatgagatgcagtcagcattggagaaggaattggacaggaggtcaagtgactggtcatttaagcttgagaagtaccagttagaagagcaaaggcttcgtgaacgagtcagagagcttgcagagcagaatgtatcacttcaaagggaagtctcctcttttagtgagagggaaatggaaagcaaaagtgtgatggcatatactgatcaacaactcaagggattgactgataagacagagataatgaaaaaggagattttggatttgcagcaaaatctcttggaactacaagagaaatataagatagcagaagaaaatagggactgtttccttagaaattttgaagagaaggaggaggagtgcaaggagttacacaagtccctaaccagattattaagaacttgcagtgagcaagagaagtcaatagccggattacaagatgggtttagcgaggagcttcataagaaccatcccatggagagtgttgacaagcacattgcaaaccatcacatggagaatgttgacaagcacattgcaaaaatgcgaatggagcaaatgagattaacgggtgtagaactagccttgagaaaggagttagagtcttgcaggtttcaggcagattctcttcgccatgagaatataatactcttgaaccggttgaaaggtgatggaaaagaaagtgttgctgctacttatagactagataaagaactatgggcccgcatctactgccttcagaatcaaggactaacaatgctaaatgaaagcacatacttgtgttcaaagttactggaatttgttaaacgaaaaggaagccaccttcgtcaaaatgttcagctggatcgagaagtgattggaaatggtttagatgggcaatttattgttgaatctgaaactaaaattcagggactcaaaagtggcactgagggtttaacaaggagtttgcagttgatgtcttctttgttgaaagataagtcaaatccattgacttctaaatttcaatcagagattatagacgctggtaaattagctacactgaatgatcaatcatccgaggatattttaagaactgaacttaaagcagaatgtttggtgacaagtttattaagagagaagctgtactctaaagagctccaagttgagcagatggaagctgaacttgctacagcagtaagaggaaacgacatacttagatctgaggtgcaaaatgcgttagataacctttcaagtgtaacccacaagttgaaggaccatgaacttcagatgttgaagaaagatgagagtagaaactgccttcaaaatgatctgcaagagtctaacagggaattgacaatcatgaggggaaaactgcccaaagtgacagaggagagagattatatgtgggagcaagtgaagcaatatagcgagcagaatatgctgttgaatgcagaggtcaatgtattgaagaagaagatagagacacttgaagaaaacaacctcgagaaggaaggtcaaatatccatattgcaagactcccttgccaaaagatcctatgatgatctccttgggagtcctgcgcatgattttttcagtacaaaattgctttaa

SEQ ID NO: 18102 - DNA, 1763 bp, Glycine max
  Peptide Sequence Number=SeqID_134880
atggctctgctaacacttctttgtttccgtttgattaaccgccacttccatcttggtcggccgttgcctttgtcgctccgtaccatccactgtcgttactgccacgaccactgccatgaaatcccctacaccaatgacgccatcctgctcgatgatgccgccgtggtgcaccagattcatccgcgctgggttttggttatctccgcccccaagactcgactttgctctgttagtcatcagcgtcgacatccgtcgccacacctgccaccttatccatcgtcaccatcgaagccacaacccaagggagattatgccgctgctgaaattgttgatggattaaagttgaagggtctacgttgtggcaggggtctattattgcttgctgaaatgagttcagctggtaaccttgctaagggagattataccgctactatagtaaaaattactgaggatcattctgactttataattggcttcatctcagtcaatcctacatatggccaggggcacctatatatccttctttcattctggcaacccctagagttcaaatgcataaggaaaaaagggagagacagaatgcttgaagcttggctttctctcaagaagacccttcaatgcaaaccacaaccaaatcaagttcatgatccaaagactactaggcagcaaaagggtaatcagagaacaaagttaagtaatcttgagagttcaaataccaaagatttcatccaaggaagcaaggggcacttaaaaaaatcactgagttatagaggggacattgacatcactagtcccataactaatgaaattgttcttgatagctcaaacaatggaacctctcgatgttgtccttgtcctcaaagcaatagcggcaacaaagcttcggaaggttctcatagaacacgaaggtcagctacatcttcaaagataacaatgacatatcatgttgattacaatgaagcaaatgtctcctccaatacaagtacgctggttcagatggattctgatggttgttcaacattgacatgccataaatgtggcaagaaattgaaaaatctcgatgctgtagaagcacatcatatttccgagcattcagtcactgaacttgaagaagattcatctagacagattatagaaacaatatgtggaagtggaacaagctctattaataattccgaaaacatggtggggcagattgattgcattttaaaggttctgaatgtaccaaaaaccttagcttgctttgaggaatacagagcaaaggtgaaggataacgctgagaagctacagaagaagcatccacgttgtgtggctgatggaaatgagcttttaaggttccatggcacaactatttcatgttctcttggcacaaacagttctagcctgtgcactttagactattgtggtatatgccaaatcctgagaaatggcttcttcaccaataaggaattccatggtgcatcgggggtttacaccacttccacaagtaggaaagcctttgaatccatttccattatgacatcccatgagaggccatttgcaagaaagtctgtcatagtgtgcagagtaatagctgggagaatttatagtcctcttgaagaaattgaagaagaaagggctgattcagagtttgattcattgtcagaaaatacaaatggtcattcagatgctgaggaactctacgtgttaaatcccaaagcccttcttccttgctttgtgataatctacaaacagcaaacagacaaggctaggagattagggag

SEQ ID NO: 18103 - DNA, 201 bp, Glycine max
  Peptide Sequence Number=SeqID_134881
atggtgggaagcagagtcgacgtaggtgcagttgttaatggtgatttgggagaagatggagtgagtgtgagagcggatagccggtcaaggatgacgttaagcttgacggtcatctgcaaagtcttggtggtcatctcgagagtctcggtggccatggcggtccatggtggtgtggtggccgttgtgagcgagcatgattag

SEQ ID NO: 18104 - DNA, 225 bp, Glycine max
  Peptide Sequence Number=SeqID_134882
atgtcatctcgcattgttgcggacaatgctacaccatcgccgtatttcgacctaatggaactggatgacctcacgcgccgccccagacattcccacgctcggacaactcctcaagcacgctcaccatctcagctaccgctttacttctcggagttcgcgaactggaaggttcccccggcggaacgaagagtatggtcgagttcaacaagtcatggcagagcatga

SEQ ID NO: 18105 - DNA, 651 bp, Glycine max
  Peptide Sequence Number=SeqID_134883
atgccattccgagttcgcactgcaactgcaagtcgctggtggtctctgcacaccgttttcaacactcattgtctttgccgcaacttgtattattcggctttgtccaaacgtcagtggttggagcggaaagctgcctgtagtatttcctcctcactttttattggcaattcttcgtatggaaggtctctgtttgcctctaagataatacaaactggagattgcattttaaaggttccttacagagtgcaaataactgcagataatctccttcctgaaatcagatctttgattggtgaggaagttggaaatattgcaaaacttgctactgttattctgatcgagaagaaactgggtcagggctctgagtggtatccttatatcagctgtcttccacaacaaggagagctgcataatacggcaagtttttgttctttttcttactttgagtggtgtttgttcctggtattttggactgaaagtgagttggagatgattcgtccaagttcagtttatcaggaaactattgaccaaaaatctcaaattgaaaaggactttttggcaatcaagcatcttggaataaaatttttgaatgttcccatcaaagttttggagattctacctacaaggacttcatgcatgcatgcacactag

SEQ ID NO: 18106 - DNA, 528 bp, Glycine max
  Peptide Sequence Number=SeqID_134884
atgctggactttggttttacaattccatacaacatttacgatcaggttcagatccagtttgatattcctaagcatgatcctctgcgggacatgaagttggaactcttgcatcagtactttatacctccacctgaagatatgaagggcttgtcacatcccgtgaattccttcagcatcaaggaggtgaagtctgatagtggaaaagggaagggtcttccacaatcacttcgtgcgcttgctcgtgttctttcttgtacaacatctcaggaaattgacaatttgattgcggaagctgctcaaactgatggtaggctggctaggcgccctttacaggatatcagcaaagagatacaagcacacatgatgttgttgtcactattcatccaattaattgaggagcgcagtgtggctattatgtcactggattctctctccttgtgtggaagattttctgttagaaaactaatggctcaagatctcctacaagccacaggattatcaaagaggttaagcttccaacagatgtag

SEQ ID NO: 18107 - DNA, 237 bp, Glycine max
  Peptide Sequence Number=SeqID_134885
atgcctgactttggaattagtgtgtcccttggaggcaattcattctacaagaactgggtgcagctaaagggtgtaatacactcgatcggatcaacaactcttgacaatcaagtaaatagatacagcaagaaggactttgcagatggaatgtacaatccatcatcaaccaccactgtctccccaacaatgcctacgatgcttaatttcagttcagggtgtattcatcgtcaactgtaa

SEQ ID NO: 18108 - DNA, 1464 bp, Glycine max
  Peptide Sequence Number=SeqID_134886
atgtcgtcagcgaaggattctttattgccaaagtataaaaaaagtcctagacgatctaaaagtaggtgggagccaatgccagaggagaagccagttgacaatccaatgttaatcagtaatgatactgtaaaatacaatagttgggtacctactgaaaaggacagaaaggtggcagtggaaaacaaagaaagcaaggacgggtttaggaatactaaattttctccattactgcatagattatctagtaaggctcttcaaaggccatttaagaagcagcgtgttacagatgcttctattgcttctgaaaatggtgatgcatctagtgatagtgacaaggaacaaagtttgacggcatattattccgctgcaatggcttttagtgatacaccagaggaaaggaagagacgtgaaaatcgttctaagcgatttgatttaggacaagggtatcgaacagaaaataatcactcgaggaaaaaacacgctggggctggaagcttttacaatagaagggctagtgccttggtgctgagcaaaagctttgaagatggtgccagcaaagctgttgaggatattgactgggatgctctaactgtgaagggtacttgccaggaaattgaaaagcgttacctgcgcctaacttctgcacctgatcctgccactgtaagacctgaagaggttcttgaaaaagcactattgatgattcaaaattcccagaagaattacctctataaatgcgaccagttaaagtctattcgtcaagacctaactgttcaacgaatacgcaatcaattaacagtcaaggtgtatgaaacacatgcccgattggcactggaatttggggacctgtttgagtataatcagtgtcaatctcagttacaaactctttatgccgaaggcattgaggggtccgatatggaatttgctgcttacaacttgctttgtgtcataatgcattcaaataataacagagatcttgtatcatcaatggccaggttatctcacgaagcaaagaaggatgaagctgtaaaacatgcccttgccgttcgtgctgctgtaacttcaggaaattatattgcattctttagactgtacaaaacagctcctaacttaaacacctgccttatggatctttatgctgaaaagatgcgttataaggctgcgaactgcatgtgccggtcatatcgcccaactctacctgtttcatacatttctcgggttcttgggttttcaactggcatggccacaaatggagcaagtgatgagggagagactgatgcattggaagagtgttcagaatggttgaaagcacatggggccagcataattactgataacaatggagatatgctgctagatacaaaagtttcatcatctaatctgtttgtgccagagccagaggatgctgttgcccacggagatgccaatcttgctgttgatgactttttagcacgagcacctttatag

SEQ ID NO: 18109 - DNA, 1458 bp, Glycine max
  Peptide Sequence Number=SeqID_134887
atggccaacgaaggaagtaatactgagaccttacctcctgcggagccacatctgttcgagaatcgacatgttgatgctagccaacatcatccaacttcctatgctcccactacaactgggtctgaagctgcaccatggactgttcatagctctacaggaaatggagtttattctaatccaacctacctgtatgatcagcatccacagccacctggaagaagcattcaagatggtcaaaatgtatcatcagttgctggtaattcatcaaatttgggaacagctaatgtaacccaagattacaatgcatacgcatcatacccaagttcttctaatccatatggttatggcagcatgggattctcgggctactataacaactatcagcagcaacaacctaatcatacctattcacagcctgtaggagcatatcaaaacacaggtgctccttatcagcctatttcctcctttcagaatactgggtcttatgctggatccgcaagttattcaagcacttattacaatcctgctgattatcagactactggaggttaccaaaacagcagcggatatggaaatcaagcaactatgtggaacaatggcagttattcttctcatccatatactaattacaccccagattccagtggttcttatagttctggtgctgccactacttcagtgcagtatcaacaacaatacaaacagtgggcagactactacaaccaaacagaagtcagctgtgcacccgggacagagaacttatctgtcacaagttcatctactttgggttgtcctattcctgcagttactggtgcttatgcgactccaaatagccagcctccacaatcatatccaccattttggaggcaagagtctagctcttcttccataccttttcagcctgccgctgtaaatagtggtgatcatgatggttactggaaacatggggcccaaagttctcagatacaacaaactaatcctattcaaccaaactatcaaagtcctttggatttaaaatcttcttatgataaatttcaggatcaacagaagactgtatcttctcaaggaaccaatttgtaccttcctccaccgccgccactacctctcccctctcaacaggtgaatatggcacctgtacaaagtgttccatctccggatgcaaaacggcccaaagccgaaaaagatagctctacaaccagttcagtaccaaaacctgcgtatattgctgtttcgttaccgaagccaagtgagaaagtatcatctaatgatgctgctaattctatacttaagcctggtatgtttcccaagtctttgcgtggctatgttgaaagagctttggcacgctgtaaagatgataagcaaatggccgcatgtcaggctgtcatgaaggagttgatgcacacctatgatgtttttgaaacccaagatgatttatgtgtgtatataaccttattttga

SEQ ID NO: 18110 - DNA, 4392 bp, Glycine max
  Peptide Sequence Number=SeqID_134888
atgagtgttgaaaacggtgtgcagagaccaccagcgacttgcagttgcagtgcgaactcggaatggcattgcagaacctcgggaaggcgacacgaaggggtgggcaagaagcagactaaaaagtcacgactttacatcgaacggtcgagatcagaggataagaaacacggaggaaaaagggccacgtggaaggagaggacacatggcgatgcgtcccgtcgtgagagcaaggctaggattgttttacttggaaaggagaagcgttttagaagatataaatgcctaccgatgactgactactttggaatcatgcctgtttcaggacatgaagagaccggggtaaagtcctatgctgggcaatttagtggtttaattgcaggtgtgcctatcaagaaaaggaggttccctacgtttcagccttcttcttctcctgtgtctggggaaccatgttctctcactgaagaaaccgagttacagcgtaaagaaaattcaatcacttctcaaggatcagctttaccaaatgctgcaggtgcaccaatcaagaaaagaaggttcccgtgtcttccgccttctttggaagaggcttcacgttcagaagaaagtgatgccttgcgaaaggaacattcaagcacatcaccgggttcaactctttctcccagttcttctggtctatctgatgctaatggaatctctgcgtttgaagataagaaagcaagtattgatgttaccaatgctaacatggtgcaaagcaactcctgcttccttacacccaaacttgagcaatcaaatgtcggaactcaatcatgtactttaaatgtcatggatagcaaagagaaggtgatactcagtgaaggtagcaataaaaaattggaatcccaaactatcaaggggaatcctgaactcttattggctgcaaaggaaggtcttgctcttagcattggagctgatgagcacctctttccggctgttgcaagtatggagaacaatcctcaaaaaatagagaaagcacaacctgtttcattggaattgtctttaagcaaagaagactgcagtactcacagtttaaatactgatcctaaaactgatagtgacactactcgtgttcattctaacagggcaaactgggatctgaatactacaatggatgcgtgggaagaatctgggaccgaagctggctcggttaaaacaagtattgatgggctgaaaatttctgatagttcacttgatgaaaagcagttagtgtgctctccagggatgacatcgccagcaagtgttgtgtctgtaaagccaatgtgtgaagagagtcagaaaaaaactttcacttttccatctggactctgtggaccgcagtttaaatttgttgactcaagtaatctatctcttgcaccatttattcagaaatataccgaggagccctctagattatctgttaagctgaattctggtagtgctattccgaatgtgagcttgtcaagtgtggcttcaaccgtgggtgatgcgaatacttctagttttaggttggtaaaaccagaaccatttgatgagaactcaaaaagggatttgaaggatgttaatgcctctactgtgggttccttagatagtgttactgttaaacaagaacttgttcaggcttccgctgccaactcttcaaagttgtcaaatgttagcaatctattgaaagttgatgctgcctccgttaaacaggaaccagatcacaagggtaatcaggaaggatccaatgctgcagtgagtaaaatggatcagttgaataaagattcgcgacaagaattggataattcttctccttccatggcgatgccagttatgcctgatacaacacaaatttctgccgagccagcttgtgctccagtgaaacctatgtgtactgcagagttatcaaccagtgaaaacacagtaagtcagattgaaaattctagtcctacagaaggagtcaatgttgagaaagtttgtgatggagcttgtttaaatgctgaacaggttatcatagaaacagttgctatgcctatggttgataatggtttggtgttgaacaatcctggtctgcaaacttcttctgttagtactgaggaagaaaatgctgctgatcgcgatgcttgcagattaaaactcatgaatgagcctccacctgcttcacgaggcaatggtgaaggctgtgcaagtgatgaagaaaagataaccctatctactgatatgttggaggatgattcttatgattctgattccgagtcagacgagaatcatgctgtaactattgctgtggataccgagtgctatgttgaagatgatgattatgaggatggtgaggttcgagaaccactggatccttccacagcagaagacgtatgtgaggtaagagaagtagagcatcctgatagtaactttgtaaataaacagatggagaaaggaatggtaagtggtgattgtcccacttcatatcaggtggtggaaaagaacaatatgactgcaattcaaagtgaaataaataatgaagttgttgatatggacattgaaatgcatgagaggtctggtaaggtcgttgataaaaatgtgtgtgtgcaagagtcattggatgatgagaagtgtaacattgctactcatgggaacaaaccagttaatgttttgcaaatgaaagcattagatcttttagaaggaaaaaatgtctgtgaagctctggtgacagaatcaccttccaatcaagccactaatggaagccatggggttgatgttcagtgtgctgatgaggttgtcaaaacaactgacatagttaaacaaactgacttagattttgaaactatggaagtgtctgcaaatgctgatgatgcagccaaagatgttaataatggtggtaatctagggagaattatagatctgtctcgagctacaagttcttcatcccctggtaaaactaggcccatgtcaggcaggtcactgtcgtctcgagctggaagagatgtattgtctgacacacttgatggggataaattacacagaggaagagatgaagtttacattgatggccctcacaaattttctagagaaagacatcaagatatctcccctagaaaaactagaatgaattttgttcgaggtagaggaagacttaacaatcgattagattcagttcgaaatgattgggaatctgaccgtgaattttctggtgagttttataacggaccaagtcagtttcggggacccaggcctaaatatgcatctgcttttgccgatactgatatggagtacaataacgttgcacctgatgggtcatatgttggtaatggtcgattaggcagaaagccattgaatgatgggtcttacattgcaccaaggaggcgttcatcaggaggaagagatggcatccaaattggtcatagaaatccaagaaacattagtccaaatagatgtattggagatggctcggacttggttggagtgaggcataatgaaaaatttatgagaagcttgcctgaggataacatggatgctatgttcacacggccccaaacatttgagggaatggatggccggtttacaagagggagtaggaatttttcttcaatgcagagaaggggtcctcctcaaattcgttccaagtcacccatcagatctaggagtcgctcacccggtccatggtcatctccaagaagaaggtctcctagaagaagatcccctgatggttttggtggacatccagaattaacccatagaagatcaccattttacagggttgacagaatgaggtcacctgatcgtcctgttttccctgcggagagagtggtgaggaggcatggctccccctcttttatgtcaagaccttctaatgatatgagggacatggattctgcaagggaccatggccatccgaggtctggtcgaattttaatcagaaataggaggtttgatgttgtagatcctcgggaccgtgtggataatgatgatgaatactttgggggccccatgcattctggtaggttacttgagcttagtggtgaaggaaatggtgaggataggagaaggtttggtgagagacgaggaccagtgcgttctttcaggcctccctataataataacaatgttggtgagagttttcaccttaatgctgaagacggacctagacattaccgattctgttcagatgattcagattttcatgaaagaggaggcaacaacttaagggaaagggactttgaaagaagaatcaagggccggccagctaatgtgccacctagaagaacaagaaatatggatgagcaagaagagaatttcaggcatggtggtggtggtggtggtggtggtggtggacaggtcaaaggtgtggaacaagaattggatgctgaggatgatggagcagcattaagtggacaaatgaaatag

SEQ ID NO: 18111 - DNA, 1065 bp, Glycine max
  Peptide Sequence Number=SeqID_134889
atggaaatggattcccttcccaacggcaacaacacctccggaaccccgatctccgccaccgccaccgccaaccccgcgcagcctccgtcgtcgaaccttccccaactgacggagtctctgaagctggagcaccagttcctcagggtccctttcgagtactacaagaaaaccctccgtgccaaccaccgcgccgtcgagaaggagatgtccgccgtcatctccggcgtcaacgaagccgccgccaccgacctgtcccccgacgacgccgtcaaccaccttaactcccttgtctcccgcctgcaagggctcaaacgaaagttggaggaaggaagtcgggcagagcatttgcaagcacagaaatgtcgagtgcgtctcgatcacttagaatctgctgatgcagaaaacatgtcagaatggaataacactcgtatgaagcggattcttgttgattacatgttgaggatgtcatactatgacactgcagtgaaacttgccgaaagcagcaacttgcaggatcttgttgatattgatgtattccaagaagcaaaaaaggttatcgatgctctacaaaataaggatgttgcacctgccctagcatggtgtgctgataacaaatcaaggctgaagaagtctaagagcaaattggagttccagttgagacttcaagagttcatagaattagtaagagctgagaacaatttgagagctatcacatatgctaggaaatatcttgcgccatggggagccacccacatgaaagaattgcagcgagtcattgcaacactagcttttaaaagggatactgaatgtgccacatacaaggaggctttccgcacactagccatgccattaccatattcaaagcagcatcactctaagcttgtttgctatataactaaggagttaatggacactgagaacccaccgcaagtcttgcccaatggatatgtttatagcactaaggctcttgaagagatggcgaagaagaataatggtacaatcatctgcccaaggacgggtttagtttgcagctacacagaactggtcaaggcatatatttcataa

SEQ ID NO: 18112 - DNA, 1353 bp, Glycine max
  Peptide Sequence Number=SeqID_134890
atggagatgactccatccaacctggccatgctatgttctgctgctcatttcctggaaatggaatgtgatgatgatgatggtcctgcaggaacacccaacttgaaacctcaaattgaaaaatttcttgatgggattcgtttctggacttggtctgagctccttgaagcattgaaactgtgtcaaggcttgttttctttcaaaggttatttggaaattctggacagaattgtggataacttgatagagaggctagcttcacccggcatcacaagtccaaatacatgttcctccaacaggtcaagctttcagttttcctgtgctactagcagtaataatagttggagaaataactgctctggggctacatggtggtttgaacatcttttgttcttgaagattgatttgttggataaggtcataaggacaatgatatcttatgattttgatcatggtgtggtctctaggtttctgttccactatcacaactcaagttgtcttggtgctgcacaagctgagaagatggagtctactaaggttgtaatcgatcttgttttgctgctagaatcgagatcaatttcttgcaaggatttattcaatcttaatcggtctgctgttagtttgaaaatgagcagaagttgcataaacaagatagaaagtcttataggtcctctgctggatcaaacaacaattgattatctacttcttccatctccacacgggaagggtcaagcatatgatgttgattttgtcctaaggctagtacacatatttttctttggaggtagttttgagttaacctcaaatcgactgatgagagtggcgaaaatgatggatttgttccttgtggaagttgctccagatccccatctcaaaccttttgagtttgaagcattgattacagtgctcccagatgcagcaagggaatctcatgatcaattgtacctagccatggacatgtatctaaaggtccatgcaggactaagtgaaaaagagaagataagtatctgtagtacactgaaccacgagaagctgtcagctgaacttttgaggcatcttactcgaagcttggtgtttccttcagacgcaaaaccaagagcttatgttactagacaaagccgaatgaagaccttgctccaggaaaatgatcatttgaaaaacttttttgagtccatgtttcgtaaaagcttcaagaacatggaagcgaatgaggatgttgaaaagagaagctatgatgctgaagaacttagaggagattgggaaggaatgcagaatgggacccaaatggccagtatgaagaagtcagggacccatattatgagcaatgctatgtacttgccaaaactctgttcatga

SEQ ID NO: 18113 - DNA, 1524 bp, Glycine max
  Peptide Sequence Number=SeqID_134891
atggagagtatgtatatggttgacactatccaaaggcttggcattgaacaccacttcgaagaggaaattgaagctgctcttcagaagcaacatttgatatttagcagtcatctcagtgattttgcgaataaccataaactttgtgaagttgcacttccattccgtttacttagacaaagaggccattatgttcttgcagatgtatttgacaacctgaagagtaacaaaaaagagtttagagaaaaacacggtgaagatgtgaagggtcttatttctctgtatgaggcaacccagctaggtattgaaggagaagacagtcttgatgatgcaggttacctctgccaccaacttcttcatgcatggctgacaagacatgaagagcataatgaagctatgtatgttgctaagactcttcagcatccgcttcattatgacttatcaagattcagggacgacacaagtatacttctaaatgatttcaagaccaagagagaatgggaatgcttagaggaacttgctgaaatcaattccagcatagttaggttcgtgaaccagaatgaaataactcaagtttacaaatggtggaaagaccttgggctgaacaatgaggtgaagttcgctagatatcaacctcttaaatggtacatgtggccaatggcatgcttcacagatccacgcttctcagagcaaaggattgagctcaccaaacctatctctctggtctacattattgatgacattttcgatgtttatgggacattagaccagcttactttatttacagatgctattaaaagatgggaattggctagtacagagcaacttccagacttcatgaaaatgtgtttaagagttctttacgaaattaccaatgactttgccgaaaagatctacaagaagcatggattcaaccctatagagaccctgaaaagatcgtgggttcgattgttgaatgctttcttggaagaggcacattggttgaattctggtcatttgccaaggtcagcggagtacttgaacaatggaattgtgagcacaggagtgcatgtggtgcttgtccattcattcttcctcatggattattctataaataacgaaattgttgctatcgtggacaacgttccacaaattatacattcggtggctaaaattcttcgtctttctgatgatttggaaggagctaagagtgaagatcaaaatggacttgatgggtcatacattgattgctacatgaatgaacaccaagatgtttcagctgaagacgcccaaaggcatgttgcccacttaatttcatgtgaatggaaacgtctcaatcgagaaatcctcacccaaaatcaattgccatcatcatttaccaatttctgcctcaatgctgctagaatggtccctttgatgtaccattaccgtagcaatccaggcctctccactctacaagaacatgtcaagttactgtctaataatgctgtcgctggtgctgagcgacatgtagtgcatattctatgcctgcaatttgttatcgaataa

SEQ ID NO: 18114 - DNA, 489 bp, Glycine max
  Peptide Sequence Number=SeqID_134892
atgttatcatggattgaaaacaataatcacaattctacgatgcaactcacgagttacaggggaactggaaaaggaggttctttgttcttgatagctggggaatgctgtattactatcgtaaacagtgcagcaaatcttctgatcatttcaccaacgaagaactacactttgcaggtagagagtgctctggagcaaatggattggattgaaaagataacaggtgttattgcctcattgttgagttctcagattcctcagagagaagtcttgcttctgtacatcttgagtgcccctcaaggggtttgcagctgcaacaagactggactaaaaagtgagaagccaattcatgtgttacgaagagtttgtgggaacgataaatgtgctgattgtggtgcccctgaacctgattgggcttcactaaatcttggtgttcttgtttgtattgagtgttctggtgttcaccgaaactttggtgtacacatatcaaag

SEQ ID NO: 18115 - DNA, 675 bp, Glycine max
  Peptide Sequence Number=SeqID_134893
atgtcatcttggctgagatctgcggtcaacaaagccgtcgaggtcggcaacaaaaacaacctcactcgcaccgtcaagaactacgccgacaccgtcgttcaacacgccggccaagccgtggccgagggcgccaaaatcctacaggatcgcattagtgctcggaattacagaagtgttgcgcagaccattaaaaggttggaagaagctgctgtctcgtataggggacctgagagagtgcagttgcttagaagatgggtggttgtgcttcaagagattcagaagttgtccgaggcttcattggctgaaggcaaagagaggactctcgagcagcaccttgcggttgaagaagccaaggagaacccaaggaaaccatctctggttctttattacgattctgatgttgggggagaaccattaaatttccgtgatgtttttcttcaaagtcaggcattggagggtataacgttatccatgattattcatgctccgaatgaggaagaggtttcccttctcctggagatgtttggactttgtcttactggaggaaaagaagttcataatgccatagtgagcagcctgcaagatttagcaacagctttttcaagctatgaagatgaagtactggtagatatattcttcagtattaatgctatgtatgctttcttctctctttga

SEQ ID NO: 18116 - DNA, 264 bp, Glycine max
  Peptide Sequence Number=SeqID_134894
atgaaatggtgcagcagactacaaaaagaggaagcattaaaggttcgagtgactaaagatggtgaggctagtgaaaaggagaaggaactggttactgagatatctgaactgcaatgcaaaaaagaagatctcgaagctgaattgaaaaaggttagcactactttggctgctgctcaagcacgactatggaatgtgagggaagagagagaccagtttgaagaagcaaacaatcagatagttgaacacctgaagataaaggtttga

SEQ ID NO: 18117 - DNA, 1875 bp, Glycine max
  Peptide Sequence Number=SeqID_134895
atggcctcccactcaaaccaaccaggtcccggagctgaagggctaggagagaaggaccccccaacaagtttccagaacccgctttctgagatatccccgtcgccgtctccgtcgtcggcgccggcgccggcgctggtgctgtcgaactcggggaagcgaatcgaccaggcggggaagaagaagtacgtgaagcaggtgacggggcgccacaacgacaccgagctccacctggcggcgcagaggggcgacgtgggcgccgtgaggcagatccttgaggatgttgattctcagattatgggaactctgagtggcgatggcgatgaggatgatctgaacgcggagattgcggaggtgcgtgcttgtcttgccaacgaagagaacgagctcggtgagacccctctgttcacagctgctgaaaagggtcaccttgatgtggtgaaggagttgcttaactattccaccgctcagactgtttccaagaagaaccgatccggatttgatccattgcatattgcagctagtcaaggccaccaccccattgttcaggttttgctagattatgactcaggattgagcaaaactattggtccctccaactccactccgcttataaccgcagcaacaagagggcacacggaagtggtgaatgagctgctgtcaaaggattgtagcttgttagagattgctagatccaatggcaaaaatgcgttgcatttagcagctcgtcagggtcatgtggagattgtgaaagccttgctcagtaaagatccacagttggctcggaggactgacaagaaagggcaaactgcattgcatatggctgtaaaagggcagagttgtgatgtggtgaaattgcttcttgaggcagatgctgctattgttatgcttccagacaaatttggtaacacggcgttacatgtggcaaccaggaaaaagcgagtagagctaaatatgccttatctctaccgtagtagtaggataacccaggtcttggtgttgtacctgggatcccgtgaggctgattttaaacatctaaaggtgatagtgaatgagttattacatctgccagacaccaatgtgaatgcattaactagagaccacaaaacagctcttgacattgctgaagatcttcccctctccgaagaggcatcagatataaaggactgtctttctcgatatggagcacttagagctaacgagctcaaccaaccaagggacgaactgaggaaaactgttactcaaatcaagaaagatgttcacacccaacttgaacaaaccaagagaaccaacaaaaatgttcacaatatttccaaagagctaaggaaactccacagggaaggaattaacaatgccacaaactcagtgacagtggtggctgtgctgtttgctacagttgcttttgctgctatattcactgtgcctggtggggatcacaatgacggctctgcagtggtagcagcttatgctgcttttaaaatcttctttgtctttaatgctatcgcactttttacatctttggctgttgtggttgttcaaatcactttggttagaggtgaaactaaagcagagaaaagggtggtagtggtgatcaacaagctcatgtggttggcttctgtctgtacttcagtgacgtttattgctgcttcttacatagttgtgggtaagaagaatgagtgggctgcaattttggttacattagttggaggggtgataatatctggagttattggcactatgacttactatgtagtgaggtctaagagaagcagatcaatgaggaagaaggagaagcaagctgccaggaggagtggatctaactcatggcatcattctgaattctccaattccgaggttgatccgatttatgcgctttga

SEQ ID NO: 18118 - DNA, 1092 bp, Glycine max
  Peptide Sequence Number=SeqID_134896
atggccactacactctttgcatgtgaccctgcagaagatgattacattgacatggaagtcaactcatactccaacttcttctgccattctcaatctcatccacagcctagagaatttgaattccaaatgtcctccattcttcaagagaaagatacaaccaccttaccagccgatgagcttttctacaaaggaaagctcctccctcttcaccttcctcctcggttacaaatggttgaaaaactccttcaaaactccccctccccttatgacaaggaaaatgatatctttgaagagttctatagcactcctctagccactacctacacaacacctactgcaggcaccccatttgaatcctgcaacatctctccatctgattcttgtcaagtaagtagggaactaaaccctgaagagtattacaactttgactgtccaacagatacaagtggatttgctgctgaaaaccagaagaagtcatggaccaagaaactgaagcagtcttcactaggttcaaagttgaaggcttcaagggcttatctcaagtcttggtttggaaaatctggttgctcatatgaaacctatgcaacctcaacaaaagttgcggatgaaggatcggtttccaaggccagggaaaatttaaacaagcatgttcaagtggcaaagaaacattcatatggccaaattcatagggacagatatcatcagccctccaattctgtcatgagaagctacaaagacaagacaggtgaggatggaagtaaccagcacagaagatcattctcagtcggcatcaaactactttcagggaacaagtcatcatcatcaacttcatctgtgtctggctcaacttcattttcattttcattttcaaacaaatcatatggatgccaagcgcgacagctattgaaaaggtgcagcagtgcaaattcagagatagaaaattcaatccagggagcaattgcacactgcaagaagtctcagcaaatgttctcttcaaagaagactgcaagtgaagtaggaatctactcaatgtctgcatctagaacctcagtttgtgaggatcatgagagagtagagctttggaggggctga

SEQ ID NO: 18119 - DNA, 1554 bp, Glycine max
  Peptide Sequence Number=SeqID_134897
atgaaagcttttcgcttgttcctaacactattaattcctttcttactctcctcttttgtttctggttattcatggaatgatgttaagctttggtgcaaccaaactccaaaccctcaaccatgtgagtatttcttgagcaataaccccacttatcaatacaaagccctcaagcaaaaatccgatttcctcaaactttcattacaacttgctcaagagagagcactcaaaggccatgcaaacactctctcacttggttcaaagtgccgaaacccacgtgaaagaggtgcctgggctgattgtgttgagctttatgagcaaactatccgtaaactcaacgaaaccctaaaccctgaccctaacacaaagtactcccaagttgatgcccaaacatggctcagcacagctctcactaaccttgagacatgcaaagccgggttctatgagcttggtgttcaagactatgttctacctttgatgtctaacaatgttaccaagttgttgagcaacaccttgtcacttaacaaggttgaatatgaagaaccaagttacaaagaagggtttccaaaatgggtgaagccagatgacagaaagttgttgcaatcatcttcaccagcttctagggctaatgtggtggttgcaaaagatggttctggaaaatacacaacagtgagtgcagctgtaaattctgctccaaagaatagtagaggaaggtatgtgatatatgtaaagggagggatatacaatgaacaagttgaggtgaaatcaaagaatataatgttggttggagatggtattggaaagactataatcacaggtagcaaaagtgttggagggggcaccacaacctttcgttcagccactgtagctgtagttggggacggatttatagctcaaggtatcacatttaggaacaccgctggtgcaaaaaaccaccaagctgtagcattgcgttctggatcagacttatcagtattttacaaatgtagctttgaaggttatcaagacacgctatatgtccactctgagaggcaattctatagagagtgtaacatttatggcactgttgacttcatatttggcaatgctgctgttgtgttacaaaactgcaacatatttgcaagaaaccctcccaacaaagtcaacaccatcactgcacaaggcagaaccgatccaaaccaaaacactggaatttccattcacaattctagagtcacagctgcatcagatttgagaccggttcaaaactcggttaggacttatcttggaagaccatggaagcaatattcgagaacggttttcatgaagacttatcttgatggcttgatcaatccatcgggttggatggaatggagtggtaactttgcattgaacacactttattatcgagagtacatgaacactggtccaggttcctccactggtagaagagttaaatggccaggttatcgtgtgatgactagggcttctgaagcctcaaagttcagtgttgcaaattttattgctggaaatgcatggttacctgccaccaaagtgccttatacaccttctctgtaa

SEQ ID NO: 18120 - DNA, 645 bp, Glycine max
  Peptide Sequence Number=SeqID_134898
atggctctctcagacatttccactcccaccagttgtccggatgaaaaggaaagtgactgtgactctccgattgaaagcaatgcttttggtgatttgagtttgacaaaggagaaaacttttgatcttcaaactgtgtcacctcattcttttggtcaaggtttgccatatgcacctgaagggtggcctaatccaggtgatgtattgggctggaaagtattgaaaaggacctcccatgctggagacggagcttcagaaccgagctttatgtttagcaatacattgaatcaaattttcctaacttgggaattgaaacattctttgatttatttagctggcagatcccgctactgggaaaactcccagaaaagtcaactaactcagaaattttccagactacttcatcttcgtcaatgcttagcgcctaatcaagatgcaaatatcgtcattgatttttgcgatcagaatgacaaagagacaagaattgattcaactgagatttcaaaaggcatctcagattctgaagaaggatctgctatgcagacaactgtaaagaaagatcccaatgcaaccactgttctagagaatcttgatgaggatcttgataccttggagaacgtgactgttgagcctcatactgagacttaa

SEQ ID NO: 18121 - DNA, 924 bp, Glycine max
  Peptide Sequence Number=SeqID_134899
atgaaccatccttcttctttaccaacaatattgggaaggaaaaaggactgtggctcggatgaattaagctggcctcaagcgtttccaatacttgcttctcaatctctattttctgaaaatggaggaggtgaatgtgatgttggatattgcggggtggaggtaagtgagaaggatcgtaaaaaatggcggaatagcggcgaagaaccgaaatatcggagagggtcaaaacgcttgaattggtgggctgaggtaccctccattgcgtttaaactgattttgggaagcggcacgggctcaggtgaaaccgatagagaaatctcagatgggaaatcgatctcctcgtcggcgatgaagaggtgtggagagtcgcttgaaagggagcttggtggtgggaccgaaagaggtggccaggggtttatggaacatgggagaaggggagggaggcaccctcgagctacgccctctgtccatcaacttatcctcttggagtcatgccaacttcgcggcctaaggaagagaaaggggctgaagtgcctgaacttcgcgctggagttcaggaatcaaacccgagatgaaacaactgagcaagaacgaaggagcgaggccgacgatacgattggccaatcattcgaactcaggccccctggggatcatcgtaaaaagacggagcgaatcaagattctaaagcctaaagcattgcggaccatgacgggaaaaatccattttgcgacatccactgataccaagagagcgctagcccatccattcgattttggaagtaaggaaagaatggatggaatccattttggtgttcagggcgatgtggttttgggtgagggtcgcttggccttggatgaggcgattgacagcctcctccaagcgatcagaggtgacctggcgagtgtggtgttcgggaatgactga

SEQ ID NO: 18122 - DNA, 357 bp, Glycine max
  Peptide Sequence Number=SeqID_134900
atggctgagctaaacgcatcagtctcaagtgtaaatggtaaagagaaatccgacgtggctaggattagagctttagtcatcaaggttttgagatcgtcaaaagcctgggtagccgtcggagtccaaataaattggtccttacgcaaaagggtcgggtgccactccttgggccgaaatgacatggccaaggtagttaagcctgttttgtgcgaagacacatttggattgccggagaagaaattggcgtgtgtgaaagatcgacatgatggtatccaaatgaaccgcatacgaatccaaatcagtgttgcagatgagtatatcatcgaagaacactaccacatattttctcaggaatga

SEQ ID NO: 18123 - DNA, 834 bp, Glycine max
  Peptide Sequence Number=SeqID_134901
atgccttttggcctctgtaatgctccatccacctttcaggcggccatgaatgatgtgttacaatcattcctgagaaaatatgtggtagtgttcttcgatgatatactcatctgcaacactgatttggattcgtatgcggttcatttggataccatcatgtcgatctttcacacacgccaatttcttctccggcaatccaaatgtgtcttcgcacaaaacaggcttaactaccttggccatgtcatttcggcccaaggagtggcacccgaccctgataaagtacaagccatattagcctggccaattcccacgtctaccacagctttacacggatttcttggattgactggattctaccgtaaattcataaagcactacgcaacagtcgctaccccccttacaaaccttttgcgtaaggaccaatttatttggactccgacggctacccaggcttttgacgatctcaaaaccttgatgactaaagctctaatcctagccacgtcggatttctctttaccatttacacttgagactgatgcgtttagctcagccattggtgcgttgcttgccatcacatcttcagttcgcaaatggcgccattatctcctgggcaaccctttcatcatcctcactgaccacaagagtcttcgggatcttatgtctcaagttattcaaaccccggaaattccagtaccggaggctatgtgctggacattatcgatgcctcattttgatttcttggacaatctccaacagactctcttgcgagaccctcagtatgttgatcttctcggtcaactccgctcacgtcctgaagcatatcctgatctttcg

SEQ ID NO: 18124 - DNA, 396 bp, Glycine max
  Peptide Sequence Number=SeqID_134902
atgaagcagtttgaggcagagagagagaaaatcataaaaattcatgaagagaaaaggttggctctgaagaagcagtggcaagagcaggttgaacttgagaaggagttagagaatgaacgcacgcagctcatggacaagtacactttcaaccagactcaagaagaaaattttaaggatgttccttcttatgtatcaacacataaaatttccgccgtgaaggttcgtaatcgggttacagaagattatatagctcaacatgttgaacctatttatagatcaaaggggagtgtcaggcttgctacttatttcccttcaataaacatgagaaaagcaggggaaaaaactgatgttgattctgttgcatgcttagcaatgtatggaagcttagagttgtag

SEQ ID NO: 18125 - DNA, 354 bp, Glycine max
  Peptide Sequence Number=SeqID_134903
atgaaggcctcgtcgaagatcactgtggttcttggggattacaaggagcagtacaatgacgccttggagaacctccacagggccatgaaggccattctgccacacgatctcagcactgttaccgttatgcttagtgttgttatggtgggtgtttctgcctacgataatgggtttgaggagcataaggttagcattactgctaggtttaacaagaaccctaaggactatgccaatcactctaccattcagtggcattgtgtctcagtttatcctcagaaattaggagaccttgtcaccgaacatgttgttcccaccctaaggttcatatactatcacaggagaatgcttgtctga

SEQ ID NO: 18126 - DNA, 462 bp, Glycine max
  Peptide Sequence Number=SeqID_134904
gtggcggaacgtatcagacccgttgcgtacaagttgcatttactgacgtcatcccggattcatccagtattccacgtttcccttctgaagccacatctaggaccagtacctgagaccccagctcggcttcctccatccaccgtggatgaccaccctcttttggtcccactctccattctcgattggaagtgggatacttccgtctctccttcggacaaactggtcctagtccaatgggaaggtttggcaccggaagataactcctgggagcgttgggatgatttgcgagtttcacacaaccttgaggacaaggttgtttttggatatgagggtgttgatagcataactcctatatcagataacacacgagaggccacaccagacaacataccagaggaaaataatattaacaggccaaggagaaccattaagaagcccaattacctcaaagattatgcatag

SEQ ID NO: 18127 - DNA, 1536 bp, Glycine max
  Peptide Sequence Number=SeqID_134905
atgatagcctttcgcttattcctaacactatcagttcctttctttctctcttctttcgtttctagttattcttggaatgacgttaaactttggtgtagccaaaccccaaaccctgaaccatgtgagtatttcctgagcaataaccccactcaccaatacaaacccatcaagcaaaaatccgattttttcaaactttcattgcaacttgctcaagaacgtgccctaaatggccatgcaaacactctttcacttggttcaaaatgccgtaacccacgtgaaaccgctgcttgggctgattgtgttgagctttatgaacaaaccattcgtaaactcaacaaaaccctagaccctagcaccaagttctcccaagttgatacccaaacatggctcagcacagctctcactaaccttgagacatgcaaagccgggttctatgagcttggtgttcaagactatgttctacctctgatgtctaacaatgttaccaagttgttgagcaacaccttggcacttaacaaggttgaatatgaagaaccaagttacaaagatgggttcccaacatgggtgaagccaggtgatagaaggctgttgcaagcttcttctccagcttctaaggctaatgtagttgtggcaaaagatggctctggaaagtacacaacagtgagtgaagctgtaaatgctgcacccaagagtaacagtggaaggtatgtgatatatgtgaagggagggatatacgatgaacaagttgagatcaaagcaaataacataatgttggtgggagatggtattgggaagaccataatcacaagtagcaaaagcgttggagggggcaccacaaccttccgttcagccactgttgctgttgttggagatgggtttataacacaagacatcacatttagaaacactgccggtgcaacaaaccaccaagctgttgcattgcgttctggatcagacctatcagtattttacagatgcagttttgaaggttaccaagacacactatatgtgtactccgatagacaattctatagagagtgtgacatatacggcacagttgacttcatctttggtaatgctgctgttgtgttccaaaactgtaacatttatgcaagaaaccctccaaacaaagttaacacaatcactgctcaaggaagaaccgatccaaaccagaacactggcatttccattcacaattcaaaggttactgctgcctcggacttgatgggggttaggacttaccttggaaggccttggcaacagtattcaagaacagttttcatgaagacttatcttgatagtttgataaatccagagggttggttggagtggagtggtaactttgcattaagtactttgtactatggagaatacatgaacacaggaccaggttcctcaacagcaaaccgtgttaattggttgggttatcatgtcattacaagtgcttctgaagcctcaaaattcactgttgggaattttattgctggaaactcatggttgcctgccaccagtgtgcctttcacctctggtctttga

SEQ ID NO: 18128 - DNA, 221 bp, Glycine max
  Peptide Sequence Number=SeqID_134906
atgaagacttatctagatggctttatcaatcctcagggttggatggaatggagtggtaactttgcattgaacacactttattatggagagtacatgaacaatggtcctggttcttctactgctagacgtgttaaatggccaggcaaaagaagcaagggagatggggtggtgggtgtcaacatgaaaggaaagtgtgaaggaggtatagggaagggaggaag

SEQ ID NO: 18129 - DNA, 165 bp, Glycine max
  Peptide Sequence Number=SeqID_134907
atgagtgttgagaaagcaatttcattggcagacttgttcaaaagatccaaacatgctacaggagatttccatcaacttctcagccacacgcgtttgggtaaaaacaaaatgttaagtcaactaatagccaggaaattccattacactttcacatgcatacagtaa

SEQ ID NO: 18130 - DNA, 183 bp, Glycine max
  Peptide Sequence Number=SeqID_134908
atgattccggaagcattaaaaatccttccagattacggtttctggattataggttgcgtgatcaccttaagagtcactaagggaagaaaatcaaagaggtacaggaagcaaaagctgagaagaaaaccttcaaccagtaggaaactcccataccacaagaaaaatattgacaaatttatctag

SEQ ID NO: 18131 - DNA, 744 bp, Glycine max
  Peptide Sequence Number=SeqID_134909
atggaggatttctttgagaccaaaatatcagaggttgatggtcagacagttgcgttttttggtgttttcgatggtcacggaggttcccggactgcagaatatctgaaaaacaatctgtttaagaatttgagtagccaccctaactttatcaaagacacaaagactgctatagttgaagcatttaaacagacagatgttgactacctcaatgaggaaaagaggcatcaaagggatgctgggtcaactgcatcaacagctatgttgttgggggaccggattgttgttgcaaatgttggtgattccagagtggttgcatctagagctggttcagctattcctttgtctatcgatcacaaacctgatagatctgatgaacgtcgaaggattgaacaggctgggggattcataatttgggctggaacatggagagttggtggtgttcttgctgtttcccgtgcgtttggagacaaatttcttaagccctatgttgttgctgacccagaaattcaggttgccaaaatcataagcttgatcacccacttggaggaagaaattaacggagttgattttattataattgctagtgatggcctctggaatgtcatatcaaacaaggaggccgtgtctttagtacaaaatatcacagatgcagaagtggcgtccagagaacttataaaagaagcttatgcacgaggaagctcagataacatcacctgtgttgttgttcgatttgatctatcctga

SEQ ID NO: 18132 - DNA, 1389 bp, Glycine max
  Peptide Sequence Number=SeqID_134910
ttgattcttgaacgtagaggccaaccatgctacatgttggcctacgagtgcttcatgcccccggaagacacgaaactcgacacggactccgcagcaaaaatcgtgctacgaaacaaaaaactgaggttggaggagttaaggtttctcctgaaaaccatcgtgagttctggtattggagagaacacttactgccccagaaccgttctcgaagggagagaagagtgtccaactctcaaggacacgtacgaggagatagacgagatcatgttcgacacactcgacaacctcttcaagaagacaggaatttcaccctccgagatagacttccttgtggtgaacgtgtccttgttctccccagcaccttctctcacagcacgcatcataaacaggtacaagatgagggaaaacatcaaggccttcaaccttgccggaatggggtgcagtgcaagtgttgttgctatcgatgtggtgcaacagcttttcaagacttacaagaactccgttgggattgttgtgagcaccgaggatctcggtgcgcattggtactgtggaagggacaagaagatgatgctctctaactgtctctttcgctctggtggctgctccatgatgtttacaaacaaggcttctctcaagagccgtgcgatattgaagctcaagcacatggagaggactcagtatggtgctgatgacgaggcttacaactgctgcatacaggtggaggatgagttagggtattcaggttttcgactcaccaagagtcttgtgaagagtgctgctcaagccttgacggtgaatcttcaaactatggcgcccaagattctgccactgtgggaaatggtgaggttcttttttgcatctataaggtatagtgggatgaagaagagggagctgctaccctttctcactgggatggttcttggaaagggtaataagaagaagacaaagtttaatgtgttgggagggggtttgaatttcaaggctgggatagagcacttttgtgtgcaccctggtgggagggcagttattgatggggttggtaagggtttaaggctgaatgaatatgaccttgagcctgcaaggatggcacttcaccgttggggtaacacttctgctggtggcctttggtatgttttggggtacatggaggccaagaagaggctcaagaagggtgataggatcctcatgattagtcttggagccggcttcaagtgcaacaactgtgtttgggaggtgatgagggacttgtctgatactaatgtgtggaaggactgcatagaaagttaccctccaaacacactaaacaacccttttaaggaaaagtatgactggatcaatgatgaatatcttagctttgtgaggttggattttagcaggatggtcctttaa

SEQ ID NO: 18133 - DNA, 234 bp, Glycine max
  Peptide Sequence Number=SeqID_134911
atgatctcaaactcggaccccgtagaaccagtcacggcaaccgccactgccggcgccgacgacgccaccgtctcaacaaccgcctcttcttccaatgaagatcagcctgcaccgccggcggcaccaaacattgtgatgtcctccaaggatcacgattctctcttcagcggtggcggcatcaggctgttcttctttgtttacccagctttccaatcctctgctggtttcaattga

SEQ ID NO: 18134 - DNA, 129 bp, Glycine max
  Peptide Sequence Number=SeqID_134912
atggctggcttcacttcatccccaatgagcacaaatgtcaccgatgaaatccgaaaacttattaagatggtgtattgcgacagtgcttttcttaacgtggctggaggacaagggagcaagaagcaatga

SEQ ID NO: 18135 - DNA, 1263 bp, Glycine max
  Peptide Sequence Number=SeqID_134913
atggcacttcggttccccaagttggatttcaagtcttttccctttactgagaacctcaaccctgaattgctaggtcacgccggtgtcgcggtcggcgtcgtggaggctggtgatgtcgggggtggtgatgaggatggcctcgttggctggcgtgatggcggtgatgaagctggcgtcaatgccagcggggcagtcgatgaggatgaagtcgaccagcgctgtgaacgtgctttcagcacgtccacgagccaggcggcagtcaccattcaggacctcgatcacggtgtagttgacgcgattctcgatgtcgaggaggaggtcgaggttgcggaggctgacgtcgacgtcaatggcgaccacggagaagccaagacaagcgagggagaggccgatgttggcggtggtggtggtcttgctcacgccacccttgctggaggtgatgccagcgacgcaggggatggagccgaagagctcaggcttgcgattccactggagagctcgtggagtcgtggcttccacaagagagtagagaaaagaagcttggaccccaaaaatttcaaggaatttaaactcataaagaagactcagctcagccataacgttgcaagattcaaatttgcccttcctactccttcttcggtattgggccttcctgttggaaaaaacatacttgctaggggaaaagatagccaaggagaggaagttatgagatcatatactccaatcacgttggattcaaatattggctacttcgagttggttgtgaagatgtacccgaatggaaagatgtcccaccattttagacaaatgaaggaaggtgatttcttggccgtgaggggccccaagggacgtttcacttacaaacctggccaagttagggcatttggaatgattgctgggggctcaggcataactccaatgtttcagctcataagagccattcttgaaaaccctaaggacaaaacaaaggtgcaccttgtttacgccaatgtaacagtggacgacattctgttaaaggaagaactagataactttgcaaacaaatttgctcaaagatttgaagtctaccatgttcttaataagcctcctgaacaatggaatggtggcattggatttatatcgaaggagattattaaatcacattgtcctgaaccagcccaagatattcagatacttaggtgtggtccaccacctatgaataaagccatggctactcatcttgacgcacttggctacacatctaacatgcagttcgagttctaa

SEQ ID NO: 18136 - DNA, 207 bp, Glycine max
  Peptide Sequence Number=SeqID_134914
atgttggaagatcggaggcaggtctatggtgttgttctggccctggatgtggtcaaacttcagataccactgcttgatgtccagtgcagtggaatcctacaccagatggatcgagtagtgaagatcaattgtggtggtgcagttcacttgggaaatcagaaggcattttgtggtgccgtctttagggactctaaggatagcttttga

SEQ ID NO: 18137 - DNA, 565 bp, Glycine max
  Peptide Sequence Number=SeqID_134915
atgggtggtgataataatgttagtaaccctcccgcgaaagaaagaaagacgccagcttatcattaccgctaccgccattgcaaaacgacgatagtaaggggtttaaggttggacaggtttattcctaatcgctctgcgatggacttcgattatgcgcattatatgctcacggaagggaacaagaagggaaaagaagagaaaaagaaccctctggtgatgtcaccatcgcgagaagcgtaccagaagcaactcgctgatgccttcaacatgaaccggacccgaattttggccttcaagagcaaaccccgaacgcggcgggttgaactcattcccaattccatcttttcccctcctcctccacccatttcctctaagcatagacgccacattcctcagagttcggagagggtattggatgctccggatatactggatgacttttatttaaatctgttggactggggcaacaacaatgttttgagcattgcccttggaaacaccgtgtatatatgggatgcatcttatagctccacggctgaacttgtcactgtggatgaggaagagg

SEQ ID NO: 18138 - DNA, 168 bp, Glycine max
  Peptide Sequence Number=SeqID_134916
atggtgactggtgcagagaataaaacttcaagcagcaatgggtttgctgtcaacaaagaagcagcagctttgaagatcactaacattaaaagcaggattttacaacaatttcactccaactacaattccatgtgctatctgagtcattcggagggattaacatcgtaa

SEQ ID NO: 18139 - DNA, 381 bp, Glycine max
  Peptide Sequence Number=SeqID_134917
atgacttacgtgaaatgtggatcactggtggattcccaaacacatattgagattacttactttatcaccaggtgttgctttgggcagcatgacaagaccatgctcattggacctgacccaactcacatagtcacattggtgatagatgcatccgggcaacgacaaccttgcgtgagatttggaaaagttcatctgtacaacaattacaccagaaactgggggatatatgctgtctgtgctagtgtggaatctcaggttcatcagctcatggcctatcttgttctaaaatttaatctgagaacaatactaaaatgcaattccttaggtgttactgttttcagagttcttcaattcagattagagtttcatctcaatgagtaa

SEQ ID NO: 18140 - DNA, 336 bp, Glycine max
  Peptide Sequence Number=SeqID_134918
atgcttgttttgaaacctgacgcccttcgagctggaataagtgctagtgatgctgcaaggacactaggggttgctccagcaatggcaaaggagcatctcttgtctgcagagagcaaaggtttactatgcagagatatcagccctgatggatttcgcttttatattaacttgtttgtggaaattgaccgagattatatgtatttttttgacttattgatattccagcaaaactgttccccctggagcccccttgagctaaaacttgctcttggttggacaattcacagttcttcaagcatcaagcctgaaaaaggtgttggcaatctacttggttag

SEQ ID NO: 18141 - DNA, 342 bp, Glycine max
  Peptide Sequence Number=SeqID_134919
atgtatttattggagaagccatctttcaactattgtgaaaaaagttcttctcatttaacttgtccacattctaagcgcaaggtaggcgggcctaagcattatccaaactatgggcctaaagggttcttgcacagaggggtattaaccgtggctttcgtattagggcttgcacagattgctcatcttgttgctttttctcaccttttgttgcaggtcaggtctctcacactggatgcaagtttgggaaccttctgtgataagtttgtttcagtctcttgggaatgcttttgccaacacggtctgggaggaactattggaatcaagaagttcatttcaggttga

SEQ ID NO: 18142 - DNA, 3645 bp, Glycine max
  Peptide Sequence Number=SeqID_134920
atgtatctctacagtctcactctgcagcgtcccaccggcatcatctgcgccatcaacggcaacttctccggcggcaagagtcaggaaatcgtggtggcccgtggcaaggtcctcgatctcctccgccccgacgacaacggccggatccaaaccatcctctccgttgaaatcttcggcgccatccgctccctcgcccagttccgcctcatgggtgcccagaaggactacatcgtcgtcggctccgattccggtcgcatcatcatcctcgaatataacaaggagaagaacgtcttcgacaaaatccaccaagaaaccttcggcaaatccggttgccgacgaattgtccccggccagtacctcgccatcgatcccaagggtagggccgttatgattggcgcctgcgagaagcagaaacttgtttatgttttgaatagagacaccgctgctaggttaaccatttcttcccctttagaggctcataaatcccacactttagtttactcaatttgtggcgttgattgtggctttgagaaccctatttttgctgctattgaattggattactccgaggctgaccaggattccactggccaggctgcttctgaggctcagaagcatttgaccttttatgagcttgatcttggccttaaccatgtctctaggaagtggtctgagcaggttgataatggggcgaatttgcttgttactgttcctggaggtggtgatggccccagtggtgtgcttgtttgtgctgagaattttgttatttataagaatcagggacatccggaggttagggctgtgattcctcggcgggccgacttgccggctgagcgtggcgtgcttattgtgtcggctgctatgcataaattgaagaacatgttcttcttcctcctgcagacggagtatggggatatttttaaggtcaccttggaacacaataatgatcgcgtctcggagttgaagattaagtattttgatacgattcctgttacagcttcaatgtgtgtgctgaagtcggggttcttgtttgcagcgtcggagtttgggaaccatgctctgtatcagtttaagtctataggggatgatgatgatgtggaggcatcgtctgccacgttgatggaaactgaggaaggttttcagcctgtgtttttccagcccaggaggctgaagaaccttgttaggattgaccaggttgagagtttgatgccgatcatggatatgaaggtcagtaatctctttgaagaggaaactcctcagatttacactctctgtgggcgtggtcctcgatcctctttgaggatcctgagaactggtttagcagttagtgagatggctgtgtccaagcttcctggtatacctagcgctgtttggacagtgaagaagaatgttattgatgagtttgatgcatacattgttgtgtcattcacaaacgctacacttgtgctgtccattggtgagactgttgaagaagtcagtgacagtgggtttcttgacactactccctcccttgctgtttctttgataggagatgattctctcatgcaggttcacccaaatggtattaggcatattagggaggatggccgtattaatgaatggagaactcctggaaagaggagtatttcaaaagttggatcaaatacacttcaagtggttattgcactcagtggaggggagcttatatattttgaaatggatgtaacgggtcagttgatggaggtggagaagcatgaaatgtctggtgatgttgcttgtttggacattgctccagtacctgaaggcagacaaagatctcgatttcttgcagttgggtcatatgacaagaccatccgcatcttatcacttgatcctgatgattgtatgcaggctctaagtgtacaaagcgtttcttcagctccagagtctcttctttttcttgaagttcaagcatctgttggcggtgaggatggtgcagatcatcctgctagccttttcttgaacgccggcttacagaatggtgtcatgtttagaactgtggtggatatggttacaggtcagctttctgattctcgttcccgattcttaggattgagagctccaaagctgtttcctattattgtgagaggcaagcgtgctatgctttgcttgtcaagtcgaccttggcttggttatattcaccaaggacatttccttttaacgcccctgtcatatgaaacccttgaatatgctgcctcattttcatctgaccaatgtgtggaaggtgtagttgctgttgctggtgaggccttgaggatttttaccattgaaagattaggagagacatttaatgaaactgtaattccattaaggtacacaccaaggaaatttgtgctgcaacccaaacgaaaacttcttgtgatgatcgagagtgatcaaggagcattaactgcggaagagcgtgaagctgcaaggaaagagtgttttgaggctgctcaagctggggaaaatggtactggaagtgcagaccaaatggagaatggtggcgacgatgaagataaagatgatccactttcggatgagcattatggttatccaaaagctgaatctgataaatgggcttcctgcatcagagttcttgatccaaggacatcaaatactacttgtcttttggagcttcaggagaatgaggctgctttcagcatttgcaccgtaaatttccacgataaggaatacggaactcttttagctgttggcacagcgaagggactgcaatttttgcccaaaaggactgtaactgctggatttattcatatttataggttcgtagaggatggaagatctcttgaacttctacacaaaactcaagttgaaggtgttcctcttgctctatgtcaatttcaaggaagattacttgcagggataggacctgtgctcaggctgtatgatttggggaaaaaacgattgttaagaaaatgtgagaataagctattccctaacacaatcatctccattcatgcgtatcgtgatcggatttatgttggtgatgtccaagagtctttccattattgcaagtataggcgtgatgaaaaccaactttacatatttgctgatgattgcgttccaaggtggcttactgcatcataccacatagattttgacaccatggcaggtacagacaagtttggaaatatctattttgtgcggttgccacaggatgtttcagatgagatagaagaagatcctactggtgggaggatcaagtgggagcagggaaagctgaatggagctcccaataaggtggaagaaattgtacagtttcatgttggtgatgtggtcacatgcttgcaaaaggcatctcttataccaggtggtggagagtgcattgtatttggaacagttatgggaagtgttggggcattacatgcctttacttcacgagatgatgttgatttcttttctcatttggagatgcatatgaggcaggatcacccacctttgtgtggaagagaccacatggcatatagatctgcctattttcctgttaaggatgttattgatggggatctatgtgagcaatacccaacattgccaatggatttgcagagaaaaattgctgatgaattggacagaacccctggagagatactgaaaaaacttgaggaagtgcgaaataagattatttaa

SEQ ID NO: 18143 - DNA, 366 bp, Glycine max
  Peptide Sequence Number=SeqID_134921
atgaaagttagggttttcaacagcaatacctcatttaggtggggaagagtaatgttggagaacatcatcataagggtccctccgaccagccacttggttaatctgggcatcccgtgcaagctgagaattgtggcgctcaaatgtccagaaaccatagggtcacatagggtagctccacatctccttcgtcttctcacacctgtccttcactctataaacaagctccctgaacctccgatccctttcctttgggtcttccatcaacttcaataccaagttctctgcaaatttcatgatgaagcccaacttttcctctcttatcttctgatcatacaaaccaaaaaccccaaatttcatcagttgtaa

SEQ ID NO: 18144 - DNA, 162 bp, Glycine max
  Peptide Sequence Number=SeqID_134922
atggaacaagattcggctcttgctaaatacacctcttgtgtgctaatggccccgcatcatatatgtgaaactcatgctatgtggctaatcaggcgtctcatggaatttgtggaatctcaaagtaacaattacatcatgattatgttaatgggagaaatctaa

SEQ ID NO: 18145 - DNA, 1098 bp, Glycine max
  Peptide Sequence Number=SeqID_134923
atgggtagagtttggttcacggcgccgttgacggcgctgttactgctcgcattttcctccgcggttagttcgtgtccacagtcggacctggcggcgctgttggccttcaaatccgctctccgggagtccaacgacggcatattcaacacgtggaccggcaccgactgctgccacaactggtacggcatctcctgcgaccgcaacacccaccgcgtcgccgagatcagcctccgcgccggtcccgtctacaccaccttcgagaagcccttccgtcctggctacatgtccggttccatctcgccggagatttgcaagctcactcacctctccagcatcatcatcaccgattggcagggaatctccggcgagatcccgcgctgcatcacctccctcttcttcctccgcatcatcgacctcaccggaaaccgcatcgccggcactctcccctccaacatcggaagacttcgccatctgactcttctcagcgccgccgataacgtcatcgccggcataatcccgccgtcgctaaccaacgtgaccggtttgatgcatcttgacctccgtaacaaccggatcttcgggcccatcccacgaagcctgggccggcttcaaatgctgagccgcgtccttttaagcgggaaccatattagtgggcccatcccgcgttcattctgtcatatatatcgtctggtggatctggacctctctaataaccgtttatctgggtccatccctgaagctttgggccgaatgaaggtactatcgacgttgaagttggactctaacaggctttcgggaagtataccggcgagccttttgggctcgggtatcagtgagttgaacttgagccacaattatttggagggaaatatacctgactcgtttggaggtagctcttatttcacgttactggacttatcgtataataacctcaagggcccaatacccaaatccatgtcttcctcttcctacgttgggtttgtggactttagccacaaccacctctgcggcccaattcccagcagctacagtgatgccgatgcgtcgtcgtttgattacaacgattgcctttgtggaaagccactcaaagcttgctaa

SEQ ID NO: 18146 - DNA, 768 bp, Glycine max
  Peptide Sequence Number=SeqID_134924
atggtgtcagacatcctgatttcaatttcgaagcaagagctagctagcttggtcaaccttcaagcaaacgcgtttcgtgcatgcacacaggataaggcaatcgttgtaatcaaacgacgacgcatcggcatcactgtagctgctgggaattgggccgcagaggtggttgtggctaaagtccacaaacccaacgtaggaagaggaagacatggatttgggtattgggcccttgaggacgcggctcagcatttgaagccggcccaggcttcgtgggatgggcccgaagatccggttgttacggagatggcgaagtcttccgatgttggaggggagagtgccggcgatgcggtttccggtgaggtcgatgatgcggaggaagaagagggaggtgatgcagcgcgggatctcgccggagattccctgccaatcggtgatgatgatgctggagaggtgagtgagcttgcaaatctccggcgagatggaaccggacatgtagccaggacggaagggcttctcgaaggtggtgtagacgggaccggcgcggaggctgatctcggcgacgcggtgggtgttgcggtcgcaggagatgccgtaccagttgtggcagcagtcggtgccggtccacgtgttgaatatgccgtcgttggactcccggagagcggatttgaaggccaacagcgccgccagtatgaaggttttgagaagagggaaaaagaaaatttagagatgcgcgatttgtgcatgcatatgcatgagcatgagagttag

SEQ ID NO: 18147 - DNA, 1431 bp, Glycine max
  Peptide Sequence Number=SeqID_134925
atggtttcgcgccacctgtttaaatggaccaaagaagtctcttatgcagactattacgaacgtgccttgaccaatggtgtgctcagcattcaaagaggaaccgatcctggagtgatgatttatatgcttccactaggtcttggggtttccaaggctaaaacttaccatagttggggaacaccatttgactctttctggtgctgctatggaacgggaattgaatcgttctcaaagctgggagattctatctattttgaagaggaaggcaaagatcctacactttacatcattcagtacatatcaagctcgtttaattggaaatctggcaaagttttgctcaatcagacagttgatccagttgcttcatgggatccttacctacgagtggcatttacgttttctccatttgaggggaagaaggtacagactgcctgcaaaggcactcaaacgtcgatatgtgaaccagcagattggagcacccagcctcaaacagaaaatactttgactacaaactctacattgaactttcgactcccaacttggactcatctggatggtgccaaggggatattaaatgctgaaactttatctctaccaagtccaggaaattatttatcaatcacaagacaatggagtggtagtgacaagctgacccttcagctgccccttaccgtaaggacagaggccataaaagatgacaggccagaatatgcctctgttcaagcaattctttatggtccttatcttcttgcgggtcatacaactggtgttgattgggatcttaaagctggggctaacaattcagactggattactcctattcctgccagttacaatagtcaactagtttctttttctcaagactttgaaaattcaacttttattttggcaaattcaaatcaatcacttgcaatgcaaaaattgcctctatctggcactgatttggctcttcaggcaacctttaggcttgttgtcctaaatgaatcttcctcaaagttttcaacattggcagatgctaatggtaaatcagtgatgttagaaccatttgattttcctggaatgaatgtggttaaccaaggagcagacaaacctcttctcatcatagattcatcccatggcgggacatcttctgtttttcttgtagttccgggactggatggacgaaatgaaaccatatctttagaatcccagagctacaatggctgttatgtgtatagtggtatgagctctattgcaggagtgaagctcagttgcaaatctggttctgatgctagttttaaccaagcaacaagctttgttgctcaaaaaggattgagccaatacaatcctatcagttttgtggctaaaggggcaaacaggaattttcttttggagccactattctcattcagagatgagcattatactgtttatttcaacattcaaggttga

SEQ ID NO: 18148 - DNA, 1907 bp, Glycine max
  Peptide Sequence Number=SeqID_134926
gttatggaatgggtagaaatgggttcgttcaaaaagtggtgggtgacctttgtttcctcgattcttcacccttcgccaagttattggactcttgcgttaggtcaaagtctgaaattgatgcgcgtcgcattcatgctcgaatcagtaagacacagttttcatatgaaatctttattcagaacaggctcgttgatgcttataggaaatgcggttattttgaggacgcacgcaaggtgtttgatcgtatgccgcagaggaacactttcagttacaacgcgattttaagcgttttgacaaagcttggtaagcatgacgaggctttcaacgtttttaagtcaatgcctgatcccgaccaatgctcgtggaatgccatggtgtcgggttttgcgcaacatgatcgctttgaggaggctttgaagttctttgttgacatgcatagtattcgtttgggagtgctcttagtgcttgtgcagggcatgggttctgctcttgttgatatgtactccaagtgtggggtggtagcttgtgctcaaagggcttttgatagcatggttgtgaggaatatagtttcttggaacagtttgattacgtgctatgagcaaaatggtcctgcggggaaaactctggaggtttttgttatgatgatggataatgtggatgagcctgatgagattactctggccagtgtggtcagtgcttgtgcgagcctgtcagcaattagggaaggtttgcaaattcgtgcctgtgttatgaaatgggataagttccggaatgaccttgtggcagccagtgtgaaagcagcgaggttgatgttttcaaacatgatggagaagaatgtggtgtgctggaatgtgcttattgcaggttacacacagaatggagagaatgaagaggcagttagacttttcctcctcctaaagagggaatctatctggccaacccattacacctttgggaatctacttaatgcatgtgcaaatctcaccgatctgaagctaggtagacaggctcacactcacattttgaagcatggattttggttccagtctggagaagaatctgatatttttgtggggaattctctcattgacatgtacatgaaatgtggaatggttgaagaaggatgcctggtttttgagcacatggtagaaagggatgttgtctcatggaatgccatgatagtggggtatgcacagaatggttatggcacagatgcccttgaaattttcaggaaaatactggtatcaggagaaaagccagatcatgttactatgataggagttctatctgcatgtagtcatgcggggcttgttgaaaaaggacgtcattacttccactcaatgaggaccaagcttggtttagcaccaatgaaggaccattttacatgcatggctgatttactgggtcgggccagttgccttgatgaagcaaacgatttgatacaaacaatgccaatgcagccggatactgttgtctggggatctttacttgctgcttgtaaggttcatggaaacattgaattagggaagtatgtggcagaaaagctcacggagattgatcccttgaactctggactttatgttcttctttcaaatatgtatgctgagcttggtagatggaaagatgtggtgagagtccggaaacagatgaggcaaaggggagtaattaagcaacctggttgcagctggatgaaaattcagagtcatgtgcatgttttcatggtgaaagataaaaggcaccctcgtaagaaggacatccattttgttctgaaatttctcacagaacagatgaagtgggctggctatgtgccagaagctgatgatgatgagatttgtgaggaggaaagtgactctgaacttgtcttgcattatgaaatggaaacggatgttgatactgcagttgcataa

SEQ ID NO: 18149 - DNA, 264 bp, Glycine max
  Peptide Sequence Number=SeqID_134927
atgatgttccatcccatacgcctcaatttgtggggtggggttggggaaaaggacactgatgaggaaattgaatggactaaaattataaatagcgtaagtatacaggttctcctagaaactggtaaggcaagtatgggagcaagttctagagatggaagttctgggttgagcccaattgaaatttactttgagaattttggtggattattgtgcatccaagttttgagccaacaagatggagatccaattaaatgggaaccgtga

SEQ ID NO: 18150 - DNA, 606 bp, Glycine max
  Peptide Sequence Number=SeqID_134928
atgctggtgtggtggatgttgatccatcactggtatcaaagagccccattgatgactttcaggaacattctgttccaaattcttgaagatggagggaatactagaagcctgacccttgaagaggtaacagatactatacttttttgcagctctatcatccatgatcttgcacatcaggctacaacgacagcaatggaaaatgaacactcagaaccattggaaggttctgagccaacggtgactatattggcgaaaaccaattccgataccaaggactctcagcagccgaactgctggcaagggtgcatgaaaccccagaaggaagcaaggctgagaatgatgaaaatattgatcagtttgacacccaatgttggacttcctaacaaagacattaatttgaggcatttggaggattgtgctcctccagttgccccatttttgttatttgatttccatctcaatgaagtgatccatcaatggaagtgtgaagtagaactcattcatattcgttttaaaaagaaaacacagatcatgccatactattattacatatcaatatggctactaaatgttgatataattaacgaaaacagctacactgagtag

SEQ ID NO: 18151 - DNA, 1143 bp, Glycine max
  Peptide Sequence Number=SeqID_134929
atggaagcttttgtgtttgtgtttgtggtccttgtgttgtgtggttgtgctgctggtaaggagtgcacaaacattcctacacaatcacacacgctaaggtaccagctattgacatccaagaatggaagattggaggaaaaggccatgtctcactttcatttgacgcctacagatgaatctgaatgggcagatttgctgccgaggaaattattgacagaacaacatcaacacgattgggcggttatgtataagaatattaagaacatgggtgtgttcaagtcacctgaaggctttctcaaagaagttcctcttcaggatgtgaggttgcatgaggattccatccatggtatagcacaacagacaaatttggagtatcttttgatgttggatgtggacagcttgatttggagctttaggaagacggctggtctatccacacctgggactccttatggagggtgggaagctccagacgttgagctccggggtcattttgttgggcattacttgagtgcatcagctctaatgtgggccatcacacagaatgataccctgaaacagaaaatgtcatacctcgttgctggtctgtctgactgtcagaagaaaattggaactggatatctatctgcctttccatctgagttgtttgatcgatttgaagctattcaagaagtttgggctccatactataccattcacaagatcttggccggcctcttggaccaacatacttttgctggaaaccctcaagctctaaaaatggtaacatggatggttgattacttctacaacagagtccagactgtaataacaaagtacactttaaataggcactatgaatcactgaatgaggaaactggaggaatgaatgacgtcctttataagttatacatcataacgggagattctaagcatctattgttggctcacctttttgataagccatgctttttagggttgcttgcagtgcaggctaatgacatagctgattttcatgctaatacacatatcccagttgttgttggatctcaaatgcggtatgaaatcacaggcgatccactttatcagtttatgtatgttttcaacaatataagtagtcagtggcatgcagaatcaacctattcactaggtaatataacttga

SEQ ID NO: 18152 - DNA, 1230 bp, Glycine max
  Peptide Sequence Number=SeqID_134930
atggaggatccgtttagcaatttgccagatgaaattctaagctgcatagtttcttttctgccactagaaaccagcctcatatctactaggtggagagacctgtggaaccaagcccttgttagacatggaagcacacaagacgacgtagctagtgttgttgctggttttctgtctcgttttgaagagcttgatccattaaaacatcctcgcaaacttcattttcacttttctgatcaagacactgcactctttgcatccattgcaaccaacagtaagcttcttcttgatttccctgctgggatcaaagacctcaaaaagcagtatgagctcaagtttatactcaacaagcatcacatcacacacaacactgtcccccccactttcttagtcaaaactctttatttgaaatcagtgagtcatttgactagtgagttgatttcctccatcgtttcaaatttagagcatcttgagaagttggtgattgttgagtgcaccgggttgcaatctttgttcattgagtctgaatcaaagcttcacgagttaaccatattagattgcccccagttgaagtctctccatcttagaacttctaagcttaaaagtttcagacttgatggacctcttccaacgatttggccagaatcccatttcaaccttagccatgccatgcttaatttcagacttggaccaagctgtgctgacttcaaggctcaatatttcaaccaaacactgttgacaataaagaattgtgaagctctcactttatgtgagtggacttttcaggaattgatatggccatcgatttctccaagtgggaactttatattctataaaataagagagctatggtggattcacaaccataggggtgaaaatagcatggacaccttagtctcctttttgaaattatgtcctgccttggagcaactttttgtgacgaatgattctacaagttattcggctccacggtccaattcatattgtttaacgcaagaaactgaatatagtacaaaattggagcatctaaaacggataaagtttatgggatttacaaatcgagtggatgaaatctcagtggcaaagaaattgattgaattagtcaagggagagcctccaaagatagagacatcggatgagagttgcttgaataaaggaaaattatatgaacaagtcatttcccatgctctttcaggctggggctggcatagcgttataattcagaagagataa

SEQ ID NO: 18153 - DNA, 4353 bp, Glycine max
  Peptide Sequence Number=SeqID_134931
atgatggtttctcggggactgttcgggtggtccccgccgcatatacagcctctcacgccggtctccgaggtgtccgagccgccggaatcgccttcgccgtacctcgacctcggtgccgagacctccacgtctcagcccatggaggtcgaggaggagatggaggaggccgacgagattgagcctccgcccgccgccgttcctttctcccgcctcttcgcctgcgccgaccgcctcgactggtttctcatgcttgtcggctccctcgccgccgccttgcacggcaccgctctcgtagtttacttgcactacttcgccaaggttctccgggttcctcagcagggttcgccggaagagcagtttcacaggtttaaggagcaattgctggtatacggacgtttaaagggttttgggggaaattcaaacaaaggattaattaaggtattgatggatgaattttgttgctatatgccaaggaaacttgcattaaccattgtttatattgctgggggagtttttgctgctggttggattgaggtttcatgttggattcttactggagaacggcagactgctgtcatcagatcaaattatgtccaagtattacttaaccaagatatgagcttttttgatacttatggaaataacggagacattgtgagtcaggtattgagtgatgtgctgctcattcagtctgctctcagtgaaaaggttgggaattatattcataatatggcaacattcttcagtggtcttgttattgctttcatcaattgttggcaaattgcattgataacattagctacaggtccatttatcgttgctgcaggaggaatatcaaatatattcctccataggcttgccgagaatattcaagatgcatatgctgaagcagccagcattgctgaacaggcagtttcatatgtaaggaccttgtatgcatttacaaatgaaacattggctaaatattcatatgcaacatcactgcaagctactcttagatatggcatattaataagtcttgttcaaggacttggccttggttttacatatgggcttgcaatttgttcttgtgcattacaactctgggttggaaggctcttgattatacatggaaaagctcatggtggtgaaattataacagctctatttgctgtgattctaagtggcttgggattgaatcaagcagcaacaaatttctactcatttgatcaagggcgaatagctgcctatagactgtttgagatgataagccggtcatcctcatcttttaatcatgatggcagtgctccagcttctgtgcaaggaaatatagagtttcggaatgtttacttcagttatctttctcgccccgaaatccctatcttgagtgggttttatctcactgtccctgctaaaaaaactgtggcacttgttggcagaaatggctctggaaaaagtagtattattcccctcatggagcggttctatgatccaacattaggggaagttcttttagatggtgaaaatataaagaatatgaaactggaatggttaagaagccaaataggactggtcacccaggaacctgctttactcagtttgagtataagagacaacattgcttatgggagagataccaccatggatcaaattgaagaggctgctaaaatagctcatgcacatacctttatcagctcattagataaaggttatgacacacaggttggcagggctggtctagctttgacagaagagcagaaaataaaactttctattgcaagagccgtgcttttaaatccatccattcttctgcttgatgaggttactggtggacttgattttgaggctgagaggtctgttcaggaggctctggatctcctcatgttgggacgatcaacaatcataattgctcgaaggcttagtcttataaagaaggctgattatatagctgttatggaagatggtcaacttgttgagatgggtactcatgatgagttactcaccctggatggcttatatgcagagcttcttcggtgtgaagaggccacaaaacttcccaagagaaaatcactttgttcatcatccaggatgcctgttcgaaactacaaggagactgcaactttccaaattgagaaagattcttcagaaagtaatagcttcaaagaaccttcatctcctaaaatgataaagtcaccctctcttcagagagtttctgccatatttcggccttcagatggcttctttaactcacaagaatcaccaaaagtccggagcccaccatctgagaagttaatagaaaatggccagtctttagattcatcagataaggagccatcaataaaaaggcaggatagttttgaaatgagactaccagagttacccaagattgatgttcaatgtgtgcatcgacaaacatcaaatggttctgacccagaatcccccgtttcacctcttttaatgtctgatcctaaaaatgaacgctcccattcacaaacttttagcagacctgatagtcattctgatgatctttcagtgaaaatgagtgaaacaaaggatgctaggcatcgaaaacaaccctcagtttggaggctagcagagcttagttttgcagagtggctttatgctgtgttaggaagcataggtgctgctatctttggttctttcaatccccttcttgcttatgttattggcctggtggtgacagattactatagaattgatgaagctcagcacttacaaggggagataaacaaatggtgcttgatcattgcctgcatgggtattgtgacagttgttgccaactttttacagcatttctattttggtattatgggggagaaaatgacagaaagagttaggagaatgatgttctcagccatgcttcgcaatgaaactggatggtttgatgaagaggaaaatagtgctgacaatttatccatgcgcttggccaatgatgctacatttgtgcgagcggcattcagtaaccgactttccatatttattcaggacagtgctgctgttattgttgcttttctcattggtgttttgctgcactggcgattagctcttgtggccttagcaacacttccagtcctttgtgtttctgctcttgcccagaaattgtggcttgctggattttcaaagggcatacaggaaatgcatagaaaggcttctttggttcttgaagatgcagttaggaatatttacactgttgttgcattttgtgctggtaataaggtgatggaactctaccagttgcagttaaataaaatatttaagcaaagcttttttcatggagtggccattggttttgcatttggcttttcgcagtttctgctctttgcttgtaatgcccttctactttggtacactgcaatatgtgtaaataagagttatgtggatctacctactgctctcaaggagtacattgttttctcatttgctacatttgcccttgtggagccttttgggttggctccttacatacttaagcgacgtaaatctctcatgtcagtgtttgaaattatagatcgtgtgcctaagattgatcccgatgatagctcagcactgaagccacccaatgtatatggaagcattgagttgaaaaatattgatttttgttatccttctcgaccagaagtgttggtgttaagcaattttagtctcaaagtcaatggaggacaaacaattgctgtagtgggagtttcgggatcagggaagagcacaataatatctttgattgagagattctatgatccagttgctggccaagttttgctagatgggagggatttgaaacaatataatttaagatggttgaggagccaccttggtttggttcagcaggaaccaattatcttctcaacaaccataagggaaaacatcatatatgccaggcataatgccagtgaagctgaaatgaaggaggctgcaagaatagcaaatgctcatcatttcattagtagcttgcctcatggctatgacactcatgttggaatgagaggtgttgacttaactccaggacaaaaacagagaattgcaattgcaagggtagtgcttaaaaatgctcctattttgttgttggatgaagctagttcatcaattgaatctgagtcaagccgagtggtgcaagaggctctagacaccctaataatgggaaacaaaaccacgattttaatagcacacagggctgcgatgatgaggcatgtggataacatagtagttctaaacggaggaaggatagtggaggaggggacccaggattcattagtggcaaaaaatggtctgtggaggcttgcatgtagcaagaatgggagtattggatcagcactcgacattggtaggcataagaagagggtactctggcaggggtag

SEQ ID NO: 18154 - DNA, 816 bp, Glycine max
  Peptide Sequence Number=SeqID_134932
atggcggaagtggatgtccctggtcatgcagcatcatggggtattggatatcctgatctttggccatcaccctcctgtaaggagccactagatgtttcgaagaagtttacttttgatgtcctttctggtattctaacagatatgagaaaaatatttccatttgaactatttcacttgggaggtgatgaagtgaatacagattgctggactaatacttccacagtgaataaatggcttcggaatcacaacatgactgctaaagatgcctatcaatattttgtactgaaggctcaaaacatagctcttacaaaaaattggagtccagtaaactgggaagaaaccttcaatacttttccaactaagctccatccacggactgtagtgcataactggttgggccctggggtttgtccaaaggctgttgcaaaaggtttcaggtgtattttcagtaaccaaggtgtatggtatcttgaccatctagatgtaccttgggatgatgtctatactgccgagccactagaaggaatacgtaaagcttcggaacaaaaacttgtacttggaggagaagtctgtatgtggggtgagacagctgatacatcagatgttcagcaaacaatatggcctcgagcagcagcagcagcagaacgcttgtggagtcggagagattctacctcaggaaatgttaacataattgcattgccgcggttgcattacttcagatgtctcttgaatagacgagggattccagctgctcctgtcaagaattttattgcaagaactgctcctgttggtccaggctcatgctttgaacaataa

SEQ ID NO: 18155 - DNA, 456 bp, Glycine max
  Peptide Sequence Number=SeqID_134933
atgtccatttttgcaacttcgatgcccgtgttgtccattgttcatccgaggaggatggaggcttttgtatttgtgtttgtggccattctgttgtgtggttgtgttgctgctaaagagtgcacaaacattccaacacaatctcatacattcaggtatgagctgttgatgtccaagaatgcaacatggaaggcagaggtgatggatcactaccatttgacaccaacggatgaaacggtttgggcggatttgctgcctcggaagttcttgtcggaacagaaccaacatgactggggggtgatgtataggaagattaagaacatgggtgtgttcaagtctggtgaaggatttctcaaagaagtgcctcttcaggatgtgaggttgcataaggattcaatccatgctagagcacagcaaacaaatttggagtatctgttgatgttggatgtggacgcttga

SEQ ID NO: 18156 - DNA, 591 bp, Glycine max
  Peptide Sequence Number=SeqID_134934
atggccaacatgtattcttggtctgcaaaaaggagttacaaaaacggttatgtgtggcaagatttgtccgagaatgatttcatttacccaagtagtggccatgagtatgtcctcaaaggaacacaaatgatagaagcttctttgagttttcgatcctgcgaaacaatatcaacatcaagctccaaaagttccactgaagcaatcaattctagcacgggtgcagactcccctgccaccataaaggggagaagccaatcattgaactcgagtgattacaagttttactcggcaaagacatgcgaagagtttgcagggaaagctactaatgcgtcgactcagaccgaggagaagcatagggaaaggataaaaagggaggagcaagttgaagagtgtgaaggaaatggtgatgcaagggagttgggtgagaatgaagggtctttgccattttctagatcaagttttggaacgttggaagggtctttggagggttttgaatcagcagatatcagaagccagagggtggagaatgaacgtccaagtgggaggatcaaggcttcagaagttttgatgcagttcatcaggtgtggatga

SEQ ID NO: 18157 - DNA, 213 bp, Glycine max
  Peptide Sequence Number=SeqID_134935
atgggttccatcagagggatcaagaagaggaagaaggctgacaacaaagatggccaagatgcctctgcaacctcattcgattggtggcatcacttctccctcagaatctcaggattccagatttgtttcttcaagcttactaatttactcactttgcttgactttcatactcatgttgctcttattgggcatacttcttgcccagttacttga

SEQ ID NO: 18158 - DNA, 948 bp, Glycine max
  Peptide Sequence Number=SeqID_134936
atggtggccagagcctcaaattttgttgatttaaatggaaatcgcttgtctttgaatgatcaagtagctgtagctctcagaaggcttagctctggtgagtcattgtcaaccattggtgactcatttcggatgaaccagtcaactgtttcccaggtaacatggaaatttgtggaaacaatggaagaaagagggctccaccatcttagttggccttcaactgaaatggaaatggaagagataaagtccaagtttgagaacataaggggcctttctaattgttgtggtgccattgacagtacacacataatgatgactttgccctctgtagatgccttgaatagcgtgtggattgatcgtgagaagaattgcagcatggtgttgcaagctgttgtggatccggatttgagattccatgacatagttactggatggccaggaagtatgagtgatgagcaagtgcttcgaagctcttctcttttcaaacttgctgaagaagggaagaggttgaatgggggtaagaaaacacttccagatggatcagtgttaagggaatatattataggggatacaggctttccccttttgccatggcttcttacaccttttgaaggtaaaggactgtcagatattcaagttgagtttaataaaaggattgttgaaacccaaatggtggccaagaaagcattggctaggctgaaggatatgtggaagataatccaaggtgttatgtggaagcctgataagcacaagttaccaagaattgttcttgtttgctgcatactgcataatatagttatggatatggaggatgaagtacataatgatatgctctcttgccaccagcatgattcgagatatcaagaccaaactagtgaatttgctgacaatactgccaacattatgagagagaagctatctctctacttatcaggcaaaatgccaacttga

SEQ ID NO: 18159 - DNA, 399 bp, Glycine max
  Peptide Sequence Number=SeqID_134937
atggaaaaccatagatttataagcaagtctgattcagcaaaagccaggagcaacaaaaagcgtattagacaacaaaaagtccatcttgatgttcaacatagtgtccatgcaagtttcaatccagcttcatcccatactgaagatgattataaccaaccaaagacaccacctcatagtgttcatgcaactgccaatcgagctccacacgatgctaaagatcattttaatatctgcgattcatctgagaatgagacttctggatcagcagaagaatctgagactatttcttcagttggatatccaaactgtgaatcctcgcatcatgattcttcaatggacacaggagccattcctataaaaaaaatttctcaatggttacggttatggtctaatatctaa

SEQ ID NO: 18160 - DNA, 540 bp, Glycine max
  Peptide Sequence Number=SeqID_134938
atggccaagttcgatccagacatagtcctcgaattttacgccaatgcttggcctacagaggagagcgtgcatgatatgaggtcctgggtgaggggtcagtggatctcgtttgatgcagatgcgatcggccagctcctaggatatcctttagtgctggaagagggccaggagtgcgagtatggccaaaggaggaaccggtccgatgggttcgatgaggaggccatcgcccagttgctaaagacatccatgcaaacccctgaaagtctgtcttcttttaatgaatgccctaggccttcttcacttgcacaaccctccctaacagcctatgaatgtgtagtggaatcccgcaatgcgtcactgaatttgatggcaggcacaattctggctagttctccgcactacttttctgcggttgaagactatcatgcctgtttaatgaaaaactggctggctctggctaccttgcggagcaaacaaaatctcccccaatcacactgcctcttacgtggaaaagattcgatattctttctatgccaatag

SEQ ID NO: 18161 - DNA, 528 bp, Glycine max
  Peptide Sequence Number=SeqID_134939
gatgaagtgggatgtgaagccgttagtggatatagcaagtgtgccggggatgcggctcgggcgtacgcctcgggtcggtagccgggctccgggacattactaccacggctactatcgacccgagcccaaagaaggaaaagaacggactaaagcgaggagttcattggccatacatagtgaagggggatgggggtcaacctctttcatgacccatggccccattgagacacgtttttcggatatggattttttcgagatggttaaccacttttttaaccgtgagagggaggtcattcagaacccgctggctccagtccagaaccggtggaagttccccacgccgatcccccaacggcggctttccgttcactttccggaaattgaagaaatctattccagtgtcgcagagaacattatgtctcgcgatctggaaatatctgcggagatttctattgaaaccctccgcggatgggtggaggagataaaggagaaccctaatcccctaaaatccctcattagggaacacct

SEQ ID NO: 18162 - DNA, 294 bp, Glycine max
  Peptide Sequence Number=SeqID_134940
atggtggaagcctctggtaatcgattaccagcctgtgtaatcgattacacagaggaatgggtcactgtggttatgagacaaatgatcgtgatggtggcgcagctaatccgtgatcgagtagagatggagtgcctagagggagcttgggagaccctcgaaggcaacacgaggtgccgatttcgaggcaccactcgattcacggctacttctttggtgcatccagatgaacctgcacggacgcttcagcgcacggtggagtggacagctccttggattagttttgtggatttttag

SEQ ID NO: 18163 - DNA, 109 bp, Glycine max
  Peptide Sequence Number=SeqID_134941
gcgaatcaagtgggtgggaatgatccgagccccctatgtcaatttcagtaagtctcttggtcaaaagccggtacctaattcccctgctggtgggccgatcctcgtctag

SEQ ID NO: 18164 - DNA, 240 bp, Glycine max
  Peptide Sequence Number=SeqID_134942
atggcttttcaagaggaaaggtttgagaccgaaaatgctaaacacatggccactcctatgagcactgcttgctatctggataaagatgaaattggtcagtcaagagacataaggaaatatagaggcataatcggacctcttctttatttatttgcaagtagacctgatataatattcagtatttgtatgtgtgcaagatatcaagaaaatcccaaagaatcccaccttagtgtagtttaa

SEQ ID NO: 18165 - DNA, 288 bp, Glycine max
  Peptide Sequence Number=SeqID_134943
atgtcagcctctgcaacctcgacctcgagaaccgaatcaactacaccttcatcgaggtcctcaatggcaatagagagagagagagaaagaaacaaagacaaaaagagagagaaagaatggttgaaagacgcgaaagctgcgctttacaaggagttatggcacgcatgtgtaggtcctctagtgatggtgcctagagaagcaaaacatgtgttctactttcttcaaggacatgccggtttacgatctaccacccaagatcctctatcgggttatcaacatcaagcttaa

SEQ ID NO: 18166 - DNA, 240 bp, Glycine max
  Peptide Sequence Number=SeqID_134944
tttgtgtgggagccgtacccatcaaccgttatatcactgtttcctcccgtttgtttagtcggaagtctcgcgtggcgaaagacaaagatgtttgttgacccacaaaatgcaaagacggctacattggctgaagttgcggagacattacaatacatggtgtctcctcaagggaggaatacatggacagttgatgttctcgtgccttatgtggaaaaaattacaattttatccaaagagtaa

SEQ ID NO: 18167 - DNA, 387 bp, Glycine max
  Peptide Sequence Number=SeqID_134945
atggcggcacagctaattcgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcactgtggagtggatactacccacgcctacaccatatcgtctagtggagcccgttcaaagtgatcgaggggtgatgaggatccacttcttgaggtggattctcccgaggaagtcatgtcggcatctgaggcagactctatggtggatagcggcccgagggagatggcgatcagcggaggctcttcatcctagtggacagctttttggattagttttgtatactttttga

SEQ ID NO: 18168 - DNA, 512 bp, Glycine max
  Peptide Sequence Number=SeqID_134946
atgaattcatggcctagcgatgttcaaggatcctcaaccaggaagtatgtaggcctggcatttgattgcagagctctgttcgccaattctccattctccagtcttatttggagccccatgaatttattgtctagcgccggtcgggagtcctccaccttggagtttggagccccgcaaagttattccgtagcgctgttcggcaattctccattatccacttttattgggagccccatgaattcattgcctagcgctgttcatgcgtcctccaccttcgagtctggagccccgcgaagtgattgcctagcgctgttccccaattctccattctccacttttattcggagtcccaagaatttattgcctagcgctgttcatgcatcctccaccatcgagtctggagccccgcgaagtgattgcgtagcgctgttcgccaattctccattcttcacttttattcggagccccaagaatttattgcctagcgcttttcatgtgtcctccaccatcga

SEQ ID NO: 18169 - DNA, 265 bp, Glycine max
  Peptide Sequence Number=SeqID_134947
ggggatgctccgcaagcccgcagacgcgccgccacctcatcaggctggtccagccggatcgtttgatacggaagccagggttttacttctttttcatgcccatactccggaccatttcagggcagaggtcccatggcctggagattggcctaaggcccgggcaggagaggcgccagcagaggctcccaacgaggcagatgaggcccgcgaggacgaggagatgaccaatttacttgatttcttaggagggagcggggccatatga

SEQ ID NO: 18170 - DNA, 387 bp, Glycine max
  Peptide Sequence Number=SeqID_134948
atggtagatatgcttgccacgtacatcccattcaacattaaacaaaccaggatgaatggagagggtgggttgtcattgttgttctcatttcatggtatggtgaaatgcaaatttgaggtacccgttgttatgttcacatcacgtagtgtgaaccatccagagaaaaggttttggagatgcccacattggaacgaatcaagttcttgtagattttttcaatggattggtgatactgaggctgacaataatgtgtctgtagaggagagtgagttggtccgatatgttcgagaaaatgaagagctgaagctgaaagttgcttcattaatggaggaagctaaaacaaatgtacaagaaataacaaatttgaggaaaaaaattgttgcataa

SEQ ID NO: 18171 - DNA, 549 bp, Glycine max
  Peptide Sequence Number=SeqID_134949
gggcaagcgagcccattgacacgcagagactaacgtcatcttctgcacctttgtcatccagagacgaagagttcgatgacatgcgggggtactttgtggggtaccttacggttatccgaaccttttgccaaccagaggaaagcgagcccgttgacaagcagggacaaacatcgtcatctgcaccttttgtcaacctggggcaagcgagcccagacgacgagtccgatgacatgtgggggtaccttatggttatccgcatcttttgtcatccagagacgacgagtccgatgacatatgggggggcaagcaagcccgttcacatgcagagactaatgccatcttctgcacctttgtcatctagagacgacgagtccaatgacatatggggctacctttcggttatcggcacctcttgtcaactagaggcaagcgagtccattgacacgcagagactaacaacagaagacgagtcggatgacatgcggttgtaccttatggttatccgcatcttttgtcatccagagacgtcgagtccgatgacatatgggg

SEQ ID NO: 18172 - DNA, 330 bp, Glycine max
  Peptide Sequence Number=SeqID_134950
gtcgactctagaggatcccacccccttgtacataaagcatgaagatctgtctgaaatagcacacggtggtgaatgtctcagcatctctcttatacagttgtggattccttacattaagaactggatgcagaattcaaaacgggatgtgtacctaggagcctacctgaatggtgcacattggcaaatggtcgtcattttgcttaaggaaaatgttgtcatctggttttgttcattgcataataggtcagacaactacctcaaaggaataattaatagtgctttgaaaggacttaaccatattccacaaagtaaatccaaggttgttgctag

SEQ ID NO: 18173 - DNA, 561 bp, Glycine max
  Peptide Sequence Number=SeqID_134951
atgcagtcattagaagagaaagaacatgaaattaggattatgactgaaaatgttagtcggtttgtcagattgattgtgaaggaatgcgttaaccgtaacccggggagagtggagattgatgcagaggaggaggctgttggtgaagggcagggtgttatggagcaaggcgatgatgcctatgttgctaaaaggagcagtcgcgctaaacggaacctgtgggctacacgtgcatctatcgctaagtgtagctacaacgcgcttagcgtgatgagagaatctggaagagcacaagaatcgaagcagcgcgctaagcgcgagatcagctcgctaagcgacccaaatccatttactcgcgctaagcgcgatagtggcgttaagtgcgacggcacgattttcaaagcctatttaaagcccgaactgtcagattttgggcatcatcaaagagagagcacttttaccatagcttcatacttttgcacaaaattcgagaaaagtgctctagaggaagcaaaaaggaaacagctaagcaaggaagctaggttcatcactttgagagattag

SEQ ID NO: 18174 - DNA, 294 bp, Glycine max
  Peptide Sequence Number=SeqID_134952
atggcctctcatcagcgggagattcgccacttgagtgaatcccccaccgagggtcaggaggccagacaagaaagattcgcgcgcctcaagacggttcttgactcagtcgacagccggttggatcaagcccgagaaatagatcgggttcgtgacaacgaacgtgctcggctacgggcagaaatggatcacgactgtgatcggtggagggctctcgagagaaagaacgcccaaatgcgattgaaagttaatgaactaaatttaaaaaagaggggacctcttattaagtttaagtga

SEQ ID NO: 18175 - DNA, 267 bp, Glycine max
  Peptide Sequence Number=SeqID_134953
atggaagcacataagatattccccaacttggagtgtttggttattgactttgacgaagcacagaagtggttattgagcaacactgtgaagcatccaatgcaccgtttaaaagagcttcacttgcgcgaagttaatgatggtgaacgtctctgtcaaattctgtacagaatgccaaatctagaaaagttattcttgtgggaagctaaacatttgcttaaagagtcgtcggagtcacgtttgggaaccgtattacagctgaaggaattg

SEQ ID NO: 18176 - DNA, 303 bp, Glycine max
  Peptide Sequence Number=SeqID_134954
atgctggaaagttttaaacaacaacaagaaatgtcagttctagaattgtacatagaaaaggatgtggctggtggttccctgtttcattctgcaaattcccttacatcatgtggaaattatgtatctaacgatgacacacaaccgccaacaaatatgagcaatttaaatcttgacgaagatgatgatcatgatgatgatgattatcttgtgtctaactcatacgttgaagagtctttagacgaagatgacagtgttgacggtatctctgacacagacgatgcagtcattgacattcctcaacca

SEQ ID NO: 18177 - DNA, 981 bp, Glycine max
  Peptide Sequence Number=SeqID_134955
atggcctcatttgggactaaccgcattatcaacccttatcatatttttggcgaacacttggccatgcgactcaatgcgctgggaacgtatttgttgcacgaatggctgacccgagcaccgggtgatgccattgccacgcctgctgccattccgcaagggcaatggattgcctgtggttatggccggtttggcaaatcggttgtcagtagcctgcagaatgaaaatatgcaagtgaccattattgaggctgatcctgaaggcacgcaatgcgatgactgtattattggtagcggtgtggaagcgcatgtgttgcaacaagcgggtgtagagcatgcggtcgggattgtggctggcactgataacgacattaataacctgtctatcgtcatgactgcgcttgaattgaacccggatttgtttgtgattatccgcaaaaacaaacgacacaatgatcccttgttccagcacttcaatgccgatatcaccatgcagcccagtgatgtgattgcccatacttgcctggcatatatggtttcgccgatgctggcggaatttttaaccatcgccaggcataaaggtaaccaatgggctaacgcagtcattgctcagctggtatccaaactgggtgagcaggtgccggatacctgggatatcaccattgcagatgatatggcgattgcggtgtgtgcgatgatggaacaaggcttgcagcctgcgctcaagcatttgatgatgagtcctgccgggcagcagcgtcgagaaatgcctgtggtgccattgatgctggttcggggtgatcaggagatgctattgccggagttgtccacgccattgcaaattggtgaccgcatcctgtgttgcgggttagaccaagctaaatctatccagcggtttgtcatgcatgatgtgaaaaccatgcattacctggtgactggcagcgagatgccggaaacctggattgggcgctggctcaagcaataa

SEQ ID NO: 18178 - DNA, 586 bp, Glycine max
  Peptide Sequence Number=SeqID_134956
atgaatatacctgattcagaagggaagaacttgcatcagtatctcaatttcaattcaaacatgggtttgattcacactccatgttctgagaaatatttaccatccgaaaaaaggaaaaaacggagtccttgtctaaaaaaatgccttgagaaagggcagatgtatagaactttcaacaagatagtgtttttcaactctctcaaaatggaatctattccaaacatatataccatggttccttacctcgacagggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaa

SEQ ID NO: 18179 - DNA, 186 bp, Glycine max
  Peptide Sequence Number=SeqID_134957
atgacttttggcaccggacgttcccaaactggaatgtgtattatcgatataggggatctttcaattgagaagatccatcgacctgagacgaagagaaagaaagatagcaacaaccatctcctcccccccccagccatctttttctcaacaatgtctttgtcatttgatccaatagcgcttcgttag

SEQ ID NO: 18180 - DNA, 1256 bp, Glycine max
  Peptide Sequence Number=SeqID_134958
atggcactgccgaaaaaactgaaatacctgaacctgttcaacgacggctacagctacatgggcgtggtgtcctcgctgacgctgccgaagctcacccgcaagctggagaaataccggggcggcggcatgaacggcgcggcctccatcgatatggggctggacgatgacgcgctggccgttgagtggtcgatgggcggcattgatgagctggtgttgaagcagtggggcgccgtcgatgctgtgccgctgcgctttgccggttccttccagcgtgacgacaccggcgaggtgtccgctgtggaagtggtgatgcgtggccgccacaaagaaatcgattttggcgagtacaagcagggcgaggataccgaaaccaaggtttccaccgagtgtacttacttcaagctgaccgtggacggcaaagagctgatcgaggtcgataccgtgaacatggtcgaaaagaacaccatgaaagacgcaaaagaaaataccgttaccctcgacaccccgatccagcgcggtgaaaccaccatcaccgaggtgcaggtgattaaacctaacgcgggcgcgctgcgtggcgtcgggctggcggcgatcgccaatgccgatgttgacgcgctgctggttgtgctgccgcctgccggatttggtggcgctggccgggaaagtggtcggttttttgtcgccgaactcggcggcgtaatccccgacgcccggctgggcgttgatgacctgatggcggacatcgcggtgatcttccactggccgccgtctgaaatggccggaatgacgctcacggagctgttgaactggcgccatttggcactgcaacgcagcggagccgtagaccaagccacccgcccgctaaagagtatccaacaggcaagcaaacagcttgccggtgacatcaaaaccacgcagcaaaccctcaaggctctggacgcgcaaagcgcccggattgaggggtttcgcaaggcgcaggggcagcttgccgttaccggcaaggcactaaagaaagccaaggaagaggcggccgcgctggccgttcagttcaaggcgacggaaaagcccacggcgcagcaagcgcgcttgctggaggcatcaaggcgcgccgccgccgagctgcagacgaaatacaacggtctgcgccagtcggtgcagcgccagcgtgacgcgctcaacgctgacggcatcgctacccggaacctgagcgccgaacagcgccggttgaaggccagcgccagggaagccacgacagc

SEQ ID NO: 18181 - DNA, 225 bp, Glycine max
  Peptide Sequence Number=SeqID_134959
atgcggatgaggcgccactcgatgtttccatttgcctgcatgcctttggtattgtggggtgtggttcgtttagtggtgtcaagtcttgcgaacgtgagggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 18182 - DNA, 2352 bp, Glycine max
  Peptide Sequence Number=SeqID_134960
aacaagccgccgatcgctggaaatattgccgccggggtgctgagcctgccttgcgatgccgcaccctcaacgggctatgtcagcgtgtcggggttgggacatggttttattggccgttctaaccggccggaaaatggggtggtgtggtcacggatttacaccaccgattacaaaccgacggccgccgatgtcggcgcatggagtaaaaccgaagctgacggccgttttctgatgctgtccggcggcacggttaaaaaactggctattaagcccggcaacgctgaaacggatggggactcactgaatattgagggaaaccagcatacgccgttggtcatgagccgcccttcagcacagagtaatttatcaatcggtttccaagtcgccgggaaggcactgatgcgtcttggtttggggatggataacgagttgcattggggaactgagcctaatcagggggcaaacccgcgtatttatacgacggcgaaaccgcctaccgcgcaagaaacaggcgcgttgacggatgcgcaagctatgcagaaatacgcgctgcgttctatcaaggtgaacggcaaaccgttgagcggggatgtcaatctgttggccggtgatgtcaacgcatggaataaaaccgaagccgacgggcgctatgtgaaacgggcgggcgataccatgaccggggcgcttgcgttgccgcgcgtggttttccccagcgaaagcttgcaggccacaaacgccgacagcgacctcacacggccggacggtttcacccttgaacagctcggcgataaatcagtcggctatccactgactaaagggaatctcggtaatttgatgacgttcaaactcaacaaataccggcatgtccaatttgcgatcggctcgggtaatacggagttttggctacgttctcctcgggaagataatccggcgacggctaaggcttgggcgcaggtgtacacgacacactacaagccgacggccgctgacgttggcgcgctgacggatgcgcaggccgcgcagaaatacgcgctgcgctctatcaaggtgaacggtaagccgttgtccgctgatgtgaatttgttggccggtgacgttaacgcctggaataaaaccgaagcagatggccgctatctggcgaagaccggcgggcagttaaccgggacgctaaagaccagcgcggagatccaatctacccatattgataattatcgcatggtcggcggcgggttcggttccttctggcgcaatgacggcaatcggctttatctgctgctgacaaacgaaaatgaccaatacggcacattcaacgccctgcgtccgttctctgtggatgtcagaaccggtgccgccgcttttgagtcgggtattcatatcggcggtaaatggcctgcgatcaccacctccagcgggacgacgtggcaccctgacggcaacgtacagggcagctgctggggcggctacctcagcaactggcttaatcaaaatatctcggctgcgcagaacaatgcgcagaactgggcctatcagaatttggttcagggtgtgcgcatggccgggcgcacggttatcgcggataccggcgggcgcatcgatttaccgtcgggctgtgtttataccggcatgtccggctcaaactacaacccctcaatctggggcgcttattcagcggttcaggtgctgattaacggcacatgggcaacaattggaacggatgataacggtattgactggtacgccgcgcaaaaattgttttcgccggacaccgtaaaactggcttatgacgaaagcggcattatctgtgtgattaacagcgatgtgtcgatgctgtggccgattggcttatcggttattgagctgaacccaacgaaactcccaaagcgctgtctggctaatggtgagtgggtgtttgacggtaagaaggtgagcccgcgcgcctattccgcagaagaaatgatggcgagggctgaagccagaaaaaatgaattgctggcgatagcgggcgcggctgttgcgccgcttcaggatgctgttgatttggatatggcgaccgaggcagaaaaagcgctgttggcggactggaaaaaataccgcgtgacgctgaatcgtcttgatatgtcggcctcggaaattgactggccgcacccaccgcgtgcggcccggcgtgccgggcgtcatcatgcctgcacctactcaccatggagcaagttaatgggcgattatcatcacggcgtgcgcgtcgtcgaaatcaacgacggcacccgcgttatttccaccgtatcgacggcgatcgtcggcatggtctgcacggcggaggatgccgacgcgtcggttttcccgctcgacaccccg

SEQ ID NO: 18183 - DNA, 492 bp, Glycine max
  Peptide Sequence Number=SeqID_134961
atgtggcattggggtatagggttttatagacggccttgtttgagccgaagtgaatttattatttatttagaaaagttttatgatgatgttagaaaggtgaatagggtgtcacaaggaggaggaggaggaggaggagaggcaggtggagaagccatgatcctttatacaataacatacaacaacatacaaaatatagaggaagcaaaagaacatcacctagatgaagatgctctgataccacatgatgtaagctccattggagcttgtaggcttaggatcttcttcatcaatggattcctttgcttcttggaagatgaatggcagcggaatgaagaaaggaagagagagaggagacaccacttcaaggagaagatgagtctagaagaagctcaccaccataggaggccatggataagagcttggagaaagaatgagatgaatgaagggagaggaagagaagagcacgaaatttgtgctctaaatgagctttga

SEQ ID NO: 18184 - DNA, 683 bp, Glycine max
  Peptide Sequence Number=SeqID_134962
gaaacagctatgaccatgattacgaattcgagctcggtaccggtgacggtcacacggattgggtttcatgcgtgcggttcattccggacgcggcgccaccgaggttggtgtcggcgtcgtgggacgggagcgttagggtttgggacgtggacgtggacgtggacaagggcgcgttgaggaagaggtttactctctccgggcacgagggttacgtgaacgtggtggcggtgtcaccggacgcgtcgttggttgcgagtgggggaaaggatggggtggtgctgctgtgggatatggcgggtggggtgaagatttatgagtttgaggttggttcggttgtgcatgggttgtggttttctccaaacaggtattggatgtgtattgccacggatgagagtgttagggtttgggatttggagagtaatagcattataaaggatttgaatgtcaatggtaacaacgaccactacaattatgtcaatggtgggactgagatcactgccaacaacaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 18185 - DNA, 210 bp, Glycine max
  Peptide Sequence Number=SeqID_134963
atggctcaacctccacctcgtgagaggactcttagggagatggctgcacctgatttcacttatgaaagcttgtgcattcaatatcttgatgagggtgttccatatgttctcaagactggactaatacatttgctgcccaagtttcatggtcttgcagatcaccatacaaatctctgtccttctttgcagcaatctggagtcaatgagtaa

SEQ ID NO: 18186 - DNA, 279 bp, Glycine max
  Peptide Sequence Number=SeqID_134964
tcgtggcatagttgtgaggccaaggatgatgagagccttgggtacgaggttgaggggagttgctacgtgcacccagcattattgctggggcacccagcaaacagtgaagtggcaaaattgcccttcaataattcttcttccggaagaagtatttccgtaaacttttcggaacaagcttttccggaaagtttccggaaaaagacttcttccggaaaaagaatttgggaattccggaagtactcacaaacttcgtccggaagaaccttcttccggaactga

SEQ ID NO: 18187 - DNA, 687 bp, Glycine max
  Peptide Sequence Number=SeqID_134965
atggtcgtgctgccgggtgtgccgatcgaggcgtatcagagccgcaaatgccatttttcagagttgagccgctgttgtttggcgatacttatggctgatggcgacaacgctagcgaccgccagaactatacgatcgtaacgctgctgtatcgtgttgtttccactccagtcataggccatttgtacgcccccgcgcttttttggaatcgtgccccatcatggttaaccgaagcttacggtgcccctgtgattccttgcggttttggaagggctgccgcgacaaatcggctattggcggaagggatggatcagcagccgcccgccgatatggaactgacgctcagaacgcttgccatgcctgccgatgccaatccggccggcgatattttcggcggctgggtcatgtcgcagatggaccttgccgctttcgtccgcgccaatgatgtggccgggggccgaaccgtcaccgtcgcagtcaacgagatcgtcttcaagaagccggtcaagatcggtgatacattgtgcgtctatacgcgcatcgaaaagattggccgcacctccgtcacgctgaagatcgaagcctggacgcgccggcactatcgggattcgcgtgaaaaggtgacggaggccgtcttcatcatggtcgccgtcgatgagaacggtgagccgcgcccggttcggaaagac

SEQ ID NO: 18188 - DNA, 339 bp, Glycine max
  Peptide Sequence Number=SeqID_134966
atggacgatgaggatcccgccgctcagctaacacatcaatcagtagatgagtcatcagagtcatccactcctgagcccttgatcaggaagaggagggtagttgtaactccggaagtcgtagccactcctaaaaagtctcctgaggccactccaaagcctctggcaccaatggcagataccacttctccacagcaggcaacagatccttcaacgcctgaagatcaaaccacaccagtccagtctccaaacgcctctcttgtatctacttttgtactacatttgactgacgaggaggaggttcagacacaagacacccaagaccaatcacaggacttttaa

SEQ ID NO: 18189 - DNA, 225 bp, Glycine max
  Peptide Sequence Number=SeqID_134967
ataaagagggaaatatccaccttgaagctgctgaagcatccgaacgtgaggaacttagatcaattggaagacttactcaacaaggttaaattgaagaccataaggactgaaccaccttctgcatctattgctggcacaagttggtgtatctttggtgtttctgtagattctgtagttgctgcgttacaatttgtggctccctctgcaaagggattctttttgtaa

SEQ ID NO: 18190 - DNA, 150 bp, Glycine max
  Peptide Sequence Number=SeqID_134968
gtgaaaaagaggctaagtcatgaagtgccaaaagtgacagttgagcttagctcatcagtgtcttcagccaggctcaacgcactactggcgctaagcctgaatccacttacccgcgctaagcgcaacgtcacgaattcagagcctatttaa

SEQ ID NO: 18191 - DNA, 465 bp, Glycine max
  Peptide Sequence Number=SeqID_134969
atgcagtcccagttgcaatcactgatccaatcacagggacttgcactgcctccagagcctgaggttggtccctcagctgctcgtgtcaacacaaaggggagttgtgttgatccctcaccgaccaatccagacacgggtgactcagacaaatgcaggttgtacatcgaagaaaatccttcccgcttggttgccctaggaagagtttatgagggatccacatcagttcacaacatccctttgttgcatggccaagtgaaggttggtgttgaggaggcacttaacaccttccttccttggtcgacacatctcgtgaagcatttatcagaacaggtagttgtgtctccaacaaaacctccagataggccggatcctgaggtcgatgatcccttatatttgatgacattgaccatcccacaactttttttgaagcctctccaggttatgtgggatgctaccgtgttcggg

SEQ ID NO: 18192 - DNA, 279 bp, Glycine max
  Peptide Sequence Number=SeqID_134970
atggcaaatactttgtgcggtgaattggggaaaagagggacaaaaagatacagggggaaacgagggttttttgtttacaatgaaacccccaaatccgtcgtcgagtccatgtcgatgatcgaagagttaaggaagcttttgttgctctccgatggggctctgttcttggtcgaattcgaactctggaatcgcgacacgaaattgagtttcccgaagagggtttcattggtcacgaggagaaggttcacaacaatggtggagaatccccaatatctgtga

SEQ ID NO: 18193 - DNA, 138 bp, Glycine max
  Peptide Sequence Number=SeqID_134971
atgaatcatgctgctagtgatctgagctttagtcactcaagatacggcgagagctacaaagatggcatggcggccagagctggggtcaacacagaagtggagatggcaccggcggagcttctatcaacacgacaatga

SEQ ID NO: 18194 - DNA, 459 bp, Glycine max
  Peptide Sequence Number=SeqID_134972
atgtatgatgacgtaggcactgatgtaaaagcaatgatgttgaatatgggaacttctacatcagtggtgacgtatgcactgatgtacaacgatgttgaatatgagaacttctacatcggtggtgacataggcaccgatatgttccagaaaggctcgccagtggccagagacgtgtcaaaagctatattacatctctcaaaaaaagcagagctgaagagattggaagagaagtggttgattacctcaccggcatcatgctccaacgtgacctccgatgatacggacagtttgaagctgagaagtttatggattctatatgtcatctcaggtgccacttccaccatttgtgtgctactatcagccatccaatctctagtaaaatcctgtcaccaatgtcaagcagtggcaccagaaggcaatgacacaccaagtgatcataaagtgtgggagaacaaataa

SEQ ID NO: 18195 - DNA, 345 bp, Glycine max
  Peptide Sequence Number=SeqID_134973
atgaaggatagcactgaagaggttgtcggaaatgggaatagcggcacaagcgtgaccaaaagtgggaagatgcaaagcatgcctaggaagcgaacccgacaatggtggaagggatggttgtgcggatggaggctccgttggcatgggaagcggaggcggcatggctggcgaaggtggcatgtcggcttgagcggcggaggcaacggtggaggcagtagtggagtccgcggcagagtcagtattggagtgtgggtgaggaatgtctgtgcagagaaagaagatggaggtggagtcggcatgggcggcggaggtggcggtggtgactgcacaaaggatgatgggtag

SEQ ID NO: 18196 - DNA, 222 bp, Glycine max
  Peptide Sequence Number=SeqID_134974
atgagtcaagtataccaaagtgaggaagattgtattgagggaagaggcttagacccgaggaggagtcttgtgatcgaagtcactaaaaggattttcaactgggcacaccgcttggtattgagaaccagatatgtaaactctttcttcttggtctttcggcaaagttccggggacgaaacttcttttaaggggggtgaaattgtaacatccaatttttcataa

SEQ ID NO: 18197 - DNA, 159 bp, Glycine max
  Peptide Sequence Number=SeqID_134975
atgagggaaaaagcattgtgtcccgacgtccttcagcacaaggttcctttaagcacttcacctagccatctgctcccccgaacacaaggttcaagatcatcacaggatccaaacacaaacagcaaaccgggagtgagttaccacattcctaactactag

SEQ ID NO: 18198 - DNA, 495 bp, Glycine max
  Peptide Sequence Number=SeqID_134976
atggcagcggaatggagaaggaagagagagaggagacgctacttcaaggagaagatgagtcaagaagaagctcaccaccataggaggccatggataagagcttggaggaagaaggagatgaatgaagggagagggagagaagagcacgaaattttgtgctctaaaagagctctgaaatctgaacccatgggcccgaaatctaccctaaggctcatgagaaccctagggtcttctcttgcatttttggcccaatcttcttggaatcttctatccaatgcccttgggggggttggagttttttgggagtggctcacattgaaggccaaagcgtgtgctaaccatgaatgtgggtggccatgggggaagttttacagcgctcctacgatgggcgccaaatgtacttaccgaaatctagagctgactaacgtcagggttgtcgaaatcaagatgagctcctcgatctcccatgtcgaatttacaagtgcccaccactaa

SEQ ID NO: 18199 - DNA, 297 bp, Glycine max
  Peptide Sequence Number=SeqID_134977
atggcaagggaaggggtggttcaacggatggtatgggttgcaatggttggagctataatggcagccacagaagctccatttagcgagtggtgtggatggtgcatcccttatatagaggcactagccaaggttgctgctacgaaaacagaaggtgctagaatgccaaaagaaattaacagaaaagtggaaaatgacaacaatgcagtgtttcatgatgggaagcaacatgccaacaacatattccatatgaaccaatatcctcctgacagctcagcaccttctaacaaattctgttaa

SEQ ID NO: 18200 - DNA, 438 bp, Glycine max
  Peptide Sequence Number=SeqID_134978
atggattcaatagcagataccaatcagttcaaggtggaaggaaattggcatatgttatacaagcttcagattggaagttgtctcaggctgtcaccaaagttggcaattaagattgagcaactagaattatgtgagatggagaaagcctcctactggtcaactaaaatgcaatacagatgcaacattttttgtggaagattcagaagccaaaccaatgtggtggcttatactttggctagaaactctaaattctatgctaatgataacattgaaaacctttcatctgtctctagaatatttccattggatttaatgatgaaatctgtgcaatttcaggtgaaaaagaggctaagtcatgaagtgctaaaagtgacagttgagcttagctcatcagttgggctaagcgcgcatccaccgctaagcgcagtttcagcgtga

SEQ ID NO: 18201 - DNA, 264 bp, Glycine max
  Peptide Sequence Number=SeqID_134979
atgcacaactctcaaccagttcctagatggcaaccaccttctaggggattctcaaatgcaatgtcgatgttgcacttttcttggataagaaagctttgggctttggattttgtccaaggaatgatcaaggcttggtttttgatgatgccaaagtataatcaaacaagattgcttcaacaaacattcaaggttaagcaaacagagattgcttcaagattaattcaaggtcaagcaaacaagatcaagaaaaagataaggccttag

SEQ ID NO: 18202 - DNA, 201 bp, Glycine max
  Peptide Sequence Number=SeqID_134980
atggcagaatcgtcaaagaaacgtaagggttcatccgcctccgtttcggcttcaagagctcatcgttccggagccactagcgcatccacagtaccaattccaccttcattatcctcttccacattgttttcttccgaagaacaccagaaacggtattcaaatcttttctcatcttgttccattatcgaccctaagtcatga

SEQ ID NO: 18203 - DNA, 984 bp, Glycine max
  Peptide Sequence Number=SeqID_134981
gaagtccctactgctcagaaggatttgatttgggaggatattcaggcggaatttgaaatccctgaagcttctgacaataggacaaagaagaaaattcttcagattgttggcgagaggtggcggcagtttaaatcggacttgactagtaaatgggccctttcagccgaccaagacggtgtggacgacactgtctgtgaaaaatacgacattagcaaggagaaatgggccaagttttgccagagacgcagagacccttcttgggagaacaaaaagctagtggtgaccaaaaagaaactggaggaagctgcccagtttggaaccgctgacggcgtcattgaccctccatctcccatcagacgccacgtgaagtggaagatggtctgcatcaagaaaactgggcagatgacgtctgaggcagcaaaggaaatcgctgagaagatcgcgtcacagggatcgttcgtccctcatggacgtcaggatgtcctgactgccgccattgggcgagcagagcaccctagtcatgtctgtggtgttggagctcgtgtcaccatcaagcaatattttggatcggctccacaaacgtcccgcaactcttcctccctgcctcttaaagacctacaacagctgacccaacaaatcagggaccaacaagaggagtcgatcacacaaaaagggcttgcactgcctccagagcttatggttggtccctcaagtcctcatgtcatcacaaaggagagttatgttgatccctcagggaacgatcctgagacagttcacaaaattcctttgttgcctggccaagtgaaggttggtgttgaggaggttaaagatgcacaggctcccgttcctatacccactgatgaggttaccttagtggggcaggcacttaacaccttccttgcttggccgacacatctcatgaagcatttatcagaacaggtagctgtttctccagcaaaacctccacaaaggccggatcttgag

SEQ ID NO: 18204 - DNA, 1731 bp, Glycine max
  Peptide Sequence Number=SeqID_134982
aaggaggaccatcccaaggatgtttctaccatcgagtcgttgacagaagaagtcagaaaccgcttgcgcaacaagaggtatgttgtcttgtttgatgacgtatggaatggaaaattttgggatcacattgaatctgctgtaattgataagaaaaatggaagtaggatattaatcacaaccagggatgagaaggttgcagaatattgtaggaaatcatcatttgttgaggtgcataagctagagaaacctttaactgaagaagaatctttgaaattgttctgtaagaaggcatttcagtatagttccgatggagattgtccagaagaacttaaagatatatctcttgaaattgttagaaactgtaaaggtttacctctagcaatagtggccattggtggtcttttgtctcaaaaagatgaaagtgcacctgaatggggacagtttagtcgagatctaagtttagacttggagaggaattctgagttaaatagtataacaaaaattttaggtttaagttatgatgatttgccgatcaatctcagatcatgttttttgtatttcggaatgtatccggaggactatgaagttcaatctgatagactgattagacagtggatagctgaagggtttgtcaaacatgaaaccggaaaaacattggaagaagttgcgcatcaatatttatcagggttggttcgtagaagtttggtgcaagtatcctcacttagaattgatggcaaagttagaaggtgtcgtgttcatgacttaatacacgacatgatccttagaaaagtcaaggatacaggattttgtcagtatattgacgggcctgatcaatctgtatcaagtaagattgttcgacgcctgacaattgcaaccgatgattttagtggaagtataggaagctcacccattcggtcaatttttattagcaccggagaagatgaagtatctcaacacttagtaaacaaaatccctaccaattacatgctagtgaaggtactagattttgaaggttctggtttacgtgatgttcctgaaaatttggggaatttatgccacttgaagtatttaagcttccggtatacagggatagcaagtctaccaaaatccattggtaagctccagaatttggagaccttggatataagagacacacatgtgtctgagatgccagaggagattagtaagcttactaagctacgccatcttctgtcttattttacgggtttaattcaatggaaggatattggaggcatgacatccctacaagagatacctccagtgactatagatgatgatggagtggtcattagagaggtagaaaagctaaagcagttaaggaaactgtgggtggaagattttaggggaaaacacgaaaagactctgtgttccttaataaatgagatgccactcttggagaaactacttattaatagagctgatgagagtgaagtaattgagttgtacattacgccacctatgtctacacttaggaagcttgtcctatttgggaagttaacaaggtttccaaattggatttcacagttcccaaatcttgtgcaactgcgtttgggcggctccaggttgactaatgatgcattgaaatcactaaaaaatatgccaaggttgttgttcctcggtttaggttacaatgcttatgaagaaactaaagcaactgtccctcggaagtttggatcaattgaagtgcatccttatcgacagaggagcact

SEQ ID NO: 18205 - DNA, 504 bp, Glycine max
  Peptide Sequence Number=SeqID_134983
atggacccagaaaagattggttcaaatttcaaagattctgactcttatgaaccggaagcaaagccaaagaggattgttgaagctatgaatatccctgctttgataagagagcaagtagctagtcatttgcagtggtatgtagaagctttaagcttacatgaaatacaggtgccaagcttgttttctatccaaactcaggcacttgcattttgtggttctaaacaaaatatagacatcatagaatccaagggaagggcaggtgcatatggagtgacactgaaacagaacgagaaggcattgcaaaactacatagaatccaagggaagggaaggtgcatatggaaggtttgattcaatagcttttggtgataccagccatgttctctatgcagcccttcatcccgaggggctgacaagtaacgtgacgccaagagaagaagacgaatcattcccaagcataacaaaatgtagcaacaatgttaaatcagaatttttgatactgtga

SEQ ID NO: 18206 - DNA, 261 bp, Glycine max
  Peptide Sequence Number=SeqID_134984
atgcctgctcctcacctccctgccaatagcaaggttttctctctatgtcttaagtttttctaccctcttctctctgcttctgcattctgcgtttctgcttctattcagaaatatagacatcagttgttgaatacatcaaatggagtgacactgaaacagaacgagaaggcattgcaaaacaacattgaatccaagggaagggaaggtgcatatggaaggtttgactcaatagcttttggtgataccagccatgttctctaa

SEQ ID NO: 18207 - DNA, 288 bp, Glycine max
  Peptide Sequence Number=SeqID_134985
atgggcacgtaccccactgagaaggttttctttcaattcccagcaggtcttagggtccttgcagttgatcatgacaccactattcttgatgtcattaagaaaatgtgttttcgatgccactaccgcgctgtcacatactccgatgcctcacttgctttgaattatgttcgggagaagaaagattgcattgatgtgatactcattgaagttcacatgccatatggggatagctatgaattccttcagcatgtgactgtggaaactaatattccagttatcagtatctaa

SEQ ID NO: 18208 - DNA, 1011 bp, Glycine max
  Peptide Sequence Number=SeqID_134986
caacgacagtgtggtagtagtggtggcagcgatgctggcgatggtggtggtaatagcaatggtggtggtaacgaaaacagtggtagggcagcaaaggcgaggtacgatagcaatgatggtggtggtggaatggtggaggcaatagtggtggtggtgcaaacgagaacaacggggtgtggtggtggtggaatggtgacagtggaggtggcggtgcgatggcggtggcaatgcggtgcggtggcggaaaaagaagttcaagataccctaactgttagctctattgcgaaaagtgtaaacaaggaaacaattgatttagatatgccagtttcaacaacgaatgcaagtaatgctggagcggcagaaaatctagaggaacaagaggatacacaaagccatagtgaatcctccccattgaaacaaatgtcactcccggaaccaatgctcgaagaaaacaccgttgaggtggattcgaatcttgaccattttatgaattatgaaactaagcaacaccctccaactgcaaaagaggaacttccatacataaaccctgttgttgcctttgtctccattccaattgtcaaaactaatgagccaataatttaccaaagtataatccccaattacaaatgcaggaaatctctaaggagagacagtccaatagatgttgatccatttgcatttatcgacgttttgtcttctaattcgatgccatccgaagcctctgaatccagccataacaggccatttacacattttgacaaagttgtagcaagtcaacacactactgatattgctgaaatagaatcttctatagagctggatcgaaataaattaattcaagctaaagagggttttgagaaggccaaagagaatcttatgctaatagaagggctaatcgagaaaacagagagatatgaagcagaattggtcaagaaagaagatctcttggcgaacctcaatcctattcaagatgaacctcattctacacgtttcaaccttgcagaactttga

SEQ ID NO: 18209 - DNA, 213 bp, Glycine max
  Peptide Sequence Number=SeqID_134987
atgatgatagagacaaccacatggccttcttggttgattgagttgatgcccttgaagtccctctccgtgaaggttatcgttcatgccattgttgctagtgtctttgtttgccttggtctttcgctcttcttcggtttacttcctggttcctatgttgctcctcctgatgttcttcaggtcttgctcctgcttggtggttgtatgacctcttaa

SEQ ID NO: 18210 - DNA, 1266 bp, Glycine max
  Peptide Sequence Number=SeqID_134988
atggaagaagagttgatcaaatgtctgaggcacaacaaggatgcctttgcttacaaagcacaagacatgtctggaatacatcccaattttattgaacataaacttttcactgaatctggatgcaaagctggtagcctagaaaaggaatttggagatgataagaggaagacgataaagaatttacaagatagtggaactctcaagcgggttgcttggggactggacgtaggcacaaggcttcatggacatatactcaggataaaaccaaatctcaatggatcccaagatgaggaaaaaactgcattcaccattgaggttggaaacttttgttacaaggtcatgccattttggattgaagaattctggggcaacatatcagcgactaatggatatgtagaagcaagatattttgattttttgatgatgccaaaggatcaagatagagtctttgatggaaaattgggtaaaaacatagaagtatatgtggacaacatggaggggaagatcttaggattcatgctgacaattagaggaattgaggctaaccctgataagtgcaaggctatcatggaaatgaaaagtccaaagacagttaaggacatgcaacaactaacgggaaagatcatgccattatcttggttcttgtcaaagttgataaagaaagaactcctcgtgttcatcaaagatcctcaagggatgtaccctcccttgttctctttgaacaacctagtggatgtaccctccactagaactgatccagaagagatgtaccctctcttgttctcagtcaacaacccaagtagatgtaccctctacttgtaccacaaaggatgtaccctccaatatgttaagacaaagttctcaggtgaaacaagtcacttgaagaaatgtgaagaaaaaggggatgaaggcaattggatactctcagtagatggatcatccaatctagttggcaacaagacatgcattattttggaaggacctgatggactcatgttagaagaatccttaaagtttgacttcaaagccgataacaaacaagcaaagtatgggactctgttagctaggataagacttacattggatcgaaatagtcgagtggacttgttggcaaagctagttatcacaaagaaaccagggaacaacaagtcggtcatccaggagaacattagtcacccaagcatcgatgactcggagcctggtgaagctaaaaagatccaaaatgatgtgagtagatactctattctcgatggtcgattattttag

SEQ ID NO: 18211 - DNA, 246 bp, Glycine max
  Peptide Sequence Number=SeqID_134989
atgacaataagagtgagaaaagtagtacctgttatagatttcttcattttttctaaactaagtttgccgaagttgggtgaagtgcggattctcagtcttcttcaagaagtttctgaaaacgaccaaaacaaaggctcgatgcttgaggggttatacattgtccaagacaaatatcccgataaagttgataggagagcattggaagactcatccttaagcatctacgtcattaggctcaacgcttga

SEQ ID NO: 18212 - DNA, 460 bp, Glycine max
  Peptide Sequence Number=SeqID_134990
aggcggagacgacgtcgtaagctacaaggctttcctagacaggctgaggggactagctatgcaatggttcttaagtcttcctccaaaatcaattttcaactttcaagagttggctaggaagtttgagtctcaatttgaggctagtaaaagtaaacggcttgaggtggttgacttgtttgagataaaacaacaaaagggagagactctgaaaaaggcggggaatatggaggagatatgtgctagagtcaagaagcacatagaagctgaggaggagatttggcgctctcgaagttatggcgataggaggaggagagaacagaatccaaagcatgagttaccacacaggggaaccatttcaacaatagttggccctccaaaagctcgtaaccaaatgagggatgcagaaggcattgagcctcatgatattgaccaagtggtaatcacaatcgtcaccaaatga

SEQ ID NO: 18213 - DNA, 606 bp, Glycine max
  Peptide Sequence Number=SeqID_134991
atggttcttgtgaatcaggtgccttcctcagaatgtatcgaccctttacttttggcatttagtacgaattcaacgaatgcttcttgtgaattggatgtcgattccgttgatgtcgtggaggaggacagtgctgacaatgtgagcatggaggatgttatcaaagagtctgacgaagacactcttgatagtcaagatttatctgataatgaggtggggaatgaggataatgacgatgtcggggccgaggacattagtatagacgtttctaccaatacaaactatggaggtattgacttagtagtagtagaggcatgcaacgaagaagagaagcaagtcatagatgattatttgaccgctcttggggacgaggaatggatgaagaaggtaggtcctggtggtgcctgcaaagccaagaaagatgtaggtttgatgaagtttgagttgatcaagaaggaaggaatgatcattgccctaaataagaagttggaggaagctttggatgaaaagacgttggagactcaagtaaaggatctgactggcttcgagttgcaagctaaagagtctagtaaagaggtggagtcattgatagccatgttaaggcaatga

SEQ ID NO: 18214 - DNA, 186 bp, Glycine max
  Peptide Sequence Number=SeqID_134992
atggcagcctcacaaaagcatactacgggtgaactaactactgaacagggtgttgaagttcgtcaaccaatcagaccaccaaaaatagccaaagatatccgatcaactttccttcaaggtaatttcttgaacaaaactaccaccgaggtcaaaaagattattgaaaacttggctgctagcgaatga

SEQ ID NO: 18215 - DNA, 435 bp, Glycine max
  Peptide Sequence Number=SeqID_134993
atgagcataagtgatgagggcatggtgaccttagaggctagatgtagtgccattatcgaaaaaaccttgctttccaagttgggagatcccaggagtttcacaattcctatcactatcaagaacttgtcaattgggagtgcattcctagatttgggagctagcatcaacttaatgaccttatctatgatggaaagaattggtaacatggaagtgaaagagactcgcatgactattcaaccgacggatcattccatcaaaatccctcatggagtggtggagaacatgttggttgatgtaggaaaattcacactatcgactgactttgtcattatggatatagaggaagactcaaacattccgttgatcttaggaaaaccattcctaaacacgatcaatgttgttattagtgttgcaaaaggaaaattcacaatctga

SEQ ID NO: 18216 - DNA, 282 bp, Glycine max
  Peptide Sequence Number=SeqID_134994
atgcgacctcgccggaaagcaccgaaaaagggcgagagaagagctacctcgccgaaaaacgtgtggagggacagtgctgacctcgccagatttaaaccacgtcgaaaaaaagcgagaggagagaagtcatccgtcgacgttcagcacccgtcgtccgtcaacggtcgtgctgggagaagcagtcgcgtgaacggggaagggattttgttctctgtagaaagtgctgttgacgaaatcaagaaggacgaaatcaagaaggacgaaatcggaggaaaatggtaa

SEQ ID NO: 18217 - DNA, 252 bp, Glycine max
  Peptide Sequence Number=SeqID_134995
atggccatccaggtcgagatgagggagatgtgggcagacatagcagacaacaaccatgccattggcatggtcatggattccttgcgagttaaacttttgttgaatcccgagcttgaaaagaaaggcaatgttatccttgactttagggaagaggagagcaaatgtcttagaataccgcgggattctaagttaggagtgggcaatccatgctcaccaagggagaaccaagttcaagtatctcaaagtggctaa

SEQ ID NO: 18218 - DNA, 366 bp, Glycine max
  Peptide Sequence Number=SeqID_134996
atgtctcgctcaagcaaggctatcagtgatgaggcaatgtttggtcaatactacaaggtggctcgctcaagcgcccagaatgttgcgcttgagcgaggaggagtaaggatgattgggtgcttgagtgtgataatgaaagaaagggaatgtcagtgcaagggtgagaatgagaagaaaaaggttttaaagagagaaaggggagtaatgaatcggggaaaagggaagagaattcagggagtaatagaaggaatgatggagggagagggaaagtatgatggctcaagaagcccaaacccaacgtttgttttagctcacttaagcatcaacaagggacacttaagtgaggttggtcaaggaattccttga

SEQ ID NO: 18219 - DNA, 510 bp, Glycine max
  Peptide Sequence Number=SeqID_134997
atgatgatggtgatggtggtgatgttagcaacgacaaaagtagagaaaccagtggtgattgcggtgacagtgacagtagaggtggtgatggcaatggtggtagcggtggtggcaatgacgatgacaatattggtggtggcattagcggtgttggtggtagtaatgttggcgacaatggtggtgatgattatggtggcggtggcgtcgacgacattggtggtagcggtgactgagatggtattggcggtggcggtagcaatgacgacgacaatggtagtggtggtagtagtaatgccaatgacgatgttggtgtcggcagccagtgatggttgcgatgacattggtacggtggtgacaaaggtagtatatattggtattggtggtggtggtggtggtgatagtaatggtgctagtggtggtaatggtggtggtgatggtggtggtggtgataacagtattggcagtagcaattgtggtggtgacaacaaaacctgtgattgtcaaatatga

SEQ ID NO: 18220 - DNA, 457 bp, Glycine max
  Peptide Sequence Number=SeqID_134998
atggctacatgtcctcgccttcagaagactgcacgtccttgccttcagaggactacatgtcctcgccttcaaagggggccagtagtttccctttatcagtcccttggtcaccccctgatctcggaggagggccaactttgcgagcacaaccagaggcaggctatcgtgcagccactatgcatactggagcaagatttcaaccgtgccgctacaaagagacgagtgcggatcatgcgcaccaacatgactactcttacacagatatggatgacggatcgcaccacaagacacccagtggacccgggggagcccaacagtggccttggggtttccagctctggttacgggcctctgtcagtcctacagggtgcccgtcccccccagcaagtgtcatgtcattgtgacatagggatcgcgcctgcaagacacccagtggacccggagaagtccaaacagg

SEQ ID NO: 18221 - DNA, 240 bp, Glycine max
  Peptide Sequence Number=SeqID_134999
atgatgctcccaatgtttagtgacagtcaaagtgctattagtcttgctaagaatccagtcttccattctagatgcaagcatattcaattaagataccattttatcagggagttgataaatgatggagacttatctttattgaagatcttaggatcagagaatccagcagatatgttgactaaagctgttacaactgacaaactgaggttttgcattgcctcagttggccttcaaggataa

SEQ ID NO: 18222 - DNA, 291 bp, Glycine max
  Peptide Sequence Number=SeqID_135000
atggattacctgcgccgccatcacgatctacaagaaataaaagaaaggggtagactctttcacaagagatctaactacggtagcaacacaatgcgtctcataaccactacatgcaaaggccaaactcgaattacgcagcctcaggacatgaaacctgcaaaaatgcactgtgtaatcgattacacagcattggtaatcgattaccagaggccccttcaacattccagaccccttcctaagcctggtaatcgattacgcccctttgtaatcgattaccagaagccctcttag

SEQ ID NO: 18223 - DNA, 153 bp, Glycine max
  Peptide Sequence Number=SeqID_135001
atgactaatcaatcgagatacttcaacctaaaatataagttgcaacagatatcacctataattatcaggattcatggaaaatttttttgtgcaacacctccagagctctctcaagaaactcacattcctctaacaacgagatctgggaaataa

SEQ ID NO: 18224 - DNA, 1590 bp, Glycine max
  Peptide Sequence Number=SeqID_135002
atgaagctattctcgttttctctagcatgtgcttttgcacttctaacttcttccctggcttcagcaactatacaggaacacactttcaaagttcaaaacacgactatcaaacgcttttgcaaggagcaagtgattgtcacagttaatgggactttccctgggccaacgataaatgtccgagaaggtgacacagtaattgtccatgtattgaacgagggaccgcatggagtgttgcagctctttagtccttgggcagatggtcctgaatatgtaactcaatgcacaattagaccaagaagtaaatacacttataaattcaacgttacacaacaagaaggaaccgtatggtggcatgctcatgcatcatatttacgagcaacagttcatggtgctttcatcattcagcctcgttcaggccaatttccatttcctaaaccgtacaagcaaattcctcttatattaggagatttgtataactctaatgttgaggatattactaccgaagcacaggccagtggcggtggaccaaacatatcttgtgcctttacaatcaatggttttactagcggccttctcattaataattgtactgaaaatgagacatttaagatgaaagtccagcaagggaaaacctacatgctccgaatgatcaacgctgcactcaattacgacctattcttcaagatagcgaaccacaatttcacagtggttgccgtcgacgcctcctacaccgaccactacgtcaccgacctcatcgtcattgcccccggccagagtgctgacgtgttattcacagcgaaccaacccatcggctcgtactacatggttgcatctccttacgttgttggtctcgatcactttgacgtcaacgtaggtcgcggcacgcaaggtgggggcccacactgggttcctgtgcctcgtaaggttgatgagcacatgttcattaccattgggttcaacacagaattttgtgattccaagaatcccaacaatgcctcgtgtaagggcccaaatggtcaaagattttctgccagcatgaacaacgagtcatttgctgttcccgcgggtgtgaagttttctttgttggaagcattctatgaaaacatgagtggagtttacactacggatttccctaacaagccaccagttatgttcgacttcacaaatctgaacaacgctaataatatgaaccttctatttgcgcctaaatcaaccaaggcgaagaaactcaggttcaattcgacggtggagattgtgtttcagaatacagcacttcttgggggccagaaccaccccatgcacattcatgggtatagcttccatgttttggctcaagggttcgggaatttccacaagaaggatagggctaagtttaatttggtgaatccgcaatttcgcaacactgttggtgtgcctatgggaggatggactgtgatcagattccaagcaaacaatccaggggtttggcttgtgcattgccatatggaagaccatgtgccatggggactagccatgatttttgaggttgagaatggaccaactccttcaacttcagtccctccaccacctgctgatctacctaaatgttaa

SEQ ID NO: 18225 - DNA, 249 bp, Glycine max
  Peptide Sequence Number=SeqID_135003
atggaggccctcgtcacctcgctcacgcgcctccaccttgacgacgcgtggttggcatcgttgtgctttgacactggtgtggggttcaaggctggatctttaagcttcaatgaggaagaaggagcttcaccaccaagaattgccttggataagaagcttgaaaaggatgctttaatggaggaaaagaaagagagaaggggggagcacgaaattgaaggaataaaagagggagagaagtggaactttgaa

SEQ ID NO: 18226 - DNA, 195 bp, Glycine max
  Peptide Sequence Number=SeqID_135004
atgtcggaccttgaaccccacaccagtgtcaaagcacaacgatgccaaccacgcgtcgtcaaggtggaggcgcgtgagcgaggtgacgagggcctccatgacgaggctcgcatggggacgaaaagatgggagtgtgcaaaccacaatgttttacaaaaacatcgtggaaggctgcgttcaatgacgattatataa

SEQ ID NO: 18227 - DNA, 273 bp, Glycine max
  Peptide Sequence Number=SeqID_135005
atggaggtgaatagaccaaggtgggaggccgaagatctgaaatttgttgtaggaaatgacaaagaagaaagtagagctacaacccaagtagtttggaggaggctagagacaaactttataaaggtcaactttgatgcatctgtgaaaaaaccaaacggtattggtatgggtttggtggcaagagaccacaacgggatggtcctgggagctatgacttttcttattaatacagtctttgaacctcaaattgctaaagccctttgctacaggtag

SEQ ID NO: 18228 - DNA, 231 bp, Glycine max
  Peptide Sequence Number=SeqID_135006
atgcttatgctagccagtcctttgaataaggctaagcatagttgctacgctaagctcttgttgctaagtgcgccctgtgcgctaagcctaagggtcattttgatggcctcaaagaagagaaaggcacctgccacaccttcccaggtccgatatgaccgatctaggttcacttctcctaaggcctgggaaaggtacagtgacattattgttcctaggaagctgctgccatag

SEQ ID NO: 18229 - DNA, 192 bp, Glycine max
  Peptide Sequence Number=SeqID_135007
atggatgcaactgccaacgatataccacgcgagacttttgaggtacaaggttatccaactgtgtacttcaggtcagcaagtggaaagatatcacagtatgatggaagtaggacaaaggaagacatcatagatttcattgaaaagaaccgggataaagcggatcagcaagaatcagtcaaagatgagctttga

SEQ ID NO: 18230 - DNA, 528 bp, Glycine max
  Peptide Sequence Number=SeqID_135008
atggagatggcgagttggacacgtggcggcacctggtggactcgccagtggagttggcgagttgctgtccacgtggcggcatgggtgtcagtgatttcggggggttttattcaacaacccctaatggaccgagagttcatttccattggcggttcctccttagaggatactcgccatggagcctcccacaacgattctttcttctcagagagggtaagtgcttcgtgtcgtactagtggaagtgcttctcaccttcgcgggagggcgcgacctttcattttttccagagagcctgtcccaattaatatgatccttccccttttcgcttctaggggagtaaggagaggtagtggtggtggatatgtcaaggcgtctccccgcgtgcgacatagtcatggcgctgggttaccatcatccccacctatcgttactagctatgagtgggtgaaggacaatgttctaaagtataagtcctctttcacctttgcggcgagcgtcactactcttcaacgaggtgaatttggctaa

SEQ ID NO: 18231 - DNA, 297 bp, Glycine max
  Peptide Sequence Number=SeqID_135009
atggcaaccaaaagcaaaacttaccaagacacagtagacacaagaagaggagcaaaaagtgctttggtgccaatggctgcaaggaaagcaatgtcaacagacacaacagacacagtagacacaaagcaagaaaacttacctgagcatagtgaagagggtggctttgagaccagagcacgaccagggtggctttgtgagactctgcgtggtgggtcaaggacaatgacagtgcagagggtggctttgcaaggtaggtcaggagaaatggcagtgatgagggtcattgcactccagtag

SEQ ID NO: 18232 - DNA, 1218 bp, Glycine max
  Peptide Sequence Number=SeqID_135010
atggcgcatcataacaataatagggtttcgatttggttcctcttcgtctcatcacttctttctctcttcgctcagatctcctccgcagagaaggagttcgttctcactttagatcgctccaacttctctgacattgttaccaaacacaacttcgtcgtggtcgagttctacgcgccttggtgtggccactgtatgaagcttgctccagagtatgagaaagctgcttctatcttgagtagcaatgatcctccggttattttggctaaagttgatgccaatgaggaaaagaatagagaacttgcaagacaatttcaggttcagggatttccaacgattaagattctaagaaacgggggcaaggttgttcaagattacaaaggtccccgtgaagcagatgatattgttgactatttgaagaagcaaagtggtcccgcaacagctgaaattaaatctgcagatgatgctagtgctttgattggcaaaaataaagttgttattgttggggtcttcccaaaattttctggggaggagtatgagaacttcaatgcattggcagagaaattgcgttctgaatatgatttcggtcacaccttggatgccaaataccttccacgtggagaatcatcggtgactgggcctgtagttagattattcaagccatttgatgaactttttgttgactcccatgatttccatatggaagccttagagaaatttgttgcagaatctagtgtccctgttgtgactgtttttaacaatgacccaagcaatcacccttttgttgtcaaattctttgacaatccaaacgtaaaggcaatgatgtttgtcaacttcactgctgacaatgctgattctctcaaattaaaattccgtgaatctgccgagcagtatagacaacagggcgtaagctttctagtgggagaccttgaggctagtcaaggtgcattccagtattttggccttaaggaaaaccaagtgcctctaatgatcattcaacataatgatgggaaaaagtttttgaaaactaatgtggaaccagatcacattgcaacttggttgaaggcatacaaggatggaagtgttgaaccattcaagaagtctgaacctattcctgaagttaacaatgaacctgttaaagtggtagttgcagacaatcttcaggacattgttttcaactcagggaaaaatggtatgacattttgcttctatttggtttaa

SEQ ID NO: 18233 - DNA, 426 bp, Glycine max
  Peptide Sequence Number=SeqID_135011
atgggtcagattctacaggaccaaaccttgtgggagttaaggaatgatggaagaaaagaaataaaaaaaaaatgggacaaaaggattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattgaccaccatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 18234 - DNA, 237 bp, Glycine max
  Peptide Sequence Number=SeqID_135012
atggcgtctaacaccaagagcaaagcactgtttgattcagaagaagctttgatgatggttaaggaactgagagtaacgtttgattgtggtaagactcggagctatgaatggagaatttcccagttgaaggcgattatcaagttaactgaagaaaacgagcaacagatttatcaagctcttcactccgatttatctaagtgtgaaaccgaagcctttgtgcaagagacttcggattag

SEQ ID NO: 18235 - DNA, 378 bp, Glycine max
  Peptide Sequence Number=SeqID_135013
atgaggtcttttaacaaactcatttacgaaaggatactggaagaatttgaggccagactatctcaagctaggactaatgttgcatcaagtgttggtaaatcacaactcactcctatagatcctgttgaagaacaaagacttaggagttggtgttcggttgcagatgtgagaccaaagcgtaagggatgcatttatggtactggagaccttccttatacatataaatgcggaaatgacagcttcatgcaacctacatgttcgcggccggtatgtaaactatctacgccaaaaagaaagaaaatcacgcaagaaaaatgttgtgtaaaaacaagtagagaacgtgttggtcttcctaataggttcctgatgctaaaatga

SEQ ID NO: 18236 - DNA, 855 bp, Glycine max
  Peptide Sequence Number=SeqID_135014
cccaacaatgaagagctcaaacaattttcagattggctacttgacataggagatggaaaaattggacaacataatgacggatttttagaaatcactattccagatgagtttcgtataaaaaattatgatgatcctatccatgctattgttgaagccacctatcccagcttgatagataactatagtgacacaaattacttgcaaaaaagagctgttcttgcgtctaaaaaagaaattgttgacaaaataaatgattatgtcctatcacttatacccaatcacgaaaaagagtattgcagcgcagatagtattgataaatcagatgaattgctcaatcctgtttttgcattattgccacctgaattcctatattcattgcaaacatcaggtatacctaatcataaattaaaacttaaggttggaactccaatcatgctattacgaaatctcgaccagactgatggcctgtgcaatggaactaggctcattatcaccaaactcggatctaatgtgattgaggttgaagtaattactgtgcctaattcaggaaataggacatacatacccagaataaatatgtctccttctgaatctgcatggccattcaaacttataaggaggcagttttcattcatagtttcttatgctatgactataaacaaatctcagggacaatcatttcatcacataggactgtatttgccacacccaggttttagtcatggccaactatatgttgcactctcaagggtcaaaaacaaagatggacttcatattctcatacatgacaatgatggtaatccaaaaaatattaccactaatgttgtttacaacgaagtctttgcgaatttataa

SEQ ID NO: 18237 - DNA, 399 bp, Glycine max
  Peptide Sequence Number=SeqID_135015
atgtatggtgtagaagcaaggcttcaagaagattttgatgatgccaatagtcaagcatatccaagaccaactcaagaagattttgaattcaagaaagatttgtcttcatggataattcaaatagagcttacatcgtcgaaactagaaatgatgttttgttcgaccaagcaatacatacaattgttgacaattgagcttacctttcccgctagagtattctctatgtttgattgtgagaatcctgatgtgaatcctggcatcgacgacaaatacatatgtttgcctttgccacttcttgtacttgagaacgaaaatcaacatcctatcaagtttaatgatgagaaagaagggtatgctagtgtcatagggtattgctctgatgaggtttgggtgttttga

SEQ ID NO: 18238 - DNA, 273 bp, Glycine max
  Peptide Sequence Number=SeqID_135016
atgttaagtaaacccttaatactaacttcttcaacaccaaacaagaaaacaaaaagatcgagaagcttaccttcacgaacagttgcagggtgtgacaacactcaaaagggcacggcgagcctaggtcgcgatggtgcgaacaacacgcaacgtggaggtcaaggaggcgcgacaatgtacggttccttttgcggaggtcacggtggtgagagggacattcaggcaaacacacgacgccaactgatagtagaattttcagagacagggatttag

SEQ ID NO: 18239 - DNA, 1170 bp, Glycine max
  Peptide Sequence Number=SeqID_135017
atggcttctaggaaaagaaaaaaaccatctacacccacccaagttagatttgacagatcaagattcacttcccaagaggcctgggaaagatacacatatgttattgttcctaggaagcatttgctagagaggaacgtggtggtctactatacagagttcgatgagttcaaggaggaactcaaaagacgccactgggacgaggagttggctgactttgaggatgacaacattgatgttgccattatgaaggaattctacgccaacctctatgaccccgaggacaaatcacctaagcaggtgagggtgagaggtcatctgattaaatttgatgaggatatgcttaatactttcttgaagacccatattattatgaaagagggggaatcactctgtgcttattccaaatttgcactcctaaggcctgttaagctctgtatcccagggaggggattcgagcttaatgttgatgggcagcccctgaagattttgaggaagaacatgaccaccttagctcagacatggagtgttctttccttctctaacttgattcacacctcccacacttctaatgtcactcttgatagggctagactcatttatggcattattatgaagatggatatgaatgtgggaggacccaagaaggccagaggaaagagacttgaggcctcttccacagcatcatcagagacaagaggtccttcttctacacttcctccttcttcctccacagagatcccagtgattcctcccgtacccacacagattccactaccacctcctctctctgcaggtccagcaaattttattttcactcctcatatgcttcactccatgctccagagcatccatagagggaagtccatcatcatgcagagccttcagggcttgggcttgccctccattatgagcatggaggagtttgacgcacaggtggcctggccaggagaccggccttcttcctctagagggggtggggccttcacagcccaggagcctgtgactgaggagccaccagcaccagcaccatcaccagcaacagcagaggaggaaaccactccagctcagaccctacagccatctccaccatctgcacctacttttgaggagattcagccatcagcactggatcttaatgaagaccagccacaagaggagcaggacgtttaa

SEQ ID NO: 18240 - DNA, 231 bp, Glycine max
  Peptide Sequence Number=SeqID_135018
atgattcgaaagcgcctcggcctcattttttcttcttctttctccttcttctccttaattttacttaatctttcaatgtttgaaagtctgaacccgttccttcagcccccctcatacctatttataggaattgaggggaggaggttgatcagcagctcgcccaagcgagctcagctcgcgcaaatcaaaggcactggtaatcgattaccaagcagtgtaatcgattactag

SEQ ID NO: 18241 - DNA, 231 bp, Glycine max
  Peptide Sequence Number=SeqID_135019
atgggtcaggtggcaagcggaaatacacaagtggttatccgtacaaagacaacatctgttatcatgacctgcgaaaatacccaagtggttatccgtacaaagacaacatctgttgatcctgacccacgagtcaggtggcaggcgaaaatacccaagaagcttcctgaggaagccacctactcgcctaggcgagctgggcggcaacctcctcccattttctcctataaatag

SEQ ID NO: 18242 - DNA, 498 bp, Glycine max
  Peptide Sequence Number=SeqID_135020
atgaatcatttcggaaacttgagcaccaaccatagttcatggcctattttgctaatgatttacatccttcctccttggttgtgcatgaagcgaaaatacattatgttgtctatgatgatagcaggtccaagacaaccaggaaatgatattgatatgtatctgactcccttgattgaagacttgagaaaattgtgggttgaaggggttgatgtgtatgatcagagtgttcaacaaaccttcagatttttaactaagcatgatgggcacatgattatttgggaccatgctgttgatggtggtgggaatgcagcaagagcaaggttaaagccaggggaccaagtcctttacactaccagtttctttggggatgaattgtggcctgcagataagcttggatttactaaaaccgccatccaagcaaagccggactctatctactttgtcttcaataggttttctaatccatgtttgttccattctaccttcttaattacatga

SEQ ID NO: 18243 - DNA, 162 bp, Glycine max
  Peptide Sequence Number=SeqID_135021
atgtatgagaaagaaattcatttgtgtgaattgcgtgtgaaaggagcggtctgtacaagtgtaggaataaagaatttgttagaagagatactgagagtaggaaatgtggttgtcccttcaggcttcgtgggaaaccagtgcatggaggggaaggttagatga

SEQ ID NO: 18244 - DNA, 361 bp, Glycine max
  Peptide Sequence Number=SeqID_135022
cgtagggcaagacgaagttgacggtgagtttggaggggagagtcgaaggagtgggtggtcggggcttcatgtacgccagcggcgtcttcggcgggtcgatgttggggctcactttcttccacgcctccgcgaagacggaatccgccgccggcgtcgccggcacgtcggtggagaggcggcggcgggaggcgccggagatgagggaggtggttgcgcggcggagcatcgcggggttaggatcggatcgctcggtctcgctagggcgacaagtttgaagagaggagtgggtctgagagattttgggcttattgaaacattgggctctaacatgcctcaatactacagagcagggagttgctag

SEQ ID NO: 18245 - DNA, 375 bp, Glycine max
  Peptide Sequence Number=SeqID_135023
atggaaagtgatgtatggatgaattgctggaaggaagtcagggtattcccttcggcaagatatacatctgcccataatccaatggaattggattttcaaaatcagattctgaaaaagggaagaaaaaggaagaaaacaaagaggtacaagtttgagaaggtatggctaaatgatgtggaagggtgtcaagcagtaactaaaggatggtggtgcaaagctacgaaagacgaggagttggatgagttgcttaaattggaagacgaagtgtggctgcaaagatcaacaggcatttggttagaagggggagatagaaacacaaattcttccatagaaaagcttctcaaaggaatcaaacaaataagatcaaaaaaataa

SEQ ID NO: 18246 - DNA, 348 bp, Glycine max
  Peptide Sequence Number=SeqID_135024
atgaagatgaaagccaacaaaacaagaaatgaattgaaagtctcggatttgaaaacttaccagttgaagaccgaagaaagcacgaagaacggacgaagaacggcgaagaacagtggaaaatcttcacggaattgctcacagaaacatctcgaaagcgttacagaggcacctcggcttggattttcttcacggaaacacgttttttcacctaaaacagatgaaatgcatagcataggggttaggaacaattttacacagcccccttcccctatttataggagaaaaagggaggaggttgccgcccagcttgcccaggcgagccggtggcttcctcaagaagcttcctaa

SEQ ID NO: 18247 - DNA, 288 bp, Glycine max
  Peptide Sequence Number=SeqID_135025
atgaggcttcactgtcatcaagcgagttggagacccagcatgaccatagattcacctccactccttatggctcacatagacccgggcatagggcctaatatctcaataaaaaaggtatttctaactatgaatgtaattgatagacaaacacaccaaacacaacaacatagcaaagtccccagcggagttgccaactgtcgcaacctacccttcggcgggagggcgatgcggggctcatgggtgcgcggagtcgccaccaacgtttattcaaggaaaacgtcgtattag

SEQ ID NO: 18248 - DNA, 259 bp, Glycine max
  Peptide Sequence Number=SeqID_135026
atgccggcagcggctctggccgcaggctgccgcgatatcgcgcgccagctggtggaaatgaagtacggcgacggccttaacgtggcaatgggcggcgggcgcgccaacttcctgcccgatagcgtgagcgatccggaataccccggcaagaaaggcgccagaaaggatggccgcgatctgacgcaggcctggctacaacactatggcgagcgtgggcaatatgtctggaatcaggcgcagttcgacaaaatcgaaccgg

SEQ ID NO: 18249 - DNA, 591 bp, Glycine max
  Peptide Sequence Number=SeqID_135027
atgggcataggtcgcgcccggcgtggcgtgggtgatggtggcggtcgtcacggcgccggtggccatgccgagcgttgcggccatctcccacagcgtggtgacggtcttggtttgctgatcctcgcaattgttgagggtggccgtatggttgaggcccatcagatcgttgatggttttgacgccggtggtcatcgccaccgcgctgggcgcggagtcggtgatttgggcgtcggcggagtaggttttggccgcagccagataggggaaggcctcccaggccagcacgttggattcgccgtccacgccgcgctgctgcccttcaaaaatgcgggcggcggtcacggtggaaaaccccatgccgtcgccgaccaccagaatgacgtttttggcgcggttggtgtttggcgtctgtttcagccgctgttgcagctgagcttgcgcctgaaggaagtaaggatcttcgcgctgcgtcagctgcgcgttgtccgccgcgccggcggtggccgtccagccggtgagcaaggatatggaaagcgccaggcgggttgccagtgtgagtctgaacatgaattcctccttggtgagacgtaa

SEQ ID NO: 18250 - DNA, 225 bp, Glycine max
  Peptide Sequence Number=SeqID_135028
atgaaggatagggtcacgaccgaccaatcgtcgtcccttcccagcgctggacaagcagagaacgtcgttgcaaggttagctcgcctgggcgagcaacccctgcaccagattataaaaaatgagggagggggacgttttctgcaccaagaaactccccccccccccctcattcaaaagagagacctcacgaagcttgcggttattgctctcccaagccacttttag

SEQ ID NO: 18251 - DNA, 675 bp, Glycine max
  Peptide Sequence Number=SeqID_135029
atgagagcaaacaaggaacgaaaaattttcataaccattcaatcagattcaactcaaagaatcattttagctttgaaactctcatatcttctatttctcttttcttcaattccaaatgcacaaggctacactactagagctcatacattcatttatgccggttgctctcaagaaaattaccaaccaaacacaccctttgaaacaaaacttaattcctttctgtcttcagtttctgcctcatcttctgacacttcttacaatagctttgccattggaaatggaagctcatcaccaccagaagggttcatatatggcttataccaatgcagggctgatttgaggccaaataattgctcaaaatgtgttaaaaattgtgttgaccaaataggcttgcctgacacaaacctttggtacaagaggtgcagtaaagcagtggcaaataatgccgagttcttccagcgaagagatgatgttcttgctgatttgcaagtagctaatggatttggagtcagcacttcaggttttgttgaagggtttgcactgtgtttgatggatttgtctgtggctgattgtccttcttgccttcaagaagcagtggaaaagcttaggagtatatgtggatcagcagcatcagctgatttgttcttggcacaatgttatgcttggtattggtaa

SEQ ID NO: 18252 - DNA, 420 bp, Glycine max
  Peptide Sequence Number=SeqID_135030
atggcaaccaaaagcaaaacttaccaagacacaatagacatagcagacacgacaagaggagcaaaaagtgctttggtgccaatggctgcaaggaaagcaacgtcagcagacacagtagacacaaagcaagaaaacttaccagaccatagcgaagagggtggctttgcaaccagagcacaaccagggtggctttgcaagactccgcgtggtgggtcaaggacaatggcagtgcagagggtggctttgcaaggtgggtcaggagcaatggcaatgacgaggttaaactatacatgggatatcaagtgtgctaatatactggttgatgtaagtgggcaagtcaagcttgcaggttttgggttggcaaaggctatgaaatttaatgatgccaaatcaagcaaaggaattcctacaaaggaataa

SEQ ID NO: 18253 - DNA, 381 bp, Glycine max
  Peptide Sequence Number=SeqID_135031
atgtcacatcctatcagacattgtgtttcatcgtcctctagcatggggttctccatagctatacacctaaccatctgctcccacaaacacaaggcattatgcaacaaatgtactaggactcaatcatatatgcaatgtggtatcatgtcagtgaaaaatctcgtcgagcgcctaggagtatatgacaacatagaccacacactggtttgggtgtatgggaaaaaaaacaaagagctaggtgcgagggacattaccctcaccacagaaattatttcgaaaattccaacgatttggatgtatggagaaaaagagatggttttaggaaaggaaaaagggaaaacaaaatttagaggaagaggaagtgtagagaagttaatgtga

SEQ ID NO: 18254 - DNA, 393 bp, Glycine max
  Peptide Sequence Number=SeqID_135032
atgcataattcacaaagacatgtctacctaggaaccttcttgaatggtactttgaagagattcaatgataaacacggaagtaaatccaaggcaaatgttcaatggattctagttaaaataaaactcaaaataacttatacttacaaatgtctagtgttgaagttttatgcattgagatctttctttctcaatctgctgttaggattccctgttcttgggattgagtggcagaaaatggaaaatcctaatctgcaaatggaaataggcatgaaacctgatcagaaaggtgtgcacaatagaagaattgatcctactgctctagaatctaaggttttaaatccatcagatgttatccctagttttgatgggttgatattgccaatgatggaatag

SEQ ID NO: 18255 - DNA, 318 bp, Glycine max
  Peptide Sequence Number=SeqID_135033
atgaaggcgtaccatgatcgaaagctagtgaagaggaacttccaaaccgaacaacaagtgttgttgtcaattcccgacttaagttgtttctgggcaaactcaagtccaagtggtctggccccttcaccatcaaagatgttgaagatctacaatggtggaaatattgagagattgccaccatcatccacctccaagacccatgaggatgtctcacgtcaagctagtgacgttaaagaagcacttactaggaggcaacataggatttctgaccttacccttggtgttgtgcacaatattaggaatttcctgcatgcttag

SEQ ID NO: 18256 - DNA, 531 bp, Glycine max
  Peptide Sequence Number=SeqID_135034
atgtctcgctttgggcttagtgtacactctcgtgctaagcctcagtccccatttttcgtttctatggcctctaagaaacgacgagcagctcctagtcagtctcaaggggcgaagcccgcatgggactcctcccattttgtttctgaggtcgcatggcaccgataccaagacaacattcacctccagaacattctttcagagtggaacgtgcagctcttccctgggcagaggcagtggcaccaacgcctctccaacttgcccgagaagggcatcgacctggcattggtgaaagagttctacacaaacatttacgattcgaaggatggctccctggagcagtgtagggttcggggaaagctcatcaagttcgatgaacaaacattgaatgttttcctagagaccctcgtcatcattccagagggggagagcctgaccaccttctctcagttcatgcacacctaccctaatgcccaaaccattgtggcaaagttgtgcatgtcgggtggtcattttgttctgaatgttgagtga

SEQ ID NO: 18257 - DNA, 402 bp, Glycine max
  Peptide Sequence Number=SeqID_135035
atgcttcatttggagattgtctccaatagtcatatgtggatcattaactctgtggaagttgtggctgcccaaaagaatgatgccaagactgtcatcaagtcccttaaaggaaatattttctctcgttttaggatccccagagtgcttataagtgatggggttcacatttcttcaattcacaactgtagaaggtgttggggcactataatttcaaacataaaggttgtttcaccttatcatccccagacaaatggtcagaccgaggtatccaacagagaattaaagaaaattctggagaagactattgcttccttaaggaaagattgggctgtgaagttggatgacgccatatgggcttacaggactgccttcatgactcccattggactatcgccattttag

SEQ ID NO: 18258 - DNA, 849 bp, Glycine max
  Peptide Sequence Number=SeqID_135036
atgtggctaaaaggggtgaagacccctatggtcctgtttggaaattgcgatgacgcactaagcgtgcctgctgcgcttagcctgttcatcgctactgttaaaattttggatttccagatgaacgcgttaagcagaccatctcgcgctaagcgcgctaagcgcgccctctgcgctaagcctgagtgttattctgatgaggctgagctaagcgcgccatgctgcactaagctcaaactctcttctgtttcgaaaattagatccaggttcacatctcaagaagcttgggagaggtatacagatattgtggtgcctaggaaactactactagagaggaatgtggtagtttattacatcaagtttgacgagttcaaggaggaactcgagagaagacactgggatgaggagttgactgattttaatgacagtagcatagacattgccattgtgaaggaattttacgctaacctctatgaccccgaggataaatcacctaagcaggtgagggtgagaggtcatctagtgaaatttgatgaggatactctgaacacattcctgaagaccccagtagttctggaagagggggaaattttgtgtgcttattccaggtttgcactcctgaagcctgatcctcaagagttagctgctaagctctatatcccagggaggggattcgagctaaatgctgatgggcagccgttgaagatactgaggaagaacatgaccacccactacaagaaaaatgacctatacctacggacaaaaactgtcactataaataaaaaatctgtagacatttcttcttcaactttgagatggcatataatgacggctaattatctgtcactatag

SEQ ID NO: 18259 - DNA, 225 bp, Glycine max
  Peptide Sequence Number=SeqID_135037
atgacggcacaactaatccatgaccgagtggagatggagtgcctagagggagcttgggagaccctcgaaggcaatgcgaggtgccgatttcgagccacgattcgattcacggctacttctttggtgtatccagatgaacccgcgcgcacggttcagcgcactgtggagtggatactacccacgcctacaccataccttctagtggagccagtccaagtgatctag

SEQ ID NO: 18260 - DNA, 390 bp, Glycine max
  Peptide Sequence Number=SeqID_135038
atgagggatacgaatctggagttgcaggaatcgggttgggaggagctgcgcaaggaagcgcgcaagatcgagggtgatctcgacgtcaagctctcctcctacgccaaactcggcgctcgtttcacccaaggaggttcaggttatgtagatagtggttcaccacctattgggtccagtaggtcttggaagtccatggaaatggaaatccagtctttactcgagaaactgttggacataaatgattcaatgagtagatgtgctgcatctgctgggccagctacttctgtaactcagaagttggctaggcacagagacattcttcatgagtttacccagattaatctttcaactttctctcagttcaaaaagaacggatctctagcaatatag

SEQ ID NO: 18261 - DNA, 465 bp, Glycine max
  Peptide Sequence Number=SeqID_135039
atgagggaacatgcagagcttttgagttctgtcagggatgatattactgactttaagctattttctcttagttgtactagacttaccttcttctggcagacatcaggaagtatgtcaccaaggatgcagttactacgtgagagagcttccatccatggaaatatatctcatgagtctggattcactttccctgcatttttccagatagatgacgtgattagtcaagctcaagcaacaagggctgtgttgggttctcagagaacattgtttactgatgttcaaggaaaagtgaaggttcttggtgacaagttccccatgattcgtagcctgcttggttcgataagaaggcggcgctcgagggatactcttattctgtcagcagtaattgctgcttggaaaagggcggaaactaaggagcttaagaaacaaaagtggccagtggtatcaagaaaagttaattcctaa

SEQ ID NO: 18262 - DNA, 330 bp, Glycine max
  Peptide Sequence Number=SeqID_135040
atgtcttcatttacctttcaaaagacttcaatgtcttcagtcatttattctttcaaaagactacaacgtcttcataggactcactgtccttgtttgtgcttcggaggaagggctgaaagggaggttctgaggtccagaggtgaaggatcggagagaaagaagagaaaagaagaaggaagaagagaaaaagaagctaaatccctgtcgaattgtgattgtaatcgttcttcgttttcatccgtaagtttcaaccgatcgctaatgccgaaaaagaagctaaatccctgtcgaattgtgatcgtaatcgttcttcgttcatcatctggttag

SEQ ID NO: 18263 - DNA, 306 bp, Glycine max
  Peptide Sequence Number=SeqID_135041
atggattggtctcatggattcatccgcaataaggaattaagatgcgaaaacaagaacaatgatggatttaacaaattgactttgctgaaaacgcctgacactacacatagttggctggatcagacaattgggttagaggaatgcaaagtcaagtgcttggataactgttattgtatggcttacacgaatttggatattagtggacaaggaagtggttgtgctatgtggtttggtgatctaattgatattagacagttgcagttggaggctaggatgtatatgttcaaattgatgcttcaaaattag

SEQ ID NO: 18264 - DNA, 204 bp, Glycine max
  Peptide Sequence Number=SeqID_135042
atgaagactaaccgcgaagggattaaccttgatccgttcttcgtcgaagggattgggatcagagaaagcgtcagaatctacaacattttaaaggcgtcgcaattggcgagtttttggcccagttcacatctttctaatccctcattcactggaaaccctaagcgtgacagagtagagggaaagacatgttgcgtgggtcattaa

SEQ ID NO: 18265 - DNA, 270 bp, Glycine max
  Peptide Sequence Number=SeqID_135043
atgggtgctgccattgaagatggcgagaagcctgcatacgtggaggtgaatcctgcgagacacacacattctcgccaattcgaatggcgagacatgctggaagcccatgccgccaatacaagtggcgggacatgccaacgtggacagtcccacccttggcttctgcgagacaacttcacgaggtctgaatgcccaccttcacgaggtctgaatgccacagctctgaagatggcagtgtataggattgcagggttagggtttgtagtctga

SEQ ID NO: 18266 - DNA, 348 bp, Glycine max
  Peptide Sequence Number=SeqID_135044
atggcggcgcaactaatccatgaccgagtggagatggagtgcctagagggagcttgggagaccctcgaaggcaatgtgaggtgccgatttcggggcatgattcaattcacggctacttcattggtgcatccagatgaacccgcgcgcacgcttcagcgcactgtggagtggatactacccacgcctacaccataccgtctagtggagctagtccaagtgatcgagggtgatgaggacccactccttgaggtggattctcccgaggacgccatgtcggcatctgaggaagactctacggaggagagcggccctggagagatggcgactagtggaggctcttcatcatag

SEQ ID NO: 18267 - DNA, 249 bp, Glycine max
  Peptide Sequence Number=SeqID_135045
atggacccaacaacaaaccttgttgagttttcatctcagaatttggaagcatgtaccaacaatttcagtcagaacaatctcattggcttgacacagtttggtagattgtatagaggcaaccttgaaggtcaacatgtagtagtgaagatatgggatggtgaaagaatgaaacagataagttccaaatataatgatgagaatttgattatcaaagcaagtgctctcactatctctttcactcataaatga

SEQ ID NO: 18268 - DNA, 900 bp, Glycine max
  Peptide Sequence Number=SeqID_135046
atgaagtttgggaagagactcaagcaacaaattcaggaatcgttgccggagtggagggacaagtatttgtcgtacaaggaattgaagaaacttgtacggctcatatcggcggcgccgcctaccttgttgaatgggtcgttggaatttggcaagacggaggctgagtttgtgtacttgttgaacaatgaaatagacaagttcaatgggttcttcatggagaaagaggaggacttcattattcgccacatgggaatcgtggctctccctcatccacaagaggatcctacaaatatgaatatgggtcagaagggagataatttggcccatgatggtttttcacgtggaacaccgtcaccattgcaggaagtacaacagagaatccagagagtagttgatttgtggggaccaaatggaagtcaaccttctgaagaggattataaagaggagatggcgaaaatcagaaaagctattgttgatttccatggtgaaatggttctcttagtcaactacagcaacatcaattacacagggttggcaaaaattctgaagaaatacgacaagaggacaggggggcttctgcgtttgccgttcatccagaaagtgttggagcagccctttttcacaacagatttgatttcaaagctcgtgaaggagtgcgagagcataattgatgcagtgttcccggccgaggaagaagctgaaagagcaaaggaagcaaaagaggcgataactgtggcaggaaaagggattttcagaaacacggttgcagctttgcttacactgcaagaaatcagaaaaggtagctccacagagagccctttttctctgcctccactcaatttgccggactctgatctcatccaatcaatacagctcaatgctgcagttcctattgtctag

SEQ ID NO: 18269 - DNA, 357 bp, Glycine max
  Peptide Sequence Number=SeqID_135047
atgttgaggagggtttactatgaacttgatgaacaacgaacaaaggaagatgcaaaggatgttgcatttgttgtgtttttgctagatgcggaggttgtttggtgtcaagaagagccaatgaacatgggtggatacacttatattttaccccgactcataacttccatgaaggctgtaggtaggggaggttatgaagatgtcaaatatgctggtcgtgctccctctgcagccacagctactggtttcctcaaggttcaccttaacgagcaggctgagctagttcagaaagccattcaacgtgagccaatcaatttccctttactgaggcatagcatatacattgtttctccagagtga

SEQ ID NO: 18270 - DNA, 555 bp, Glycine max
  Peptide Sequence Number=SeqID_135048
atgttgtatggcagtatcgattttaagataagaaccattgaactagacggcaaacggattaagttacaaatctgggatactgctggtcaggaacggtttcgaactattaccacagcttattaccgtggagccatgggtatcttgctggtttatgatgttactgatgaagcatctttcaatagtaatctcctttccttgcttggtttttgctatccagatattaggaattggattcgcaatattgaacaacatgcttctgacaatgtaaacaagatacttgttggcaacaaggctgatatggatgaaagtaaaagggctgtacctacctccaaagggcaagcacttgctgatgagtatggtatcaagttctttgaaactagtgcaaaaaccaacatgaatgtggaagaggttttcttttcaatagcaagagatatcaagcaaaggcttgcagacacagattcaagagctgagcctcagactatcaagattaaccaaccagaccaggcagccagtggtggtcaacctgcacaaaagtcggcttgctgcggttcatga

SEQ ID NO: 18271 - DNA, 201 bp, Glycine max
  Peptide Sequence Number=SeqID_135049
atggtggtgataaaactggttgtgaatgagccatcagaaaatctcaaaagcagacaactcttcccgacacctagaataattaacgatcaaaggaaaaaggaactgaccgctgtcgccgataagaagaagcttgatgaggtaatcgtaatcggcacgagctctagcgggtgctgcggccatcgcagaaatgaaatgccctaa

SEQ ID NO: 18272 - DNA, 660 bp, Glycine max
  Peptide Sequence Number=SeqID_135050
atggatgcgtcgtctcaggaatatattgatgaaataaaagtggtaggtgcccatgatgttagtctctcaatatgcagaacaaaacccagaggagttagagtggctaagaaagtaaaccaaaggaaatcaaagcttatgggctgcacatgccgtctgaaatattataatcgaacaagcctatcgacttcctcaatcgagcaagagtttatcccttcaatcccatggcatgccatctttgtgtttcttgacccaatactcattggtgtgatgcaagttgagtatcaaaacaagaaagaatccccctttgatacacacccacttcagaagaacaccttcttgacagccatatgcatctatggggcgttactaggaatcaagatgcagacaaagactcgcgacggcttctttcaagagattctcaactatggtcttctcctctctggagcgttttcttcagtgtcccttttatccatcttattgaagcaacatcaccttttgtggattgtgcttaccatatggggatctataccaatagtactgtctcgtcacatgctcaaaagttcagcgtgttggataacaaaaatgttagccaagttgacatggggtgtttgtaaggattcttcagccaatggaagcaacgatatttgtccaagagtttaa

SEQ ID NO: 18273 - DNA, 456 bp, Glycine max
  Peptide Sequence Number=SeqID_135051
atggtcaccgagctaaccggtaaccggttacaccatcccggagctaaaagcctctacgttggagaaggctcctcaatggccgtcacaacaatgaaacagttaggttttttctccagcgtcagtgtcgtccaaatgcaccatttcgagcagaggaatgtcctgtacaaggataattcctttgatttcttgttctccaaagacctaggagaggtttctgtcccaacattgctggttctcgagactaattcgaagacatgggttgagagagacttactgagttatggaagtggtgaaaatggcgggggattggaggtggtgagtttggcttgtggcctagtgggaggggatactcttatgagttacacacccttgagtgttacattactttcatctcaggcacaagacaatgaagccgcataccagtctttgaagaatgggatggaaaaatcccaatag

SEQ ID NO: 18274 - DNA, 171 bp, Glycine max
  Peptide Sequence Number=SeqID_135052
atggagttagttcaaggtctccctgaatatctggttgtggttgtgcaacaccaacaactagggcatttaacaaccttcccaaacgaaacctacaatgaccaaaaaggaggagttgtcaaaggtggaaatgacattaccgttttaggaggagttatcgacgatcatttgtaa

SEQ ID NO: 18275 - DNA, 612 bp, Glycine max
  Peptide Sequence Number=SeqID_135053
atgacatctggtgggcacaaaataacatcaagacaaaggtggacacctacacctgtgcagcttcaaattcttgaacgtatatttgatcaagggaatggaactccaagcaaggaaaaaatcaaggaaatcactgctgaactgggccagcatggccaaatttctgaaacaaatgtgtataattggtttcagaataggcgtgctcgatccaaaagaaagctgcaaaatgtggctgcttatagcaacactgaatcagaagtggagactgaggttgattctaaggataagaagacaaaagctgaggaagagtttcagtcccaacataataataacataagtacaacttctggaggggctgaaaagttgtgcttccagaaccctcaagtacactctgattacttgcagtacttgaaccctgcagattccaacaaaccatattccatgttccaaacagatgacaatctgaaatccacaagaaatttgagtcatgtgtctgttttcaatgaggtgctgtcaaactcaaggagtgagcatataggtgggaaaatggaagttggtgggagtgtgagctacaatttattccaccaaacaggacacttcaatctagcgggttaa

SEQ ID NO: 18276 - DNA, 1836 bp, Glycine max
  Peptide Sequence Number=SeqID_135054
atggttatcaaagcacttatagaaaccagcagaaagaattcctgggcagaattagttcattgtaagctcatttccatgttagctaacatgttgtatgaggttcctgatgaagttgttgagctcctacctagcacaccaaagtttctcgtgaatcaacttgatctgattggaggagttcaatttcttttacgtgaggattgtactgtcaaatatgcccttgtaaactcgagagaggagaggaaaaatctgtattcggtgctttttgactatgttctgcatcaagttaatgaaaattgcatagctactggaatcaatgaatatagtgatgatgagatccaaccacttgcaagtctacttgctcaaacaaatgcagctgaggcatttcatatttctgttaaacttggggtagaaggaattggggagcttttgaggagatcaattgcatctgcactttcgagatatcccaacagtgaacgtctaaatatgctcttggattttgtgacagagaaatttgattcattaataagttcattcactcatttggatgaagagttctctcatatgattcagataaccaaaactcacaagtctcttgaaaatgtggaaattattgctctaagaaatgacattgatctgcaggcaaagcactcgtgggccactttacattcccttcttcattctgaaagaattgcttaccgtcagaatgggtatatctggttaggtgatctgcttatttctgaaatcagtggggaaagcaatggtaccatatggtcaaatatagaatacttccagcagaaatttgctcaagtaggaaaacaggattcttcagatatgtcagatattcctttgcccatttcacttatgtgtgggcttttaaaatcaaatcataactatattagatggggatttttatttgttcttgaaaggctgcttatgagatgcaaatttttgttagatgaatatgaaatgcaacaatcaaggaggagtgatcttgcgagtgggctgaaagattggcatcttgagaaagcccatgcattgattgacataatgagcagtgctttgttgtttcagataaatgaaaaagattgcaccaataagtatgaaacagatcgcaccaatattctgaaaatgtgtgacatattattatcccaattatgcctaagagttccccctgctatggccctacccaatggagatgatatgcaacatgacaggattttaaattgcttcagttcaaacaaaatgtttgatagtgataaccgtgcccttaaacaagatacttatctcgtggatgaacatattgaggaagaagctgatggaacttcaaactaccctaagaactatcatcttgttcgtgagactgcagcaatggcagcacttcttctccaaggacaagccattgcctcaatgcaattaattgcgcgcattcctcttgatttgctattttggccactaatgcaattggctggagcagcaacagatgatattgcattgggtgttgctgttggaagtaagggaagaggaaacctgcctggtgctgcatctgatatccgggccactcttctcctacttcttattggtaaatgcacagcagatcctgttgctttcgaggatgttggtgaagaacgtttttttatgttcataaatttcgtcctttgtaacgatttccctttactgcagcgaatgatgactgagagtccagaaaaatatcaacacatgcttcagaatcttctttttaaagctcagcagaccaacaatgaaaaactgttagagaatccttaccttcaaatgtgtggcatacttcaattggcaaatgatcttggatttgacttgtga

SEQ ID NO: 18277 - DNA, 3945 bp, Glycine max
  Peptide Sequence Number=SeqID_135055
atgaagaacttgaaggtgtttggggaggttcccttgggactctcccttgactctaacgaggaaactatagggttttgcagcttcgacatcgaacgcaaccgcatcttcttcctctcttcccacaatctcatttacacttcccatctctcctctttccacgagaacgccgtttggagccctaacgcctcgctctcctcctccgatgctgttaccgtcgatctcgaacccggagacgccgttacctccttcgactacctcatggagaaagaagcgcttcttctcggaacctccaacggccttctcttgctccacaacgtcgacgacgcctccgacgcgacgcaagtcgttggcaagctcgacggcggcgtcaatgcagtttccctcagccctgacggagaactcgtcgccgtaaccaccggtttcgggcagcttttggtgatgactcacgattgggacgtgttgtacgaaacatcactccacgatgatgatgttcccgtaagtgaaggggagtttcttcccgtgtcttggcgaggagatgggaaatactttgctacgatgagtgatgcgtgtggttctggttcgttgcttaagaaaattaaggtttgggatcgagattcaggggatttgcttgcttcttcggagctgagaagttttgctggggcagttttggagtggatgcccagtggtgctaaaattgcagctgtttgtgatgggaaagatggaaatgaatctccctctgttgttttctttgagaggaatggattagagagaagcaggtttagtgtcgattcgaaagttaaacttctcaagtggaattgcagttctgatcttctcgcaggtgttgttgaatgtgaaaattatgatgctgtaaggatatggtgttttagtaataaccactggtacctgaagcatgaaattagatacttgaagcgagatgaagttagcttcatttggaatccgacgaagcagctgcagttaatttgttggactgttggtggtcaggtcacagtttctaactttatttggatcacggctgttatggagaattctgttgcactggttgtcgatggctccaatattcatgtaacgccactgtccttgtccttaatgccacctcctatgtatttatttagcttgaaattttcttctcatgtccggggtatggcagtgtattgcaaacactctaagaaccagttagctgcgtttctttcaaatggtagcttatgtgttgtggagcttccatcaattgaaacctgggaagaactagaggggaaagaattcagtgttgaagactctcatacagaaatggcatttggatccattttacatcttgaatggttggattcccataagctattagccatttcacattatggttttagtcatagtaatgacttatttcaaacctcattgactgagggtggacttcgaggcttctatttgcaggaagtggaacttgaatgttctgaggatcttgttccaggattgctgacatgctcaggctggcatgcagcagtttcaaatcgaaatacccttgaagagctggttattggcatcgcttccaatcctgctagtaaacactctgcatatattcagttttctaggggggaaatccaagagtatgtatcaaaaattgggattagtagaggatctctagaacaagaacatcaaggtttttctgcagcttgcccttggatgagtgtagcgttagttggcagtgctggcctatcaaaatcagtgctttttggactggatgagattggcagactgcatgctaatgcggggatactttgcaacaactgcagcagcttctcattttactcaaatttggctgaccaagtgatcacacatctaatccttgcaactaaacaagatttgctttttattgttgacattgcagatgtatttaatggggagttagactcaaagtacagtaactttgtccgcattaacagtagaaaaaaagaagaaaatgaaagcttcataaatatatgggagagaggtgctaaaattgttggagttttacatggagatgaagctgccattatactgcaaactactcggggaaacctagaatgtatatgccctagaaagttggttttggtttccatcattaatgcattagttcaaaagcgctttaaagatgcattacttatggttagaaggcataggataaatttcaatgtaattgttgattactgtggctggcaagcattttcacaattagcttctgaatttgtcaggcaggttaacaatctgggttacataaccgagtttgtttgttccataaagaatgaaaatattatagagaaactctataaaaatcacatttctgttccctgtccaaaggttgctgatgttatgctagttgggggcatccagaattctcttgctggtaacaaggtttcttccgttttgatggctgtaagaaaagcacttgaggatcacataacagaaagtcctgcaagggagctttgcattttgaccactctagctcagagtgatcctccattacttgaagatgctttaaagagaataaaagttattcgtgaaaaggaattgtctcatgctgatgaccaggggagaatgtcttacccttctgctgaagaagctttgaagcatcttttgtggttagctgactctgatgctgtatatgaagctgctttgggtctttatgatttaaatcttgcagctattgtggcattgaatgctcagaaagatccaaaagagtttcttcctttcttacaggaattggagcgtatgccaactctattaatgcaatataatattgaccttaggctgaaaaggtttgaaaaggctctcagacacattgcttctgctggagattcttattatgatgattgtatgacactcgttaaaaaaaaccctctactttttcctttggctcttcaactttttactggccctaccaagcagaagccattccttgaggcatggggggattatcttagtgatgaaaaatgctttgaagatgctgcggcaatttatatgtcctgtttcaatctggataaggctctgaagtcttatcgtgctattaataactggagtggggtgcttacggttgctgggttccttaatttgggaaaggatgagctactacatcttgccagtgagctctgtgaagaacttcaagcactaggtaaacctggggaggctgccaaaattgccctggagtactgtggagatgttaacaccggtgtgaatttgttgattactgcaagggactgggaggaggctttgagggttgtttttatgcatagaagagaggacttaattaaaacagtgaagagtgcatctttggaatgtgcaagcacacttaccagtgaatatgaggaaggcttagagaaagtggggaaatacttggcacgttacctggctgttcgacagagaagattacttcttgcagcaaagctccagtcagaggaacgtgcagcaagtgatcttgatgatgatgctgcttcagaaactagcagtaattttagtggaatgagtgcatacaccacagggaccaagaaaagttctgctgcttcaatgagctcaactgcgactagcaaggcaagagaaactaggcgtctgaagaagagaggaaaaatccgtcctgggagtcctgatgaggagattgccttggtggagcatttgaaaggcatgtccctgacagtggaagctaaacgtgagctgaaatctttgttggtctcccttatgatgtttggtgagggagaaacatgtaagaagctacaacaaacgggggaaaactttcaattgtctcagatggcagcagtcaaattagctgaagatacaatatctaatgataccataaatgagtatgcacatacgttggagcaatatacccaaaaagtaaggaatgaaattcacaattcagaggctttctcgtggcggcttaaagtttttttgtcctatgagtga

SEQ ID NO: 18278 - DNA, 843 bp, Glycine max
  Peptide Sequence Number=SeqID_135056
atgctattaagacttaagagttctcaactagttaatttatacagatacaaaccaagtgaggagactttaattcagatagatcttttttgttcaaccattattgctcaatgtgatattaatctgaatcgaccatggtcaagatctttgaatcaacaaactggtgctttagcaacatccacaaatacatctcctttgcctgtatctagttttacttctggggcaattctcaaatcactgagttatgtgcgttcccttgtggctcaacacattccgaagcggcattttctaccagcttcattagccggaccaccttctgcgtcgggacaatcactgccaacattgtcatcgttgttgagtaaatccttcaattcccaactatgtccagcaagtgtcaccgaatcagtggagaaggattcagtcacttcatctatttctaagttatcaaaaattgaaaaaattgatgaaaaagacgaacttgggttcattgcccatgatattttacaatggcgttggcttgataaacagcagtcatcatcaatgaaagctgacagtgatcatgctgtaaattcacaaggcatgagagcatataatttcttagaagttggtgctgcagctctacttgaaggagacattggagctaagatgaaggggcaaccatggaaatattttgggacggatgatatgccttatctggatcaactattgcaggcttctccagtaacatcatttactaattctgcatctgcttgtccccacctgagagcaataacagcatctaaacgcacaaaagcaggccctcgtcaagtttggcatgttcttctatcagataactttctgttctga

SEQ ID NO: 18279 - DNA, 273 bp, Glycine max
  Peptide Sequence Number=SeqID_135057
atggtataccaccatgactacagaccattatacttaatattcaatgcacaaggtcttaccttcacactaattctggcaggactatctggcagaccctgcaaccacggacttggcttacagtgcaattttgggacatactattgcagagagggagcggagtcctgcagtagtctcaaggtgtgtgacacttttcaaacgctatcttctaaggaaaaagagtactcaacctccctaaacactacctcttttacaaatggacaccctaaactttag

SEQ ID NO: 18280 - DNA, 276 bp, Glycine max
  Peptide Sequence Number=SeqID_135058
atgataaatgattgtagatgcgattgtgccaactatgagtgtccatttattcttgtttctagagattgcaataagaaaatacgaaacaaaaacaacagcagattcctgcatcaggatctggctccaacgtcagtgagattaagggagattgatgcagatctccaaggccgagatgcactagatcaacgagaagtcgctgaaggtggacccgccttcgatggatcgggtgcgggcagatcaaaaggagcatttggcggaggaggaagaggagaatga

SEQ ID NO: 18281 - DNA, 2567 bp, Glycine max
  Peptide Sequence Number=SeqID_135059
atggagagtatcttcctctcctccttcaagtttgcactctccctctcactcctactccactcaccttctttttcctctgctcagatcatgcaaggttttgtaagtttggactgtggaggtacagaaaaatttactgatgaacttggtcttcattggactcctgatgataagcttacgtatggacaaataagcactatatcagttgcaaacgagacacggaagcaatacacaacacttcgacactttcccgctgattccaggaaatactgctacactcttgaagttgttagcaggacgagatacctattgagggcaagcttcttatacgggaactttgacaataacaatgtttatccgaaatttgacatttctgttggggctacgcattggtctactatcgttatatctgatgctaatagcatagaaatgcgagagcttatatttttggcttcgagtcctacagtaagtgtatgcttatcgaatgcaacaacaggacaaccatttatatctacactagaacttcggcagttcaacggttcggtttactatacacaatttgagcaacacttctaccttagtgtctctgcaaggataaattttggtgcagagagtgatgctccaattaggtatcctgatgacccttttgatagaatttgggagtcagattctgtgaagaaagctaattatcttgttgatgttgctgctggaactgagaaaatttctacaacagtaccaattgatgtcaacagagatgaaatgcctccagtgaaagtgatgcaaacagctgtagtgggtactaatggatctctaacttaccggttgaacttggatggttttccgggtactggttgggcattcacctattttgcagagattgaagatttggatcccgatgagtctagaaaattcaggctagtacttccgggtcagccagatattagcaaggctgttgtaaatattgaagaaaatgctcaagggaaatatcgcctctatgaaccaggatttaccaatatatctttaccctttgtgctctcttttagatttggcaagacatatgattcttctaggggacctctcctaaatgccatggagataaatatgtatttggagaaaaatgatggctctctagatggagcaacaatttccaatatactttcacactactctgcagcagactggctccaagaaggtggtgatccatgtctgcctgttccatggtcatgggttcgatgtaactctgatccacagccaagaatagtttcaatcttgttatccaataaaaacttaactggaaatattcctttggatatcaccaaattggttggtttggttgaactatggcttgatggaaatatgttgaccggtccatttccagattttactggatgcatggacttaaagatcattcatcttgaaaacaatcaattgacaggtgtgctcccaacctctttgacaaaccttcctagcttgagggaactgtatgtgcaaaataatatgttatctggaacaataccatcagaacttctaagcaaagatttggttttgaactactctggaaatataaatcttcacagagaaagtagaataaagggacacatgtatgttatcattggttcatcagttggagcttctgttctacttttggctactattatatcttgcttatatatgcataaagggaagagaagatatcatgagcaaggctgcattgattctctccctacacaaaggctggcttcttggaagagcgatgatcctgcagaagctgctcactgcttcagttattctgaaattgaaaatgctacaaataactttgagaaaaaaattggttctggtggttttggagttgtatactatgggaagctaaaagatggaaaagagatagcagttaaagttttaaccagtaattcctatcaaggcaagcgagagttctcaaacgaggttactcttctttcaagaatacaccacagaaatttggtgcagctgcttggttattgtcgagatgaagagaatagtatgcttgtttatgagttcatgcataatggcactctaaaggaacatctttatggcccattagtgcatggacggagtatcaattggattaagcgccttgagattgcagaagatgctgccaaagggattgaatatcttcacacgggttgtgttcctgtcgttatccacagagacttaaaaagcagcaatattcttctcgacaagcacatgagagccaaggtctcagattttggtctttcaaaacttgctgttgatggagtttcccatgtttcaagtatagttcgaggaacagtaggatatctggatcctgagtactatatttcccagcagctgaccgacaagagtgatgtttatagttttggtgtaattcttcttgaactcatatctggtcaagaagcaatatcaaatgaaagcttcggtgtaaattgccgaaacatagttcaatgggcaaaattacacattgagagtggagatatacaaggtattatcgatcccttgttgcggaatgactatgaccttcaatcgatgtggaaaatagcagagaaagcattgat

SEQ ID NO: 18282 - DNA, 102 bp, Glycine max
  Peptide Sequence Number=SeqID_135060
atggccgtgacaaagagttatgtcacaccaaattgtgaaatgctaaatctcattacttcttcctgttggcatccttatcttctcgtaaagaatcattattga

SEQ ID NO: 18283 - DNA, 849 bp, Glycine max
  Peptide Sequence Number=SeqID_135061
atgagatcaccccagcctcttcgcaacggcggcgataacagttgttcgccgtcgcataacccccgtttccactccacggtggcggaacacaaactacggcgtttcaacttgcttattctcgtgttccgcctcagctccttctccttctccctcgcctcctccgttttcatgctcaccaacactcgtggctcctattctcctcactggaaccactacgataccttcagattctttctggcggctaatgcgatagtggcggtgtactctgtgttcgaaatgggcgcgtcggtgtgggaaatttcacgaggcgtaacactgtttcccgaagtgttgcaaatatggttcgacttcgggcatgaccagggtggtggtgcaggtattcgcgtacctgctgttgtcggcgagcgcggcggggacgtcgatggcgaggacgctgaaggagatggagacgtgcttcacctcgctcctaacgggcttccgcgtcgtctctttcataatcaacggttcccgttttcatctctgagcgttgcagttgatgaagatttgggtcatagagaggaggaaggatcactcagtgccaatgagctcctcattgaccgccttttctccctttccttcgtctatctctcctttcttgttgacgtctcgttggcaccagtcaaccagggatttgcaccaaaggcaactccagatgcggatgaggtggaggaagggacagtagtggcagatggtaggcctgttcatcaggcttgtttcatccagattcgagcccaaaaggctcaaaccattagcttgcaatacaggtccgtttctgccctaatggactgtcagcttgagcggatatggcaa

SEQ ID NO: 18284 - DNA, 348 bp, Glycine max
  Peptide Sequence Number=SeqID_135062
atggcgctgccacattccatgttgtctatcatttcacccagcatctctaatccatggtgtcttcccttaaagctggcaattcgacaacactcttctatttcccttaaacaggatggtgatagcagcagatcaataagaatactcaaatctgatggcaccacctcgggcgataattatattcgtcctatcaaagacatcaagactgcggaatgggaggagactgtgttcaaagacataagctccttgattattcttgtgcacaatcgatataaaaggcccaaggagaatgaaaaaattcgggatgaattagagattgcctttggttcctgctactttaacatgagataa

SEQ ID NO: 18285 - DNA, 2383 bp, Glycine max
  Peptide Sequence Number=SeqID_135063
gatgaaccgctttgtggtgtgtaagtctcgtttgtgggtagtgaccattgtgttctacacatgcattttgatcccattgatgcaactaaagaaggcacttgcaagcatggttttgttctcttgtgagaccaaaggcatggccaaggagatggagttcccagaaattccttccctgcctgtggcaaggttcgaggatttgaagggtcataactgtgatgaagagaaagaagagatttgttccatttgcttggtagagtatgagggagaagatgcagtgagcaagctgggaagcaaatctggcgaaatggagggaatgtgggagaacattcttggaaagcatcagcagtcgctgaaatccctattcctccgaagcaagccttcttcccccaacgccgacgccgccgatgactatgccaattcccccaaacccatccctcagctctctcctctcgccaactccgtcgtctctcgctgttccaagatccttggaatgtcgacacaggaattgcaacactgcttcgattcggaactccccatgggcgtcaaagagcttctcacctacgccagacacctcctcgagttctgttcctacaaagcgcttcacaaactcattcaaatctccgatttcttaaacgacaaggattttcatcgtttaaccttcgacatgatgctcgcttgggaggctcccagcgtccacaccctcccagatacccctacttcaagttcaagtaaagaggaaaccgcaggggacgaggatgaggcctccttgttctattcgagttccaccaatatggctcttcaggtcgatgacaagaagacggttggtttagaggctttctcgcggattgctcctgtgtgtattcccattgccgatgttgtaactgtccacaatatcttccatgcactcactagtacctccgcgcaccgccttcattttcttgtttatgacaaatacctaagattccttgacaaggttatcaagaattctaagaatgtaatggccacatctgctggaaatcttcagcttgcagaaggagagatcatccttgatgttgacgggacaattccaactcaaccagttcttcaacatattggaatcactgcatggcctgggcggttgaccctcaccaattatgctctgtactttgagtcactgggagttggtgtatatgagaaagctgttcgatatgatctgggcacagacatgaaacaggtcataaagcctgatctaactggacccctcggtgctcgcctttttgataaagctgtgatgtataagtcaacttctgtagcagagcctgtttattttgaattccctgaatttaaagcaaacttgcgtcgtgactattggttggacattagtctggagatcttgcgtgcacacaagtttatcaggaaatactaccttaaggaggtacaaaaaacagaagtgcttgccagggctattctgggcattttccgctaccgtgcagtcagagaagctttccagtttttttcatcccactataaaactttactttcgtttaacctagctgaaactcttccgcggggagacataatcttgcaaaccatgtcaaatagcttaacaaatttgactgttgtttctggtaaacatgatattcctgcgactgtagatacaaaaaggcaaccggcagtgtctccggtagcagttatggcacttttctatcttggatacaaatcaaaaaaggtgactgatatttgtgaggaagcaacttttgtcagtgatatccgagttggtgagatacatcccttggaagtggcagtgaaaaagtcccttctggacactggaaaagcggaagctgcgcaggcaaccgtggaccaagtgaaggttgaaggaattgatacgaatgttgcagtaatgaagggaagaccattagaagcctttatagtaactcctcccccaaatcgaaatgctgtagaacaactgctgacattacaagaggccattacacagtttgaatcgcttattcaagctgcaaatattattctcctaaaattgagagctcttctacttgctatattaccacaggctacagagaaggttgcactattacttgtattcctagcagcagtgtttgcttttgttcctccaaaatacatatttttggtggtattcgttgagttttacacaagggagatgccatataggaaagagagcagtgatagatggataaggaggattagagaatggtgggacagaataccagctgctcctgtccagctcgttaagcctggatatggcatcctccaagatcttagtaccattaaacctttcctctacggaaacaatcttattcctatggttggccaagtactccatggtcaaacagatccaccaggcactgccaattttgagaactag

SEQ ID NO: 18286 - DNA, 468 bp, Glycine max
  Peptide Sequence Number=SeqID_135064
atgaagtttcaaatgaggagagtatcaacaactgaacgtttcctgtccataaagtttcaaatgaccatgctttttcttatcatgaatttctcgtgtctttctggatttctggtaacgacaattggggtgcaggatgttgttgaaatcatgaaggaatccctgtatgataaatatgttgatgagcatggtgtcgtggatttcggtcgaagtggtgggatgagtcaacagaaagaggcaaaacgctttctaaatgccctaaacaagcaatcggaactggaacagaaggattgcttttcagtatctgaaatatacagtttggcggataggatttgtttgaaagttcctgatattgacactttcattgaaaatttaaacagtgttggttatctactaaaaaaaggaccaaagacataccaggttttatcctcttcctacgcacgaagccaaccgtttaggacaagggactaa

SEQ ID NO: 18287 - DNA, 555 bp, Glycine max
  Peptide Sequence Number=SeqID_135065
atgagtgctgctctcctgtctcgtttcgatttaattttcatactgctggataaacccgatgaacttcaggacaagcgactctcggagcacattatggcacttcatggtggaaatgcacaacattcaccggtgttgaaaaagcgacgtggagatccatctgattccatagctggtgtatcacagaatgccgaaggttttgatctgggcgttagatctgggtctttaatttcaagtttgagacttgacccccaaagagactgtgactttgttccattacctggtcaacttcttcgcaaatacattgcttatgcaaggagttttgtctttcctaggatgacaaagccagcagcagaaatcttgcaaaagttttacctaaaactgagagatcataatacttcagctgacggtactcctatcacagctaggcagctggaaagtcttgtaaggctagctgaagctcgggctcggctagacttgagagtagaaataacgacccaggatgcaacgaatttggcagaagtgttcaagattgttgcaatgtccaaaccatcttaa

SEQ ID NO: 18288 - DNA, 429 bp, Glycine max
  Peptide Sequence Number=SeqID_135066
atggatttggaccagtggatctcgaaggtcaaagatggccagcatcttctcgaagacgagcttcaacttctctgcgaatatgtaaaagagatccttattgaggagtccaatgtgcagcctgtcaatagtccagtgactgtttgtggtgatattcatggtcaattccatgatctaatgaaacttttccagactgggggtcatgtgcctgaaacaaattatatttttatgggagactttgttgatcgaggttacaatagtcttgaagttttcaccatccttttacttctaaaagctagttttttctatggagcctgtccttcccatacgaactacaaattcatttattcttcacttcttgtactcaacttcagcataggagcaatgattgtggtgcaaagtaggaagaaaagaagggtaacagtggattag

SEQ ID NO: 18289 - DNA, 1455 bp, Glycine max
  Peptide Sequence Number=SeqID_135067
atggatatacttggcacttactttcctcagcaactcttcaccgtcgatgatatcttgctcaatctcacttctgctcttctttccttcttctcttcaccgccgggacaaaacctcgtttctcaggtgaaaaatgattatggcaactacgtcttgtcactcgactttctgcagttgcaacaaatatgtcatgttgaggaattttataaaatgttaacggagaaacctaaaattgctctcttatgtatgagtgcggctgttcataagaatggcgatctagagcatggtgcaaaggtagatattcgtcttcataactgtcctgaaactatgattgcgctgaagaacttaaaagcagcttatattgacaagcttgtctcagttcgtggtactgctgtgaaagtcagcactgtcagacctctggtggtggaaatgagttttgaatgcagtaaatgtaaacaatcaattacacgtatatttcctgatgggaaatattctccaccatctacgtgcaatttgaatggctgcaagagcaaattctttaatccgttgcgatctactgctcaaactattgattttcaaaaaataagagttcaagaattattaaagcctgaagaccatgaagaaggacgggtgcctcgaacagtggaatgcgagcttacccaagatctcgttgatgcgtgcatacctggagatgtggtgactgttactggaattataagaggaattaacacttacatggatattggaggagggaagtcaaagaacaaaaaccaaggattttactatttgtaccttgaagctgtatccataaaaaattcaaagtcacagtctgtacctgaggatctgccagattctaaccccaaagccagaccaactgagctgtttgatttgttttcgttttcttcaaaggatttagaatttgttgcgaagtttgcgcaggagcatggttcagatttatttcggcaaatcctacaatctatatgcccgtccatctatgggcatgagcttgttaaagctgggataactctggcattatttggtggtgtacgaaagcattccatggatcagaataaggttcctgtcaggggagatattcatgtcataattgttggtgatcctggtctaggtaagagccagttactacaagcagcagcagctgtttctccacgtggtatctatgtctgtggtaatgcaacaaccagagctggcctcacagtagctgtagtgaaggatcccatgacaagtgactatgcttttgaggcaggtgctatggtgctggctgacagtggattgtgctgtattgacgagtttgataaaatgtcaacagagcatcaggctttactcgaggcgatggagcaacagtgtgtctctattgcaaaggcgggattagtagcaagtttatcatccaggacttctgtcttagcggctgcaaaccccgctggtggtcactataagtaa

SEQ ID NO: 18290 - DNA, 1155 bp, Glycine max
  Peptide Sequence Number=SeqID_135068
atggaagtagttggtaaaatgcaaatgcaattggaaacagcaaatcagactgtggaaacacttaggtcagatggcatgaaagcagcagaagcttacaaatctttggctttagagttggagcaatcaagaactcaagcaaaatcattggaagcacttgtgagtaaacttcaggctgatttgcttagcagtgcaaacaaaagtatatcaggttcaactccaaccaatgaaaatggaccttctcaggaaaatggagaaaatgaggaaataaaccagctcaaagctgagcttatctctgcaaaagttgaagtggggaagttgaagtctgcattggatatttctgaggtaagataccaggaagagtatatccagagcacattgcagattcgatgtgcttttgaacaactggaactcacaaaatcagaatctagtcagagagaggttgaattatatgaggaattgaggagagctaaagctaatactgaagagctaagggcaagcctgatggacaaggaatctcagttttttagtgtgtcggaggagaataaggagctcaattccaagatcaaggaaaaccaatctactaaaaggcaatctgaacttgtgatagagctaaaaaaattggttgctgatgttgaagagttgaaggaaaagttgttagatagagagacagaactgcaaaatatagcggtggaaaacagtatgctcaagatggaattaaaagagttcaagacgaataaaatcaccaatgaggcccttgcttcagctgaagcagcaagggcagcagagcaagaggctttgacaaaacttggccacataacagaagaggctgataaaagcaacaaaagagtggctcgggtgaccgagcagttagatgctgctcaggctgcaaattcagagttggaagccgaactaaggagactgaaagttcagtcagatcagtggagaaaggcagccgaagcagccgcctctatgatttctgctggaaacaacgggaaatttgtggaccgaaactgctcacgtgaaaacagcttcaattctgttactggcaagatgaattcaccttatttattagacacagatgacgagtcacctaagaagaaaaatacaaacatgttgaagaagattggagttttgtggaggaggaaccatcattaa

SEQ ID NO: 18291 - DNA, 2271 bp, Glycine max
  Peptide Sequence Number=SeqID_135069
atgatttccgaaccggcgagttccctgagaaagagcaacttccaagaccggcgcctcagcatcatcgacgtttcctccgccgacgattcgcttctcgatggaaaccctctcagccaccaacgttcagagaaccaagagcaggccgatgtgttgtacacgccgaactcgaagaagttcgaagacgccgccaccaaactccaacaatgggaccacgagcctcactccaacgactcatccggaatcggaaaacctaagaaaaacagcaaatgcaatctgcgcaagagtttagcctgggacagtgcctttttcaccagcgccggggttttggatccggaggagttgactattataattgaaggtgttgagaaggatgagaagcctgaattaccgtctattcaagaggatgtgtacaagtcgtgtgagtccatttctacgttagcgagtgatagcttgacctttgaaagtgtggagatggagggtgatttatttgaggatgtaagagcttcaattcagaaatctagcaaaaagtccagccctgcagcgtcaaacatcaaagtgccatcttccccttcggttccattgttccaaactcatgactcttcgaaaaaggttggcatggtttcttgcaataagatgaaggtcccacctgcttctaagaatccaagtgctggcatgcaaggatttgggaaaatgacgaagaagaataatcctattttcccccaaattccacagaagcatgtggctacaaggagagagtcatctattttaatgcaatcaaaggtacccggaaggtctagtttaagttccacaattccatccaagagagattcacttggcaatccacatgtcaaaagtgaaagggacaaggcaaaacgaatagttggtgatagagtcagttcagtggcaaaagcatctgttgttagaggttctcgaggttctgtgcctaagcccacactaccatccaaatcaccttctggtccgacagtatcaaccaggactaaatcagtgacttccacatcttctggtaacaatttatctgacaatattggtaaatcttcttttagttacttaaaaagaagttataagccaacctcatgttgcccagttgtcaaaacaccttcaagggttgcttcaagaaataaagctgaacctgagatttctagtctttcaaggttgatgtctgccacaaagctttcttctagtatttcgcccgctagctctatcagtgactggtcttcatcagagtcatcctcaacaacttctatggctaaacgtgtgtgtaatagttcaaggcccagcattgattgtgggtcaagcagaaaggttttattgaacactgatgcagatcaaggtacacaccctcagactcctctgagtgattcaagcttagaaaggcaagaggctcggcaaagtgggattattagtcagaaggaaaggacagtgcctggagcgacagttcttcctccagtttccaagaaaccttcaggccttcgactgccttcaccaaagattggttattttgatggggtgaagcccttagtgcgcactccacgtgggtctgttgtacctggtggcttgccaaaacatggagctgaaagtccaagagaaggccaaaacaaagcagaacttggaaagctgcaaccatccagatcttttgtttcaattgataatacaaaacccaacaaccagcaacctccacatccaaatccttttcatgaatcattagatgttgcaattaagacatctaatagcgtgcagaatggcaaaagctcttccgacatatccattggtgctgttgaaaatacatcacacttccatgtagtggagaaagctcatcatgatttgccaccacttaagggtgtcaataaccaggaaaatgctcatcatgatgatcaaattgattgtttgagcaaacaagttggacatatggacataaattttgagataggggaaaagtttaatagtgattccctttatttattgcagaatgatatcagcttccaagataaatccaatggtctggatttatctagtcacaaagagcttattgattgtcctaagaaagacgaattatttaatggtttatctactacatacctttatgtctccccaaccagctttgatgtggtagcttcaacaaggagaccctttgcggtcaaagattccttttgtaacatggatggtgttgtctttacagattcaacagtttcagaggctaaatcgaccaacttgcctgtgccggagagcattattatgaaagaaaacgagtga

SEQ ID NO: 18292 - DNA, 3372 bp, Glycine max
  Peptide Sequence Number=SeqID_135070
atggatgggtgtatatatattagttcgtcagatgatgacttggaggagatagatgatcaagggaggacacttccgcaatgggctactactactgtaaagagtttggataatggtggatggtctaggcgggatagtttttcaagaggggcaaatagttcgaacccaagctcttctaatgtttataatcattcacaagtcaagcctcaaaccccacccgtgtccagcaccaatacactgaaccacagaattgcacgaagagatgaaccttcctaccatgcccagaatggaaacacaagtcagcatcagacagttaattcccgaatttcaaataatcatggtgcagattatgagaaaatgtcatctcagcaagctttcaagaggacccttcagtcatctcttcaaccttcagcaacaagggctcttccttcttcatttgcaccagacagcagattaagaaacttaaaagatagcacgaacagtagtcaacttcatgatgcatataagaaccgtccccatggagtaggacctaacacgtccagtgacaggggctacattcatgaaaattttggcaggggttatgatgaagatcgtttcttgtatcaaaatggtgggaataggattcttccttcacctctgatgcttggaaaggctatatctccacagtttgctacttctagtgaatctgcgtatcgtgctggagcaggtgatgaaagggctgctgaaagtgatgagagactaatttatgaggcagcattacagaagatattttctctgttaagtttgagcagaaatcgtttaatgaaaaattacttccttaaggtggcagaaacattaggatttagcagatcagaattagggtttattgggctgatcaagggtagaaagcaggatatcagtcaacctaaaacagaatatgacttacctgctggtgtattgtctgtctctcttctgagacatcagaaaattgcattggcttggatgcttcagaaggaaaccaagagtttgcattgcttgggggggattttggctgatgaccagggccttggaaagacaatttcaatgatttccctcatcctggcacagaggtcattacagtcaaaatcaaaaatagatgatacatgcagtcataaaactgaagctttgaatttggacgatgatgatgacaatggtagtgttgatgtggaaaagcataaaaatagtgaagaatctgatgatataaaacctagtagagaaccaagcagttcaacacaggcacctggtagaaaaaggccagctgccggtacactagttgtctgccctgctagtgttcttcgacagtgggccagggaacttgatgaaaaagttggagatgaaaagctttctgttttggtttatcatgggggcagtaggacaaaggatcctgttgaacttgcaaaatttgatgtggttctaacaacatactctattgtgactaacgaagttcccaaacaaccattagttgaggatgatgatattgatggaaaaaatggggaaagatttgggttatcctctgagttttctgttagtaaaaagaggaaaaagccatttaatggaaataagaagagtaaaaaaggtggaaagggaattgacagttcttctattgaatgtggttctggccctcttgccaaagttggttggtttagggttattctagatgaggctcaaacaataaagaatcatagaactcaggtggctagagcttgctgcagccttagagccaaaagaaggtggtgcttatctggaactcctattcaaaatactattgatgatttgtatagctactttaggttcctaaagtatgatccttatgctgtatacaaatcattctacaatacaataaaagttccaatatccaaaagtactattcaaggttacaagaaacttcaagcagttttaagggccataatgctacgtcgtacaaaaggaactttgcttgatgggaagccaataatcaatttgcctcccaagacaattgagctaagtaaggtggatttttcgattgaggagcgagcattctacaccaaattggaatcagactcgcgtcttcaatttaaggcatatgctgctgctgggacagtgagccaaaactatgctaatattcttttaatgcttttacgtctccgacaggcttgtgaccacccgcttcttgttaaagattttgattctgatcctgttgggaaagattctgttgaaatggcaaaaaatcttccaagggatatgctgattaatctttttaattgtttggaagcaacatttgccatatgtcttgtttgcaattggccatgttttaggagtgtggtatatttacactccccatggatgtttactaaattgactgaagttgaacacttaacatctttcttgcaagaaaaggatgtggcggatcctcctgaagagcctgttattacgatgtgtggccatgtcttctgttatcaatgtgtatcagaatatttgactggtgatgataacatgtgcccttcagttaattgtaaagaactaattggcgacgatcttgttttctccaaagctactttgagaagttgcatctctgatgatggtggcagtcttagttcagcaaattcacatctttgtgattattcactagtgcagcagcgtgactacacttcatctaaaatcaaagctgttcttgaggttctgcagtcaaattgtaaattgaagatttctagttctgacttactgaactcctctggaggttgtagagattcaccgtcttcggataatttatatgttgaagactgtgattcagatgttagggttacaaaacacacaataaagtattcagagtccacaactgaaggaccaataaaggctatagttttttcccagtggactagcatgttggacttagttgagacatcattgagacaatttagtatacagtaccggagacttgatggtaggatgactctgggtgcgagggacaaagctgttaaggatttcaatactgaacctgagattgctgttatgctgatgtcactaaaagcaggaaaccttggtttgaatatggttgctgcatgtcatgttatacttttggatctttggtggaatccaacaactgaagatcaagctattgatcgagctcacagaattgggcaaactcgtcctgttactgtgacacggatcactataaaagatacagttgaagataggatactggctcttcaggaagataagagaaaaatggttgcatctgcttttggggaagaccatgctggcggtactggaactcgcctcacagtagatgatctgaagtatcttttcatgtgcctgctgacatcggttgcacaagttggcaggcgaggccaggcttgcttgatccaagtcgtaacttga

SEQ ID NO: 18293 - DNA, 864 bp, Glycine max
  Peptide Sequence Number=SeqID_135071
atggaagggccggttgttaaacgccaagccacaagtaccctccgctctatgcagacattatctcgcttgcagtctcagattcgttccaggaggatcagaatgttagaggagaatcaggctctgcagaggcagctcttacagaaacatgctagagagcttgagagcttgcggcaaaactggaagaactcgtctagatctgtaaatccaatgtttatggatccaactaatccgagctggggttggagctggttggaacgatggatggcagcccgaccttgggagagccgtagccatatggataaagagttgaatgaccactcctccataagaagctcaagccgcagcattaccggtggagaaatcagcaagtcatttgctcgtttccagctcaattcggaaaagcactctccaacagccagccagaatcctggctcccctagctttcagtccactccttccaagccagcttcatcatctgctaagaaaccaaagaaggtaagtccaagcccaaggggcagctgggttatggacgaggactccaaaagcttggtcagtgtacactctgaccggttccggaggcactccattgccggttcatcggtgagagatgacgagagccttgctagctctccagcagttccaagctacatggtgccaactcaatctgcaaaagccaagtccaggacacaaagtccattagcctcagaaaatgcaaaagcagagaaaggttcctttgggagtgcaaagaagcggctttctttcccagcttcacctgccaggccaaggcgccattcaggtccaccaaaggttgaaagcagcagcttaaatgcagagttagctgtggacaagggtgtggacagttga

SEQ ID NO: 18294 - DNA, 1800 bp, Glycine max
  Peptide Sequence Number=SeqID_135072
atgcaacttgggaaatgggttgtggatcttgttctcatattttcacttctcagtcctcagttctccggaagtgtggcagagacaacatcctcttcaacaccaatctgttcagaagaagacagagcttctcttctcagattcaaagcaagcatttcacaggacacaacagaaacactgtccacgtggactagcagagactgctgcgatggtgggtgggaaggggttcagtgcaatccatccacagggcgtgtaaacgtgttgcagattcaaaggccagggagagatgatgatgatgaaacttacatgaagggtactctttctccttctctgggcaacttgcatttcttggaggtaatggtcataagtggtatgaagcatatcacaggacctattcctaatagtttctcaaacttaactcacctcacccagctaattctggaagacaattcccttggagggtgcattcctccaagtttaggtcgtttgtctttgcttcagagcctttcattgagtgggaaccatctgaaaggacagatcccaccaacacttggggctctgagaaaccttgcccaacttaatttagcaaagaattctctcacaggtcctatccctcttagtttcaaaacccttattaatttgcaatactttgatctcagctacaatttgttatcatctaccatcccggattttcttggggaattcaaaaatttgacttatttagacctatcctctaaccttctaaccggaaaaattccagtttccttgttcggccttgtcaatcttttagacttgtcattgagctataacaagctcacagggaacattccagatcaggttggaaatctgaaatccctgactagtcttcaactcagtggcaatctgctcacagggaatattccactgtccatatcaagattacagaacctttggtaccttaatgtatcaaggaattgtctttcagatcccttaccagtgatcccttccaagggtatccctgcccttttgagcatagacatgtcttataataatctcagccttggaattgtacctgattggatcagaagcaagcaactcaaagatgtccatctagctgggtgcaaattgaagggagatcttccacacttcacaagacctgactctttgagctccattgacctatcagataactatctggttgaaggtatttcaaatttcttcacaaatatgtccagcttgcaaaaggtcaagctctcaaacaaccagttgaggtttgacatttctgaaatcaaattgccaacagaactgtcttccatagatttgcatgctaatctgctggtgggttcactatcaacaatcataaataacaggactagcagctctttggaggttatagacgtgtcaaacaattttatttcaggtcacattcctgaatttgtggaaggctcaagcttgaaggtgctaaacttggggagcaacaacatatcaggtccaatcccagtttctatctcaaacttgatagatcttgagagactggacatttcaagaaatcacatactgggtaccatcccttcaagtctaggtcagttgctgaaactactatggcttgatgtatctataaacggattaacagggcaaataccgagtagcctgtcacagataactggtctaaagcatgcaaacttcagggcaaacaggctgtgtggtgaaataccacaaactagaccattcaacatctttcgaccggttgcttacgcccacaacttgtgcttatgtggcaaacctttagaaccatgcaagaaacaagggagtatgggtcagtga

SEQ ID NO: 18295 - DNA, 321 bp, Glycine max
  Peptide Sequence Number=SeqID_135073
atgatccagctgaataaagaaaaagttcttcctccgtttggacagaagaatttttcggttgacatgatgctggtatttgatacgctttcgtatcattcggagttggaaacagatacttgtgaaacatcttccttattttcctcgaatgcagtttcctattgtcgttcaatgggaccttgcggggttccaaaaagagtaggaaaaaaatcttcctatggcactcgtcacagaaaaagaaataggacaatacccgtgatatgtattccgtcattcatggtgggaccactctatcgtccaatccctgtttttatttataattga

SEQ ID NO: 18296 - DNA, 465 bp, Glycine max
  Peptide Sequence Number=SeqID_135074
atgggggtggcacgtccactgttcaatgaccgcaggaagtttccaaagttagcagatccacagctgcagggacggtatcccatgcgaggtctttaccaagctctagctgtggcatcaatgtgcattcaagaacaggctgcagcacgtcctctcattggggatgtggtgacagccctttcgtttctagccaaccaggcatatgaccatagggggggagctggtgacgataaaaggaacagagtattgaaaaatggtgaaggtggaggaggaggatctggaggcagatgggatttggaaggatctgagaaagatgactccccacgtgaaactgcaaggatgttaaacagcaacaacagggatcttgatagagaacgtgccgtggctgaagccaagatgtggggagagaattggagagaaaaaagacgacaaagtgcgcagggcagttttgatggttctaacgcttag

SEQ ID NO: 18297 - DNA, 243 bp, Glycine max
  Peptide Sequence Number=SeqID_135075
atgggctccattggcgatccagtttcagctgctgaggaaattgctttctgcaaaacttgtgcccggtttggtcttagcttgtatttgtatcatgaagatgaaatgaccaaggtggctgttaggtacttctataaagcactgtcaagtattgtggaaaacttgaagccatgtcttctttttatgaggatccgatgcttatgtgtattcaggtttcttttattgctcaggggggctgaacgatga

SEQ ID NO: 18298 - DNA, 162 bp, Glycine max
  Peptide Sequence Number=SeqID_135076
atgatagcgatagttgcgatggagaaatggtggcaacgacgacaatgtagtattgttggcggcgatgatgacaattgtaatggtgataaaagtggtggaatgatggtggtggtgaaggcagtaaaggcaaggtacgatggtggtagtagtgatgatggtgtg

SEQ ID NO: 18299 - DNA, 336 bp, Glycine max
  Peptide Sequence Number=SeqID_135077
atgcaaaattctacccccatggttgtcaacattgcccagagctcaaactcattcaacacttcttcaaaattagcatctttatgcttccaccatgatgtaagctccattagagcttgtaggcctaggatcttcttcatcaatggattcttttgcttcttggaagatgaatggcagcagaatgaagaaagaaagagagagaggagacaccacttcaaggagaagatgagtctagaagaagctcaccactataggaggccatggataagagcttggaggaagaaggagatgaatgaatggagaggaagagaagagcacgaaattttgtgctctaaatga

SEQ ID NO: 18300 - DNA, 397 bp, Glycine max
  Peptide Sequence Number=SeqID_135078
atggaagaagctattcatgtaggatttaatgacacaaagcctgatatagaaatcttagagctcgatgaatcttttgcagatataagattggacgaaggcataggaccattgaccgaacatcaaatcattggagatccatcaaccaaagtccaaacaagaagatctcacagacaacaaggttacatagctctcatttcagaagtagaacccaagcatattgatgatgcaatggaagatgagaactgggtaaaagccatgcaagaggaacttgaacaatttcagaaaaatgacatatggaagcttgtagaactaccacaaggaaagaaagcatgtcctagtcatggctttggtgatgataatcccaaagttgcccaaatacagggacctatgaccaggg

SEQ ID NO: 18301 - DNA, 309 bp, Glycine max
  Peptide Sequence Number=SeqID_135079
atgtctagaagctcatccaaagttgtcaagattgatacaccttatgatgatgagtgcaatgatgaaggtttagaaaaagaagatcagtttgccttcatgtcaaggaagaacaagaaagtattgataagcacatgggaagagctgaacaacacatcatccaatgaggaaatagaagaggaagaagaagccaacctctgtctaatggtagacactacattaaaaggatcagatgaagaggaaaatataaacaacattgaaactcttccattagcatatcatgaacttttctccaactcacccattctataa

SEQ ID NO: 18302 - DNA, 336 bp, Glycine max
  Peptide Sequence Number=SeqID_135080
atgatgaaaaattttagatggtatagagataccttcctaactagagtctaccccagagaagatagtcaacaacctttctggaaagaaaaatgtctagccagacttccaagatcattaggagataaggttagagacaaaatatgtagccaatctgttaatggagacattccatatgagaatttaagttacggtcaattaatttcttatgtccagaaagtggccctaaaaatctgtcaagatgacaaaattcaaagacaattagccaaagagaaagcccaaacaaagagagatttaggatctttctgcgaacaacttggactaccagcttgtccatag

SEQ ID NO: 18303 - DNA, 210 bp, Glycine max
  Peptide Sequence Number=SeqID_135081
atggatgaagaaccgctaagaacgatggaaaatcttcacgaaattgctcatggaaacatctcagaagtgttacggaagcacctcgacttggattttcttcgtggaaacacgttacaagaattttacggaagcattacggaagcccgggatgccattttttacaaaatggaggtggttgccgcccagagacttcttgaggaagattcctga

SEQ ID NO: 18304 - DNA, 384 bp, Glycine max
  Peptide Sequence Number=SeqID_135082
atgaaatatttctctcagccaataattgggtatggagtatgtaaagtgttggattctaaacacccagacttcaaaaaagatgacttagtgtggagagttacgaaatgggaagagtacagtatcatcaagaccgatagcctcttcaaaattgaccatacagatgttcctctttcctattatactggacttcttggtatgcctggtatgactgcttatgcaggtttctatgaagttggggtccctaagaaaggagattatgtgtttatatcttcagcatttggtgcagttggccaacttgttgggcaactagcaaaattgatgggctgctatgtcgttggaagtgctggaagtaaagataaggtagagatattgcatgcaacctag

SEQ ID NO: 18305 - DNA, 1545 bp, Glycine max
  Peptide Sequence Number=SeqID_135083
atgagatatatttatagctatgctgataagttgaagagatttcctggtttggcaaggaaggcaatatggaaggttggcaaagaggatccaagaagggtggttcattctatgaaagtcggtgtggctttggtactagtttctttgttatttttgttggagccattgttcaaagggatagggaaaaatgctttgtgggctgtcatgactgtggttgtggtgatggagttcactgtaggggcaacattatgcaaaggactaaatagaggaatagggactctctcagcaggatcattggcatttcttattaagtattttgcagatgcccctggtcggatttttcaagcagtatacattggtattgcagtttttatgataggagcactaactacttatgtgaggttcattcccaatatcaagaagaattatgactatggtgttctgatctttcttctaacctttaatttgataactgtatcaagctaccgtgttgattatatctgggactttgcaagagatcggatatacaccattgccataggatgtggcctatgtcttgtgatgaccatattagtatttccaaactggtcaggggaagacctccacaagaacaccatatcaaagcttgaaggcttagccaactctatacaagtctgtgtcagggaatatttttatgagtctgcaaaagaagaaactgaagatgatgattcatcggaggatccaatttacgaaggttacaaggctgttttagattccaaagcaaaagatgaaacactggcatcacaagcaagctgggaaccaagattctcaagatattgccacaaatttccgtggcatcaatatacaagagtgggagctgctcttcgccaattcggttacactgttgtagcactacatggatgtctacagtctgaaattcagacaccaaagtcaattagtaccctgtacaaagattcttgcatgagacttggagaggaagtgtcaaatgtattaagggaactggccaacagcataaggaacaatcgtcaattctcccctcaaacactctcaaacaatctcaatgaagcattacaagacctggacaatgccttgaaatcccaaccacaacttgtacttggcttgaggaatggtcgaactcgaacccttaaaaccgcagttcaagcaattccacttccacatcctgaccaaaagcttgaagaggacaccaaattctcattcacaagtctcgggaattgttcttctaccccgcgtttaaggcaatccgtggagcactctcgtgaactgaaaaggaaggttttaaggccacaaatgagtatgactgcgagtgcaatcattagccttgagttctcagaagcattaccctttgctgctttcacttctttgcttgtagagatggtggctaaactggatcatgttatggttgaagtttatgagttgggcctagtagcacactttaaagagttccaaggtgatgagattgttgtcacttgcgaaaaaccaaacatgaatagagctcagaatgacttgccttctcatggagcagagtag

SEQ ID NO: 18306 - DNA, 1509 bp, Glycine max
  Peptide Sequence Number=SeqID_135084
atggctgaaaccaatactagtaacaaaagctctagccaattgaggtatgtttatagttttgccgataaggtgaaaagttttcctggttgggcaaggagggcaacatggaaggttggcaaagaggatccaagaagggtggttcatgctttgaaagttggcatggctttgacactagtttctttgctgtatctgatggagccattgttcaaagggattgggaaaaatgctatgtgggctgttatgactgtggttgtagtgatggagttcactgtaggggcaacattatccaaaggactaaatagaggattagggactcttttagcaggatcattggcatttcttattgagtatgttgcagatgccccgggtcggatttttcgagcagttttcatcggtgttgcagtttttatgttaggagcaatgactacttatgtgaggttcatcccctatatcaagaagaattatgactatggtgttctgatctttctcctgacctttaatttgataactgtatcaagctaccgcattgataatgtctggaacattgcaaaagatcgcatgtccaccattgccataggttgtggcctatgtcttgtgatgagcatattagtatttccaaattggtcaggagaagatctccacaacaacactatatcaaagcttgaaggcttagccaactctatacaagtctgtgtcagggaatatttttatgattctgcaacagaagcaactgaagatgatgattcatcggaggatccaatttacgaaggttacaaggctgttttagactccaaagcaaacgatgaaacactggcattacaagcaagctgggaaccaagatgctcaagatattgccacagaatcccatggcatcaatatgcaagagtgggagctgctcttcgccaattcagttacactgttgtagcattacatgggtgtctacggtctgaaattcagacaccaaagtcaatccgtgccctgtacaaagactcttgcatgagacttggagaggaagtgtcaaaagtattaagggaactggccaacagcataaggaacaatagtcaattctccactcaaacactctcaaacaatctaaatgaagcattacaagacctggacaatgccttaaaatcccaaccacaacttgtactaggctcaaggaatggtcgagttcaaaagcttgaagctgaggacacagcagcagcaagaacctcattatcgagtgttaagaatgattttttttcaccacgaaagaaggttttaaggccgcaactgagtaagagtgccatcattagccttgaattctcagaggcattaccctttgctgctttcacttctttgcttttagagatggtggctaaactggatcatgttatggttgaagttgaagagttgggtcggatggcacactttagagagttcaaagatgatgatgagattgtagtgactttcgagaaatcaaaaatgattatagctcagaatggcttgccttcttatggagcagagtag

SEQ ID NO: 18307 - DNA, 1341 bp, Glycine max
  Peptide Sequence Number=SeqID_135085
atggccaaagcgtcgatattcatttacatactcgtcgcagcggcgcttctcttattcctctctcattccccggataagcactccggccaccgccaccgccgcctcaagctccgctccaacttcaccctcgccccctcgcgccaccacgccgtcgccttcgaccctctcgtcgctgagctcgagcgccaccgcgaggacaaggagtgggagaagcagataatccaccaggcccatcccgaactggagtcggacccggccccggcccacgagtcccagcccgagtgggaggacttcatggacgccgaggattacctcaatgacgaggacaagtttaatgttaccaacaggttgatactcttgttcccgaagatcgatgtggaccccaccgattggttcgtgacggagcacgagttgactcagtggaacctccagcaggcccagcgcgaggtcctgcatcgcacgcagagggagatggagcttcacgataagaaccacgatggcttcgtttccttctccgagtacgatcctcccaataatgagtctttcggttatgatatgggttggtggaaagaagagcattttaatgcatcggatgctgatggagatggtgttctaaacttaactgaattcaatgactttctgcaccctgctgacagcaaaaaccctaagcttcttcagtggttgtgcaaggaggaagtcagggaaagagataccgacagagatgagaaggtcaactttaaagaatttttccatgggctatttgatttggtaaggaactatgatgaagaaagtcacaatgacacagataattcaatggatgctccagctagagggttgtttgctcagcttgacaaggatggggacgggtacttgtctgatgttgaactactgcccataattggcaaactccatccatctgagcattattatgcaaaacaacaagcagattatatcatttcacaggcagacgaggacaaggatggccgtcttactttgactgagatgattgagaacccatatgtattttatagtgctattttcaacgatgatgaagatgatgacgacgattaccatgatgagttccgatcatcatcgattgcaggatacccagaaaagtttggcacaattctagtgacaaggaatcagtatttgaagattatgacacgacagaattttgatgtttgggcccttagttggttcttagtctcaatcatggtgggctttttgtgcgatggcaacacttactgcttctttccattcatattatctgcgagttcttatttgctgatgggatccaccgtggcttgtcgtagagtcacacctggatcagttggaggatga

SEQ ID NO: 18308 - DNA, 567 bp, Glycine max
  Peptide Sequence Number=SeqID_135086
atgcaggacctcgcgctgggcctgctggaggttccactgagtcaactcgtgctccgtcacgaaccaatcggtggggtccacatcgatcttcgggaacaagagtatcaacctgttggtaacattaaacttgtcctcgtcattgaggtaatcctcggcgtccatgaagtcctcccactcgggctgggactcgtgggccggggccgggtccgactccagttcgggatgggcctggtggattatctgcttctcccactccttgtcctcgcggtggcgctcgagctcagcgacgagagggtcgaaggcgacggcgtggtggcgcgagggggcgaggtgaacagggtccatagagtggagaatcagttccatcctttcattgatggcattatggagatatcgctagcacccgaacccgggtggaagatgctggtgatagatagatacaacagactctcagatccagatgaacacgtagatacattcctcacccagatgaaccttttcaccaatgatgatgtcatcatgtgtcgagtatttttgacaatcctaaggggagcaacactttactaa

SEQ ID NO: 18309 - DNA, 1569 bp, Glycine max
  Peptide Sequence Number=SeqID_135087
gtgggttcttcaaacgcagttgcggacgccctatcccgtaccactccctccggcgagttcctactcctatcagtgcctcaccttgacttcatgcgtgatttacgcaacaccctccattccagcaacgaatttcaagaactactctccaaagtacgtgacaatcctggtgactttcctgactatcgcattcatcagggactcatcctcttcaagaatagaatctggctcaacaacgataatccgtccatacctagcctcatgttcgaatttcacgcaactccaatcggaggacatcaacgattcgtgaaggaatgcaccacgtgtcagcagactaagtctagcacacagcgacctgccggtcttcttcagcctcttccgccaccgactggagtctgggaggacatctccatggatttcattacccaactcccctcttctcacggttatactactataatggtagttgtcgacagatactcgaagggtgttcaccttggagctctgccgtcgaaccactcagccttcaaggtcgcctccttgttcatcgatatcgtctgtaaacatcacggcttcccgagaagtattgtctccgacagagacccaatcttcctcagctccttctggcgtgagcttttccgactcagtggaacgcgactccgtatgagcacggcttaccatccacaatcggatggtcaaaccgaagtcatgaatagggttctggagcagtatctcagatccttcgttcatgctcaacccaatacctggtatcgttatctaacaatggcggaatggtgttacaacacctccattcactccagttcaggaatgacgccatttgaggtcatctatggcaaaccaccaccaacacttccgcattacctccagggagcatctacaaatgaagctgtggattccatgttacactcacgccaagaaattcaccgaaagctgcagcagcgtattcgtaaggcacaagacgccatgaaaaaagtagcagacgaaaaacgccgtgacgtcaaatacagcatcggccagtgggtctacgttaagttacgacccttccggcagcgttccgtcgcaggtttaatacacccaaaactatccaaaaggtattttgggccatttcagataagtgaacgtgtagggcaagtctcatacaagctcaagctacccgacgaggcaagaatccaccccgtattccactgctcactactacgcgagcatcacggaactccacccacccaacccgatcgctggcccttacagtttatcgctcacaaacccgtcgcacgacctttgtgtattctggactctaaactcgacacttcatcatctccgccaaaccaacttgtgttagtacagtgggcgggacaaccccctgaggacaccacctgggagtcatggccggaagttcgcgaccttcaccaccttgaggacaaggtggtcttcacgggtgagggtattgttagcaaccacctaaacgatatcacgactggacccgaaactgcagatacaaggcccaaacgaagaacatcgagacccagcttcctgatcgactacgagacatga

SEQ ID NO: 18310 - DNA, 1548 bp, Glycine max
  Peptide Sequence Number=SeqID_135088
atggctgaaagcaattattttgcaagtaacagcagaaggcattggatttggaagaatatgaatagtgttggtgagaaagtgaaaagatattcaggtttggcatggagaacagcagtgaaagtagggaaagaggatccaagaagggtggtccattctttgaaagtgggcctggctttgacactagtttctttgctgtatctaataaagcctttgttcagagggattggacaaaatgccatgtcagctgttctcactgtggttgtggtgatggagtttactgttggagcaacattaggcaaaggactgaatagagggttggggactctgctggcaggatcattggcatttcttgttgagtatattgcagacatcgctggtcgggtttttcaagctgttttcattggtgctgcagtttttgttttaggagctacgactacttatgtgagattcatcccccatatcaagaagaattatgactatggtgttatgatatttctcttgactttcaatttgataactgtgtcaagttaccgtgttgataatgtgtgggaaattgcaaaagatcgtatagccaccattgctataggtggtggcctatgtcttgtaatgagcctattggttttcccaaactggtcaggggaagacctccataattccaccatatcaaagctcgaaggtctagccaactctatagaagcttgtgtagtgagatattttcatgattctgaaaatcaagaaactcaagatgattcaactgaggatcttatttacaaaggttacaaggctgttctagattccagagctaaagatgaaacactggcattacaagcaagctgggagccaagatggtcaaggtattggcacagaatcccatggaggcaatatacaaaagtgggaactactcttcgccagtttagttacactgttgttgccctacatgggtgtctgctgtctgaaattcagacaccggggtcgattcgagccctatacaaagactcttgcatcaaacttgcagaagaagtgtctaaagcactaagggaactggccaacagcataagggacaaacgtcaattctcccctcaagtactctctgataatctcaatgaagctctacaaaacctcaacgatgacttgaaatcccaaccacaactcttcctaggctcaaagaagtttggtggaaccacacatcctgaagaagacactaaagtctcattttcaagtgttaggggtgattgttcttccatgtttgaatataaatccaaagagcattctggtgaaatgtcaatggagggacacacgaaggttttgaagccactgatgagtaagattgcgatgactagccttgagttctcagaagcactgccttttgctgctttcacttctatgcttgtggaaatggtggcaaagctggatcatgttatagatgcagttgaggacttggccaaattgtcacgctttagagagttcagagatgaagatgagattgttgtgacttgtgagagaccaaaagtagctaacaatgacttgccttcttatgcattagattaa

SEQ ID NO: 18311 - DNA, 270 bp, Glycine max
  Peptide Sequence Number=SeqID_135089
atgttggctgctacaactactagagcaaagacaaaagcacttgttctccttcccatcactctttgtttttggaactttcaagtaattaagatttcaatttcttcaatgatgagtcaatcactcgaaaacaagataaaggcatatatacatcttagatggtcacaccggaataacatcaccgtctctttactttttcctacctcatcacaagggaatttggagaagtctgacatcagaaagttcaaatgccaattcataaagccttggtga

SEQ ID NO: 18312 - DNA, 1814 bp, Glycine max
  Peptide Sequence Number=SeqID_135090
atggcggaccatgcaacaaggaaaactaccaccgataggcttgaagaagctattactcgtctctctaatagccaatcctccctcctagataaacatgctgaccttgttgacaagtactctgaactttccggcaaggtggatacacttcttgatcatctccacctccgatctccggctcgagaacaccatgggacctcttcccagtttcatcagcgtaactccgtcaagattgacgtccctaggtttgacggacgcgaccctatggggtggatcttcaagatctcacaacttttcgaataccagaatacgccggaagaagaaagaatcactgtggcctctttttaccttgacggagctgcgttaagctggtaccaatggatgtttaggaatggatttattacgtcatggtcaggtttcttacaagccctcgaatccaggttcgctccttctttttatgatgacccgaagggggcgttattcaagctaacacaacgaggcatggttaatgagtacttaacggagtttgaacggttggccaatcgtgttattggcttacccccaccattcctattaagctgtttcgtttcaggtttaacacaggatattcgaagagaagtgctagctctccagcccatttcccttccccaggccatggcccttgccaagttacaggaagacaagattcgtgaccgccggcaagcaccatcacgaggtcacaatacaccatcaccatcctatgctcctcctagccggaaaccacagtctacatacgttcaaagaactccagaagaaatggcccttcgtcgagaaaaggggctttgctacaattgtgaggaaaagtggagttccacccacagatgtaaaggacgcgttcttttattcatcgctgacaacccctccttgctaccagatgagcccaaccccgaacctcctttactgccggaaccgattccagcgtgtcccctcgacctagacacaacctcagattttacttccccccacgtgagtctccacgccctttctggcctcccctcctccgagaccttccgactcgtcggaatcatcaatcactcctccctcaccattctcatagacagtggaagtacccataacttccttcaaccccgacttgcccagttccttcatctcaaaaccgaaaacacaaacccacttcacgtcctggttggcaacggctctgtccttgaatgcaatcaagtttgccgtgatacgtcacttctccttcagggccaccagttcacggtcacgttccatttgctccctatcagtggtgcggatgctgtattgggcatagaatggctacgacaatttgggcctgttattactgactacaccgcgttttccatgaagttcacccatatgggccgacccattgaattacacgctgatatctccactggaccaaaaccaatttcggcccctcaagttaaacggttattacaaaccagatccgcttcagccctcttccacttaaaaatgatacccgaccaacaacccgacccattacttcatcttcctcacccgatacctgcggtcgaagcccttctcactcagtttcataagctattccgacagccttcatccctccctcccccacgatccatcgtccaccatatcaacctcctaccaaacacaaccccaattaatgtaagaccgtatcgttacccacaagtccagaaatcagaaatcgaaaagcaggtcttagagctcctcgaatccggtctaatccaacccagtatgagtccttactcctcgccggtattgcttgtcaagaaaaaggacggaacctggagaat

SEQ ID NO: 18313 - DNA, 285 bp, Glycine max
  Peptide Sequence Number=SeqID_135091
atgcagacctcacttcttcgtgagctagttgttggaactccagtcatctcagcaacatatgatcggcctcagaagtcagttaacagatacttacctggtcctgccactcaatgtcaatattcaaccacaacatcaaagcaaattgaagaaggagagaggctgctgaaagtttcccagtgttatctgtccactacatccggacccggtcctctagcaggtttcctcttcatctccactgacaaggttgccttctgcagcgagagatcaatgaaagtctttacttga

SEQ ID NO: 18314 - DNA, 405 bp, Glycine max
  Peptide Sequence Number=SeqID_135092
atgaattatactcttataacggacaacttgattgtgggctctcaaccacagaaacctgaagacatagatcacctcaaaaaggaagagggcgtggcatacattttaaacttacaacaagataaggatgttgagtattggggagtagacttgcagtcaataataagaaggtgtcgtgaacttgaaattagccacacgaggagaccggcaaaagactttgacccagattccttgcgaaatggactacctaaagcagtctcgtccttagactgggcattttctgagggaaaaggaagagtttatgtacattgtacagctggacttggaagagctccagcggcggcaattgcttatttgttctggttttgtgacatgaatgtgagtcctaaaccctcaccttatctttga

SEQ ID NO: 18315 - DNA, 858 bp, Glycine max
  Peptide Sequence Number=SeqID_135093
atgtgtgaggctggacaacttgtggatgcatacaagcttctcactcaagttgcttgtagtggggttatgcctgacattgtgacgtacaatgttctaatcaacggcttttgcaaggctgctaatatcaatggtgctttaaagtttttcaaggatatgcaaaacaaagggttctcacctaactctgttacttatgggacacttatcgatgggcttttcaggattggcagagaagaggatgcctttaagattcgtgagcatatgctgaagcatgggtgtgaacctagctttgaagtttatagagcacttatgacttggttgtgtagaaagaggaaggtctcacaggccttccgtctttatttggaatatttgaagaaccttcgtggcagggaagatgattcaatcaatgctttggagcaatgttttgtcagaggaaaagtggaacaggcatttcaaggtttactagaattggacttcaggttgagagattttgctttagctccatatacaattctacttattggattttgccaggcagaaaaagtagatgaagcatcagttatattttctgttcttgataagttcaatatcaatatcaatcctacaagttgtgtatttttaatccgaggtctcagtgaaaaaggaaggctggatgatgcagtaaacatcttcctttacactcttgacagatgtttcaagttgaagtcaagtgtttgtgagcagctcctcaaccatcttaatctttcccaagataaaaaggagtgtgctattgatcttgttcataggatgaagtctgctggataccttttaaatagtttgttttcacagaacacattgtgtacagagcaggacaaacaatag

SEQ ID NO: 18316 - DNA, 358 bp, Glycine max
  Peptide Sequence Number=SeqID_135094
ccaacaagaagaggatcgtgaaattctctctgatggaacatctgccgtggcaggtggaattgtagcattgggaaagtttgatgctctacacataggtcatagagaacttgcaattcaagcatcaagggctggacctccatttcttttgtcatttgttggcatggcaaaagtacttggttgggaacctaggaaaggttttctaaagggactaaaattttgccttgacttaaagggtaaggttgggttgtatacttctaccctcccaagacctatttggtgggaacctcgtgtgcttgatcaccctataaacgatccttgttgcaacaataaggttatgcctttgagtaggaggtcatga

SEQ ID NO: 18317 - DNA, 4170 bp, Glycine max
  Peptide Sequence Number=SeqID_135095
atgagttcgttttctggagccattcaaagacctcttgtagcggctgccgccgttgctgtcgcttctttctctgctgatctctccgataaattgccatcacgtgattgttctacctccgatttggcacattctactccttgtagcaacacacaaaaatcagattcatcctgggtttctcatatttcagactcaaagcttgctaacctatctttcgtgacccgaattccggtgcctgtgcctcatgttcaattccgggtgccgagtttgggacacaattgtgtttcaaatttgtaccattcttcggttgcttcgtccccgcatcttcgcaatttgtatcactctgctgacttgcctagagtctcaagacctgctgcatattcccatggtgtctccgattcaacaacttctgaggtcatgtataaatggcatttacccgagccgaatgctttggatgattcgagttgttcattgacaaagtcaaggacagtggtggtcttgctgggatggttgggagcaaggcagagacacttgaagaagtacgcagaatggtacacctcaaaggggtttcatgtcgttacctttacatttccaatgggggagatcctgagttatcagccgggtggaaaagccgagcaaaatgttcatttgcttgtcgatcacttggctgattggttagaaggggaaagtgataagaatcttgtctttcataccttcagcaacactggatggttaacatatggtgttattcttgaacatcttcaaaagcaggatccaactatcacgggaaggatcaagggatgcatcgtagactctgcacctgttgcataccctgacccatgggtctgggcctctggtttctctgcagcgtttcttaagaagaacagcgtggctactaaaggacgtgtattttctgatgaatctggcattaaagtatcaattggcagtgaagattggcgcaaacctgctctaacagaagcagctttactactaattctaaagaaattttttgagatcattctggatcttccttcagtgaataggaggctctctgatgtcatgagcatgttgtcatcaagacaacctagctgtccacagttatacatgtatagctctgctgacagggttattcctgctgattcagtggaatcgtttgtagaggctcagcgtagggctggacatgatgtgagggcatgcaattttgtctcctcaccccatgttgaccactttaggaatgacccaaaattgtatacatctcagctcagtcagtttttggaggaccattccattaatggatggtgcgatggtgctatggtggttaggactatatcaaaagtcaaccacctcatggggattacacaattgttccctcacagcaacacaacactctcttctacttctaattcccatctgcagttattagccccaaatcctggggttacggtttcatctgcgtcgatggcttcgaattcgatcgacggcgacgccgtattggggtcggggctgtgcataaacgacgtgttaagggacgacgagctgcgttccattctggggcgtgtggagagcgagaaggacaaggaaacgttcgggctggtctgcaagcgatggctccggctgcagagcacagaaaggaagaagctcgccgcacgtgcgggccctcacatgctccggaaaatggccgataggttcacacgcttggtcgaattggacctcgctcagtccgtctctcgttccttctatcctggcgtcaccgattccgacctcgccgtcatcgccactgccttcacttgcttgaagatcctcaatttgcataattgtaaaggaattacagatgctggaatgaaggcgattggtgaaggtctttccttattacagtcgttggatgtgtcgtactgtagaaagctcactgacaagggattatcagctgttgccaaaggctgttgtgacctaaggatattgcatatggctggttgcagatttgttaatgatggtgtattagaagctctctccaaatattgtcgtaacttggaggagttgggattgcaagggtgcacaagtattactgataatggactgataaaccttgcaagtggctgtcgacagatcaggtttttagacatcaataaatgcagtaatgttagtgatgttggggtttctagtttttctagtgcttgttcgtcttctctcaagacattgaagttgttagattgttacaaaattggtgacgaaaccatattatccattgccgaattctgtggtaatctggagactttaatcattggtggttgccgggatgtctctgctgatgcgataaagtcgctggctactgcatgtggaagcagccttaagaacttgaggatggattggtgtttaaacacttctgattcttcattgagttgtgttttaagccaatgcagaaaccttgaggcactggacattggttgctgtgaagagttgactgatgctgcttttcagctaatgagcaatgaggagcctggattgagtttgaagattttgaaggttagtaattgtccaaagatcacagtggcaggtataggaattattgtgggtaaatgcacttccctgcaatacttggatgtgaggtcatgcccgcatattacaaaggctggcctagatgaggctggtttccattttcctgaattctgcaagattaattttaatggtagtagcatcagtgagcctgttttggactactccaagttcgcttcactcattggtggttgctggcatgtcgctggtgactgcttaaaccttgagttgactgaggctgcttttcatcttatgagcaatgaggaggctggattgagtttgaagatattggatgttagttattgtgacgagatcacagtggcggcaggtaaggctttgttgttatgttacgccagtaataattcccatttgcaatcagccctaaatcctggggttagggtttcctccgcatcaatatcaatgtctttgaaacggggatcgccgctgtgcataaacgatgttttaacggacgacgtgttgtgtttgattctggggtgcgtagagagcaccaaggacaaggaagcgttcgggttggtttgcaaaagatggcttgggttgcagagcacggaaacgaagaagatcaccgcacgtgcgggtctccacatgctccgaagaatgtctgataggttcacacgcttggtcgaattagactactcccagttcgcttcccatcgcatctatcccgacgtcaccgattccgacctcgctgtcattgctagaggcttcccttgcctgagaaattacagattctggaatgaaagccattggcgtaggtcttaccctattgcagtcgttggacgtgacactctgtacaaggctgacggacatgggattatcgctctctccaaaaactgtcatgacttagaggagttgagattggaactcacaagtattaccgatgatggactcataagccttgcaagtggctgtcatcatatcaagattttaaacctctatttatgccagcgggcttgttctcgtctcaagacattgaaattgatggattgctacgaaattggggacggaacaatattatccttggccaagttctgtggtaatctggagactctaaacattgttggttctgaggatgtctctgccgatgccatgaagacactggctactgcttgcggaagcagccttaaaatcttaagtatggatggatgtccaaacgtttctgattatttagtgagttgtattttatgtcaatgcagaaaccttgaggccttgggcgttaggtgctgtgaagagttgactgatgtggcttttcagcttaaaagcaatgtggagcctggattgagtttgcagatgttggatattagttactgtgaaaagatcagtgttgggtatatgcattctttccttggacatctcttactgttcaatggttgtcgtgattcacatgcgacagaagctctctccaaaaactgtcataactttgaggagttgagtgtgagagggtttattactgagcttgcaagtggctgtccacataatcagacatttgaaattggggatggaaccatattatccttaaccaaattctgtggtaacctggagacattactcattggtgattgctggctactgcttgtggaattagcagcagccttaaagtgttag

SEQ ID NO: 18318 - DNA, 942 bp, Glycine max
  Peptide Sequence Number=SeqID_135096
atgtcggaagcaccaccgtctcagccatcgcctccaaccgccaacgcgtcaccaccgccgtactggtgctaccactgcgagaagcgcgtctccatcgaaacgctcgcgaatctccccgacgtcgtctgcggtgagtgcaagaacggcttcgtggaatccatccacacgccgtcgcgctctcgctccccctccgcctcctccgacgacccctacttcggctcgcagttcctccaggtccttcgcctaatcgctcagtcggcgcgtgacgacgacgcgtcgcctccgccgccgccaagccgctctccggagaacgatttcctcaggatcgagctcggtggctgggacaacgatgaggagaacgacaacgacaacaacgacgacgaggagttcgaggaacacgaggaggcggaggatcgctccggcaacgaggatccgcacggaagagacgacgaggatctgagaagaaggaggcgcgagctgcttcggcttcggattagggatttggcgacgcgcacgaggagcatgcggaaccggatcttggattgggccgagattctgatgggccttgaggacaattccatcgagttccgcctccagctgccggaatccgaccgctacgtcgggaatcccgaggattacgtcgacgcggcggagtacgaggcgctgctgcatacgcttgcggaaagcgacggcggaggtaggagaggagcgccgccggcgtcgaaggcggcggtggaggcgttgccgacggtgaagattgcgtccgaaagcgaagccgtggcgtgcgctatatgtaaggatttgctcggtgttggagacttggcgaagaggttgccgtgcgggcatgggtatgagctaccaacggatgataaggaatatgaggaagagagagtggttaactctgcttcgagttccggtggaggtggaagtgccattgtttga

SEQ ID NO: 18319 - DNA, 1911 bp, Glycine max
  Peptide Sequence Number=SeqID_135097
aagcttcagtcatggcttcaactaccaaatggggattgggagctggtaaaaataataacaacttctggagacgaatctgttatttcactgcctaatgggaaagtttttaaggtgaaagaggagagtttggtgccagctaatcctgatattcttgatggggtggatgacctcatgcaactaagttatttaaacgaaccatcagttttattcaacctgcaatatagatacaatcataatatgatctatacgaaagctgggcctgttttggttgctgtaaatccctttaagaaagttcctctgtatggcaatgactacattgaagcctacaagtgtaaatcaattgaaagccctcatgtatatgcaattacggacacagccatccgagaaatgatacgggatgaagtgaatcagtctataattataagtggtgagagtggagcagggaagactgagacggcaaaaatagcaatgcagtacttggctgcccttggtggtggaagtggaatagagaatgagatattaaagactaatccaatactagaagcctttggtaatggaaaaacattaagaaatgacaactcaagtcgttttggaaagctcattgagattcacttcagtgaaactggaaaaatatctggtgctaatattcaaacatttttgctggaaaagtctagagtagtccaatgcaacgaaggggaaaggtcatatcatatattttatcagctatgtgctggagcaccatcatctcttagggagaagctaaatctactaagtgctgaagactataaatatctgaggcagagcaattgttattcaattacgggagttgatgatgcagaagaatttcgcatagttaaggaagctctggatgttgtccacattagcaaaggagaccaggagaatgtatttgcaatgcttgctgcagtattatggttaggaaacatatcatttactgtggtagataatgaaaatcatgttcaagctgttgaggatgaggggctgttgactgttgccaagttaattggctgtgaaattgaagacctgaagttgactttatcaactcgcaaaatgaaagttggtaatgatattattgtccagaagttgactctatctcaggctattgatgcgagagatgctttggcgaagtcaatatatgcttgtctgtttgattggttggttgaacaaataaacaaatccctcgcggttggcaaaagacgaactggcagatcaatcagcattctagatatttatggctttgagtcattcaataggaacagttttgagcagttctgtataaattatgcaaatgagagattacaacaacacttcaatcgtcatttattcaagttagaacaggaggaatatatccaagatggaattgattgggctaaagttgaatttgaagacaatcaagattgccttaatctttttgaaaagaaaccactcgggctactatccctgttagatgaagagtcaactttccctaatggcacagatttaacctttgctaacaagcttaagcagcatttgaattccaattcatgcttcaaaggagaacgagaaaaagcctttactgtgcgtcattatgcaggggaggtcacttatgatacatctggattcctggaaaagaacagggaccttttgcacttggattccatccaacttctatcctcaagcatatgtcatcttcccaagttatttgcatcccatatgcttactcaatctgagaagcctgtagtaggtcccttacataagtcaggtggggcagattcccaaaagctaagcgttgccacaaaattcaagcttgaaaaaggacagcctcatctaaatattaatgaccctaatgataagtgtgacatggcctgtcaacgaagatgcttcagattagttcttttatcaatgcaggtttag

SEQ ID NO: 18320 - DNA, 267 bp, Glycine max
  Peptide Sequence Number=SeqID_135098
atgatgcatgcacctgacctcaactctcagatgcaatgcggtacgtaccgtatccaataccaaggaaatagccctaagcgtgtctacatgacacctcacttaggaaaccatgcagtatttgtcgaggccacccagtcgtgcatcgtaactccccccctaggtgatcaacttggggccacaaggagttccctaccaggtgacacaccccctagtacaaagtacatactgccacagtttatactatttcccgtgtcatataaggtatga

SEQ ID NO: 18321 - DNA, 1068 bp, Glycine max
  Peptide Sequence Number=SeqID_135099
atggagaagttcctgaagccttttgtggcatgtggttgggtagggtatttctcttacgatacaatgcgttatgtagaaaagaagaaacttccattttctaatgccccagcagatgacagaaaccctcctgatgttcatctgggcctttatgatagtgtgattgtgtttgatcacgtggaaaagaaagcatatgtgattcattgggttcgggtggatcgatattcttcggctgaggaggccttcaaagatggaaagaaccggctggaaagtctagtatctctcggcccatggctgcctgcaggttcgataaagttatacactcgtctgtttggtcctaaattggagatgtcaaacatgacaaatgaggagtataagagggcagtattgcaggctaaagagcacgtactggctggtgatatttttcaaattgtactaagtcaacgttttgaacggagaacttttgcagacccatttgaaatctacagagcattgaggattgttaatcctagtccatatatgacttatttacaggccagaggaagtattttggttgcttcaagtccagaaattcttacacggttgaagaagagaaagatcaccaatcggccccttgctggtactgttagaagagaaaaaacaccgaaagaagatatcatgttggagaaagaacttttaaatgatgaaaagccatgtgcagagcacgtaatgctagttgatttggggagaaatgatgttggaaaggtctccaaaccggcttctgttcaagttgaaaagcttatgaatattgagcactgttcccatgtcatgcacataagctcaacagtcacaggggagttattagataacttaacaagctgggatgcattgcgtgctgcattacctgttggtacagttagcggagcatcgaaggatatgaagaaacgcagagaatgggttgcccatctccaggctggagcgggaattgtggctgacagtgatcctgctgatgaacaaagagagtgcgagaacaaagctgcagctcttgctcgtgccattgatcttgcagaatcttcatttgttgataaataa

SEQ ID NO: 18322 - DNA, 741 bp, Glycine max
  Peptide Sequence Number=SeqID_135100
atgccatccatcgtgcctattaggctctgtgcaagtagtgcaggtgttaacagggtcaatgaagcttatggggttgcacacagttgtctggaggtggtggttagaggttggcctaacaacagaagagtgcagaaaaaggggagtgcaaaatcatctatagaagaggcaataagaattacagagaggggagtgcaattttcaggttattttaggaaaaacaattataaagtgagtcagtttgtgttgctccctgctctgttatgctgcacctccctgtttgatttcaagtggtggtgcaaatcagcatcagttggacattataagacaaatgtcggcattaataaacctgtattattgacaatcagctataaggatgttccacaaaatagtcccccagctgatactgacaattcagtgccaaagggagctcaaggggaagctaatattgaatccaatggtggcaagggtgcaatggtaaagaacgggatagggattgggaaagagatagagatcgggacagggacagaacaaaatccagagatagagatcgaagaagggattctgacaaagcgtgaacgagaggaagctgagagggacaaactcaaggatcgtggacattctgagaaagtcaaaacgccattcctcgcatgcattccatcttccttcccaacacatttcaattttacagatcgggattcccatgtttcctcttactcgtcaagggagaaagatcgacattga

SEQ ID NO: 18323 - DNA, 1965 bp, Glycine max
  Peptide Sequence Number=SeqID_135101
gtttttccattcggttcttttccactaaaaacttatcttcctgatggagatatcgacttgacggttattaatcatgaagacgaagaggagaatttggcaaaagaaatatgcactatacttgaatgtgcaaatgaccttatataccaagtaaaagacatagaacatatacgtgcacaggttcaggttgtgaaatgcacagtgaaaaatataccaattgacattactttcaatcagatgactggactttgtactctatgctttttggagcaggttgaccaacttgctggaaagaaccatattttcaaacgcagtattatcttaatcaaggcatggtgttgctacgatagtcgacttcttggttcacagcatggcttgttatcaacatacgcaacagaagtattagtcttatatattatcaatcgttttcatgcatcagtgcgtgatcctttagaggttctatacatattttttgactactacggcacatttgattgggagcataattatatgagtatatggggtccaaaagccttatcatcccttcctgaaattgttgatagaccagaatgtgatcaggatgaattcttgctccataaagagtttctcataaactacagggatattttctcttccaaagcaaagtcatccgagactacgaccaatacatttcccgttaagcacataaacatcttggatcctctaagaaatgataacaaccttggtcgcagtgtcaacgaagccagttttcatcgaataagatttgctctttcctacggtgctaaaaagtttaagcagatcttcacgctcgcaggagaaaacatgggtgaggcactggagaagtttttcttcgacactttgcaaaggaatgggaaaggagaaagggcagatgtagatgttcctgtttctccatttggtactggaagatatgaaaagtctgtcctcgatggagattgtgatagttactatggtggctcacaatatgctcaacaatatcctaattatgccatgccaacaacaactatacattccaattctccatcatcaccttctcaggacgatatccttgcactatctacacaacaaaattggagtgaaggtgatctccttgcattatcaacacaacaaaactggagtatgtattatcaaagcgtttacaatggatatatcccaggacaaacactttttcatccaacttacaactttgaagaaggaggaagatcacgaggaacaggcacatatatacctgacttgaattataattgctactgggatatacgtgcaaaggtgaacaggccaaggagatttccttctgcaaagcacaatgcattgctcaaatcatgtcccaaaaggaaagaagcggaggaggttcattttgagacaaacatgaatgataattcaaaaccgtttgagctttcaaatgaagacttcccccttattctaggcattcgcaaggctacatcgccaacacaagcacaggagtcagctccatttgcaaatgttcattctgagacaaacaaggatggtggtaactcaaggttctatgagccctcaaatgaaacacatgccaaagagcctgctctgctggcaaaggttctttctaagacagacaagcctagtaatccgtggtcgtttgagcttgtaaaggaagattttcctcttcttccaaaggtttgttctgagccacgcatggatgataattcaaagtcttttgatctctcaaagaaagattttccccctcttcaacgcagtcacaagattgttccatcaaagtctaatcagccaactaagtatgagaaaatttcatcatcctctaaagagtctaaattgaaaaatgttgagtttggaactcataagctttcacaatcactggcagaacaaagtatgtcaacaaagggtgagaaagaaatttctggtgtttcatcatcccaggaaactaagctggtagttccaaaggtggcattgtag

SEQ ID NO: 18324 - DNA, 1089 bp, Glycine max
  Peptide Sequence Number=SeqID_135102
atggccgcgcgagctctgttgaccagaaaaaccctagccaccgtgctccgcaacgacgcgaagcccataatcggagttggcataacagcagcggctactcattcacgcgggttgcacgtgtacacgctacccgatctggattacgactatggcgcactggagccagccatcagcggcgacatcatgcagctgcaccaccagaagcaccaccagacttacatcaccaactacaacaaggccctcgagcagctccaagacgccatcgccaagaaagattcctccgccgtcgttaagctccagggcgccatcaagttcaacggcggaggtcatgtcaaccattctattttctggaaaaatctagctcctgttcgtgaaggaggtggtgaaccacccaagggttcactgggatgggctattgacacacattttggttcttttgaagcattaatacaaaaagttaacgcagaaggtgctgcactacaggggtctggatgggtgtggcttggtctggacaaagagttgaagaggcttgtagttgaaaccactgccaaccaggacccactggttactaagggaccaaatttggttccattgattggtattgatgtttgggagcatgcgtactacttacagtacaagaatgttagaccagactatcttaagaacatttggaaagttattaattggaaatatgccagtgaaacttttaagcgcaggaatggaggtcgcaacaaacacggccgtggccacgtcaagttcattcgatgctccaactgcggcaaatgctgtcctaaggacaaggctatcaagaggtttctggtgaggaacattgttgaacaggctgcagtcagagatgttcaggaggcttgtgtctatgaacaatacacgcttccgaagctttatgtgaagatgcagtattgtgtttcctgtgctatccactctcatgttgtgagggttcgatcccgcactgataggagaaagcgtgagcctccacagcgatttatcagacgcagggatgatgcaccaaggcctggtcagcctggtcaagccccacgtcctgctggagtaggagctcctgcccgaacttaa

SEQ ID NO: 18325 - DNA, 438 bp, Glycine max
  Peptide Sequence Number=SeqID_135103
atggcaacatcagctggttcgtggaagggtctggagaggatgagcgtggagcagctgaaggcggtgaaagagcaaggcgatctggaagttaatcttctccaagaaagcctctccaacattcgcaccgccaccacccgcctggagatcgcctcctccgccctcaacgatctctctctccgcccccaaggcaaccaaatcctcgtccccctcaccgcctccctctacgtccccgccactctccacgactcccaacacgtcctcgtcgacgtcggcaccggctacttcatccagaagaccatgccccaaggcaaacattactgcgaccgcaaaatcaacttgctcaaatctaactttgatcaactcctcgaggttcctacctttcttcctttcctcttacttgcaccatctcttcttcttcttctacgctatcacctataa

SEQ ID NO: 18326 - DNA, 558 bp, Glycine max
  Peptide Sequence Number=SeqID_135104
atggagaagcctgctccaaaatggtatgaaatatctggtctggagaggcttgccccgcaagaacaggttccaaagaagaaaaaaggaaagagtctttatggccttttggggctttttgctggtgctattttcagctcaagcatttgtgggactcccaagaattttaaggcagggaatgattgcagtctaatgggaaaaattggtgagttcagttcatccttgaacaatacggtcataatatttttaccagcattatttcatctcacattacattcatcaatcatatacaagcatgcttataatatctttctatctgactgcagaaacatcactaaacaagacaacaccaaaaaccatgtacaatggcttcctcattcttgcattcaagtttgtgcactacctaatctcgaggggatacgacaagtcatcttcaccttatacaatgatcctgccatcttgggtggcatttaccctatcagtttcccatatgtcagagttatcattaagctgagagtacaagagatatcaaagactggttggtacctgcattcagaataa

SEQ ID NO: 18327 - DNA, 183 bp, Glycine max
  Peptide Sequence Number=SeqID_135105
atggttcacgtgaatcctgccactgggaaaactgatggtccctacagaaagaaattaagaacatatttggggaccgttgctagcaataagggggatgttacaattgataattggaaacaagtccctgcagctcaaaaggatttgatgtcgaaggatattcaggatgttcaaaaaaaggcgtag

SEQ ID NO: 18328 - DNA, 881 bp, Glycine max
  Peptide Sequence Number=SeqID_135106
atggctacgcgtcctcgccttcagaggactacacgtcctcaccttcagagggctagacgccctcgccttcagagcactacacgtcctcgccttcagaggactacacgtcctccccttcagaggtctgcatgccctcaccttcagaagactacacgtcctcactttcagagggctacacgccctcaccttcagaggactacacgtcctcgctttcagagggctacaggccctccccttaagaagactacacggctacacgcccatgccttcagaggactacacgtcctcaccttcagatggctacacgccctcacctttagagggttgcacgcccacaccagcagagggctacacgccctcatcttcagaggaccacacgtcctcgccttcaaaggactgcatgtcctcaccttaagagggcgacacgccctcgccttcatagggttacatggcctcaccttcgaggactattcgccctcgccgctaaaggactacacgtcctcaccttcagagagctgcactcccttgccttcagagcactatccgtcttcgcttttagaggactacacgtcctccccttcagaggtttgcacgccctcaccttcagaaggctacactctctcgccttcagaggactacacatcctcgcctttagagggctacacgtcctcaccttcagaggactacactttttcccctctagagggctgcacgccctcgccttcagaggactacacgtcctcctcttcagagggctacacgccctcacctttagaggactacatgtccttgccttcagagggctacacgccctcacattcagaggactacacatcctccttttcagagggctacacgccctcgccttcagaaagctacac

SEQ ID NO: 18329 - DNA, 372 bp, Glycine max
  Peptide Sequence Number=SeqID_135107
atggcatctttcagtcagatgcagtcccagtttcaatcccagatgcaatctcagggacttgcactgcctccagagcctatggttggtccctcaggttctcatgtcatcacaaaagagagttgtgttgatccctcagggaacgatcctgagatgggtgactcaaacaagtgcgagttgtacattgaagcaaatcatcctcgcctggttgccctaggaagagtttatgagggatcaatagtttacaacatttctttgttgcctggccaaatgaaggttggtgttgaggaggttaaagatgcacaggctcctgttcctgtacccactgatgaggttaccttagtggagcaggcacttaacaccttgcttgcttag

SEQ ID NO: 18330 - DNA, 408 bp, Glycine max
  Peptide Sequence Number=SeqID_135108
gatgtatggaaaaaggcacaggccatccagaagcaaaacattgccccccacgtgttgtctcgtgggggttatgaatatttagaacaaaaactaatggctgagaagaccaaaaagaaactggaggaagcttcccagtctagaagcactgagggtgtcattaaccctccatctcccatcagatgccacacgaagtggaagatggcctgcaccaagaaaactgggcagatgacgtctgaggcaacaaaggaaatcactgggaagatcgagcaggcgtcacagggatcgtttgttcttcatggatgtcaggatgtcctgactgccgccattggacgagtagagcaccctgcccgtgtccgtgctgctggagttggtgtcaccatcaagcaatatttcggatcggctccatga

SEQ ID NO: 18331 - DNA, 501 bp, Glycine max
  Peptide Sequence Number=SeqID_135109
atggttacacaaaacaatgagagtggcaaatttttgctctgggaccgtgaatgtgctgaattgattggccaaacagctgatggtgtgaatagggtcaagattgaagatggtgatcttgatttgaatgcttcccctcaagcactcgacaaattgttgggtcatgtgcttgcttttaaggtcaggattcaatcaagattaaaaaatgtagttgtacttaaatactcaaaagacctggatttgatcaatgttgttctggagatgctgcctgatagtgaggcatgttccaaaatagatccttccaatgttgattgcaatgatgctacgcatgctgaatgtcaatttctgtctgccacagctgaccatgatccggttgcggggttgcctttaacacccaaaaagcggatgtcatctgatgaagccgatgatgagttagggagctctcaaatttcgccagccctgctatcgtctaacaaattaacaagacattctcataggagctaa

SEQ ID NO: 18332 - DNA, 948 bp, Glycine max
  Peptide Sequence Number=SeqID_135110
atgcttttatgcagcttcgtatcggtaatccatttattcgtgggagtggcgtactgtttggtgagctgggccgtgggccttccaaagcgtgctcctatagactccaacctactgaagttgctcattccggtggctgtgtgtcatgcattaggccatgtgaccagcaatgtctcatttgctgcagttgctgtttctttcactcataccattaaagctcttgaaccattcttcaatgctgctgcttcacagttcatacttggtcaatcaatccccatcactttgtggctgtcactggctcctgttgttattgattatgtgaaaaatgcaggtgtgtccatggcatctttgactgagctctcgttcaactgggtcggcttcataagtgctatgatttcaaacatctccttcacataccgaagcatctattcaaagaaagccatgactgatatggacagtaccaatatctatgcctacatttccatcattgctctaattgtctgtataccacctgccgtaattttggaagggcctacactgttgaagaacggcttcaatgatgccattgctaaagtaggtttggtcaagttcgtctcagatctcttctgggttggtatgttttaccatctctacaaccaggtggctaccaacacactggagagagtggctcctctcactcatgcagttgggaacgtactgaaacgtgtatttgtgattggattttcaattatagtctttggtaacaagattagcacccaaactggtataggaacagccattgcaattgctggagtggcactctactcgttcatcaaagccaggatggaggaagagaagcgagtgagtattgtcttaatttatttgtaccataacttcttattaaattggttgaaacttgagaagttattgttcattctcgagtataaaccactctggctagatgctttataa

SEQ ID NO: 18333 - DNA, 336 bp, Glycine max
  Peptide Sequence Number=SeqID_135111
atgggtggagcaatatacatccggcatctccctgataaccgaaggaaagtcgctaaatattcgcaggcaaggtcagtttttctcgctgttcacgcagcgctctatgataagaaggtgagtatggaaggtatcagcattaccaaacttctggtgattgccgtgttggtgattttactgttcggcaccagcaaactgcgcacgctcggcgccgatcttggcgcggcgttgaaaggctttaaaaaagccgtgggcgacgacagcacgccgccggccgccggcaacaacgccgccgaaagccagtccgctcagcagagcgtcgaaaagaaagacgtttaa

SEQ ID NO: 18334 - DNA, 327 bp, Glycine max
  Peptide Sequence Number=SeqID_135112
atgaatagtctgtggctcgaggaatccatacacatcggaattccctgctcgcatacttgtctcagtcatatgctttttgttgttaagacaaagttaattatgagagatcttcgtgctttatgtacaacgggatggggaagcaatgtcttccaaggttattttgatgatgccaaagaatcaagatttaagcaaagtttcaagcaaagattcaagattcaaatttcaagtttcaagattcaaagaatcaagtttcaagaatcaagaataatcaagatcaagattcaagacccaagattcaagaatcaagagaagactcaatcaagataa

SEQ ID NO: 18335 - DNA, 297 bp, Glycine max
  Peptide Sequence Number=SeqID_135113
atgtacatcaagtatggcccaaaatacatcatgaagcatagccaacaaaacaagttatccaatgaaacaaaaactccccacacttattcccaaaacaattccaaagctccaaaattccttaaggatatggtgatatcatggaaagggaaacaaggttcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgtaa

SEQ ID NO: 18336 - DNA, 1160 bp, Glycine max
  Peptide Sequence Number=SeqID_135114
gtggtgcattacggccgcccgggccagggcctggtgctgcagccgggcatgaccttcaccatcgagccgatgatcaacgagggcacccgctacaacaaggtgctgccggatggctggaccgtggtgaccaaggaccgcaagctgtcggcacagtgggagcacatgatcgcggtcaccgagaccggcgtggacgtgctgaccctgtcgccgggcgagtcgcaggtctcctgaggatgctgccggcgagttcgctgctggacacgccggccgcgtcgctcaacgacccggactgggctgctgccgcgcgccaggcgctgcagcaggctgacgcgcgcctgtaccgccgcttcgaccagggcgacaacatcgagcgcctgctggcgctgcgcgcgcgcgccgccgaccatctgatccgcctggcgtggcagcgttgcctggccgccgatagcgggctgtcgttgttcgcggtgggtggctatggccgcggtgaactgttcccgcgatcggacatcgacctgctggtgttcggtgatccgccggcacagttggcgcatgaatccgcactggcacgcctgttcgcactgctgtgggactgcgggctcgcagtcagccatgcggtgcgttcggcgccgcagtgccgtgaggcggcggcggaccagaccgtgctgactgcactgatcgaggcgcgcccgatcctggccgatgatgcggcacgccgcgcgctgcgcgaggccatcgacgatcgggaactgtggccggcacgcgcgtttttcctgaccaagctggaagagctgcgcaaccgccaccagcgttttggcgacaccgccgacaacctggagccggacctgaaggatggccccggtggcctgcgcgatctcaacacgctgggctggatggcactgcgtgccttcggcgtgcgtgacctggaggcgctggtcgggctcggccatctgggcgccgacgaagcggcagcactgaagcgcgaacgtgcggtgctggcgcggctgcgtttcggcctgcacctggtggcgcgacgccccgaagagcggttgcgcttcgattaccagaagaccctggctgcacgcctgggctttgaagacgatgccgagaatctcggtgtcgagaagatgatgcagggcttctaccgcgccgcgctggtg

SEQ ID NO: 18337 - DNA, 639 bp, Glycine max
  Peptide Sequence Number=SeqID_135115
atggctggacgtatcgactaccagattgaaaaatttcagttcatcgagcgcaacgaatctccgcgtattacccgccagtgggcggaagtcattgctgaatgtcagcaggaaaaggcaaacagtgaaacgcgtttgcgtactgcgttgctgaatgtcgactacgccaccagcttcgaactgccgtttcgtttattgcttatccgcgccccgcagctggtggatcgcttacgccatgcactggcgctgaatcaaaagaacgtggtgattaatggtaagaaacgcggctgcgtttacagcctgaaagccgatctcagcgctgtaccagaggagattcgttatcgctttgtgagccggattactcgcagcggaccggatgcgctctccgccgcgccctatcagcagctggcaaaagagataaaggcgccgcgcgagcggttacgtctggcgctggaaagtggcttgcaggtcaatgcgctggatgggctgttctggtttggcatccagcgtatcgccgcggatatttcggcgctgcgttctgcgggaatggcgattacgactgcggaagtggaggtggcggatagtctgaccagaacgacgagaatgatagcggcgtatcaggtggcgacctgctcccgttga

SEQ ID NO: 18338 - DNA, 468 bp, Glycine max
  Peptide Sequence Number=SeqID_135116
atgctgaactggccggtgtcgcccgaggtgctgattaacggcagtgataataaggtagcgcttgccgcgacgccggtaacggcggtcaatccgcccgcgccgccggtgaaagcctcctgggtacataaaaccggctccaccggcggattcggcagctacgtggcttttatcccgcaacaggatctcggtatcgtgatgctggcgaataaaagctaccccaacccggagcgggtgaaggctgcgtatcatattcttgaggcgctgcaggagcgcacagggggcggccagtcgccgcccttgcaaatcacggccctcagcccgcatccatgcaggctgccccggaccgtaggccggataaggcgtagccgccatccggcgtacaggcggctccctacctgtggccatgcccggcggcgctgcttgcgcgggcctacagatttagtgcaatgggtgggcccagtgccatag

SEQ ID NO: 18339 - DNA, 165 bp, Glycine max
  Peptide Sequence Number=SeqID_135117
atggggcatgccacattgcccccattctcttgcaatttatgtctaaacatgcgcccaccaagtgctcgggacagcatagggaattcaaataggcccccaaatgcaatcccaagattaggaacccaagcttttagcttcaatgcaaggaaacatacttatggctaa

SEQ ID NO: 18340 - DNA, 345 bp, Glycine max
  Peptide Sequence Number=SeqID_135118
atggcaaaaggtgcagaagacgatgttagtctctacgcgtcaacgggctcatttgctccttggttgacgaaaggtgcgggtgcaggagacaatgttggtctctgcgcgacaatgggcttatttgccccctggttgatgaaaggtgcggaaattgtttgtgcgaagaaattacttgtgtatcttcgcatgtcacctgacttcacgggtcagtatgacaaatattgtctgtgcggagaattacttgtgtatctccgcacgtcacctgacttcacgggtcagtatgacagacagcacggaagacgacgtaaatctctgcgtgtcaacgggctcgttggctacaattga

SEQ ID NO: 18341 - DNA, 449 bp, Glycine max
  Peptide Sequence Number=SeqID_135119
atggaaagaaagcaacaagatcgtatgatgcaattccttagaggtttaaatgatcaatttaatactgtgagatccaatgtattgatgatggactcattcccaaacatagccaaggttttctcatatgttgttcagcaggaaagacagatcaatagcaatgaattaacaggaagcataagtttgatcaatgcagcaggcaacaattcatcaaattctagccttcttgtacctattgtgggaaagaaaataaaacctataatggttaagcttcctaatggccatacaattactgcaacccttaagattggtacagttaagacggtggaaggactttatagactcaagatgattccattcaagtctaagtacaagtctgattttggtccttgcaatgtaacttcattaaaaggttacaagtatttccttactataatatatgattactcaag

SEQ ID NO: 18342 - DNA, 225 bp, Glycine max
  Peptide Sequence Number=SeqID_135120
atggtgggttcaactgctccatgtctaccctcacctcttcacaatgcacaatccatcttgcactgggaaaagccgttaacttatcttgctgtgcacaagggtcaggtcctgcaaacttcttcttcgttgtggtttcttatcttcttctcccttcattggcttgacgcattttcgttctcttttaagattgtcaatccatgcgaaccatacggattactcaagtag

SEQ ID NO: 18343 - DNA, 342 bp, Glycine max
  Peptide Sequence Number=SeqID_135121
atgtcttttccggtttttctgacgttttcctcaaataaacgttggtggcgactctgcgcgtattcctttcttggaacacgcacccgcgagtcacgcgtcgccctcccgtcgaaggaggctaaaaaaagtggaagaaaacgaactgcgttttctgcattttttctggaaaacgtgatgaactcgctaagcgagcatgctacgctaagcgagttcatcaatattaattgtatatatgtgtttccaaaggaacatgctaagctcacttactgcgctaagcgagttcatcttttgaggatgaacactcatcatcctgttgagatacttgtggctaagcaaggctga

SEQ ID NO: 18344 - DNA, 207 bp, Glycine max
  Peptide Sequence Number=SeqID_135122
atgactaaagcacgtcaaaagggggtacggaaagaaaatgggggagatgcttgctacccagctcgccaaggcgagcaaggtgacttcctccagaagcaaccgccttctggaggaatcttctggagggcccaagtgggcctgagggataagcgcttagcggttgttggatcgcttagcgctaatatggctgcaaggaattgggcttag

SEQ ID NO: 18345 - DNA, 1257 bp, Glycine max
  Peptide Sequence Number=SeqID_135123
agggctgcatgccctcaccttagaggactacacgtcctcgccatcagagggctgcacgccctcgcctttagaggactacaagtcctcacaatcggagggctgcaagccgtcaccttcagaggactacacgtcctcgcctgtagaggactacatgtcctcgccatcagagggcagcaccccctcacctttagaggacaacacgtcctcgccatcagagtgctgcacgacctcaccttcagaggactacacgtcctcgcgattagagggctgcacgccctcacctttagaggactacacgtcctcgccatcagagggctgcacaccctcgcctttagaggactacaagtcctcacaatcggagggcagcaagccctcaccttcagaggactacacgtcctcgccatcagagggctgcacaccctcgccattagaggacttcacgttctcgccatcagagggcagcacgccctcaccttcagaggactacacgtcctcgccatcagagggctgcacgccctcacctttagaggactacacgtcctcgccatcagagggttgtacgccctcaccttcagaggactacacgtcctcgccatcagagggctgcacgccctcagcttcagaggactacacgtcctcgccatcgaagggctgcattccctcaccttccgagggctacacttcctcgccatcagaggactacacttcctcgccgtcagagggctgcacgccctcacctttagaggactacacgtcctcgccatcagagggctgcaagccctcaccttcaaaggactacacgtcctcgcaatcagagggctgcacaccctcgcctttagaggacttcacgtcctcgccatcagagggctgcacaccctcaccttcaaagggcaatacgtcctcaccatcagagggctgcacgccctaagctttagaggactagacgtcctcgccatcacagggctgcatgccctcaccttcagaggactacacgttctcgccatcagaggactgcacttccttgcctgtagaggactacacgtcctcaccatcagagggctacacaccctcaccttcagaggactacacgtcctcgccatcagagggctgcacgccctcaacttcggaggactacacgtcctcgccatcaaggggctgcacgccctcagcttcagaggactacacgtcctcgccatcggacggctgcatgccctcactttcagaggactacatgtcctcgtcatcagaggactacac

SEQ ID NO: 18346 - DNA, 213 bp, Glycine max
  Peptide Sequence Number=SeqID_135124
atggagaaaataattataatgtttgttttcaaggccgaggtaaccatcacgaagcttaatgaggagaggcgcaggaacactcaagaaaaagatttactgctgcggcaggaggaactagacaatttgttgttcagaatttctcaaatttctccattgggtgttcattcatggcttttggaagatgcaataagcaataaatatttacttatctga

SEQ ID NO: 18347 - DNA, 351 bp, Glycine max
  Peptide Sequence Number=SeqID_135125
atgagcaagatactcagaatgggggcaatttttttgtcatcatgggaactttttccaaccaagttgagctgcttaacagtgatcactgcacgatccgtagggtttcacgatgtttcggaaggaaatgggcaagaaattcaagataggggcaaaatggtccattttggaacattcctcagctcctgggcccacttgggcccaatagatgacttaggagggaagaaaccagctcgcctgggcaagcaagttgcttctagagtaagccaccagctcgtctgggcgagttgggcagcaagctcctccccctattttgctataaatagtcgtgggagattgaggagaagggtttaa

SEQ ID NO: 18348 - DNA, 679 bp, Glycine max
  Peptide Sequence Number=SeqID_135126
gtcgactctagaggatcccacttcccaccgtctccgcctggcccgcctgacgctcgtgcccggcctgctgctcgccttgggcgcatgtgcggccggtgactcatccgtcccgacagcgtcggcaccggccgctgcagcaccggcggccgcacctgccgcagcgccggccacggctccggctgccgacggcctggctgcgctgatccaggccagtggcgtgaaatgcagcaacgccagtacgggcagcggctgcacggccggtgatgtggacagcggcgatttctacgatgttgaactgtcgccggactgtggcgaccagggtttcttcgccggcgtagccgacgccaaaggcgtggaaacgttgaatgcggtgccatccaccggcagcaaggccagcgtgaccgcgaagctgtcgaaggggcagctggtctgcgtgcagggcatcgggcgcaccggacagaatcccctgttctattacgtcgttgcggttcccgccgcgacggtcggcaagtgcaagggcaacacgttgtgtgacacctatggcgacaggccgatcactggcttggccagcacagggggcgaggcctgccatgcggcggcgccgggacgttacgccgggaactgcgcacagggctgggtcagtgcggacgtgctcgacgtgttttccaacggaatgtaa

SEQ ID NO: 18349 - DNA, 1263 bp, Glycine max
  misc_feature (29)..(29): n is a, c, g, or t
  Peptide Sequence Number=SeqID_135127
atgcggattttggtacggttaaagcaacngtctttaaactacaacacggtaacctctcttccggatactaaaattatccctatttctattacctgcgaaacccctacgcgtgttggtgtgacgtttaacgatgcgcatgcggactccgcgccaaccgaatatttgtctaccgagtttagcgatcctgagtttttgttaacctctcaaagtacagcaggattgggcatgtttaacggtaagaagatcggtgcttatgccatgggtattcaaagggataagggtaccgcgacagacgatacgggtgcgacgctataccccgtattttcacaggatgctaccgcgacttcgggctggcatatcaaatccggaatccattatctgccggttgttacggataaaagtgagacctactctttcaccaaagattccggtgctgatacacctgctgcgctgaaacagattaattttaatgtcggcatcgtggcgcagatcaaccccgctggcgagctgaatattaccgacgaattaacgctggacggtttaaccaacgttgagctgtattactggactactattatgctgcttttgaaaagaacgctgatttgtgcctgcctgttagcctcgtttaatacactggctgctggaatggtgccagaaaccccactgttgatcgttaaagaagacgagcagggcgccagtatggacgttaaaaacacggatgccgacgcccaattgctgtataccaaactggttgatctacccgacgacccaaaacctggcctgattgtgacacagccggtggtacgtgtagacgcgggcaaaacccagcgcgtgcgctttgtactgaaaaacagcgcggagccgctgaaggtggaacacatcaagcgcgttatttttaccgctattccgcagcgtgaaaaaaataaagtaaaagtcgcattcagccagaatttgcccgttattattcgcccggccgggctggcggttaatctcgaaccctggaaagacttaacatggcaaatgaacgacggcaacgtcactgtcgagaataaaaccccttacgttgttcgcatggaacaaaaagctaaattattgccatccggtacgacggctcaattcgctaagacgtatattttgccgggtgaaaaaatgacagcgagcgcgaaaacgaaaataacgtcggcagataaacagattgaaatatatcctgtatcccgttatggctatcaagtgcaaagttatcttactgatctgaaagaataa

SEQ ID NO: 18350 - DNA, 423 bp, Glycine max
  Peptide Sequence Number=SeqID_135128
atgtggctacatccagaagattcatctaccagtcgctgcaggaagcatgcatggtctctcgtggaggagacaaaagcgacgaatgtctgtttcatctcgggaagttacacgacatggaaacctgccccgcggtggaagagctacttcaacggctcatggactgggggcagctcgatgtgtctgagaggtagggaagaaccacagatttgcacgcagtcggcagaaaggaaggctccaccaacccccaaagccctagtaatatgtttcactaggaatatgaccagccccaggtccgagtacccccagacagtgcccaagccgacgccattttccaatcaaagcaataaggtcgtcccatggaaatatgcccctcccgcttttggagaaggggctgcaaccgaggttgactccttgtcagccaag

SEQ ID NO: 18351 - DNA, 261 bp, Glycine max
  Peptide Sequence Number=SeqID_135129
atgaaacagaaagaacctaagtcacaagtaaatggtgttttgaaggaacgggctatggatgtccgattggactacaccatgttcaattcaaaagaatcaaacaatgttgcttcaaaagataagcatggcttcaagattaatacaagattgcttcaacaaacaaagccttgcttcaagattaactcaagatcaacccttgccttaaaacaaagtgctttcaagacattcaaggctctggtaatcgattaccaggcaatgtaa

SEQ ID NO: 18352 - DNA, 243 bp, Glycine max
  Peptide Sequence Number=SeqID_135130
atggggtcaagtcaaatgccttcgcttaaaaataggttctatcaagtcaaggtaaggagcctaggaatcaccagtctaaaagagttagggcagttgatggagccgctccaacgacaagcttttcgcaaagcttacgataagatctgggacctagccatggcagaagtctccacggaggccattgcatccctcgcccaatatgatgaccagccgttgaggtgcttcacctttggggacttctag

SEQ ID NO: 18353 - DNA, 584 bp, Glycine max
  Peptide Sequence Number=SeqID_135131
atgaagaactacgtaggtctgagttcctcatcacaaatggaggatagagacggtgagtccgatgacatgcggagataccttatggttatccacaccttttgtcaaccagaggcaagcgagcccgttgacacgcagagactaacgtcgtcttctgcacctttgtcatccagagacgtcaagtccgatgacatgcggagatacccaagtggttatctgtacaaacgatttctgttaatcctggcccgtgaagtcaggtggagataccttatggttatccacaaattttgtcaatcaaaggcaagcgagcccgttgacacacagagactaacgtcgtcttctacacctttgtcatccagagacggcgagtccgattacatgcagagataccttatagttatccgcaccttttgtcaaccagaggcaagcgaacccgttgacacgcagagactaacgtcgtcttcacctttgtcatccagagacgtcgagtccgatgacatgtggagatacccgagtggttatctatacaaacgatttctattaatcctggcccgtgaagtcaggtggcaggcggagatactcgagtg

SEQ ID NO: 18354 - DNA, 198 bp, Glycine max
  Peptide Sequence Number=SeqID_135132
atgtggtcgtctgcgccctttccggggatggcagcatcttccggtcgagactcttttggtctcacaacatctgttgatcctgacccatgcgttaggtggcaggtggcaggcggatatacccaagtgattatccgtacaaagacaacatctgctggtcctgacccatgcgtcaggtggcaggtggatatacccaagtga

SEQ ID NO: 18355 - DNA, 300 bp, Glycine max
  Peptide Sequence Number=SeqID_135133
tttcgaggagctttgtggggaagcaatagtgagcttaagcttcgaagggctgagagagaccaattgagagttgagggcatgatattggaagataagctaaaggcttgtcaaaggtcaaagagaagtttgtccgaccaattgagcaagatggaagaaaacatgggggccatcattgaccaatacaaggaaaaactaagtctagcagcaacccatgaacaaaagctagaaaatgagtatgcaaaggttcgccttcaccttaaatgggagtcaagagcttccaagactgctagccaaagctaa

SEQ ID NO: 18356 - DNA, 1065 bp, Glycine max
  Peptide Sequence Number=SeqID_135134
atcatcgatgtcaccggacgcaagatcgagctggacctgccggcgaagcgtgtcatcgttggcgaggcgcgccaggttcacgtcatcgcggcgctaaagggcgaccagactttcgatactattgttggctggcgtgacgacctgctcaagaaggacccggacagctacgccgcctacgtcgagcgtttccccgagatcgagaaactgccgcgcttcggttacgtgccacagggggatttcagcctcgagtcggccatcacgctttcgcctgatgtcatcacactcaatctcgaagcggagaaatcagccaaggaaagcggtttcgaagaaaaagccgaagctgcgggtatcaaggtcgtctatctcgattttcgcatcgatcccgaaaagaacagtgaagcctcggtcgaaatcctcggcaaactcttcggcgccgaagagcgcgcgaaggagttcatcgcctatcgccgtgccgaaatcgcgcgtgtgaccgaccggctcgccagcgtcaaggacttgaagcgccctaacgtcttcattgagcgttcgcccggcatttctggtgaaaacaactgctgccgcacttttggcccggccaatttcggtgccatggtcgatctcgccggtggtcgcaatattgccgatggcatcatcaagacgacctttggcgacctcaatcccgaacaactcgtcgttgccgatcccgagcacgtgattgtcacaggttcgaactgggcggctgaatccgacatcaatcagttcgttcccgtaggacgcggtgcggatatggctctttcccgtgagcggctggccaacctgatgaagcgcacgccgtttccggaactgacggccgtcaagcaaggcaacgtgcacgccgtctggcaccagttctatggcgcgccttacgagtttttcccgatccagcaattcgccaagtggtttcacccggacctcttcgccgatctcgatccggaaaagaatttcgaggagtttcaccggaaattccttcccgtcacctacaagcccggctatttcgcctcgctcgaaaaaggtttgaaccaatga

SEQ ID NO: 18357 - DNA, 414 bp, Glycine max
  Peptide Sequence Number=SeqID_135135
gtattctcttcgacattgtcttctttcatctctaacttcgccataggtataggcgatagtgattctgggagtttgattcagcaacctttggtggaccaaaaggtcatctccatcaacggttcctcgaaggaggaggctcgtcatggggcttctgatagtgagtcaccttccttggagtggttgacggtctcgtgccgtgctagtggcacttctcacccccgtgggaaggcgcaaccttccgctacttctccgatcgaggaacttgttccgatcaccatgattcttccctcttatatttttgggggagcaaggaagagtggtggcgggggcgttagagcgtcccctcgtgcgcggtgtagccatagtgctaggtcgtcatcatccctactaccgttgctggttttgaataggtga

SEQ ID NO: 18358 - DNA, 351 bp, Glycine max
  Peptide Sequence Number=SeqID_135136
atgttaagcgagcttggagccatcgtctctacaccacatcttaagatgaaatttccaaccttgacgggagaaatcgtaactgtcaaggcagaccagaagcaggcccgacaatgctatgatgaaagcttaaaggtggctcctcatccttccactagagagtcgggcaagcctcatcccacatctggtggtagcagtcaagtcatgaacatggatgaagaatcttcaataaggaccttagtcgtctacaaagcaactaggagagatcaagatgatgtatttgatgtagatttgtacggcaacactgtcaacaaaggcccaataccaatcgaagaacttgtcaaaacaatttga

SEQ ID NO: 18359 - DNA, 537 bp, Glycine max
  Peptide Sequence Number=SeqID_135137
atggatctctactatagtcatgacacttcaggctttgttctttctccgtcagatgagacgtgtgctcggcctcatcaccagaagttggagatcattggttttccatttgggtttggtggtgttgctgaatcagctattccagactggagcagctccacatttgcagattactgcacttggtctggaagcaaaagacttgctaggaaaatctgtgaatccttagctggtttggatcaactaagagtcttgaaccattctcataatttcttcactggctctcttccagacaacttgtttcttcttcaacacttggaggtcatggacttcagcaataatcattttgaaggtcctataaatacaactatctgttcctctttacctcggctccaggataataagctatctgggtcactaagtgagggacttggtaagatttcaaagctagtggattttgacatctccagtaatgaattttatggaattcttcctaacatctttgggagcctaagaaggcttaagtttttctctaccgagtaa

SEQ ID NO: 18360 - DNA, 368 bp, Glycine max
  Peptide Sequence Number=SeqID_135138
ggcacacaccaaacttgaaggaaggaagcacagcaagcacaagaagctcacactcaagaagaaagagaaaggagagctcaacaacttgaaggagaaatgtacatccatttacaacactgcaaaccctaaccctaaacactgcaagcctacactgccatcctcaaaactgtggcatcttcaaaactgcactgtgcatggcgtgaaggtgtctcgccaatgggagaggcgagaccctcttcacgtagctccgacgtggcatgtctcgccaatggtaccagcgacactgtccacgtcaggtgtcttgccattcatcccgacggcacccttccaggtcagcaacaaattcgccattggggatggcggcacag

SEQ ID NO: 18361 - DNA, 786 bp, Glycine max
  Peptide Sequence Number=SeqID_135139
atggaaaagtttcttgcggagttgcagaccaaattttcagaagatctaacggttaacgaaggctgggcagcgtttttaccaaggatgaaaaaaaagggtatcaaggatttgacaatagggttaagcattgatggcagcaacattgaatgtttgtatttacgtgcttcctactaccatgttgttggacaactgaaagaagcggtcaaggattatgatgctgcattggataaagaacttgattcaatggaaaactgttgctgtatattcagtagccaagaggagtgtacatgttttcaaggatgttgtatctatatcctcaactttctaagctatcatgatgtacaagtcaatgcttggaaaaaggaggttggtgaaggtggttcacctcctagttggcttacagagttgcagaaaatagtgtctgtgacattggaggttgacaaagagagcttacgttgggagacatacgtcgaggtccacaacagcgcctatggcggccaggatgtcgaggtggcgctccaccgagtcctgaaggatgtcgtggcgcacgtcctcgacgtcgatggctgtgtggagcttcctcttggagatgctcttgcatgcgagcaactcgcgcgtgtgacggtcgatgcaaaggtatgtcacatcaaactcgtcgtacccgagctcacggtccaccaggtaccaatccttgatgctctctttcggcacaccgtgagaactgtgatcgatgccttctgctttgcgatggagacgttggagaaaatcaatttcacatcctcgtag

SEQ ID NO: 18362 - DNA, 381 bp, Glycine max
  Peptide Sequence Number=SeqID_135140
atggcatggaaatacgatttgttgattgatgttggaaatgcattggcatgtgcatgttgtgtatgttcgtggggggcactgtgcactgacctttcaggatctttggcactagcttttggccaggttcatacgttggatgttgtgtatgatcgtggggggcactgtgcactgaccttccagggtgctttaattggtccatggtctttggcatttacctttggccgtgatcatagctcatacgacacaggaaatagagtaactgtggccaaggaacacctttgggctcccaggctgatcacctatgggaggggggctgttacgtgcacaaccgggtggtctcgacaaactcagcacagttccctaagtgagagtgtcgtgtag

SEQ ID NO: 18363 - DNA, 780 bp, Glycine max
  Peptide Sequence Number=SeqID_135141
atgtctgagcaattttactgcaatgagggaaatgggagtaatccgaagaaaaattgttacgagacaaagggtcaggaatatttgtatttgaatcctgagtttcttttgaagagcattgatctctcaagtaatgatttaacaggtgaaataccaaaggagttatcaagaaatcatttctcttgtgaagttccttctactctttccaaaattgatcgtcttgccatgttagacttatctaacaactatcttgttggaagaatcccctggggaagacagcttcagacctttagtgcctctacttttgaaggaaataccgatctttgtggtgaaccacttaacaaaagctgccctgtaaatggcacagcaacaaagcctcaaggaccagcaattcatgatgatgatgacaattcagttttctgtgaagcattatatatgagcttggggttaggattcttcacaggcttttggggcttaataggctgtccgggtcaatattttcagaggattcaaattctcactttcatggtgggcctacacatttccgatgagcatgttgagtgggaggatatacatgagcaacgtgcactcaacgtctttttggccgttggtgattgtgttctagttggcttccagtatgttggacttgctgatgcaagctccattggagcttgtaggcctaggatcttcttcatcaatggattcctttgcttcttggaagataaatggcagcggaatggagaaggaagagagagaggagacgccacttcaaggagaagatga

SEQ ID NO: 18364 - DNA, 3029 bp, Glycine max
  Peptide Sequence Number=SeqID_135142
atgagagtgacattcgtgaggagaaggagaatgagaggtgtagcgtcgacaagagaacacagtggtagcacggtgggcacgtcgcgccacgacaagttgagtcacgatgagagagcaagagagttgcgaggaagaggagatgagagtctcgtgttgattgaggaatcaaaaccgaagctcggaaccaaggaaaaacgcccgcgattctcgcttgcttttcggaactatccctcgcttttccttgtctttattttcctgtttcctgttccatctgccatgattggaggcaaagatcttgttcccaatggcgttggctccgagggtgagaactcaaggagcaaggtgcaacaacatcagcatcatgattttgctcatgctaacaaggaacaccctcaagagaaaaaaccaagttttgacgagtttcagtcaacaccctcaaaggtttccatttctgggttgcaagagttgaccctcagctacctctgtgagaacccaaaattgggttttgttgagagagaggttggtgatagaagctcggtgaagggcaaagaagttgttgtttatgggaattctgatcaggatgagaaatgcctaactgggttgggtatgcctatctggcgtgacgaattaaggttaaaatcgtcgatggtagaggtgtccacatttagtgcgcaacagtaccttgaacaagattgtcttcgaaggaagatatccatcggaaagcaaaagcaagatcaagatgagaaatgggtagagagggatttcttgagtttgagtgagactagggaggcttcttcaaatagatccattgaggaagagtgtgagagggagaagaatgatggcagcaagaagcagaagcttgagactcttagcctctctcttgctttgcctgatgtgtcgctctctctcacagcctcaaacgctttgcaaaatggcgaccaactcgttaggccaaagccttgtaagccatccacaaggaccacaactacgataaattcgtgttcaaatgattacacagcagcttctgtgtctcactcttactctcaccctttctcacacaaccaaagttgctcactcacccgaaattcaaccgagaattttgagtattcacacagcaaagatgatcaaatttggcattgtggagaggggactaatggctcggttcatagcaggttcaagccaattggagatggggttgctttggccaattattccttcatgcaagggaatagtcagtataaggctactagttcagataaccaatcttttttcccttcagaattgcctgcaagagtgagatttgaaggtcagtcagaatgctcaagaggaaacaattctggggatttaagaggcttggaaggtgtgaatggtgggaaaatgcagttttctacatcagagagagttctaagagacattgtgtctgagtctatcccagccatggcattgacatttcaggagttcactgaagaagtcataacttcaattaaggaacacttgaaaggtctcattgaaatgccagagaagaaaggggaattagagagcctccagaaccagctaggccgaagatctgacctcaccagagagactctttcaaactctcataagcagcagctagagattttggcttccatcaagatggggcttggaagtttcttgtccggtcagttccaattcatggagatggtggatgttttcttgtacatgagatgtagaaatgtgaactgcaagagcttacttcctgttgatgactgtgactgcaagatctgttcagggaataagggtttttgcagttcttgcatgtgtcctgtttgtatgagctttgattgtgcaagtaacacttgtagttgggttggttgtgatgtttgttctcactggtgtcatgctgcctgtgccattcagaggaatctaatcaaacctggtcctagtttgaagggtccttctggaacctctgaggtgcagtttcattgcattggctgtggacatgcttcagaaatgtatggctttgtcaaagatgtctttgtgtgttgtggcaaggattgggggctagaaaccttggcaaaagagcttgactgtgtgaggaggattttccagggaagtgaagatcgcaaagggaaggaattgcatattaaaacggaaaatatgctgttaaagcttcatgctaaactggtttctcctttggatgcctgcaaccacatcatacagtttttcaactatacggatggcatgtctgaatttcctccttctgtatcctcaaaggatttgtctacatctaaggctaacctaacaatggacacaacatcgtctcttccacaatctacttctctaatgccaatatacacttttgacatgagctacactaggtcaaatgatgttcaacaaaaagacctcaaatcctccctcttaagtgaacaaaaaaaagagactgatttccacttggagcctctattagggaaaggagaagggctcgaaagcttggagagcatagtgaggataaaagaggtcgaagccagaatgttccaaaacaaggcagatgaggcaaggagagaggcagaggggttccagaagatgatcaagacaaaggctgcacagatggaagaagagtatgcagaaaggattggcaagatttgcttgcatgaggcagaggaaaagtggaagaagaaatttgatgaactcaatgtcttgcaaaattcccactatgattacttcaacatgaaaaacagaatgcaagatgagatccatggattgttgaagagaatagaagcaacaaagcagcaacgggttttagtgatttttcaaagacctaggttggaattcgcaagatctgagactgaggaggagaaagtgacggtggtggagcgacaaaaatctgtagaacaagttgtcggatcttgtggagtgcctaaacgcatcgaacttcagttgaaactaaccatcttttggcaaattttgcagtcaaagtatggggttggattttggggtgggggcataggtgttgtagggagccaagagagggagaagaagttggagaa

SEQ ID NO: 18365 - DNA, 546 bp, Glycine max
  Peptide Sequence Number=SeqID_135143
atggacataaccattgttattgttgttcattgtgcaaaccaggttttgaggaattgggagagtgctcgtcagaagacttcttgtcttcccatgcagcaagttcatcatttgcctctgcagaaactgccttcaggtttggtgaagtgcaatactgatgttgcgatgttcactaaccaagtcaatgccttggctttgcctgaggctattaattggatggctgatttgggttacaatagagctattatagagtctgattgtaaatggattattgaggggattaaaggagatgaaaacaagcatccaaccctttgtgaaacccgtgtcaatacactgagtcatgctttgtacattcaaaggacattcacttttaccaagtgtactaagatagagacaaattggaatatcaccgcatacaaggaatcaagtagtacaagtagtggagtagagagcagaagatgtagtgtattgttacccctgtctctctctctcctcaacaagttgtcacgtagcagaaaaggacaacttgttgataacaaaaacatttga

SEQ ID NO: 18366 - DNA, 222 bp, Glycine max
  Peptide Sequence Number=SeqID_135144
aaaattgtgacagagcaggccaaacgcaaggaactccaggagaaggccgctaactcgatccagaaactggttgatgaaaaagggagggaaggcctgaaggcctttagcgcatctcaggctgtagcagatgaggcaaaggttatggagagtgccgaccaggtcttaactaaagagatggcctccttgaaaaagctgtatggggatttggtcaagaatttgtag

SEQ ID NO: 18367 - DNA, 381 bp, Glycine max
  Peptide Sequence Number=SeqID_135145
atgggaaagttggatcatctagaggaaaggctcaaggccattgaaggaggtgaagattattcctttgctaacctagaagagttgttcctagtacccaatatcatcacccctcctaagttcaaggtgctggactttgacaagtacaaggggactatttgccccaagaaccatataaagatgtattgtcggaagatgggggcatacacaaaagatgaggaactgctgatacatttcttccaagaaagtcttactggggtagctgttacctggttcactaacttggaaccttcccgagtccattcttggaaggacctaatggttgccttcgttaggcaatgtcgatataattctgatatggctcgggataggatgcaactatag

SEQ ID NO: 18368 - DNA, 360 bp, Glycine max
  Peptide Sequence Number=SeqID_135146
atggaggccttggaggttggtggtggtggttgtcgccagcgaggaggcggaaaagaagcagtagtcgtttccgccggagaagaagtcgttgtcgtagtcgtcgatgaagaagttgcggtctggtggaggaggacagaaccttcttgtgatggtcttactctgagacggaggtggctttgtcggcggcgacaatggtgcaatgaggccgacgggcttgaccgaggaagagtgttcaaagaagacgaagaagcaacagagaccttgaatagcatgttcatcatcaatgcaggttctggatttaggatactgtggaacaccgtaaaatcagtccttgatcctaagaccaccacaaaaatcaac

SEQ ID NO: 18369 - DNA, 345 bp, Glycine max
  Peptide Sequence Number=SeqID_135147
atgggggagatgcttgccacccagctcgcccaggcgagcaaggtgacttcctccagaagcaaccgctttctggaggaatcttctggagggcccaagtgggcctgttgcatgccaccaagaaaaggtccccggacaaaattagggtatgacaaccagctgagagggaaatgggaaactagagaccccaagctgataccctactgtcgcaacctacccttcggcgggagggcgacgtgtgactcacgggtgcgtgttccaagaaaggaatacgcacgtagttgccaccaacgtttatttgaggaaaacgtcggaaaaactggaaaatacgtgatctacgaactttaa

SEQ ID NO: 18370 - DNA, 362 bp, Glycine max
  Peptide Sequence Number=SeqID_135148
ctctggttacgggcctctgtagtcctacagggtgcccgttccccccggcaaggtcacgtcatcatgacatagggatcgcgcctgcaagacacccagtggacccaaagaagtccaacaaggtcttggagttgtcaagctctaattacggcaagggcatcaggccccctactaatcgagctttcatcaagaagtactgcgtctccaggcaggcgcagggcgaaacaccacagcagcctggggatggccagcagcgggcaacagatgcaccgccatcacctctagagttcacctcagctcatccacaaaaagccatcatgcgtccagctcaagacgttaaagaagcgctactaggaggcaaccta

SEQ ID NO: 18371 - DNA, 270 bp, Glycine max
  Peptide Sequence Number=SeqID_135149
atggagagactaacatcgtcttctgcaccttttttcgtcctgacccgtgaagtcagggatagcgagtcaggtggcaggtggagataccttatggtcatccacgcctttcgtcaaccgaggggaaccaattcgacggtttttactctcattgtccggaaacattcaagcccaaagacacgcgagattcttttctgctggccagggacgatcgagtgcaatggcgaagggaagtgtcgtggttgtccaactttgtcattttcaagacactga

SEQ ID NO: 18372 - DNA, 630 bp, Glycine max
  Peptide Sequence Number=SeqID_135150
atggacagggcaaggttagtttatgggctggtgatgaagatggacatggacttgggctccatcatctcaagccagatctcacagatggcccagtccaaatcctctcggctcgaatttcctacactcattacagcactgtgcatcgccagaggagttgtgtctgattccctcaccttcgagtccctgagcccgaccattaacttggcctacattaggaagaactgctggaacccagatgatccgacgattacattccctgggtcccgcaaggccagggctaaagctccttcagacacttctacttttgctcttgctcccactctagcttctacctcagcaccagcaccactagttcctgttcctgcccctccagcactcacagcaccgtccggcccctccgctcagagctcagaagtcttggagtcgcagccagtgccagaggtgacaccagaggagacgctggaggacacacctgccactaccgctacaaatgttgattatgttgcggacatgacggcagctaggggtggaaatgagccgagtagcttgtcaagggcctttggctcggcctatgtaaggctcgactcggctcggcttgtttactataaaggccaagctcaagctttttaa

SEQ ID NO: 18373 - DNA, 231 bp, Glycine max
  Peptide Sequence Number=SeqID_135151
atggcaagaattggacaaaacagactggcaacaagagtgtttatggctatattgcatgtggacagaaaaaacaaagatttagccaatctcaacaaattttacagattttaccttggtgtaatctgggtgtgccaaaacaaaaatggatgtagctgctcaagcaaggagaaaaaggaaattaatactacaagaaaagagaaaaaaacaagaaaagcaatagggatatgctga

SEQ ID NO: 18374 - DNA, 219 bp, Glycine max
  Peptide Sequence Number=SeqID_135152
atgttgaatccaactcagtttcaggccaaagaagagaacgttcaagtagttgatgacttgctcagcgagtggcatccgctaagcgaggcatacaactcacttagcgggttaggaaaccctagaagaggatcaattagagatgtgctcgcccagtgtgcagccagcctgcccagcaaggtctttgtctcttctcgcgcttatcgcgcccagtctcgctaa

SEQ ID NO: 18375 - DNA, 339 bp, Glycine max
  Peptide Sequence Number=SeqID_135153
atggcatctgattttcctttactttttgatcatgtgaatttatatccttccatggggagatcatggaggccactatctgaaatagcatctcgaaaaaccttgaatgagagcaaggccaccactccttccattaacatcaatagcaatgcaagagtcaaagtcagtgagattttttatttcttcaattcgtctagaattcacaagggtttcacagagaaagatggcatgcaaatgctcttaaatcttcatgttcatggaaagaactcaattgacaacaaggtgcactacattcaagctcatattaatctacttgttggtactagttcactgtcctcgtaa

SEQ ID NO: 18376 - DNA, 615 bp, Glycine max
  Peptide Sequence Number=SeqID_135154
atgtcacgctctcgtgcttcatcatcacattggaccagcatgaatgaggaactcgaacacattgttgtgcatatgcccaaattaacaattgaagagcaagggcaatgtaaggaattggcatacaagatgcagcatgtcacggctccaccagagggtttcttccagatgattttcggtgaagttggtaaggtatatgctaccaagtggaaggatgtacttggcagtatatggcatttggttgacaaggacggaaattatcacaacgttatgtacaaccaagatatggatcaaccagccatcgttgcaggacccctcgcctgcccagagcattcccaagatgacactctttatatcatcaagtatcaggacgttccaagtagcatgtattatttcttgaaagacaaaggctggactcatttgcacttgggagatgttgcagaatgtcggctcgtgttcaatcattggagaaagtcactgaaaattggagccgggtggaaacatttctgcgagacgttgtcgttcactactggcatggagatagtttctgaatttattgatcctgatgttaatcacgtgctttactggccatgtttattaattggcttaggattgtga

SEQ ID NO: 18377 - DNA, 138 bp, Glycine max
  Peptide Sequence Number=SeqID_135155
atggaatggagacatgcccctacgattaatcatgcaagtgggatcctatgtctatggggagaaggcaatttgaatgtaatgaattggaagttagaagaagggaggaaagtgttagacaagtggccccagatatcttaa

SEQ ID NO: 18378 - DNA, 333 bp, Glycine max
  Peptide Sequence Number=SeqID_135156
atgcatatgacacagatgcaatttacgaatacaggagcccgagaaactgtctccttcttagatacaacgtctaggggtagcaaagtgccccaactgaggggatcaaagacgaaacctacgcatgatgcatatgcgaaaggcacaacatgggggatgtacatagtacaacaatattcacaaacaaatataagcaaaagggtacatgacacttatgcatggcaatgtgacatatggcacgcagcgtgtctgctccgtgcccctatttgggaggtagctaaaaaggctttcagtgataattcccatggtggtcatatctctcttgatggtctctag

SEQ ID NO: 18379 - DNA, 225 bp, Glycine max
  Peptide Sequence Number=SeqID_135157
atgggatcaagtcaaaagccttcgtttaaaaagaggttctatcaagtcaaaatcaagagcttagaggtcactagtttacgagagttggggcaattgatgggtcaacttcaacggcaagccttccgcaaagcctatggaattagaccaccaaaagcaagtcgaaaatggggtggtcgggataccgagaaaatgtttggaggcaaaagcaagaatcttggcaggtag

SEQ ID NO: 18380 - DNA, 534 bp, Glycine max
  Peptide Sequence Number=SeqID_135158
atgaaggtattagaccaagcttttgtggagaaggatgtgactgttaatcaattggacagtatagtaggaaacattactgcctgcaataatttaagttttagtgatgaagagcttcctgaggaggggaggaaccacaatctggcgttacatatattggtgaactgcaagtctgatgctctgtcgaatgtacttgtggacactggttcctcattgaatgtaatggccaaatccacattagatcaactcttctaccaggggcctcccatgagaagaagcggggtggttgtcaaagcgtttgatggatcaagaaagtctgttatcggggaggttgatttgcccattaccattgggccgtctgttttccaaattacattccaggtgatggatatccaagccgcatacagttgccttttgggtaggccgtggatccatgaagctggggccgtgacatccaccttgcatcaaaagctgaagtttgtcagaaatgggagattgatcactgtgagcggagaggaagcctttgttagtgcttag

SEQ ID NO: 18381 - DNA, 330 bp, Glycine max
  Peptide Sequence Number=SeqID_135159
atgaatttatcacttaaagttgtcgaaaatatttcaaaagccgtgaaagggggaggttttgggaccatttttgaggagcagtatcggcctgagttggtgatggtgttcgcgattccgttgtctcagcagctgacggggatcaacattgttgccttttatgcgccaaatctgtttcagtctgtgggatttggcagtgactcggctttactttcggctgttatattggggcttgtcaaccttggttccattcttgtctcaactgctgttgttgatcgctttggtcgaaggttcttgttcattgcaggtggcattcaaatgcttctttgcatg

SEQ ID NO: 18382 - DNA, 99 bp, Glycine max
  Peptide Sequence Number=SeqID_135160
atggtgtcgtcgtctgacaagatgacgaaggaggccgaggaagagcgccatgacagtgttcacaatctcctcggcgcacgaggggttgttaggctttga

SEQ ID NO: 18383 - DNA, 181 bp, Glycine max
  Peptide Sequence Number=SeqID_135161
acgacgacaccattggcaacaccttggagtaagaaggttgggtcgttatagtatccatggagcagaaggatttcgtggagaacgtggtgaagacaatgtggtgggtggttgcggtgcgaaaaataggctcatggagcggtggttgcggcaactcttgacatcagcaaaggaaaggaggtga

SEQ ID NO: 18384 - DNA, 504 bp, Glycine max
  Peptide Sequence Number=SeqID_135162
atgaggttcaatagtgtcacctgcatagcagtcaccattctcttcctctccatacacctccaagcatacaaatacaggccactggaacatttcaccatcagctgtggtgcaactagaacatctttgaactactacttccccgtcacctctggccctaaattcgttcgcctcttcttccaccctgcttcttatccttcctttccctgcactgaggcaccccttcactgttcagtccaactcatcctccttgacagtattgacagctctatggaaaccgaagctgaaaacacggaaagcattttcagagagtatgtgatacaagtgaattacgatgagatgctgaccctcagctccactccatcacatccaaactcgaacgctttcatcaacggaattgaaatattgtccattccaagtgatctgtattacatgtcaggaaactacacaaaattcaaatccctaggaggtgatgaattggtctacattgctcgagccagagtatag

SEQ ID NO: 18385 - DNA, 990 bp, Glycine max
  Peptide Sequence Number=SeqID_135163
atggacagggaacacagactcaagcttttatctgtccaagatggcatcgttactgctaatgcaacaacccaatctcctactatcaataagtcccctacaccaaagctcgcttgtcccgttctcgattcaactaccctttcccaatcacctcaggcccctaattccttcgcctcttcttctaccctgttgactacccttcttttccccgcaccaacaaatcctttactgttcaatccaaccaattcatcctccttgatggtttcaatgcctctttcaacgctgatgctgcaaacaaggaaaccatcttcagagaatatgttgtctatgtggataatgatcagaggcttatcctcagcttctctccgtctcaaccaaactgatcctatgctttcatcaatggaattgaagcacattgaaagcattgctgcactggagacggtgtatagaattcaagtccgagggcacgaaatctctccacaaagcgacaccgctaacacggatggtaagatgaacataaccgtgaatcctgatcatgtggcgcccaaggaactgtacagaacagcccataacatgggcacaaacaccactctgaacataatcagcaacctgacttgggagtttcccgttgatgctggcttcacttacgtgctcaggtttcacttttgggagcttgaccccaatcttgatatagacggtgacagggtgttcttcatttacatagcaagccacttggttgatgatcgcgctgataataatactcagaaaaaggtgtacaagggctactttgaaggcggtttcaccccagtcactatcaaacacctcaaactagattcacagcagggtgcaaatgatatcatgaacaagattgagatgctctcacagctctgccaccttcatcttgtgttcctcatcgggtactgcaatgagaactatgaaatgatccttgactatgatttcatggcgtgtggcaccccccgccaacatctctaa

SEQ ID NO: 18386 - DNA, 741 bp, Glycine max
  Peptide Sequence Number=SeqID_135164
atggctctgattgtggaccccatgttgaaggggaagattgcacttgagtgcttcagaaagttctgcaagattggggtgagttgtttgtcagaggatgggatgcagaggccttcttccatgaatgacgtcattttggagctggactttgcactgcaactgcaagagaatgtagagcaatgcaagaatgctgcaccccaaacggcgtccccaaggaaccctcgcaaatcgcggtggcgctccgagctcgagattcgagaagaaaaagattcaaccattgtggaagaggacgaaaaacccagaacgagaagacaaaccacgcgaactaagaaggagaaacctaactccgttccaccttcaaccccatctccaaagagtgaagaagagaatggtggtgatttggaccatgttggacaggtggtgagtgatttgatcatgtggaaggatgcatcaaagtcaaccttttggtttggtttttgttctctttgtctcttgtcttcatgctttactcaaggactcaactttagtgttttgtcggccttgtcgcaattggggattctcttatcaggtgtttcatttttctcgaattcgatttgtcaaagaaatgaggttgaagaaaagagggaaatcaagctggcagaggatgacattttgtgtcttgcgaaattaattcttcctgctctgaattttgcaatttcaaggatgagagcgttgttctcaggagaaccatccatgaccctcaaa

SEQ ID NO: 18387 - DNA, 2589 bp, Glycine max
  Peptide Sequence Number=SeqID_135165
atgaggttcctcagtatcaactctgtagcattattcctctttctcctcttctccacacacatccaagcgtacactccggaagacaacttcagcatcagttgcggcaccaccgggacatccttcgacggtgaaaggacatggacaggggacatacacaaaaagtacttatctggtggtcaagatgacaccgtttcaactgaagcaacaacacaatctccttctgtcaaacaagtcccctacacctcagtacgcttgtctcgttctcaattcaattactccttccccgtcaccgctggccccaaatttgttcgcctcttcttctatcctgccgactacccctcctttcctcgcactgatgcctctttcaccgttcaatccaaccaattcaccctcttaaaaggttttaacacctctctaaatgcggatgcaggaaaaacggaaaccatcttcggagaatatgtggtcaacgtcaacgatggtgggattctgctccttagcttcactccgtcgaaaccatactcctacgctttcatcaatggaattgaggtactttccatgccaactgatctttattacacatcagcgacagtggatgcagttggattcaagttcgtgggaagaaacatgcagtacaccctcagaaccagctttgccttgcaaacagagtatagaatcaaagccggagggcaagaaatctctgcacaaaacgacaccggtttgttgaggaaatgggctggtgatgaacaagattatttaattaagcaaaatccagagaataatgatctaccagctaacacggatggaaagatgaacataacggtgaatcctgatcatgtggcacccaaggaactatacagaacagcgcgtaacatgggcacaaacaccactctgaacataatcagcaacctgacttgggagttccccgttgactctggttttacttacatgatcaggctccacttttgcgagctcgatccaaatattagtgacatcaaggacagggtgttcttaatttacatagcgagccagttggcagaagacaatgctgatgttatggaatggacccagaaacagaaaggtctccctgtgcatcaaaactatgcggttttgattcccaagaataataatcagaaaaaggttaatctgttgctccaaatgcatcctcaaactgatgataaaacattatatagagatgcgttcttgaacggtctcgagatattcaaaatcagcgaagccaagtcaaacaaccttgctggacctaatccagacccagttctgactccacacaacaacatacccgccccaaagggaaacagcagcagcgggagccaaatgaccataattggtgtcattgcagggttggtatctggggttgttttgatatccgttgtcattctttttgttgtaattttgtggcgcaagagaaccactgctatgaagaccaaggataggtcaaccaacaagcagaactactctctgccatccgatctctgccgccgcttctccctcatcgagatcaaagccgccacccaaaactttgacgaagtcttcatcatcggcgtgggaggattcggccatgtctacaagggctacatcgatgacagttttacccccgttgccatcaagcgcctcaaaccgggttcacagcaaggggcacgtgagtttttgaatgaaatcgacatgctttcgcaactccgtcacctcaatctcgtctctctcatcggctactgcaacgataataaggaaatgatcttggtctatgatttcgtgagacgtggcaatctacgtgaccatctctacaacaccgataagccccctctctcgtggaagcaacggttgcagatttgcattggggcagcgcttgggctggattatcttcacacaggcgcgaaacacatgatcatccaccgtgatgtaaaaaccaccaatatcttattggatgataaatgggtggtcaaggtttcagactttgggctttccagaattggacccacgggcgtggacaagtctcatgtcagcactgttgtgaggggaagctttgggtatttagacccggaatattacaaacgctaccgtttgacagagaagtctgatgtgtactcttttggtgtagtgttgtttgagatactgtgcgctcggccacctctaatccatagtgcacagatagaacaggtgtcacttgctaattgggtgaggtgctgtaaccaaagtgggactatgtctcggattgtggaccccacattgaaggggaagatcgcgcctgagtgctttaagaagttttgtgagactggaatgagttgtttgttagaggatgggaggcagaggccatcgatgaacgacgtcgtttggatgctggagtttgcactccagctacaagagagtgcagagcaacgcgaaaatgatggtattgttattactgaagaagttaatgagaaaagagaggaaattagtgatgatacgtttaatattaacaagagtagtagtgcagtgagtgtgaatgtgagtacaagtagttccagcgaagagcatagctatgcagggattgatatacttgcttggttgaggggcatgggcaaaaacaaattgtaa

SEQ ID NO: 18388 - DNA, 660 bp, Glycine max
  Peptide Sequence Number=SeqID_135166
atgagactcttcaggaattgggctggtcatgatgaacaatatttagtgacacaaaatctatgggacaatctaatgggtgacatggatggtaagatgaacataaccgtgaatcctaaatatgtggcaccaaaggaaatttacaaaacatcccatggcatgtgcaggaataccaatttgaacaaaagccttaatttgacttgggagttccccattcattctttctctgtttacatggtcaagctccacttttgtgagcttgacctgaatattaatgacattggtgagaggatgttcatcatttacataggaactgagttagctggtgatagctctgttatgaaatggagtcaaaaacaaaaaagtctggctgtgcacagagactacatcattatgatttctacgaatgatattcagaaaaagggcaatttccaagtgtgctccattctctttctcaaccaccaagacaaccaacacacacaatcattgcaaccgtcccatctttgccgccgcttctccctcatcaaaatcaatggttccaccaactacttcaacaaagccttcatcgccaatgtcgggggatttggccatgtgtacaagggctacattgatagcggttccactcctgttgtcatcaagcgtctcaaactgggttcacaatag

SEQ ID NO: 18389 - DNA, 393 bp, Glycine max
  Peptide Sequence Number=SeqID_135167
atgaccatcgtctatgaattcatggcacatggcaacctacacgaacatctctacaacaccaataacccttctctcttatggaagcaatgcttgcagatttgcattgggacaacacgtgggttgcattatcttcactcaagcgcaaaacacatgatcatccaccacaacatgaaaaccaagaacatcttgttggatgacaagtgggtggccaaggtttctgactttgggctttcaagtattgggcccacgggcacattcgaggcccatatcaacaccattgtgaaaggcaactttgggtatttggattcagagtattatatatgctaccgtttgactgagaagcctgatgtatactcttttggagtagcgctgcttgagatactatgcacttga

SEQ ID NO: 18390 - DNA, 207 bp, Glycine max
  Peptide Sequence Number=SeqID_135168
atggtgaaacagtccactgggttgtatgctttgaggtgtgtgaagatgggggaaaggaggaagagtgttaaggaggtgataccgaggaacgtcatgctttgcgtagttgctaggaagcaccggagaaaggaacattcagagtgtttgttagtgaaagacgactgcgacaagtcaaatggcaaatatgtgcagttgacttatttctaa

SEQ ID NO: 18391 - DNA, 321 bp, Glycine max
  Peptide Sequence Number=SeqID_135169
atgacaggaaacaccagataccatgatgataggaagtatgctgtcatttccctcttggacgggcaaaccgctaattttgaatatctcgagaccattcaagaaagggctaaagtattcggtatcccaaccactttctcaatatcattattgggaatcaaaatggcatactcttattttgtacacagccagacctttctatttctggctctagctcataacatcagcaccactcttggccaactggcttgctatgtaaatgaagaacaccctatcaccaatttcataaacatgcggatcaagctcgcaaaagtgaagccttag

SEQ ID NO: 18392 - DNA, 969 bp, Glycine max
  Peptide Sequence Number=SeqID_135170
atggaattgactttggtcaacccgagctatgcccttgagacggagcatagaatcaatgtaggagggaaagaaatctcaacacgaaacaatactggtttgttcagggtctacactggtcacgatgaaaattatttaatgacacaaaatctaaaggataatctaccacttgacaatagtggtaggaacataacagtgaatccatattacatggcacccaaggaactgtacagaacaacacgtgacatgagcataaacaccactctgaacaaaagtcccaagttaactttggagttccccatttttggctgctgccacatgatcaaggccgccaccaacaactttgtcgatgccttcattgttggaatcgggggattcggccatgtgtacaagggctacatcaacagcggttccaccacagtcgccatcaagcacctcaaaccgggttccaagcagggtgtgcatgagttcatgagcgagatcgagatgctcttgcagctccaccaccttcatctcaccactcttcttggctactgcaatgataacacagaaatgatcatcgtctacgacttcatggcacgtggcaacctccgtgaccatctctacaacagtgataacccccctctctcatggaagcaacgtttgcaaatttgtattggcatcgctcgcgggttgcattatctttacgcaggcatgaagcacatgatcatccaccacgacgagaaaactacaaatatcttgttggatgacaagtgggtgaccaaggtttcggactttgggttttcaagcattaggcctacgagtatgtcaaaggcccatatagtcatagttgttaagggcagttttgggtatttagacccaaagtattgtaaccgacagcgtttgacagagaagtctgacatgttcaatgtctctcgacctgctctgatttgtctctttttttctctttgtgcatatcggctcctttgctga

SEQ ID NO: 18393 - DNA, 552 bp, Glycine max
  Peptide Sequence Number=SeqID_135171
atgaattttgcgaagaagaagaactcgctagtggttcgatgccttatgccgccgcatctcgaacacgcttccaacgtcatcatccacctacgagaacgacattctctaccacaactaccacgaagcgtgtccttacttgaagttcgcacacttcaccgtgaaccaaacaatcttagaggccttcaacggctacgattgcgtccatgtcatcgacttcaacctcgtgcaagggctctagtggccagtgctgatacaggcactggcactccgtcccgacaaaccgccactgctgaggctcaccggcatcgggctgagactcgccgagctggcgtagtccgtgaacgtgcagttcgcattccaggtgagtcagaaggaggagcatgcgttccagatcttatggcgttttcagatccaagacagcgacatcgtggcctattggaaccgggtgttccttgttacgagcctcctctgcaatgtcgtatcgtccttttttcttcttccttggaggatccatggtatgacacaatacgcacaggtcactaccatcgatga

SEQ ID NO: 18394 - DNA, 255 bp, Glycine max
  Peptide Sequence Number=SeqID_135172
atggcgactctggatttcgacgtgcctatggttcccgccgacatcattgtcgataactgtgctatctaccggaaccacatcatggatctctgcatcgagtgccaagccaaccaggctagcgccactagcgagaaatgcattgtggcatgggttagagtgcttcagtctcagttgcaaggttgttattgggctatggtggctgctattttctccttgatcttgttgagtgaggaaaatggtgtgattcattcttaa

SEQ ID NO: 18395 - DNA, 546 bp, Glycine max
  Peptide Sequence Number=SeqID_135173
atgccgccagagatcgaagtggatggaaggatatatggggatgatgaagagatttttgccaacaaaacctctcgtagtggaagacgacatcgtattggtggtggtggaatgacgaaacggaagattgaagaaattccagaccttaggttcggagtgaggcttggggtcagctacgaacatgatctctctctctctctctctcctgtttgggaaacaacaacgtcttttgacacggatatgatgggggattatgaactgcaatggagaaaagagtttcaagtccacgcgtttttggttcttcctacgtgtaatcccaatcagccaatgagtacatgtggtagcacatgtcgcatgccaatgtgtttggttaacaaccacttcctcttggcatttcctcctctttgctggccgagcttcttgcagctgttactgccattgagtttgcacatgctaaagggtggaggaacctctggctgtaatatgactcatctgctatccttgaagcctttgaatgttcagaagtcgttccttgttggaatttcttaa

SEQ ID NO: 18396 - DNA, 1488 bp, Glycine max
  Peptide Sequence Number=SeqID_135174
atgggttctctgttgttcttgcttttggttattgttcttccattgtgttattgtgttgatgctgcttgctctaatggaaactgcaaggtaaatgatgagtgctcgtctaatggtgattgtggagccggtctctattgcttctcatgcccacttggatatttaggctctaggtgtgtgagatcttccatcacagatcaattcaagctcacaaataactctctaccattcaacaaatatgcatttttgacaacgcacaatgcgtttgccattgatggagagccatcacacacaggagtgcctcgagctaccatcactaaccaagcagacagtgtaacagagcagctcaaaaatggagttagggcactaatgctagatacatatgattttcgtggagacgtgtggttatgtcattcatttcaaggccagtgctatgacttcacagcttttgaacccgctatagatacactgaaggaaattgaagcttttctatcagccaacccagcagaaattgtcacactcatattggaagattatgttaaaacaccaaaaggattgacgaaagtcttcgccaaagctggtttgatgaagttttggtttcctgtgactcgaatgccaaaaagaggaggagattggcctctagtgagtgatatgattgctaaaaatcaaagattactagtgttcacttcggtcaggtctaaggaacaaagtgaaggcattgcataccagtggaattacatggttgaaaatcagtatggggatggaggaaggaaagcaggaagttgtccacacagagcagaatcttctcctcttgatgacaagagcaagtccttagtgttggtaaactatttccgctctacgccatttaagcctattgcatgtgaagataactctggaggactcattgacatgctacaaacctgtcatggtgctgctgccaacaggtgggctaattatcttgctgttgattattacaagaggagtgaaggaggaggttcgtttcaagccgtggacactctgaatgggaagctcttgtgtggttgtaatgatgtgcatgccctggatctacttcacaagcttgctcagcatagaaagcatagcaacgagcttcttgaaatgtttcatcccacgcttcctggttctgaataccatattttatgcagccacagggttaccaaatctccgtactcttgcaggtgcagcgcaaactccagcattgaaacaacatcgttcatcgatggcctctgcattcccatcctctcacaaaaaactcaccctaatcttggacttgcacgtaggcccaagcccagttctggaaagcccaaagtcagaaagcttggccttgatggccacgctagtggaattgctgttgatatagcccttgtacacatggtcgaatcccccaatgtcgacgatgaaggcctaatcaaagtttctggtggtggctttgatcttgatgaggagaagcaacgacagtggttggatggctag

SEQ ID NO: 18397 - DNA, 111 bp, Glycine max
  Peptide Sequence Number=SeqID_135175
atgtggcacctaactgcatatgtttgtgtttactacgacggccaaatttgcaatactaatgagggcaccaccttcattagtaacaacacaaaaactttcatggtcgacaag

SEQ ID NO: 18398 - DNA, 840 bp, Glycine max
  Peptide Sequence Number=SeqID_135176
atgaagctcatgggtgtttatctaatcggtgttctattcttggtgctacatgacatggttcttggtgtggagaaaacagcatctcaacaggaaataaagaaggcatactacaagttggcattgaggctgcatcctgataagaaccctggtgatgagatgttagcggttgtaattgatcatcttttacaggaagctaaagcaaagtttcagcaattgcaaaacgttattgctattcttggggatgaagaaaaacgggccgtttatgatcagactggttttgttgatgatgctgaacttgcaggggatgttgttcagaatcttaaagaatatttcagagcaatgtacaagaaggtcactgaagctgatattgaggaatttgaagcaaactatagggggtctgacattgagaaaaatgatttgattgatctgtacaagaagtgcaacggtaatatgaacaggctattctgttcaatgctttgttcagatcctaaacttgactcacaccgattcaaggatattattgatgaggttatagctgctggagaactaaaggaaacaaaagcctacaagaaatggacaaagaaaatatcagaaatcaagccaccaactagtcccttaagaaggagggcaaaatcatcaaagaagcaaccagaaaaagagctttatgctatcatatcacaacgcaaacatgagaggaaagaccactttgattccatgttctcatctctaatttcaaagtatggtgggggtcaaatgccagaaccctctgaagaggaatttgaagctgcacagagaaaggtggaaagtggaaggtcctcaaaaaaattaaagcgaaaataa

SEQ ID NO: 18399 - DNA, 402 bp, Glycine max
  Peptide Sequence Number=SeqID_135177
atgataaaattcccagctttgggaattgatttggggttaaggatttatgagattattgagaaagtccctcgttttgtgcaggaaggaagtgtgtttatcgacaggaaacaagcaggtggagattgtgagtatcttgtgaaatgggcctttgataatgaaagcaagggggttcctgagaagattgttgattcatctttactgggaaaaatagcacctgcttgttgggaagtgttcattgagatcgttcagagatgtttggcttcagttgaagagaggccatggatgggtgaagtggaggtggttcttgaaatttttgcactgctgttgcaagagagggtagatgctgtgaagctaatcagtaccataaacctcaaaccgcggcgatccagcaagactgaataa

SEQ ID NO: 18400 - DNA, 273 bp, Glycine max
  Peptide Sequence Number=SeqID_135178
atgtctagcaagcttgttcgctgcgatgataaagctaacaaaagtggaaggaagggtatggaaatgaaaaagcaaggagtttttgaggaacgtcgagaacttttgaagggtgttagtggtgtctttaggctaagagtactaacagctctgatgggtgctattcaaggagttcctaagatcaaagaaggttataatcctgcaacctggatgttggaagttacatcagcaggcatagaagcatctcttaagatatttcaaaccaaaggctattga

SEQ ID NO: 18401 - DNA, 336 bp, Glycine max
  Peptide Sequence Number=SeqID_135179
atggcgtgtcgatgtgcgattgcgcaccaggcattccggtcggtggcgcttcgcctttcaggatatgggcgcgctcaactggcgctgcgtggtgagtccgcagcatgcgctggctcacagtccgcagctggacgacgaaaccctgcgcgcctggccatcgctgcggcggctggtggtgccggagtgggaaaccgggctggattgcctgcaggccggattgtgcgtgggcatggtgccgggccacctggcgcgcccgctgctggacagcggcgcgctggtggagctggcgttgccgcagccgtttccggacagcccgtgttgcgtcagctggtctga

SEQ ID NO: 18402 - DNA, 228 bp, Glycine max
  Peptide Sequence Number=SeqID_135180
atgcgttcttccggatcttcccgaattttttccgaaggaccacttcttccggaagacttccggaaaacgtcttccgggaactttccggaagaagtggttcatccggaagaattccggaagacgcccacttccggaagaagtttcaaacttccggaagacctttccggaagaaccccttcttccggaatgtttccggaagaaccacttcttccggaagtgattttatga

SEQ ID NO: 18403 - DNA, 261 bp, Glycine max
  Peptide Sequence Number=SeqID_135181
atggtaaagtgtcttgtgaagttgcaaaccagatttcgagaagatccaacggttaacaaaggctgggtagcgtttctaccgaggcagctacagaccaaatttagagaagatccaacggttaatgaaggctgggcagtgtttttaccgaggcagcttcatgtagctttctctagaagcttcattaagaggcctcctctagaagcttcctctagaagcttcctcgtggcttctttgagaagctttctcaagaggcttctttga

SEQ ID NO: 18404 - DNA, 219 bp, Glycine max
  Peptide Sequence Number=SeqID_135182
atgtcgctcaatgtcgcgtactccaccaccgaatggctctttggactcttcaccggttgcgtaggtttggtgcttgatgcggttcacttgacttttggatgtggtcttcttacatttttgttatttgttatggccgcgtctaggaagaaagccgatcaagagtatacttatgggactgtaggagaggggtgcttggatagttcttctggaaataaccct

SEQ ID NO: 18405 - DNA, 417 bp, Glycine max
  Peptide Sequence Number=SeqID_135183
atgaacgaaaacacaatccatggggctccgaaaaggggtagagaatggagaattgcactaagcaatcactacgcatggctcgaaattcgtgggcagaggatgcatgaacgaaaacgcaattcatggggctccgaaaaaagggtagagaatggagaattgcacgaagcaatcactacgcatgactccaaactcgtggttggaggacgcatgaacgaaaatgcaattcatggggatccgaaaaagggtggagaatggagaattgcactaagcaatcactacgcatggctccaaactcgtgggtggaggatgcttgaacgaaaacgcaattcatggggctccgaaaaagggttgagaatggagaattgcactaagcaatcactacgcatgactccaaactcgcgggtggaggatgcatga

SEQ ID NO: 18406 - DNA, 822 bp, Glycine max
  Peptide Sequence Number=SeqID_135184
atgatgttaactttaccgctgctgctgaccggctgtctgtcgctggatccgcactaccagcgcccggcggcgccggtgcccgccaacctgccgcagggcgaggccggcggcaaccgggcgctgagctacccggacgtcgcctggcgcgactatgtccaggacgcccggctgcgccaggtggtggcgctggggctgaacggcagccgcgatctgcgcgaggcgatcgccaatatcgcgtcggcgcgcgccctgtacggcgagcagcgctcggcgctgttcccgacaatcaatgccaccgccgacggcagccgcgggcgagcgctgaccggcagcggcaacgccaccgcgctgagccaaagctacgaagccgcggccggcgtcagcgcattcgagttggatctgttcggcaaaaacgccagcctgtcgcgcgcggcgttcgaaacctatctggcgaactcggaggcggcgaaaagcacccgcctgacgctgatcgccgatatcgtcaccgactgggtggcggtggcggccgagcgcagcaatctggcggtggcgcagcagacgatggcgagcgccaaacggtcgctggacgtcacgcgcaacaatcaacagcacgggattgcgtcgctggttgacgtggcgtcggcggaaaccgtctatcagcaggcgcgatcggacgccgccagctacgctaccagcgccgcgcaggcgaaaaacgcgctggatttggcggtggggcaaagcgtgccggaaagcctgctgccgagcggcatcgaggcgctcggcgggatcatgcgcgatctgccggccggcgtctcttcgcaa

SEQ ID NO: 18407 - DNA, 414 bp, Glycine max
  Peptide Sequence Number=SeqID_135185
atggcaagacacaaggtcacacgcacacacacacacacacagtcacgcaggcacaagggggaggaggggcttggtcgtcccgtccgcccgggcacacacctagttagcaccaggcaggccaaacgagagagagccgacgaacggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 18408 - DNA, 297 bp, Glycine max
  Peptide Sequence Number=SeqID_135186
atggcttctaggaaaagaaaggcaccttctacacctaccaaagtcagatttgacaaatccagattcacttcccaagaggcttgggaaagatacactgatgttattgtgcctaggaagcttttgccagagaggaatgtggtggtcgactatacagagtttgatgagttcaaggaggaactcgaaagacccctatttgcattccggaggcctgatcctcaggagttggctgctaagctttgtatcccagggaggagattcgagcttaatgttgatgggaagccgttgaagatattgtga

SEQ ID NO: 18409 - DNA, 726 bp, Glycine max
  Peptide Sequence Number=SeqID_135187
atggtgaaggcggttgaacaggtctcttatcagacgggtaactctttactgatcggcaatggctatcataatgagcaaaaagagccgccaggcgatcgaacagctgatccgccaccgctatgcccggcatggtcatcatcaaccgcatttattcctggatttgaaaaacgctgtgtggctctcgacgaccgctacggcgcctggcttgctacccgtcatctgattcaacagggacatacgcggattggctatctctgttccaaccaccctatttctgacgcagaagatcgtcttcagggctactacgatgccctgcgcgaaaacggtctgccctgtaatgaccgtctggtggcctatggtgaaccggatgagagcggtggcgaacaggctattacggaactgctgggccgcggacggaacttcacggcagtggccagctataacgactcgatggccgctggcgcaatgggggtattgaatgataacgggattgaggtcccggcagaaatctcgctgattggctttgatgatgtgctggtctctcgctatgtgcgcccgcgcctgaccaccgtgcgttaccctatcatcacgatggccacacaggctgccgagctggcgttagcactggccgagcaacgccagccaccggaaattacccatctcttcagcccaaccttagtgcgccgtcactccgttgcgtcgcctgctgaagcccaaagcgaataa

SEQ ID NO: 18410 - DNA, 246 bp, Glycine max
  Peptide Sequence Number=SeqID_135188
atggtcatagaccagtccctttacttcaaactcacccagttatctagtgatggtgtaccgtttgaaggtacacttgatgatgattggaagttcgacatttctgtttctgatgcccgtcggttggtttgcaccaaccaagcggatatgaccggaaggcttcttgccggatcattggcattcgaattctgcatcatgcactacttgattgtgcgcatcctacttcctagatcatccaacattgcacag

SEQ ID NO: 18411 - DNA, 159 bp, Glycine max
  Peptide Sequence Number=SeqID_135189
atgcatatgacacagatgcaatttacgaatacaggagcccgagaaactgtctccttcttagatacaacgtctaggggtagcaaagtgccccaacaggggatcaagacagaacccatgtgcgatgcatatgcgaaaggcgcaacacgggaatgtacatag

SEQ ID NO: 18412 - DNA, 114 bp, Glycine max
  Peptide Sequence Number=SeqID_135190
atggggtcgacttggttgatggggttgatactcttgaagtctctattagtgaaagtgataggtggtagacttcatgtatttggtcgcatcttaccccgacttgggaggacgtga

SEQ ID NO: 18413 - DNA, 288 bp, Glycine max
  Peptide Sequence Number=SeqID_135191
atggatatctctgaagatactgacatccctataatattggaaaggccattcatgttgaccgcaagctgcatagttgatatggggaagaggaagctagagttaggttttgaagatcagaaaattgattttgatttgtttgttgaagacaagcttgctccagaacacaatgtctgcttacaggtaatggaaggagtcttttcgctaagcgcaagcctcacgctaagcgcatcattagtcatgcgctacgccacgagtctcaagcgcattgcacctaacccttgcatctga

SEQ ID NO: 18414 - DNA, 144 bp, Glycine max
  Peptide Sequence Number=SeqID_135192
atggaatgccccagggctcccccacgatatgcacatgttgcgttcgagtcatatcctcagaaaaatgggggtttgagggaacctagcaggggttatggctaccattgcgttatcaagtggtcttcgtcattggaagtgcggtag

SEQ ID NO: 18415 - DNA, 858 bp, Glycine max
  Peptide Sequence Number=SeqID_135193
ggtctagatgccaccagccttaaggagttgggacggttgatgggacccctccaaaggcaagccttccgcaaagtgtacggaaagattttggatttgaccgcagcggaggtatttatggaagctgttgtatccctcgcccaatactatgaacagccgttgagatgcttcacttttggggacttccaaatggtatcgactgttgaagagtttgaggagatattaggatgccctcttgggggaagaaaaccatatcttttctccgagtttcttccctccttgagtaagattgcagctgtggcaagggatatggcaagtcaagaaaagtgggtcccgttcgcggatatactagctttgctaatctttggggttgtcctctttccgaacatggacggtttggtggacctagccgcaattgatgctttccttgcatatcaccatagcaaggagagcccagtggcggctatcttggcggacttatttgatacatttgaccgaaggtgcgagaagaacagcgcacagatcgtctgctgcttacccgctctctgtgtgtggttggtttcgcacctattccaacaagacataagacacccgtgttcgcttcaaagttatcgctcgtgcgtcaaaaagagaagagtcgattgggaccaacacttggctgggatagggggcagcacaatcaattggtttcctcgatggaaggaaggaaaggagggagttcttttctcatgtggggactaccttaacgttccattgatggggacgaggggttgtattaactataatcccgcacttgccataagacagctagggtaccccatgaggggagcgccaacggaagagagcctctcgcctttcctt

SEQ ID NO: 18416 - DNA, 201 bp, Glycine max
  Peptide Sequence Number=SeqID_135194
atgaagtttgatggctcatggaatcaaggagctggaaagaaatttgtgaagaagcatggtaaaggccaaggaccaatagagattaatgacggctctgtgcaaatccagaagaaggcatcaaagggaaataattgtcatttttgtgggaaatctggacacttccacaaggattgcccaaagtgtaagtcttggttcgaatag

SEQ ID NO: 18417 - DNA, 261 bp, Glycine max
  Peptide Sequence Number=SeqID_135195
atgaaatctcgatggcaaaaaattaatgttggtgttcaaaagttcaagggtcattacaagcaagctgttgatttgaagaaaaacggttacacaaagaatgatgtcatgattcatgcatatgccatttggaagaaagacaagggaagcaattttacttcagagcatgcatggcgactactaaaagataagcctaaatgtcgaattacgctgtttggcaccgattacagcgcgaagctagggatcactccgggttttgattaa

SEQ ID NO: 18418 - DNA, 204 bp, Glycine max
  Peptide Sequence Number=SeqID_135196
atgggacaaaaggcagccaagaggaagatcaagagaaaagaagctgcaatgtcttcatcgattgtggacttgtcaatcatgaaagttgcaatcaatgaaaaaattgttgtcaacaaaagaatagcagaggcaaaagagacggaaaacatagcggttttgtacgaaattctcgtgaagaacacatctaccatgtctgaagaataa

SEQ ID NO: 18419 - DNA, 456 bp, Glycine max
  Peptide Sequence Number=SeqID_135197
atgcaaaacagcggggtcaccctaagggctgaatctcaacactttgcaagtgtgcatgatgtcaatccttgtgtagcttccaccccttacgttgggttcattgatgaaatttgggagcttaactatatgaaatttactgtttgtgttttcaaatgtaaatgggttgacagcaacaacgacctaaagaaacttggttaccataatgaccctttcatcatggcagaacaagctagacaagtattttatgtgcaagacccttgtgatgaaaggtggtgcatggttctacaatgcaaaacaatttgtgttaatgtagaagatgatgattcatacatggacacatatgttagtcctttgtccacacaaatcactcctaacattgttggagaagaagaagctgacgacattcatgctaatcgtaatgatcatgatgaaagagaattaattaacatcgtctag

SEQ ID NO: 18420 - DNA, 263 bp, Glycine max
  Peptide Sequence Number=SeqID_135198
atggcttctccacctggctcacctcctcttcctcctccttctcctcctcctcctcttcctcctccttcagacgcatcagcttcgctgtctgccatgaagtggacacgcaaagccacatgtctacgatccttgtctactagaccacctggtgctgagagaccagtggtccacgttgatcctgctatcggcaaggccgacggtccccataggaagaaattaagaacatatttagggattgtggcacgtgataaggtggacgtcac

SEQ ID NO: 18421 - DNA, 304 bp, Glycine max
  Peptide Sequence Number=SeqID_135199
atggcgttagctgtaaagacgcagcgcgcaattttgttactgcgcgcacagcgagcagcactgacgtttgcggcacagcgcatgaatagcgccgggttgcggagcattctgtattgtcgtgttaaccgccgcttcatacactcagcgcaatttcagcaacctgaggtcaatatgatccgtatcgttaagctcgctgctgttgtagcgctggtgtccgcgttaagcggttgtctttttccgccgccgggcggcggcggaggttggggtggtcctggcggtggcggtcccggccatgggtatcagg

SEQ ID NO: 18422 - DNA, 1144 bp, Glycine max
  Peptide Sequence Number=SeqID_135200
atgcgccaggacttcgtgcagaacgggcacatgcagcgcaatggggaaatgtatgtcgattcggaattgctgtccgaggtggaggtggagcggggcgtggtgcgtggggtgcatggcaccggcgcgatggcggggagcgtggattttcggacgttggactttggggatgtgttgcgcgagggcagggatatcggtttgcggttgcgcgctacgtctggcgcaggccaccaggggaacggcgtcaattttctgggaagcgccgctggcgcggctagcgccggcgaacatctgcaagtcttggcggcgatctcccgacgatccgttggcgattatcgaattggtactcacaaaggggctgatgacgattcgaatacggcattccttagcaaaggagtcaaagccgaatacaacgatgtgaaattttccggacagacgcaggaatcctatctgttcaagtcccgttggcagttgaataaagcgcagtcggttcaattcaactatgtcggaacacgcgttgattactcatacgttggcgatgccagcaacacgctacaagaaaatgggtctccatggagaaaactgggtatctcaagggcgcaatctgatagctactccttggactatcggttggcgccggagggcagcacatggattgacttgaacatcaagctctatggggtcgatacccgtgtgagcaattacacgaatcccacatatccacgaacggttcatggactcgtcctcgacccagcggatgtacgggaacatgtcgatgagtattgggacaagggaacatgcgaagacccgaacaggacggggtacgcacgggatatctgtcggcaatacggggcgggacggaacaatcagattcgcaccaagacgcagggagtactgctaaccaatacgtcgcgattcaatctcggagccgaaaccctgctcagcgtcaattatggtgccgaatatttcagcgatcgagctatctcgaaaacccgatgggactacaagggcagggatgtcgttcccatcggtacgacgggtcagagtcttctcaatccgcagggccggcgcagcatgggcagtgtcttcaccgatctcacgctacagaacgatttctataccgtatcggccagcctgcgctacgaga

SEQ ID NO: 18423 - DNA, 150 bp, Glycine max
  Peptide Sequence Number=SeqID_135201
atggagtacgatgggcggggcaacgtttgctactacaacatggagcaagtgcacctagtggaggagatcgaagagtattggacacttctgaggcaattggagcaaacacctaaagatgagagtaacaattcttctgaggacacatcttag

SEQ ID NO: 18424 - DNA, 243 bp, Glycine max
  Peptide Sequence Number=SeqID_135202
atgtcacgttggcacgctaagcacagctgcgcgctaagcgcgccatacgaatttcagtttttaaaaagtagaggcacaggaacttgggttgctacctttgcacccaaacctctgcaacctctcatccctaagcatttttttgtttctactgtgtgcttactgctcctctgcatcctttttgcttccttgcaaagacaatccaagatttctgatgatcgcgctaagtggaccatgtcacgctaa

SEQ ID NO: 18425 - DNA, 405 bp, Glycine max
  Peptide Sequence Number=SeqID_135203
atgaagtatctttacctgttcagggcccattggcagctcgttgtattgtgcctaggcaacaatctagtggtttggttttgttctttgcgaaagaagtcggatgctgccatcaagggtgcagtaaacagtgcaatgaaatcagtcaccaaaactgcagagggaaagccacctcagcatgggcctcagtggattgaagcaaagagtcatgttcaaacaggaaattacgagtgtggatactatgttatgcaatggatatggtgcatcgtaagtggtggattgaaggatgactggattcactggttttctgatcgatcagcgctaacagaagagaccatgaccacactccggcataaatgggcagcatattttatccaaatgaagaaatgcgaaccaagaaaaaattag

SEQ ID NO: 18426 - DNA, 180 bp, Glycine max
  Peptide Sequence Number=SeqID_135204
atgtggaatattcgaatagatgcatcaaaagaaaaagaagagctaaaaataagaaaaatcaaacctttagctggtgcagctagcagcgtagtactaaagtccaaagcagagttgatgcaagaacaagttacccaccaagataggaaggtcgtcttggagcagcagattggattcttctga

SEQ ID NO: 18427 - DNA, 2163 bp, Glycine max
  Peptide Sequence Number=SeqID_135205
atggcaataaagcttccatcttcggcacaccctactcgattcctcagatgggtttatctctcttccagctgtattgcagatatttcagaaacccctggaattcttaagcccaaggattcatctgaattcgaccaaaacctcaactttttgaaaaataagcttgccccagataacttaatccgtgctctggaccgtacaagcgatttgaactcggcagtgaggatattcaaatgggcttcaaggcagaagagttttcaccacacttccaacacttatttcaggataattttgaaactgggtatggccgggaaagttttggaaatgagggatttttgtgaatacatggttaaggataggtgcccgggtgctgaagaagctcttgtggcattggttcatacatttgtggggcatcataggattaaagaagctattgcagtcttagtgaatatgaatttgggtggttataggcccccaattgaagtttttaatgttttattgggtgctcttgtgggaagagagagtagagattttcaaagtgccttgtttgtttataaagagatggtgaaggcatgtgtgttacctacagttgacactttgaattatttgttggaggttttgttcgccaccaatcggaatgagttggctttacatcaatttagaagaatgaacaataaagggtgcgatccaaatagtaagacctttgagattcttgtgaagggtctcattgaaagtggtcaagtggatgaagctgctactgttttagagcaaatgctcaaacacaaatgtcaacctgatttgggtttttatacttgtattatacctctcttttgcagagaaaataaagtagaggaggctgtgaagttgtttaaaatgatgaaagattccgattttgtacccgattctttcatttatgaggttctagtacggtgcttttgcaacaacttgcagttggattctgctgtaagcctcataaatgagatgatagaaattggtatgccaccaaaacataatgttcttgtagatatgatgaattgcttttgtgaattagggaaaattaatgaggcaataatgtttttagaagatacacaagttcatgaaactgctcctttcaatacattgctcgaaggttgctgcaatgctggtgaggttctggcagcaaatgttctgcttgagacaatgtctgagagaaacatagctgattgccaatcttggaatattctcattagatggctttgtgagaatgaagagaccaacaaggcatatatacttcttggcagaatgataaaatcatttgttattcttgaccatgcaacatattctgctcttgtagttgggaagtgtagattgggcaagtatgaagaagcaatggaactatttcatcaaatttatgccagatgctgggttttagattttgcctcttattctgaacttgttggtggcctcagtgacatcaagcattctcaagatgccattgaagtgtttcactatatgtcaatgaagagatgctctcttcattccttgtccttctacaagttgataaaatgtgtatgtgactcaggacaggtcaaccaagccataagactatggcaattagcttatttttgtggtatttcatgctgtattgcgacacacacgactatcatgcgtgagctgtcaaaatcaagaagggcagaagatctgttagcattcctgtcacaaatgttgatggtaggaagcaatcttgatttggaagcatattgtatactttttcaaagcatgagtaaacacaataaagtaaaggaatgtgttttatttttcaatatgatggtccatgaaggtctaatacctgatccggacagactatttgatcaactttcattcatagccaatcattctcagttatctatgattcctagtgcaattgatagaatttctgatggtgacattttgaatccagcaatgtttggcttactgataactgccttgctgaaagagggtaaggaacatgaggctcgtcgattactggatttgatgttagaaaaaggttggcttcctgatgcaaccactcataatttattgattggatctgatgttagagaaaggagccaagcaatgttgtttgataattctgcctcactggattctgtaagctatatacttgcagaaggccttggagatgcatga

SEQ ID NO: 18428 - DNA, 189 bp, Glycine max
  Peptide Sequence Number=SeqID_135206
atgggtcacttgactcaggcccaggctctcttcaagcctcaaggcacaaggaaaggaagaatagcagaaaggtgtttcttctttgcaaaggcggtgaggcagcaacgttctctagctccggtctctttgtattttgagggacaggttgactctgacacgactatgcagttagactgggtcgagagataa

SEQ ID NO: 18429 - DNA, 1263 bp, Glycine max
  Peptide Sequence Number=SeqID_135207
atggtaagagaaaatctaagattaggcagacctgtgttgggtgcaaatgatcagtatattggcaaaccaaccgatgagggcatagtacctttgaagaattatttggatgcacaatattatggagagattggaattggcacacccccgcagaaatttaatgtcatatttgatactggtagttccaacctctgggttccatcatcgaagtgctatttttctattgcttgctatacccatcattggtacaagtcaaagaaatccaaaacatataccaaaaatggaacatcatgtaaaataagatatggatctggatcaatatctggttttttcagtaaagatcatgttaaagttggtgatgttgttgtcaagaatcaggatttcatcgaggctacccgagaaggaagtctttcctttgtgttagctaaatttgatggattacttgggcttgggtttcaggagatctcagttgaaaatgctgtgccagtatggtacaatatggtgaagcaaaatcttgtaagcgaacaggtgttctctttttggctcaatggtgatccaaaagtgaaaaatggtggtgaactagtttttggaggtgttgatcctaaacacttcaaaggagaacatatctatgttccagttactaaaaagggttactggcagattgaaatgggagattttttcattggaggtctctcaacgggtgtttgtgagggtggctgtgctgctattgtggattcaggaacatctttgcttgctggtccaactactgttgtaactgaaatcaatcatgctattggagctgaaggagttttaagtgtagaatgtaaggaagttgtttctgaatatggagaattgttatgggatctcttggtatctggggtacgacccgatgatgtatgctcacaggttggcttatgtttcaaaaggactaaatcagagagcaatggaattgagatggtgaccgaaaaggaacagagagagttgtcaactaaagatactgctttgtgcacttcctgtcagatgctagtggtttggattcagaatcaactaaaacataagaagaccaaggagatagtattcaactatgtaaatcagaaagaaactcgttataagcatgaaagggaagaagctgaagctgaattgaagcttcagttcagaatggtaaaagaattacctcaaaatacaaagagaccggagctagagagcgttggtgcctcgccgcctttgcaaagaagaagcagctttccttgtgccggagtcaagtga

SEQ ID NO: 18430 - DNA, 267 bp, Glycine max
  Peptide Sequence Number=SeqID_135208
atgccctttaccattgactgtttactaacctactatatcccctggggattcacgtctcgtgcaaagcttcaatactatgaagatacttgtttgtatctcatactggaaacgcaacatcctgttttggaattcctgttgactccggaggagtatgatgagcgagacaatgtttgtcaatacaatgtgcatcaagtacatctagtagaggctatagaggaccgaggtgaccatttggacatgtcgcccaaagagaatgaggagtactag

SEQ ID NO: 18431 - DNA, 363 bp, Glycine max
  Peptide Sequence Number=SeqID_135209
atggcctttttaggtgatgaaaaaaacttggcttatgaattgattttagccttagtttcactttggttattagtcgattcgattaagaaagggaaatcccaaagaaaatgtccgattgaaatgaaagcacttcaaaaggggatacagaaagtaaatgaaatgaaaataaaagcacgcgaaaacaaattaggaccactaagggaaaaggaaggagaagcttgccacctagctcgcccaggtgagctaggttgcttcctccagaaggcatcgccttctggagaactttctggaaggcccaaatgggtctggttgctatttgcaccctcctttttacaaaatacaccccttgcctttttttgctga

SEQ ID NO: 18432 - DNA, 228 bp, Glycine max
  Peptide Sequence Number=SeqID_135210
atgtcggatacaatgtccaggacatcctgcccgaaaatactggaagttgctgtacaatgcacaaagctgcaggatccaagatgtcggatacaatgtccaggacatcctgcccgaaaatactggaagttgctgtacaatgcacgaagctgcaggatccacgatgtcggatacgatgtccaggacatctggcccgaaaatactggacatataaatctgttatatctttaa

SEQ ID NO: 18433 - DNA, 306 bp, Glycine max
  Peptide Sequence Number=SeqID_135211
atgtcatatgacgcagcgattgaggtgaggaaccatgtttccccagagccagaggtggaggacgccggagttgcttcgttggcgaatccaaaggcttgtgacaaattcggaatgcaaaatgattttaaaggttcaaaggtagcaagcaaatctgaaaattatgaagtctacctccagcttttctacttttgctttatgttcttcaggaagcagccggacctcatcaatcaattggatacactaggagacattctcaggggacacaaattccaattcctaataataaccttgcatatttatgtttga

SEQ ID NO: 18434 - DNA, 156 bp, Glycine max
  Peptide Sequence Number=SeqID_135212
atggttgtgcagtgttggtttctgctgtcacgggaaaggtgggcaactggggatggtgtgcttatgcctgggcttgtggaaatgggatgtttgttttgcgccatcgctcgatcgccacctagtaccacatatgacgggtgcctcataacccaataa

SEQ ID NO: 18435 - DNA, 315 bp, Glycine max
  Peptide Sequence Number=SeqID_135213
gccgctggcacaccgccaccacctcggcaggtcgactcggctgggccactgggcgtggagcgttatctacagcatttggttcaccagcaggtagccaaccaccatggacagcctcagtcagcaggggcagagttccaccccttttgtatgccctaccccagagcagtttgggctgaggtcgcattgcctggagactggcccgatgcccagacaggggaggagcctgcaggatcccccagaggggcggatgaatcccttatggatgaagatatgactgacctgctcggtttcttgggagggagtggggccacatga

SEQ ID NO: 18436 - DNA, 643 bp, Glycine max
  Peptide Sequence Number=SeqID_135214
atggcggaaccatcgaagaagcggaaaggcacttcgagtcggagtcaacggcattccggggcacaggaaactccaattccttcccccattccctctggatcattgttctcatcagaggaacagcgtatacggtacacaaacctcttttcctctcgttccattatagacccaaaattcatagatatggatttcttctcaaatgagagttttgaatgccttcaagcatttgaaaactccaatcttattccattcatgtctctggaattacctgtttattctgaactagtcaaagccttttattctaatctagaaatccatgaaggtaccctaatgtctgaggtttatgggactaagatggtcattgaccagtccctattatatgatttaacccaattgccaagcgaaggtgtaccatttgaaggtgcactgattgatgattggaagtttgatttctctgtacatgatgcccgccgattggtttgtaccaatcaagcggatatgaccggaaggcttcttgccagttcattggcttttgaaagctgcatcctccattaccttattgtttgcatcttgcttcctagatcttcaaaccttgcccaggtttctgaagaagatctcattgtcatgtgggcctttcataaag

SEQ ID NO: 18437 - DNA, 432 bp, Glycine max
  Peptide Sequence Number=SeqID_135215
atgagtgaagtagaggaggtgcaagagcagatgaagactgacatgaaggccatgaaagagcaaatggtcacaatgatgaaggccatgatgagcatgaagaagataatggaggtcaatgcggttgcaatagccgctaccagcaccattgctgaggtggacctgacccccccatatggcctcaaccaaataaatcatccaacctcagatatggtaggtttagaaggcaaagagttgggaggtatgggtggccctcatttagtgcagaaaacaagcatgccttcccaccatatggcttgcctcccaactatacaccacccaatgtggcatacactcccagtgaggatgtcaataactctgctcccatactcattgaaagccaacaacctcaatctgatcatgcacatgcctctcaacccatggggagacacatga

SEQ ID NO: 18438 - DNA, 411 bp, Glycine max
  Peptide Sequence Number=SeqID_135216
atgtccgattcaggcaaattatatattgagacggtcgaaattgaagatctgaagctctcgagaaattcaaatggtcataacttttcactcggatgtccgattcaggcgcataatatatcgagatcctctcaattaaacatggaagcacaaggaaaattcaaatggtcatcacttttgactcggatgtccgattcaagagcacaatatatcgagatgctcaaaattaaacatgaaagcacaaggcaaattctaacagccataacttttgactcggatgcccaattaatgccaataatatatcgagtcgctcaaaaattgaacaacgtaagctctcgagaaagtcaaatggtcataatttttcactcggatgtccgattcaggcgcataatatatctagatgctcgaaattaa

SEQ ID NO: 18439 - DNA, 227 bp, Glycine max
  Peptide Sequence Number=SeqID_135217
atggcacctcaaattctctacatgactacctcacacgtgaatatttacagaaaattccagatgccacctaaggcgtccagctcctccgggagaggaggaaagacggttagccaaggaaaggaagttctcctggctctaccagagccagtaatcaagaagacaacatcatcatcttctgggtcacctacccagacagggtcatcaacccagaaacaaaaaattgaagg

SEQ ID NO: 18440 - DNA, 639 bp, Glycine max
  Peptide Sequence Number=SeqID_135218
atggctctctccgcgcaggcattgcgcgtgatcggctgcctgctggagaagcaggtcaccacgccggatcaatatccgttatccctcaatggcgtggtcaccgcctgtaatcagaaatctaaccgcgagccggtgatgaacctgagcgaaagcgaggtgcaggctcagctcgatgagctggtgaaaaagcatctggtcaccgctaacagcggtttcggtcagcgcgtcagcaaatatgaacagcgtttctgcaactcggcgtttggcaatctgcagctgaatgccgccgaagtggcggtgctgacgctactgttcctgcgcggcgcgcagacgccgggcgaactgcgtacccgcagtggtcgtctgcatgagtttcaggacatggccgaagtggaacgcacgctggaggggctgacgacgcgcgatgacggccccatggtggtgcgtctggcacgcgagccgggcaagcgagaaagccgctatatgcatctgtttggcggcgaggtggcggacgagctatccgcgagccacacagcgtcgcctgagtctgacgatctggccgtgcgcgttgctcagctggaagcgcaggtggcgcgccttgatgctcagctgcagcaactgctgcagcgggaggcgtga

SEQ ID NO: 18441 - DNA, 702 bp, Glycine max
  Peptide Sequence Number=SeqID_135219
atgagtatcgacagaacgcagcctttaaaaccggtgagcactgtacaaacccgtgacagcagcgacaaccaggcaaaagtgcgtcagaacagcgcaccggccgccagcaccagccagaatggtgcagaagtgacgctgagtcccgctcaggcgcagctgatgcagccgggcagcaaagatattaacacagcgcgcgtagagcagctgaagaccgccattcgtaatggtgaactgaaaatggataccggtaagatcgccgatgcgctgatcgccgataccagggcgtttttagaggataaaatgcaggatgtgctgagttcgcttaacgtcgtgatggatgaagagcagcagcaactttctgccggacggattaatggcaacctgctgcagcgcattacagaagataaaagcgcgctgctgacgacgttgaattatctggacgagatgcgccgcaaaaccgagctgtcgctgggtaccaaagcgccttatcgtggtcacattgatattgcacgccgctggcacagcattcagcaacatacccagcgtctgcgcgacgccaatcagcacaatggcatgctgttgcagcatcagatgacctttactgaacaggcgctgtcggtgctgaaaccgcatcagacccagtcgttctacggtccggacggtcgtggtttagggcaggccacgctgagccgcaaaggctaa

SEQ ID NO: 18442 - DNA, 1059 bp, Glycine max
  Peptide Sequence Number=SeqID_135220
atggcattgctgaatatctttgatatcgccggttctgcgatgaccgcacagtcacagcggctcaacgtcagcgccagtaacctggccaacgccgacagcgtcaccgggccggacggccagccgtacgtggcgaagcaggtgattttccagaccgatgccgctcagggcgcggccaccggcggcgtcaaagtagccggtgtcgtgaacgacccgacgcccgccaaactggtgtatgacccgggtaatccgctggctgaccagaaaggctacgtcaaaatgcctaacgtcgacgtggtcgccgaaaccgttaacaccatgtccgcgtcgcgcagctatcaggccaacgtcgaagtgctgaacacggtgaagtcaatgatgatgaaaaccctcaccatggtagggattaaagacaacctcgaccccacggtcctcagctccagcagcagcaccggcagcggcaacagcgcgcaggatctgcaaaaccagttcctgaacatgctggtgacgcagctgaaaaatcaggacccgactaaccccatggacaacagtcagctgacaacccagctgacgcagatcaacaccctgagcggcattgaaaaactcaataccacgctgggatcgatctccggtcagatcagcaccagccagtcgctgcagagctcaacgctgatcggccatggcgtgatggtgaagggcagccaggtgctggtcggcagcggcaccagcacgccgtttggcgtggagctgggcaccgcgtcgaccgccaccagcgtcaccatcaaagatggcaacggcagcgtagtgcgctccatcgatctcggcggtctcagcgccggcgttcacaccttctcgtgggacggcaagatggacgatggcagcgccgcaccggacggcaaatatacggtttcactcgccgccagcaatggcagcacccaactggtggcacagccgctgaactacgcctatgtcaatggcgtcagcaccgtgaataacaccgcaaaactggatctcggcaccatgggctccgcgaccctcgatgaaattcgtcagattctctga

SEQ ID NO: 18443 - DNA, 687 bp, Glycine max
  Peptide Sequence Number=SeqID_135221
atgggcacggccagtcagacgatgggagcaacagtctgtcaccgccagcaacctcgccaacgcctcgacgccgggctttcgcgctcagctcaatgcgctgcgcacggtgccggtcaacggctggtcgctgcctacacgtacgctggtggctgcttcgacgccgggtgccgatatgtcgcagggctcgctcgattacaccgagcgtccgctcgatgtggcgcttatacccgcaacggtaacatgcagatcagcccgaccggccagctgaccattcagggcaatcccgtgatgggcgatggcggtccgattgccgtgccgcagggcgcgcaactgaccattgccgccgacggctccatcaccgcgattaacgccggtgacgcgccgaacgccacggtgcagctcggacggctgaagctggtacgtgccacaggccaggaactgacgcgcggtgatgacggcatgttccgtcccagcgccgccactcaggcacagcgcggcgcggcgctgccgaatgacgcgaccgtgcaggtgatgccgggcgtgctggagggcagcaacgtgaagcccgtggaaaccatggtcgacatgatcgccaacgcccgacgttttgagatgcagatgaaagtgatctccaacgtcgatgaaaacgaacagcgggctaatcagctgctcaatatgagcagctaa

SEQ ID NO: 18444 - DNA, 306 bp, Glycine max
  Peptide Sequence Number=SeqID_135222
atgggcttcaaagtagagtctgtggctataaattcctcagcagatgactattgtggttcatgctattatggttgcagaacaagagataagaagggaactgactccacttggttggttgattctgtaggcaatggtgcagtgatcctcactggatgtaaagctgagagattcatacttgaaaatgtaaagaatggaatgaagaaaaagaagtgcttaggagtgattgctgcagcaagttggaggaataagtgcaaacctcctatcatttatgctaaaacacactgcattatcccatcttcgcgatga

SEQ ID NO: 18445 - DNA, 531 bp, Glycine max
  Peptide Sequence Number=SeqID_135223
atggagagaagtatgatagatgctgccagtggtggagcccttgctgaagccagaaatttaattgagaagatggcttcaaactcccagcaatttagtgccagaagtgatgctattgtcattagaggagtgcatgaagtagccacgaattcatcttcatcagccgagactaagaaacttgaaggtaaactagatgtcttggttaacctggtaaaccaactggccatgaataaaaaatctgcacctgtcgccagactctgtggtttatgctcctctgccgaccaccacacagacctttgtccttctgtgcaacaatctgaagcaattgaacagcctgaagcttatgttgcaaacatctacaatagacctcctcaacctgagcagcaaaatcagccacaacagaacaattatgaccttagatggtcgaatccttcacaacagcagcaacaacagccttattttcaaaatgttgttggcccaagcagaccatacgttcctccaccaatccagcaacaacaacaacaacaacaatag

SEQ ID NO: 18446 - DNA, 324 bp, Glycine max
  Peptide Sequence Number=SeqID_135224
atgtccagcataattaactccgcgatgagcgggctgagcgccgcacaggccgcattaagcaccaccagtaacaacatcagtaattacaccgtggccggttattcgcgccagacgattttgctgtcgcaggccaacagcacgctgcagggcagcaactattatggcaacggcgtcaacgtgaccggcgtgcagcgtgaatacgatgagtttattaccggccagttgcgcggtaacagcgccaactacagcgcggtcaattcacagtacaaccagatttcgaatattgatgatctgctgtcgaccgtcgaccaccagcctgtctga

SEQ ID NO: 18447 - DNA, 1248 bp, Glycine max
  Peptide Sequence Number=SeqID_135225
atgctgagctacgcgcagggactggtaaaccagttccagactaccgcacagtatctgaccagcatgcaaaacagcgtcaatacggacatcaaagccagcgtcgagcagatcaacacctactccagccagattgccgatctcaacacgcagatcgccaagctgaccaccggcggcggctctgcgcctaacgatctgctcgatcagcgcgatcagctggtcaataacctgaatggcctggtcggcgtgagcgtgtcgcagcaggacggtaactatatcgtctcgatgggcaacaccacgctggtcaacggcagcaaaaccacctcactgatcgccatgccttccagcagcgatgcgtcgcgcattactgtgggctatgtcgataagcaggccggtaacgttgagatcccggaaaaaacgctgaccaccggttcgctcgggggcctgctggcgttccgtacccaggatctggataacgcgcagaaccagctcgggcagctggcagcggcattcaccaccagcttcaaccaggtgcacagccagggctatgacagcaaaggcaacaccggcatcaacttctttaatattggtagcccgacagtggtgaccaacagtaaaaacacctcagccgctaccgtcagcgccagctggaccgacaccggggcgatgaaagcctctaactacagcgtcagctatgacggcagcaactggtcggtgacgcgtctttcggacaacgtgaaagtgacgccgaccatgggcagcgacggtgccggcaataccaccatgagctttgacggactgtcattaacggtaaacggaacggctaacgccaaagacagcttcctggtcaaaccggtgcaggatgtgattagcggcatgtcagtggctatcaacagtgaattgcagatcgcggcagcttcggctgcgggtggcgccagcgataaccgtaacgcgcaaaaggtgctggacctgcaggatgccaaactgattaacggtaacgccacgctggcgcagggttatgccagcatggtgagcaccgtcggcaacaaaaccaaaaacctagaaacagccgccaccacccagaagggcgtggtgacgcagctgaccgaacgtcagcagtcggtttctggcgtaaacctcgacgaagagtacgccaacctgagcaaatatcagcaattttacatggcgaacgcgcaggtactgcaaaccatcaataccatattcgatgctctgatgagcattcgcggttaa

SEQ ID NO: 18448 - DNA, 326 bp, Glycine max
  Peptide Sequence Number=SeqID_135226
ttcatgatagtattatacctcatggctctccatatgatctatacgagatctatatccaaccaagtcaccatgagatttatcaggaattaaagcaccaccattcatgtacattatgcaatggtgtacacaagatgcttagcaaccatgtcagcttcagtgcagctcctttacgtgcattttcgagagggacttcccctagtaactcatcgcataacttatctcaatgtaagaagctaggtccagtcacaacacgaccatcgattctaatgcctagatacagtgcaacatcttcgagtgtgatggtgcactcaccccatggcaggtga

SEQ ID NO: 18449 - DNA, 435 bp, Glycine max
  Peptide Sequence Number=SeqID_135227
atggatctcaatggaaaaatcattacaaatgatgataatgaggagatccctaatgctgtcaatacccttatatttacaatagcccaatattttattggcgacctgtcactttggaaagataggtcagcagaattattatccaacctgaagtgtagaactttagcagactttaggtggtacagagacaccttcctcagtagagtttacaccagagaagatagccaacaacctttctggaaagaaaaaattctagtcgatcttccaagatcattaggagataagattagagataaattttgtagccaatctgtcaacgaagacattccttacaatagtttaagttatggacaattaatttcttatgtccagaaagtagtcttaaaaatttttcaagatgacaaaatccagagacaactggccaaagagaaagcctag

SEQ ID NO: 18450 - DNA, 275 bp, Glycine max
  Peptide Sequence Number=SeqID_135228
cccaagagcctgagcccacagcggagcatacaccagcagcagaggatgagctcacttctcctgagcccttttcatttgcttttgattcagttgtggctcaagaggaagtaccttcaccagagcctattccaaagccatcccctgcacctatctctgaggataccctgccatccgtaccagcattggagcaagagcagcccatttcacaggatccaccagctactccagcgctagatctgaacgagcatgcagaggatcacccacaggaggattga

SEQ ID NO: 18451 - DNA, 618 bp, Glycine max
  Peptide Sequence Number=SeqID_135229
atgaaactagaagcagaagaaggaacagaaatgaaattgcaattgaaagcggaaaaatggaacatgaattcacgtgaacaagggctgcacgtcctcacctttagagggctacacgtcctcgccataagagggctgcacaccctcgccttcagagggctacacgcccttgccttcagagggttgcacgccctcaccttcagagggctacatgtcctcaccttcagggggctgcacgtcctcgccttcagaggactacacgtcctcgccttcagagggttgcaccctctcgcctttagagggatacatgtccgcacctttagaggtctgcacgccctcgccttcagtggtctagacgccctcgcctttagaggtctgcacgccctccccttcagaggtctgcatgtcctcaccttcaaaggactacacatcctcgccttcagaggactacacattcttgtcttcagagggctgcacgccctcgccattagagggctgcacgcccttgccatcagagggctacacaccctcaccattagaggaccacacgtccttgccttcataaggctacacgccctcaccttcagaggactacacgtcctcgccttcagagggctacac

SEQ ID NO: 18452 - DNA, 456 bp, Glycine max
  Peptide Sequence Number=SeqID_135230
atggcttcccgtaagaggaaagctatagcttcagtgtctgaggctgataatgtgcttgcgaggaacattttgccagaaagaaatgtcaagttgtatatcaatgagtttgatgatttcagaagagaattgattagaagatactggcataaaccgctgaccaacttgactgagggaaacattgatgtggcaattgtgaaggaattctatgcaaatctatatgtccctaaggacaagtctcccaagcaagttagggttcgagggcacctgataaaatttgatgttgattccctcaacacctttttggagactccagtggtcgtggagcaaggggagagcttgccctcttactctaggtttgctagattgaggcctgatcctcaggagcttgtagcccgactgtgtatccctgagagggatttgtacttaatgccgagggtctgccgtggaagctcttga

SEQ ID NO: 18453 - DNA, 270 bp, Glycine max
  Peptide Sequence Number=SeqID_135231
atgacagatcctttttccgaggacagggatggaaattcttatcctgggtcaaggtttatggtggtttgcggtcttgggtcaaaagcttgtagaacggctggacatgatatatgtcagggtgttggtttggctagtggttcagggataaaggggatgtcccacattatttccatgacacatgcaacaatgatgattaggaaattttacgcaaaactggtcatgcatgctcccacgtggacactcaagcatcaagtttttatggtcatgtga

SEQ ID NO: 18454 - DNA, 300 bp, Glycine max
  Peptide Sequence Number=SeqID_135232
atggctatgcaaaacatgcagtttcaacaagagactagagcctccattcagagcttaaccaatcagatggaacaattggctacacagttaaatcaacaacagtcccagaattctgacagattaccttctcaatctatccagaatcccaaaaattgtcaaggacctcaaccagtagcatcttcctcatccacaaatgaacctgcccaacctcactctactccagaaaaagatgatgacaaaaatttaaagaaagcagcatatccctcttccattccctccaagagcaatttccaaaaataa

SEQ ID NO: 18455 - DNA, 555 bp, Glycine max
  Peptide Sequence Number=SeqID_135233
atgactaaggagggtcagaagactggtatggtgtgtatctactatgatcaaattgttaggggaggtggaattaatcggttcaatggtcacttggctggtgaaaaaggtcaagttgaaatatgcaagaaggtgcctgcaaaagtttgttataaaatgaaacaaaatcttgatggaaataagagccagaggagaaaaaatgaagaacgtgataatagttatccacctagtgaaataagggttaagacaagtgctagcattgggacttattttccgcctagaaccactcttggagctcaacctaccttgaaaagtgtgatgaaaaataaacaagtgatacaaaagtgtgaccttgctattgctaaatggttccttgatgcatttgttccatttaatgcagctaattcaacatattttcaacatatggttgatgctctatgtagcatgatccaggatacaaggctccaggatatgcaacaagtcactgcaccccccatgtacatacacaacatagagcagatgaaacatgggcaccatcaatgcactaacaatggataa

SEQ ID NO: 18456 - DNA, 225 bp, Glycine max
  Peptide Sequence Number=SeqID_135234
atggttgctgttggaggaggtgggttggatgatgaagggatgtcttcagctctttctctctttcttgaggccatctatcccgctaagcctataacttgccgcaatgatgtgcgcttagctctcccgaagccacgcttagtggtattacacagtaaaagtttcacaaattctactaagttatgggagcttagcgaaatgggtcactcagctcagtcactgccataa

SEQ ID NO: 18457 - DNA, 318 bp, Glycine max
  Peptide Sequence Number=SeqID_135235
atgtataagcaaatatggactagtacactgcaacgaacaattctgacagccactccaattattggatttcccaagatacaatggcgtgcacttgatgagataaacgcaggggtgtgtgatggtatggcatatgcagaaatcaagaaaaacatgccagaggagtatgagtatgtttgcagacttgtatataggaacggaaatccttatggaatagctgaaggtattgttttcagtatgccatgccgatcaaaggtgatcaccaaatctaaggaattggtaatggtctcattccaagtgtactggatgttaatctactag

SEQ ID NO: 18458 - DNA, 240 bp, Glycine max
  Peptide Sequence Number=SeqID_135236
atggcatgggtgctactgatagtagtgctgggttacctcgtgcatgtgctagacaatgtaattgacacagtttacatctgctatgcgatagaccgggatagaggagaggtttgtaaacaagatatccatgaagtttacgttcaattacccattagtagaagtctcagacagtctgttactacaagaactctagaggcacaagtttacactgttaatcagagagatttgttggagaactaa

SEQ ID NO: 18459 - DNA, 168 bp, Glycine max
  Peptide Sequence Number=SeqID_135237
atggcggcattccgaaggcacttgccaacaatgcttggttcatggatttgtacaaaaccagcaatggaaaatcagaaacagcgacggccaacaaaatgcacgatcaatgtgaaatttcttgtcttcatgacaacatgttcaagggacttttgtatgctttcactctaa

SEQ ID NO: 18460 - DNA, 191 bp, Glycine max
  Peptide Sequence Number=SeqID_135238
atgtcgaaaggttcaagcttcacaacctctgacattggtctaggcaaccagattagccaaactttaggaggaaaagttcagcgacttctgcctgagaagggtatctatttcaactgtgacgagaagttccgtcaaggtcacaaatgtgcctccaaggtcttcttgttgatcgtcgaggaagatgatgatgc

SEQ ID NO: 18461 - DNA, 525 bp, Glycine max
  Peptide Sequence Number=SeqID_135239
atgaaaagaagcaatggtgaggcgctcttggtcaggggtagaatggtattcaaagaactacatgatcctaaagatctagcccaacgaattgaaaccatcaaaatgaggtacttcaagcttcgtgtggtaagggtggggagggggagaagttgtttgtggtatcgcaaacaacgaagttggggactgtggatgggattcgatgttggcaattttctagagaagttgatcgagcttgttggacacggatgtctgagtggtggtaagggacagctggttggagggattaagagagctagaattcaaggtctaggcaacctcccaagcacaaagaggaatgatcttcctgttaagcctcccattcgagcttgtgttgtgatcttgctacattcccaccttcttatcatagcacctccagatctagatctaaaaattggatgtcttgggacgaagtatgtggtgccgcaaatgaggagaatgccttggatggtgggtggtggcatacctaatttcaaggaaagggtttag

SEQ ID NO: 18462 - DNA, 192 bp, Glycine max
  Peptide Sequence Number=SeqID_135240
atggagtgtcttccaaaaaggaaaacatgcaggtgtcgccaccaacgtttattcgaggaaaacgttagaaaaaccaaaaagggatctgtgaattttgaaaataagggttcgagagttgtttacgcatggggaagggtgttgcccttgctcctatgtatcctcaggtgcgatgaggaattcagacctacatag

SEQ ID NO: 18463 - DNA, 192 bp, Glycine max
  Peptide Sequence Number=SeqID_135241
atggaggatgcacgaggagaggccttggctgcgcagcaacactggtttcgtagccttctggtaatcgattacatgagtaataagccttctggtaatcgattacaggatgttgtaatcgattacatgctacctgttcttgtggaatcgattactctgagtggtaatcgattaccagagcacaaactaggctag

SEQ ID NO: 18464 - DNA, 393 bp, Glycine max
  Peptide Sequence Number=SeqID_135242
atggatcgaacttggattaaagtacctcgcataagcgaagtttatcaaaacggggttaaagaattcttgcaatttgctgaacaaaatgcaccagtattagctgcaaaatatttctgcccgtgtgttaaatgtgtgaatgggagacatcagttgttgaatggcatcagatcacatcttatatgtgaggggtttagtccgagttacacaaattggatatggcatggtgaattgccacacgtttcaacaatccctcaacctgaggcagttgatgtacaaactagagatcgtatgcaagacatgatacgggatcttggccaaaaggtttttcgggatgctcatgcgcattattatgaaaaattacaaacagattcgaaaaagccattgtatgtgtga

SEQ ID NO: 18465 - DNA, 463 bp, Glycine max
  Peptide Sequence Number=SeqID_135243
ggatcgtgcccacaagacacccagtggatccgaagaagtccaacagggccctggggtttccagctttggttacgggcctttgtcaatcctacagggcgcccgttcccccaacgaggaatcgcacccacaaagacactcagtggacccggagaagtccaacagggccctggggtttccagctctgggatcgcgcccgcaagacacccagtggacccgaagaagtccaacagggtcttggggttgccaagctctaattacgaacctctatcaattctacggagtgcctgtcgcccccagcaagggcatcaggccccctactaatcgagctttcatcaagaagtactgcgtctccaggcaggcacagggcgaaacaccacagcagcctggggatggccagcagcaggcaacagacgcaccgccatcacctctagagttcacctcagctaatccacaaaaaggttag

SEQ ID NO: 18466 - DNA, 672 bp, Glycine max
  Peptide Sequence Number=SeqID_135244
atggccttagagcttagtacagatgtcactctttttgaagtacagtattgtttgatttactttgcctttgtttcaacctcagaattgccaataaaatttaaaaccattccttcatttctaacagatccgatccaaacgttaattgttatgacttatccaaatgttaattgtcatcagtctaactcgaaaatgaatctgcaaatggcagagagaatatttattgcagcattcacctctttgaggagtcagttgttcatacttgtactcgagcaaccttcaaccagtaaaaaacgcagaagagatatggaagatcggcagaatgcatccttcaatagggagtttgaattcaaggaggaggataatctggttcatggaattatagtgatgactcatagcttcttgaatctgtatgctgtaattctgttaatgatcagaatactggttctggttcctgtctttccactgttagacctgctaacattcatccacaagtctgctactgtctactgggcaaaaacagaaagccaaatgaaaatgcaagaaactgtagcaggagaaataaactttgatgatgacagtgccaagaaagttatcatggctgctgttgaatatgcaaaaacatatccaagatgcgaggagaaccagaaattttttgccttattttcgatttaa

SEQ ID NO: 18467 - DNA, 414 bp, Glycine max
  Peptide Sequence Number=SeqID_135245
atggggttggatgtgaatgtgacgtggcttttggtgtcactttggcaaaacattaactcctcttctgaccaaccaacaactttcccttttcatttcacacgcttctgtattaatttctcttccctggcgagagaggtagacagagacagtgaagggcgatggcgagaagctggtgtcgtcacgaggatcacccttccctggctagtgctttcacgaggatcacacgccacgcccactccctccccctccttggccagcattgtcactaggatcttagcagcttcatgtgacttctacgcggcgatgctgttgggcgagactagagggagggcgatggccatgaaggaggtggcggtgctacagcgcgacagaggtggcatagcggagttggtgaggaggaggtatggaaggtaa

SEQ ID NO: 18468 - DNA, 5572 bp, Glycine max
  Peptide Sequence Number=SeqID_135246
cgagttgatagattgcgggttggctggattttgtatggaaactcggagccggaagcgggcggaggcttcctcagctgccccttcatccccttcctctggtcccaccactcgttcaagcaagcgcgcacgtctctcttcttcttcttccgcttccgccgccgtgaacactcggtcccgtgcatccaatactaaggaacccttgccccctaaaaatccccctcctcctcttcctcccatggactctgccaacgaatcctctggctcccgccgtgatcgccgcaacaacaaagaaaactcctccgacaaggggaaggagaaagagcatgatgtcaggattagggacagggatgcggcattgaacatggatggcagtggtggagacgaggacgatgacaatgacaatgacagtgaaggcggtgtggggattttgcatcaaaacttgacctctgcgagtagtgcacttcaggggcttcttcggaaactcggtgctggtttggatgatctgcttccatcgtcggctatgggctctgcatcttcctctcaccagagtgggaggctgaaaaagatcctctttggattgcgggcggacggcgaagaagggcggcaggtcgaagcattgacacagctctgtgagatgctttcgattgggactgaagaatcgcttagtacattctctgttgattcgtttgttcctgtgctcgtggggttgttgaatcacgagagcaaccctgacatcatgcttcttgctgccagagcattgacccatctctgcgatgtgctcccttcatcttgtgctgcggttgtgcattatggtgcagtctcaatcttttgtgccaggttgctcacaatagaatacatggacttggctgagcagtcccttcaagctttgaagaagatctctctggagcatcccactgcctgcctacgagcaggtgctcttatggccgtgctttcttatttggacttcttttcaacaggagttcagcgggttgcattgtctactgctgcaaatatgtgcaagaagcttccttcagatgcagctgattttgtgatggaagctgttcctcttctgacaaaccttcttcagtaccatgattccaaggttctggagcacgcctctgtttgtttgactcgaatagctgaagcttttgcatcatctccagacaaattagatgagttgtgcaaccatggacttgtaacacaagctacctccctcatttctaacagcagttctggaggtggtcaggcttctctcagcacaccgacatataccggtttaatccgacttctttcaacttgtgcgagtggatcccctcttggagctaaaaccttattacttcttggaattagtggtattcttaaagatattctatctggttctggagtttcttctaatgcctctgtttctcctgcattaagtaggccaccagaacagatatttgagattgtaaacctggcgaatgagcttctgcccccattgccacatggaacaatttctctccctatcatctccaacatgtttttgaaagggcccattgtaaagaagtctccttctggtagctctgggaaacaagaagacactaatggaaatgttcctgagatatcggctcgtgagaaactattaaatgatcagcctgaactacttaagcaatttgcgatggatctcctcccagttttaatacagatatatggttctagtgtcaatggtcctgttcggcacaaatgcctttctgtcattgggaaattgatgtatttcagcacggcagagatgatccagtctttgttgagtgtgacaaatatatcaagtttcttagctggcgtcctagcatggaaagatccacatgttttgcttcctgccttgaaaattgctgaaattcttatggaaaagcttcccgggacattctccaagatgttcattagagaaggtgttgtgcatgcagtggaccaacttattttagcctcaaattcaaccaatatctctacacaggcatctcctgctgagaaggataatgattctatatctggagcatcatctcgctctaggcgttatcggcgacggagtgggaattccaatcccgatggaaatcctttggacgatttgaaaactccagtttcagtaaatgttggttcacctccaagttctgtggatatgccaacattaaattccagtattcggttatctgttagtacagctgccaaagcttttaaagataagtactttccttcagatcctggggctgctgaagtgggtattactgatgatcttttgcatctgaaaaatctttgcatgaagttaaatgctggtgatgatgaacaaaggactaatggaaagggggaatctaaaacttctggatttggtccggaagagtatttaattgggatcatagctaacatgctaaaggaacttggcaaaggagatggtgtatctacttttgaattcattggtagtggtgttgttgcagctctgttgaattatttttcttgtgggtatttctctaaagatcgaccattagaagcccaccttcccaagcttcgccaacaagcacttacaaggtttaagttatttatagcagttgcactaccttctactattgaagttgggactgtggctcctatgactgtcttggtccagaagcttcaaaatgccttgtcctccttggagcgtttccctgttgtgctgagtcattcatctaggtcatctagtgggagtgcacgcctctcctctggactaagtgctttatctcagcccttcaagttgcggctttgtcgagcccagggtgaaaagtcacttagggattattcatccaacgttgtactggttgatccattagcaagtttagcagcgattgaggaatttgtttggcctcgtatccaacgtagtgaatctggtcagaagtccactgtagccactgggaattctgaatctgggacaactcctgcaggagctggtgtatcctctcctactacccgtcgccattctactagatccagatcatctgttaatataggtgatacatctagaaaggaaataactcaagataaaagtacaagttcttccaagggtaagggaaaagttgtattaaagcctgcacaagaggaggcaagaggacctcagaccagaaatgctactcgcagaagagcagctcttgataaagatgctcaaatgaagcctgtaaacgctgactctacttctgaggatgaagatttggatatatcccctgttgagattgatgaggcattggtgattgaagatgacgatatttctgatgatgaagatgatgaccacgaagatgtactgagggatgattctcttcctgtttgttcacctgacaaagtacacgatgtgaaattaggcgacttagcggaggagagtaatgttgctcctgcaacaagtgatggccaggctaatgctgcctcaggttctagtagcaaagctggtacagtcaggggatcagactctactgattttaggagtggctataactcaagctcaagaggtgcaatgtcatttgctgctgctgctatggctggacttggatctgccaatagcagaggtatcaggggtggaagagatcgactagggcgtccattgtttggtagttctaatgatcctccaaagttgatatttactgctggtgggaagcagcttaataggcatttgactatttatcaggcaattcaaaggcagcttgtgctagatgatgatgaaagatttgctggcagtagtgactatgtatccagtgacggaagcaggttgtggggtgatatttatactataacttatcatagggctgagaaccagacagataggactccccctggaggttcaacctctaatgcttcaaaatcttgcaaatctgggtctgtatcgaattctagttccgaagccaagctgcatcagacatctgtactagatagtatcttgcagggagaattgccctgtgaactggagaaatctaatcctacatacaatatattggcattattgcgggtgcttgagggtttgaaccaacttgcatctcgtttgagggcccaagtggttactgatagctttgctgagggaaaaattttggatttagatgagctaagtgttaccagcggtgctagggttcctacagaggaatttataagcagcaaacttactccaaaattagctaggcaaatacaagatgcccttgccttatgcagtgggagtcttccctcgtggtgttaccagttatctaaagcgtgcccttttttgtttccttttgagacccggcgacagtatttttattcaactgcctttgggttatctcgtgcattgtatcgccttcagcagcagcagggtgctgatggtcatggatcaacaaatgaaagagaggtcagggttgggagattgcagcgtcaaaaggttcgtgtctctcgaaatcgcattttggattctgctgctaaagtgatggagttgtattctagtcaaaaggctgtacttgaagtagaatattttggtgaagttggcaccggtctgggtcccactctggagttctacacacttctcagtcatgacttacaaaaaattatacttgaaatgtggagatcaggttcttcagagaaatatcaaatgaaaattgatggagatgaaaagaaaatgaaacgtagtgaaggctcttttgttggagatggagaacttgttcaagctcctcttgggctgtttcctcgaccttggtctgcaaatgctgatgcatcagagggtacccaattttttaaagtgattgaatatttccgactattaggccgtgtaatggctaaggctcttcaagatggacgcctattggatttaccaatgtcagtggcattttataagcttgttcttggtcaagagcttgatttgcatgacattcttttcattgatgctgagcttgggaaaactttgcaagagttaaatgcccttgtttgccgaaaacattatatacaatctactggtggtagctacaccgatacctttgctaatttgcattttcgtggggccccaatagaagatctctgcttggacttcacacttcctggttatccagagtacatcttgaaacctggagatgaaattgttgacatcaataatctagaggagtacatatccatggtggttgaggcaactgttaagactggaatcatgcgtcaaatggaagcatttagagcagggttcaatcagactgagacactagccgatcatataaaatttgaccatggttatactgccaagagccctgccatagttaatttactcggaattatgggagaattcacaccagagcaacagcgtgccttctgtcaatttgttactggtgcacctaggttgcctcctggtggactggcagttctaaatccaaaattaacgattgtgaggaagctttcatcaagtgcagctaatgcttcatctaatgggaacggtccttcagaattagcggatgatgacttgccaagtgtgatgacgtgtgcaaattaccttaagcttcctccttattctaccaaggaaattatgtacaagaagctactctatgcaatcagtgaaggccagggatcctttgatttatcgtga

SEQ ID NO: 18469 - DNA, 222 bp, Glycine max
  Peptide Sequence Number=SeqID_135247
atggatagcaaggcgaacacacatattggcttcaattacgcaccaccaaacacattggaattggaaaaagattgtggaagagatacaaaagaacaacacaaaaatccctattgctgcaagggaacgaatcaaatgggaatcaagttaatccacatcgaccagatagcgaagcatattgtgaaagcaaaattcgaaagtgaaacagagactaaggaatcataa

SEQ ID NO: 18470 - DNA, 2529 bp, Glycine max
  Peptide Sequence Number=SeqID_135248
atgtcaattctcaaagttcttttgattaccatcactttttcattggtcattgctgccaccagcgcccatgaagacgagaagaagatgacgacttctaacagtcacgaggacgaaggcggggagaagaagactgtgacttatgatggcaggtcactcattatcaatggaagacgggagcttctcttctccggttccatccattacccacgaagcacccccgaggagtgggcaggcattcttgacaaagcaagacagggaggcataaacgtggtccaaacttacgtgttctggaacattcatgagactgagaaaggcaagtactcaattgagccgcagtatgattacataaagttcatcaagcttattcaaaagaaaggaatgtatgtaaccctcagggttgggcctttcatccaagctgaatggaatcacggaggacttccatattggctaagagaggtccctgaaatcatattccgctctaacaatgaaccctttaagaagcacatgaaaaaatatgtatcaaccgttataaaaacggtgaaagacgcgaacctctttgctccccaaggaggccctatcatcttggcacagattgagaatgagtacaaccatatccaacgtgcttttagagaggaaggagataattatgtccaatgggccgcaaaaatggcagtgtcactggatattggagttccatggatcatgtgcaagcagacagatgctcctgatccagtgattaatgcatgcaatggaaggcactgtggtgataccttttcaggccccaacaaaccttacaagcctgccatatggactgaaaactggactgctcagtatagagtgtttggagatccaccatctcaaagatcagcagaagacattgccttctcagttgctcgcttcttctctaagaatggatctttggtgaactattatatgtaccatggtggaacaaattttggtagaacaagctctgccttcactacaacccgatattacgatgaagcccctcttgatgagtacggtatgcagagagaaccaaaatggagtcacctgagggatgtgcacagggcattgagcctatgcaagagggccctgtttaatggtgcgtctaccgtcacaaaaatgagccaacatcacgaggttatagtttttgagaagccaggaagtaatttatgtgctgctttcatcaccaacaaccacaccaaagtaccaacaaccataagtttcagaggtacggactactatatgccaccacgttccattagcatccttcctgactgcaagactgttgttttcaacactcaatgtattgcttcacaacatagttcaaggaatttcaagcggtcaatggcagcaaacgatcataagtgggaggtgtattctgagaccattccaaccaccaagcaaattccaacccatgaaaagaatcctatagagctttatagcttgcttaaagacaccagcgactatgcatggtacaccaccagcgtagaactacgtccagaagacttgccaaagaagaatgatatacctaccattctccgtattatgagtcttggtcattcattgcttgcctttgtaaatggagaattcattggatcaaatcatggtagccatgaagaaaaaggttttgaattccagaaacctgtaaccttgaaggttggagttaaccaaatagctatcttggcttccactgtgggactccccgacagtggagcatacatggaacacaggttcgctggacccaagtctatattcatccttggtctcaactctggaaaaatggatctcacttctaatggttggggtcatgaggttggtatcaaaggtgagaagcttggcattttcactgaagaaggatcaaagaaagtacaatggaaagaagccaagggacctggaccggctgtctcctggtacaagacaaattttgcaaccccagagggaacggatcctgttgccatcaggatgactggtatggggaagggaatggtttggatcaatggtaaaagcattggtcgtcactggatgagttacctctctcctcttggacagcctactcaatcagagtaccacatcccaagaacttacttcaatccaaaagacaacttgcttgttgtatttgaggaagagatagctaatccagaaaaggttgaaatcctaactgttaacagagatacaatatgcagtttcgtcacagagaatcacccccccaatgtcaagtcatgggcaattaagagcgagaagttccaggctgttgtgaatgatctggtgccatcagcttcactcaaatgtccacaccaaagaaccattaaggctgtggagtttgcaagctttggtgatcctgcgggtgcatgtggagcctttgctttaggcaaatgtaatgcacctgccatcaagcagattgtggagaagcaatgcctcggaaaagcatcttgtttggttccaattgacaaggacgccttcactaagggccaagatgcttgcccaaatgtgacgaaggcacttgcaatccaagtgaggtgtgaatga

SEQ ID NO: 18471 - DNA, 204 bp, Glycine max
  Peptide Sequence Number=SeqID_135249
atggggatagctgatcagaagatcaactttgatttgtttcatgaagacaagcatttgctcagccagagtgtctgttcagagcgagtcacttttcgcgctaagcgcatcaacccctactcattggctgaaagggcctcgctgagcgagccctgtgcgctaagcccaaaaacttctctggaatttcatcttttggaattaggctaa

SEQ ID NO: 18472 - DNA, 378 bp, Glycine max
  Peptide Sequence Number=SeqID_135250
atggcctctaggaagaggaaagccacagcatcccagccccaagagccttatgacaccaccagattcatctctgaggtttcctgggagaggtattcccaaaatgttcacccccgaaacatccttccagagaggaacattattctctacatcacagagtacgacgagttccgttgggagctcaagaggcggtgttggcacaaagccttgaacaggaagtctgatggtcacatagatgtggccctggtcaaggagttttatgccaacttgtatgatccagaagacaagtctcccaagacgcgcatagatcctcaagagcttgcttccaagctctgcattccagggagcggatttgttttgaatgttgaaggggcaccctga

SEQ ID NO: 18473 - DNA, 366 bp, Glycine max
  Peptide Sequence Number=SeqID_135251
atggctctagtgactggtcccttcctagggaggattgcatcagctctggctgaggctctttggctgcggaagcttcacctccccccaaaggagaaggttggactcctagccaggccacctaagttgcataagccttggtggaggctctacaacatcgaccccataagatctgagttcagagtggaggtgccggcaggtgctggaactgatgatggtggaagagaagtagggggagctgaggtagaagcaggagtagaagaaggggttgatgtggacgcctctaatggtcccctagccctagccttgcgggtccctggaaatacgatcgtgggatcatccaggttccaacaattcttctttacataa

SEQ ID NO: 18474 - DNA, 1215 bp, Glycine max
  Peptide Sequence Number=SeqID_135252
atggcttccaaaaagagaaagaatattggttcaagacccacagcgcagtatgaaacaaggagattctcttccttggatgcttggaccagatacaccgataatgttctaggaagacatatactgtctgagaggaagattgaaatataccatactgagctggacgagtttaaggttgaattagagaggtgtaacttccataaacgcctcaccaatttagttgacaacaacatagatctagctttggtgaaggagttttatgccaacctttacagctccgaacaagtcaaggtcagaggccacttggtgaggattgatgcagacagcctcaacacctttctggagacacctgtggtactagctaagggtgaaaccttacccgtatattctagatactataggttgcccactgatattagagaaattgaggctgccttatgtatcccaggtcgaggtgttctctcatactttaacctggctcctactttccacacctcagaccttacagtagatcgagctaggctgatctttggcctagtatctcagatggacatgaatgtgggagctctcatctctagtcatattacatctatggctcagtctaactcttctagacttgggttccctgctcttatcaccactttatgtaagtccagaggggtttcttctgacaacctggtcttcgaacgtctgagcccgatcattaacttggcctatatcaggaaaaactgttggaaccctgatgatctgacagttactatcagaggggccaggagaacaaggacaaggccagctgaggccccttccacatctatagctcctcctccagcatgtaccctagcagctccttctgccccagcttctgcaaattttcagcatcttgaagccatgcttcaaagcatccatcaagggcagattatcttattacaaagtttacagatggtggcacctccagactctattccttcagtagagcagtttaatgagtgggtagcctggcccaggattcagtcttctcttcacagggaagatgaaggtcccacagcccaggtaccacagcagatggaggatgagtcatccaagactaccactccagaacccttggtcagaaggaagaaggcagatgaaacacaagaagctgcagccacttttgagaaatctcttgaggccacttctgagccttcagaaccagtggcagatacaacttcacatcagtag

SEQ ID NO: 18475 - DNA, 718 bp, Glycine max
  Peptide Sequence Number=SeqID_135253
atggacaaccttcaaaaatgccaagcaaactacacagcactcacacctttaacgtttttgatgagggctgctgcatgctatgcaaacagaacctcagtgatacatgaaggaacccgtttcacttgggcacagacttatgagcgttgtcgccgcctcgccttctccctccgtgcccttaacattgctaggaatgatgttgtatcagtgctggcccctaacatcccagcaatgtatgagatgcatttcgcagtgcctatggcaggtgctgtgctgaacaccatcaacacccgtcttgatgccaagaacattgccaccattctgcgccactccgaagccaaagtcttctttgtggactacgagtacgtgtccaaggccaaagaagccctcagattgctcatggacgacaacaacaacaacaacctcaaaaagggtgttccaaaaccaacaaatcaaccacactcaacgacattttctcttccactagtcattgtcatagatgacataaacacccccactagaatccgtcttggtgagctagaatacgagcaaatggttcatcatggtaacccaaattacttccctgaaggaatccaagacgagtggaccccaattgcgctgaattacacatcaggaacaacctcggagccaaagggtgttgtttatagccacagaggagcatatcttagcaccctaagcctaatcttggggtgggaaatgg

SEQ ID NO: 18476 - DNA, 1134 bp, Glycine max
  Peptide Sequence Number=SeqID_135254
atgggtagtgaacctgtttatctctggacactacctatgttccattgcaatgggtggaccttcacgtggggcgtggctgcacgtggtggaacaaacgtgtgccttcgcaccacagctgcacgtgacatatacaggaacatagtagtccacaatgtgacacacatgtgctgtgcccccattgtgttcaacataatcttggaggcaaaacaaagtgaaaggattgacataaaggtaataaatgggaagagaaaatcaccggttgagattctcactgggggagcaccaccaccagcatcattgctagagcaaattgagtcacttgggtttcatgtcacacatgcatatgggctaactgaggcaacaggcccagcacttgtgtgtgagtggaagaaggagtggaacatgttgccaaagaaggagcaggcccaacttaaggcccgtcaaggggtgagtgtgttgactatggctgatgttgatgtgaagaaccttgagacaatggagagtgtggctagggatgggaggacaatgggggagattgtgctgaagggaagtgggatcatgatggggtatttcaaagatcataaggcatcttcaaaggcttttgggaagaatggcgattggttcaaaactggggatgttggtgtgatacaccctgatgggtatttggagattaaggataggtctaaagatgtgatcatttcaggaggggagaatattagtagtgtggaagttgagtcacttttgtataagcaccctagggtgttggaggctgctgtggtggcaatgccacaccctaggtggggtgaaactccttgtgcttttgtgtccttgaggaagaacaacaacaactcatcatcatccaaaattgatgatgtcactgaggctgagataattgcctattgcaggaagaatttgccacactttatggtgcctaaggtggtgaagttcatggaggagctgccaaagacttcaactgggaagattcagaagtttgagttgagggtcatggctaaggttttcgtgcagaccaagaataatactaccactgtcaacaagaagtcttgccaagtgagtcaaaatagtattgttggggggtacaataatgagcaagttttggctgcgtctcgtctttga

SEQ ID NO: 18477 - DNA, 231 bp, Glycine max
  Peptide Sequence Number=SeqID_135255
gactcctttacccgagctaagaagtgggtccaagagcttcaaaagcaagggaatcctaatatggtcatggctcttgctggtaacaaagctgatttggaagataagaggaaagtgacagctgaattatcaagaattataattataatctctaacaatatcatgttattgaatgcacaaattatagaaaaaagaatgatggaaggtgtcaaggattctggtcctaaacattag

SEQ ID NO: 18478 - DNA, 681 bp, Glycine max
  Peptide Sequence Number=SeqID_135256
atgagtgcgtccaggttcatcaagtgtgtcactgtgggtgacggtgccgttggcaagacttgcatgctcatctcctacaccagcaacacttttcctacggtcagtgctaccactaacaaaccttcacatttttctgtgctcttctgcttctaccttactggtcctaaccgtgttgctgatgctaaggactacgtgccaactgtctttgacaatttcagtgcaaatgtcgttgtggatggaagcactgtgaatcttgggttgtgggatactgctggccaagaagattacaatagattgagacccttaagctatcgtggagcagatgtattcctgcttgctttctctctcataagcagggccagctatgaaaatgttgccaagaaatggattcctgagttgaggcattatgctcctggtgttccaattattcttgttggaacaaaacttgatcttcgggatgataagcagttctttcaagaccatcctggtgcagtgcctatcaccacagcacagggtgaggaactgagaaagcttatcggtgctccaatttacattgaatgtagttcaaaaacacaacagaatgtgaaggctgtttttgatgcagccatcaaggtagttctccagcccccaaagcagaagaaaaagaagagaaagggacaaaaggcctgttccattttgtga

SEQ ID NO: 18479 - DNA, 312 bp, Glycine max
  Peptide Sequence Number=SeqID_135257
atgcagatagcggtgttcatttcttctattgatgctgtaaagccaggttggcttttgaaatatttaaaaggcattagacctgctcatatcaaagcaatgcaacaaaatcttgtcaagtactcaaggcatttcttgtattctagtcctgctcaaccattaggtcctgaagacttggtttggaaaatggaatcatggttattgttttctggatgttatggtgctacagatggctggcaaggtggtgaacatcaagcttcacaccagaagatcacaacgtgtagtggaaggatcaagaagtcagtgtacttgtga

SEQ ID NO: 18480 - DNA, 1974 bp, Glycine max
  Peptide Sequence Number=SeqID_135258
atgacagttgaaaagagaattgttttggtggggattagaattgatggctatagcagacagctcctcaactgggctcttgtcaaagttgctgagcctggtgattgtgttatagcagttcatgtggttaaaaattcagattatgtttccaaaaacaagactctgatagatggctatttagaagtttatgatggcctatgtggtgtgaagaaggtaggtctcactggtcaaatcttcacaggaagctccattaaaaacattcttgtcagagaagcaaaaaaacatgctgctctggctctagtggtagggggacgagctgccacagctaaatattgtgctaaacggctaccaccgaccaccaatgttctagccattcaagactcaagaattctcttcagaagttgcaccaataaacaactaccaggtggtcttatactggatccaagacctagtttaacaatcatcgaagaaaacttgagtgacagaataatccagtctgcaatttgtgactccatcatggagattgaggaatcaacacccataaaaaattccttagaattgaaggatgaagagaagagcaagtcaacaaggtcaatatcagttgagcagaagcttgggtggcctctactccgcagagccaattcaggaatgtcacaaacccttcttcatacaagggacatgtcagtagtacaatgggtaatgaccttaccagatcgttcaccacataataaaagttctagctcttcttccactgaggaaaatccatttgaaaggaggagcatcagcgatattgaatatgagagctctacaaattcttctcctgcatctgttgatataataccaaatggcctagaggagatattaaatttaaattctctcgattgcaagcgattcagccttgaggttctcaagtcttgcactagccaattctcttcagaaaacttggttgggaaaggagggagcaatcgtgtgtacaaaggagtcctccctgatggaaaggcaatcgcagttaaagtaatgcagtcatcaaaagaagcctggaaagattttgcccttgaggtggaaataatatcctcagtggagcacaaaagcattgcccctctacttggaatttgcatagagaacaattctttaatatctgtttacgattatttccccaaaggcagcttagaggaaaatctgcatggaaagaacaaggatgaatccatcttgtcatgggaagtgagatttaatgtggctcttaggatcgctgaagccctcgattacctacacagggaagctttgaagcctgttgttatacataaagatgtcaagtcttctaacattcttctctcccaagggtttgaacctcagttgtctgatttcggactagcagtatggggtccaacaacttcatcctttttgacccaagatgtagtaggaacatttggttatcttgctcctgaatacttcatgtatggaaaggtcagtgacaagatagatgtctatgccttcggtgtagttctacttgagctaatatcaggaagggaaccaatcagctcagcagctttcaaaggacaggagagcttggtcgtgtgggcgaaaccaataatggagagtgggaatgttaagggcttattggacccaaatttagaagggaaatttgttgaggcccaattgcaaagaatggttctagcagcatctttatgcatcacacgggcggctagacttcgtcctaaactgaaccagatattgaagatcctaaaaggagatgagagagttgaatgtttcttaaactctcaaggggatggtgatcaggaggattcagaaaatcaagaaaacattgatgacgaagtgtacccaaattcaagtgcagagttgcacctaagtcttgcattacttggtgttgacgatgacagtacatcacatagtagtacagaccacagctatagtgaacacttgaaagaacaatggagcaggtcatcaagttttaattag

SEQ ID NO: 18481 - DNA, 1200 bp, Glycine max
  Peptide Sequence Number=SeqID_135259
atgaccatctttctcttcctcctcgctttctctctcctcctattcctcttctctctctctcctctccgcaccccttctcccacgcagcatttccacgtttccgatgccgaaacctcgttcttggcctccctcgaccacttcctcctcgcccacgctcaaacgtccctcaaagacgacgacacagcgccccgcgacgaaccccaaaacgacgacatgacgaagaagctcgacgacgccgtttttcactccgagatggacaggctcctctcggatccttactacccggtgtcccttccccttagggtttacgtctacgacatgcccccaaaattcacccacgatttgctctggctcttcaaaaacacctaccgagacacctccaatctcacctctaatggaagtcccgttcaccgtctcatcgaacagcattccattgattactggctctgggcggatctcattgctccccaatcggaaaggctcttgaccagtgtcgttagggttcaccgacaggaggaggctgacttgttctacatacccttcttcaccactatcagcttcttcctcatggaaaaacaacaatgcaaggccctttatagggaagctttgaagtggatcactgatcaacctgcatggaagcgctctggtggcagagatcacatactccccgtgcatcatccctggtctttcaagtctgttcgtagatacgtgaagaatgcaatatggctcctgcctgatatggattccacaggaaactggtacaagccaggacaggtttatctggagaaagacctgattctcccttatgttcccaatgttgatttatgtgatgccaagtgtttatctgagacgaatccaaagagaagcacactacttttctttcggggccggctcaagagaaatgcgggagggaagatacgctctaaacttggagctgaattaagtggggttgatggtgtggttatagaggagggaacagctggagatgggggaaaagaagctgctcaaaggggcatgcgcaagtctctattttgcttaagcccagctggtgacactccttcctctgctagattatttgatgctattgtcagtggatgcattccagttataataagtgatgagctggagcttcctttcgaaggaatacttgattacaggaagtgtgggcaagttgctattggattatctgttggtttataa

SEQ ID NO: 18482 - DNA, 519 bp, Glycine max
  Peptide Sequence Number=SeqID_135260
atgagtgaaaatttgatgggaaaagtcaacgctttgggggagcgtctgaaaattgctacctctgaggcccttcatgagcctgaatgggctggaattcttcatatctgtgacttcataaatgctgatcaacttaacaccgccgaattggcatggggagagtcaaccattgagcttcgctatctgcctgtgtatgcagaaacttacaagagtttgaaatcaaggggtattggattccctagccgtgacaacgaaagcttggctcccgtgtttactcctcgttctgctactgcttcagctgatgctgatgtcagtcttgcacatcttatgcagcatgatgatattcatgtgcaaagttttacgtctgaacaaataaaggaaacttttgatgtcgccagaaatagcattgagcttctttctgtcttcttcaacgcagcaggatgtgttaaagagtcgtcaatccctgatgtccatagaatcgttgagactgggataatgaagcagtgcttttctaggccttga

SEQ ID NO: 18483 - DNA, 1014 bp, Glycine max
  Peptide Sequence Number=SeqID_135261
atgggaagaacaccatttgcatgcagtagtgatgaaaatggtttgaagaaggggccttggaccccagaagaggatagaatattggtggattacattcagaaacatgggcatgggagttggagagcacttccaaaacttgcagggttgaacaggtgtgggaagagttgcaggctaaggtggagtaattatttgaggcctgatatcaaaagaggaaaattctctgaggaagaacagcaactcatcattaatttacattcagttcttggtaataagtggtcggctatagcaggtcatctgccaggtagaactgataatgaaattaagaatttctggaacactcatttaaagaaaaagcttctgcaaatggggttagatccagtgactcatcgtccaagatcagatcaccttaatcttctatctaatctccaacagttactggctgctacaaacattgtgagtaatattctcacaaacacttgggacagtactcataatgctctaaggctacaatcagatgccaaactccaattgctgcagaacatacttcaagttcctacctcaaacttggacctactcaatccatttggaccatcagatggttttctaaatgaagttttggggttgaatcagtctaataagctccaaaacctttataataatggtagttcaactgatggttttccttctcagaatcagccaaatatccaaagctttgaagcccctcatcagcagcaaactctacccaatggaggaagcattaataggagtagcatgaaatctgaaaagcttgatgcgccatattcttcttcaacagcattcgttaattctcttccaaatctagtttcagcctcacctgaatattgttccactcatgtcatgcaaatggaaaacaaggtaaatccaaatgagttctctgacccttcttccacttcaaccaacaactttgaaatgtggggagatttcatgtatgaggaagtaagcgatgcttattggaaagatctcaagatagagtaa

SEQ ID NO: 18484 - DNA, 390 bp, Glycine max
  Peptide Sequence Number=SeqID_135262
gaaatagcagatggagtcaacaagtcagctcaagctttgcaagctgcagaagctggaatccgacagattggttcagtggcacaacaacaaaccgtatctatgattcaagagagggcaagtttacccgtaatttctttgcaacctgctgttgctggagctgctagaaagacttctagagcagttggccgagccacaaagagcttgttgaacatcatttcaggaaggcaagacgcaacagcagaatatgatgatgacgtaacttacatgtactatgaattgggcccggatgatccaccttatgctgccaagttctatgactgttgtggggctgaagaccctgaagcttctggctgcacaaccaattttcatgtctcttatgacgaagactga

SEQ ID NO: 18485 - DNA, 336 bp, Glycine max
  Peptide Sequence Number=SeqID_135263
atgcaccggatgtgtggagaatctgaatttgttccacaatccaccaccggatgtggagaatctgaatgggtactctttttagtctttcacaatgcacctaagctggagaagctcattattcctccaaggataaactgtgggttaaggtcttacacaggaagtatgactatgtttatatctaaagaggagtcattgtggaagatcatttacgtggcctttgagaatggtgaatgggacgtccagaacatctctaactccctggcttctcatatcttttgcaggatcatggcaactatccctccaagattaacacatggggatgacaccattgcttag

SEQ ID NO: 18486 - DNA, 243 bp, Glycine max
  Peptide Sequence Number=SeqID_135264
atggtttggtctgattcattgggtgaaggggcagaggaacaatatgcaaccaatggaaatgcagacgacttggaattggaggagatgaaaagaaaatggggttgtctgagtgtcaaggtggaagagtgttggtataatggagaagaagaagcacgcgtgcttgctaggagagaattcatgctcatactcaatcacaccacccacccttcagttcacttctcttctcggccacgcatgacataa

SEQ ID NO: 18487 - DNA, 1011 bp, Glycine max
  Peptide Sequence Number=SeqID_135265
atgtatgaatttgctgatttaacttggtatccatcaagacacacagttgtgtacagatatgactccagggttcccttaaatgcctccggtgatgcagtttatgacttcattggatttcaagccaattccatcttggtctctgaatcagttagagcagcagaaaaattgctagaaagtaccagaaatgcaaatgggaaatgcttaacggcatctactactttgggcctcaagaaattagtaggcaatggattgaagaacaatggccaaatcttcactggctatccagtagtgggttaccaaggcaaaatgcaaacttcaggttcatgcttatattcatcaagatttgacaccgcatgtgcctgggatccaagaatcaaagggctattcttctacgagagcacagcaatcttccctgcgtcgaaattcggagacttcgccggcgatgtgagaaaacttagagacctcaagccagaaaatttctgtggggtggacaactacaacgggttgctaattcgctttatcaaagcctcaagtgcctatctagggcaacctgaagattctgtggttgttgatttcaactattatcgcggaaacgatccgtcaaaccctaggctaaatcaagatgtgtgggaagaagttgagcaattggcattcttcaagcatggggctaagccacactgggctaagaataggaacatagcattcttaggggtgaatcagaagtatcccaagtttaacatgtttattgcagccaaaaaacaaatggatccactcaatgtgttctctagtgaatggtcagatgagatactttatgggcaggaattatcagagaaagttgatgggtgtgctttggagggactatgcatttgtagcgaacatagacattgtagcccacaaaaggggtattattgcagtcatggccttgtctacaaggaagccaggatcgtagtccccatcaaccgatcggagaataaatgtcattttgttaatgtcgatctacatgttaattaa

SEQ ID NO: 18488 - DNA, 681 bp, Glycine max
  Peptide Sequence Number=SeqID_135266
atgacaaatgcttttgattggtttaagcatattttaaaatggtccgattcctatgttgggggtgctattgcctcacgcattgagggccaacacagaggagctcttccttctgttattgtgattggtgctggaatatctggacttgcagcagcacgaagtctctatgatgcatcttttaaggtgactgtactggagtcacgagataggcttggtggtcgcattcatactgacttctcatttggctgtccagttgacatgggagcctcatggctacatggagtttgtaatgagaatccattggctccattgatacgtggcctggggctttcattatatcgtaccagtggtgacaactctgtcttatatgaccatgacttggaaagttatatgctttttaacatcgatggtaagcaagttccacaacagatggtcattgaagttggagacacctttaagaaaattctggaagagacagggaaagtgagggatgagcataccgaggacatttcagtttcccaagctatttcaattgtgctagataagcaccctgatctaaggcaacaaggacttgcccatgaagtgctacaatggtttatatgcagaatggaagcttggtttgctgctgatgcagatatgatttcactgaaaacctgggatcaggcaagtgccaatctaagttga

SEQ ID NO: 18489 - DNA, 357 bp, Glycine max
  Peptide Sequence Number=SeqID_135267
atggctacgatcggacacaacaatctcaatgccaaattggttcttctcggggacatgggtgctgggaaatccagcctcgttttgcgctttgtcaagggtcaatttctcgaatttcagactattatagagaatgtgaggaattccggttggtcacaacctgatttgatcatggaggctatgatggaatcaacaataggggcagcgttcttttcacagacgctggcagtaaatgacgcgacggtaaagtttgagatatgggacacagcaggacaagagaggtaccatagcttggctcccatgtattacagaggtgctgctgctgctatcattgtctatgacatcactagctcggtatga

SEQ ID NO: 18490 - DNA, 243 bp, Glycine max
  Peptide Sequence Number=SeqID_135268
atgaacatgtggaaaaggttgggattggaggctaagggatgttgtgttggttgtatagtgaagggacaatatggtggttttggttggaatagggatggacgtgggttgttcaaagatgttggtgtggtgaagagtggaaaaaggccttgtaagggttttggagattcatgtgttgtagggcaatctattgtggtggagagggtttgcttaagccgaaaagggtgtgaatcctatgaaaattga

SEQ ID NO: 18491 - DNA, 741 bp, Glycine max
  Peptide Sequence Number=SeqID_135269
atgctcctttctctttctctctcactcactttctttctctgtacaagttggaagctttctctctctcaaagcagcaaggtcctccaccaccatcacctccaatctccgtctttcacacagagagagatactatgtttgaacaagttttgggcttttggtggtaatgtggtggctatggataatgactcgtgtggagtggggttcatggcggaactgtccaacgaaagtagctgcaaaacggtgattgatgttttggagatgctggtgcgcatggacccttcggacattggtattaggcttttggagccactcaaggcggagttccctattttgagctatgccgatttctacccggtcacgggtggacctgaagttccattccaccctggaagagaggttaatttagaatactttgttagagttgtgttcaacataaatgatgatggggagttttgccccaaaaagtttcaattttttagaacaaacacattcacggaaaaagttgcaagttccagatgtggagttttcaaagcccggcttcaattactttctgggtgtagagctatcaagagaagggatatatatggtgcttgggagcaatatcttggactggaacacgatgacagtgctccaaaaaagtcctatgcagtcaaccaggaaataaattgttgctttgttgagtggatgtgcaagttgaggtgcaatatcaacaaaaggctctgttcttctatagtttcttag

SEQ ID NO: 18492 - DNA, 621 bp, Glycine max
  Peptide Sequence Number=SeqID_135270
atggcagaaccatcaaagaagcgaaagggggttgcgacttcatccgcagtcatcggaactcgaagccacgaaacatccaaatcgcagacatctcaaattcctccctccatatcatctcctacgttgttttcctcagaagaacaacgtatccggtacaattctcttttctcttctcgttccattattgaccctaaattcgtagacttagctttctttgatgatgaagtgtttgattgctttcaagcatttcaaaattcttgtttaattcagtttatctccatgaaacttcctttttaccctgaattggttgaagccttttattcgaacttggaaattcaagaagattccttgatttttgaagtttatgggattaagatggtcatagaccagtcccttttctttgaactcactcaattatccagtgacggtgtaccatttgagggtacacttgatgatgagtggaattttgatttttctgtttctgatgcccgccggatgctttgcaccaaccaaacggatatgaccggaaggcttcttgtcggttcattggcattcgaatgccgcatcatgcactacttaattatgcgcatcctactccctagatcttccaaccttgcacag

SEQ ID NO: 18493 - DNA, 156 bp, Glycine max
  Peptide Sequence Number=SeqID_135271
atgcgcacaagcaatgacaacacccttattagagatggtatcatatctcttgatgaagggaagatcaaacaggaaatctcagatatgctacaaaatattgagagggctgagttggaggttgaggttgagcttgagtgtgttccctttactcaatag

SEQ ID NO: 18494 - DNA, 204 bp, Glycine max
  Peptide Sequence Number=SeqID_135272
atgttgttgtggttcaacttgctcatcaggagcaacaactggttcttcctacaccaagtcattagtggaagcactgtcgtcaatactttagtgaaaggatgcaaacaaaggtatgaacatactttgcatgatattgttcagtttccatgtctggagctgaacgagatgtcgctccaatgttgggataagttgcaaattgtgtaa

SEQ ID NO: 18495 - DNA, 276 bp, Glycine max
  Peptide Sequence Number=SeqID_135273
atggcgaaaaagaatgaccatagtttgtctctgcgtgccatcggacacgatcatctccaaatggagaagaggtgcggaatgaccataatttgtcttcacatgtcatcgggctcgccgcctctggatggcaaaaaggtgtgcggaatgaccataatttgcctccgcatgtcatcgggctcaccgactttggatgacaaaaggcgcaaaatgaccataatttgtctctgcgtggcatcggaaacgattgtcttcggatggcgaaaaggtgcggaatga

SEQ ID NO: 18496 - DNA, 705 bp, Glycine max
  Peptide Sequence Number=SeqID_135274
atgggtggttggctttattggtatttgggcattttaattcacacacttcaattctcgtgttcagtcagaaccgtccatggcttgatcccacaatccccaatccaatgcagcagttcaggctgcaccctccgcaactcctacggcgcgtggggcgaccgaaaagactgttctgccctcaacgtgacatacccaacaaccgaagaacagctccgttcggcagtgtcctacgccgtcagaaacaacctcaaagtcaaggttgttaccagattctcccacaccattcccaaattatcatgcccacatgaaaataacaacaacaatattaatagcagcaccgccaccttgctgatcagcacggagaagtacgactcccgcatcgagatcgacgctgccagaatgaccgctacggtcgatgcgggtgtcggacttcgccaattgatcaacgcggtggaggaagctgggttcagcttggtggctgcgccgtattgggagggtgtcactgttgcggggcttattagcactggtgcacatggcagctcttggtgggggaaagggggttctgttcatgatcatgttgttggggttagtgttgttgttcctgcttctaaatctgaaggctatgccaagattttgaggctggaggggcaggatccgatgcttaatgctgccaaagtttcactcggagtgctgggtgccatctccaag

SEQ ID NO: 18497 - DNA, 1173 bp, Glycine max
  Peptide Sequence Number=SeqID_135275
atggttgatgataatttcctcaagaatttgggattagagaagggaacacggaaagtagtaaatcatgaggaaagaggtagagttttgcaggctatggatgggtgcagctataaagctgcagctggaggatctctttctaataccttagtggccctcgcaaggcttgctagtcgctcccaaaaagttcccgctataaatgtcgcaatgaccggtagtgtagggagtgatctattggggggcttctacagggagaaattacgccgagcaaatgtgcaatttctttctgcaccaatgaaggatgggacaactggaacagttatagtcctcacaactccagatgcccagcgcacaatgcttgcatatcaggttcagtacactacaaatgtcatctttcagcaggatattttaggcattttgaagtttcttttacctttattggctaattctatgagctctataaatagtgtagatgctaacatttctgtactccggtttcagggcacatcttcaactgttaactatgatgcatccttggctagtgcagtttccaagaccaacatacttgttgtcgaaggatatctatttgaacttcctgatacgattaaagcaataaccaaagcatgtgagaaagcacggacaaatggtgccttggttgcaataacagcttcagatgtctcctgcattgagagacactttgatgatttctggtgtcagatcacacacatggaaattattgggaattgtgtggatttagtctttgcaaatggtgatgaggccagagctctttgtaattttgaagcaaaggaaagtgctgcttcagctgcaaggtatctgagccactttgttcctctagcatccgttacagatggtcctacaggctcttacataggtgtaaaaggagaagctgtatatatccctccttctccatgtgttccagttgatacttgtggtgctggggatgcatatgcatctggcatactctatggtcttttaagaggcatatcagatttgagaagcataggctcattagccgctaaggttgctgccactgttgttggacaacagggaactcggcttagaatttcagatgcagtcaaattggctgaatcttttgaatttcaacttgattcctcctcctctgttggcactgatcataatatttccagcgtctaa

SEQ ID NO: 18498 - DNA, 588 bp, Glycine max
  Peptide Sequence Number=SeqID_135276
atgggagataatgcacgcgatgtggaagcctcaaaagttcaaggccttatacttactggcaacccttttataacattcgggtttgcatgcaccccattatacttcgtgtgggagaaagcaatagggatgcacgagtgcaagagcctatgcaagcgtgcattggtgagattaccagtggtgatccccatatggttcttggccatcatattccccttctttggtcccatcaactccaccgttggctctctccttgtcagcttcaccgtttacatcatccccgccctcgcccacatcttcaccttcagatcaccctcttccagacagaatgcagtggaacaacctcccaaatttgttggaagatgggtgggaacctttattatcaacacttttgtggtggtgtgggtcctagtcgtaggatttggatttggagggtgggccagcatggtgaacttcatacgccagattgacacatttggactcttcacaaagtgttaccaatgccctccaccgcttctaccacctatgccgccgcatcagctcaacgccaccgcgccttcgccacttcaccaccctcatcatgcacactaa

SEQ ID NO: 18499 - DNA, 381 bp, Glycine max
  Peptide Sequence Number=SeqID_135277
atgggggagctaaatgctcccaagattgataatactaatataaaaacaagcacttcaacgaatgaaacacggaatattttttctggcgaatctttgggcggcagtaggaagagaataagcaaaaagctagcggtggaagctgttcttctaggtgagtctcccatggctaaaccagctagatatgacccatctgggagcattgtttctcctccggttactgaacttgagccggaacccgtaactgtattatacacaacgccgttgtctgcacccgtgtacaccactgccccttcggatcctgttcctgtcactgtccctgaccctggcgatgttgtagttgaggtcatggggttggtggtggtatctcgtgaggatttctga

SEQ ID NO: 18500 - DNA, 382 bp, Glycine max
  Peptide Sequence Number=SeqID_135278
tgattcagaatggtatgacattcctgggattgatgaactttatgctcaagtgatatctcaagatctgtcagcaagtgttgtttggctattagctacagtcactagtctatgtcctaagtttgcaagtggccatcctaatgttgcagcaatctttggcattgtaacatgtgttattggcaatatgttcaatgaaggaggcaacagggaatccacattcattatcccgtgggccgtggttcttggatcaggcgcatgtgagtgtcaactgattcctgaggtttcagccttttggcagtggtcctttaagattccttattgtgtagagaccactttgagcaataatgcaccatataagggttatgatactcgtgttgtcctttag

SEQ ID NO: 18501 - DNA, 375 bp, Glycine max
  Peptide Sequence Number=SeqID_135279
atggaatccaacgccttttcacataattgctgtgctgccactgccactctgctagatctaggacataaacttgatgcgttcttcataagtttcaggaaaaaatcatcaggggcaaggtatggatctattagcatccatctctctcattgctctcctactccgagggaagcgcgtgtgaggcttttcggagccctgagtactgctgcagcggcgcgtatggctcacccgccacgtgtaggccctccatttactcggagatgttcaaggctgcttgccctaggtcgtatagctacgcatacgatgacgctacgagtacgtttacgtgttccggcgtcgattataccgttaccttctgtccttcctctccaaggttaa

SEQ ID NO: 18502 - DNA, 630 bp, Glycine max
  Peptide Sequence Number=SeqID_135280
atgtgggatctcaacaaatctctatctcttgctgttgctgctattgttgttgagatcattgaggagaaaccagaagaggagccagaaattacacacagagtatttttggatattgatattgataaacagcgtttaggtaggatagtgattggattatatggccaagttgtaccgaaaactgtggaaaattttagagctttgtgtacaggggagaaaggaaagagtgaaaatggcataaagcttcattacaaaggaacaccatttcatcggataatatctggttttgtgattcagggtggagacattgttcatcatgatggtaaagggtctgaatctatttttggtggcacctttcctgatgagaatttcaagattaaacattctcatgccggagttgtttctatggcaaattcaggacctgattccaatggctcacagtttttccttaccacagtgaaggccagatggttggatggagagcatgttgtctttggcaaggttgttcaaggcatggatattgtgtatgtaattgaagggggagccggaacttacagtggaaaacccagaaagaaggtggtgatagcagactctggggagataccaaagatccactgggatgaggaaacttga

SEQ ID NO: 18503 - DNA, 600 bp, Glycine max
  Peptide Sequence Number=SeqID_135281
atgacatgtttagtctttcttaggcatgacaatgaaatctgtatccacgggtatccgtccaaacttatcccgattttgttgggaaatagagttgaccgggtacgggttcgggattacggaatatccgacttttttaattggggtcgggagaggggacaaggatgtcactacctgtcccatacccgtcccgattatgaaaggacggggcgaggacgagaatacccgatactcgacggttatgaagatggggggattggacaacaaacacaaggtggggttgttgggattgttggaaatgggggtttggtgagacaaggtcaaggtggtgttggtgacggtggaaatgatgttgggaacaatgtaagagttgttagtaatgttaatattggaggagttagaggtgctagtggtggtggttatggtgctactactgctagttatggtggtactatattgtttgtgggtgatttgcattggtggactactgatgctaagctggaaactaagcttaataagtatggatctgtgaaggaggtgaattttttcaatgagaaggtgagtggaaagtcaatgggctattgtcacgttaagtttttttga

SEQ ID NO: 18504 - DNA, 450 bp, Glycine max
  Peptide Sequence Number=SeqID_135282
atgttgtgtagactcgctacccttttatcgcagtctcgcaccttttgttctctgctcgccgccacctccgtcttctgtgtcgcagtcccttcctctctctctccgaccacttactctatcgccgtgtttgctcactgttccgattctgcgttagcctttcacataacatcactcttgtcctctgctagggttcacaattgtttggtatctttctttgcaagggcctctctcttcctcattgcttttcacattctctgccagagagatctatacgatcaccaaagtttggttagtgcgataaagcaggtcgatgtggtaatttctactgtaggacacctgcagctagctgatcaagataagatcatttctgcaattaaagaagcaggaaatgttaagttgtggagtggaaattccattctgcttttgaacaatagagatgggaaggattga

SEQ ID NO: 18505 - DNA, 1164 bp, Glycine max
  Peptide Sequence Number=SeqID_135283
atgtctcctttggttgagtttgagagaggggaccgtaagttcggtctgtgtgttgatgtggactatgagaaagcttggtgggaaggtgttatattcgacgaccactgtgacggaatggagaagaggagtgtgttttttcccgatttgggtgatgaaatgcaagttggaattcatcggttgcggattactaaggactggcatgaagttactggggagtgggagcagcaggggaacttggtgtttcttgatttggttgaggagcggaagaggaaatcgtttgttgcagtttcggctaagcagatttggtatgatgtacgcataaaaaatggaattgagaagattcgagagtggacatgtaatatgaagtacttgtggagaaatctagtaatggaggtgattaatgactacttatctcttacggtaaatgaagttatcttagtgttgaaccttccatggagtttattaaatgaagcaccggaacccgaatctgttgaagctatggctagtgttgacttaagcgtgacctttcctgataaggaaattgttgtgcaaaaagaaccagttcctcctgttaaagaggtcttacccaagttgcaaaaagaaattggccccgggaatatctacttgctctcaaccgagcagatagggcattatggatggaaaaattacaaaaacatcttaaaatttcagaatccagatatctttcctccaactatttcatcttctctggttgaagatgaagttgaagatgtacctaagttttgtcctgaggctgttgagcagtattatcgctccggggatctagtttgtagatcagctggaaatcgaaagcggaagagcttggggaattcaaaggccaacatacccaagtgccaaagcaatggattggctccacgggtgaaaggcaggcaccgtaaagtctgtacttttgctgatgggaaaataactcgtgatggaatcaagtgtaactgttgcatgggaatatacagttttgttggcttggaaaatcatgctagtggcagtagtacctgcagaccctctgctggtatctttttggaagatgttgagaatgactacatttgttctgtttgtcactatggtggtgaacttattttatgtgataaatgttcgtcttcatttcataagacatgtcttggtttggag

SEQ ID NO: 18506 - DNA, 387 bp, Glycine max
  Peptide Sequence Number=SeqID_135284
atgaaaacaaaatcagattttgaatttcaaacttgggctaagcgcgcagttccactaagcgaagcgaaccgctttgagaaaccaaacgtctctctagctcacttagcactacagttcgctaagcgagagggtcaaaaattgcttaaaacactgtctgcatcctctttcttaccaaattcgtgcattcttgcattctttctttccacatcttctatgcatcttcagcacacaacaatccaaatggcatcaagaaaaaggaaaaccagggctagcacagatgacatcccttcaccatctactccagcacctccgactgcatcagcaggaccagatgcccagagctcccaaatcacaaccactatgctgcaaagcttatttcagggatag

SEQ ID NO: 18507 - DNA, 1785 bp, Glycine max
  Peptide Sequence Number=SeqID_135285
atgttcctcttgaacaaccatgttgatgttacctttcttctgttcctgtggctgtttggaattggatcctcatcagcttctatttacaacgctaattactgcccaaacaacacatcgtacaattccaacctaacattcgaaaccaatctcaaagtcctcctcgcatctatggtctccaacgtttcactgtctgacggctactatttcaccgccatgggcatggggaccacaagcgtcgccaacggcctactcctctgccgcggcgacgtctccaccgccacgtgtcacgactgcatctccaccgcagccacagagataacgcgacgctgccccaacaaaacagagtccataatatggtacgatgagtgcatgctccgtttcaccaaccgctacttcgcccccaccagcgtcgtgccaagagcaaacttaatggacggcaacaacatctctgcctccgacttggacagtttcaatcgcacgctgttcggcttgttgaacgatttgatcgaagaggctgcgaattctcggttggcgaggaaattcgccacaggccaaagagaattcgcagggcactcgccggagaacacggtgtatgccctgacggagtgcgagccggacttaacgactactcagtgtgaagagtgcttgcgaaacgccgtttctactcttccgtcgtgttgcggaggaaaacagggcgcgagggctctgctttcgtattgcaatgctagacacgaattgttcaggttttaccatacaagtgacacgtcaggaaataagaaatctgtatcacgagtagtcttgattgttgtccctgttgttgtatcgataattctcttgttatgtgtctgctatttcatattgaaaagatcaaggaagaaatacaacactcttctaagggaaaattttggggaagaaagtgccactttagagtcgttacaatttggtttggtcacaattgaagctgccacaaacaagttttcctatgaaaagagaataggtgaaggtggatttggagtggtttataagggtgttctccctgatggacgagaaatagctgttaagaaactctcaaaaagttcgggacaagattcccaccgaagcaagcaattgaattggtcggaacgttacaaaattattgaaggaattgcacaaggaatttcatatttacatgaacattcacgattaaaagttatacatcgtgatttaaaacctagtaacgtattgttggatagcaacatgaatccaaaaatttcagattttggaatggcaaggattgttgctattgatcaacttcaaggaaaaacaaatagaatcgttggaacatacggttatatgtcgccggaatatgcaatgcatggacaattttcagaaaagtcagatgtttttagttttggagttatagttttggagataattagtgcaaaaaggaatactcgttctgttttttcggatcatgatgacctcttgagttatacttgggaacaatggatggatgaagcaccattaaacatatttgaccaaagtattaaggcggagttttgtgatcacagtgaagttgttaaatgcatccaaattggtttattatgtgtacaagagaagccagatgacagacctaaaataacacaagttatttcatatctcaatagctctataacagagttgccacttcctaaaaaaccgataagacaaagtggaatagttcaaaagattgcagtaggggaatcgagttcaggttcaacaccatctatcaatgaaatgtccgtgagtatatttattccccggtag

SEQ ID NO: 18508 - DNA, 360 bp, Glycine max
  misc_feature (343)..(343): n is a, c, g, or t
  Peptide Sequence Number=SeqID_135286
atgtctcattcattttcaccaaattatcaacacacaatatcaccaagtcaatcaatatcgatcaatacacaagcgttatacaacatatacattaagactcaatcttatatgcaatgcggtaccatgttagtgaaaaatttcgtcgggcgcctaggagtacatgacaagacaaaccacacactagcaagtcaagaaaaccagtcagggtcagagtgttttgcgaaaatgctccaaccatatgagatcaacataggcttaaaggagcactcaaaccgggtgaccctcaaggcctacactttgaagagttcgtcagggcctctccctcctgattcagaagtccaanccaaaaaaatattttag

SEQ ID NO: 18509 - DNA, 302 bp, Glycine max
  Peptide Sequence Number=SeqID_135287
gtcttgtgggaagtgatgaactctatcaattcctagctttgcttacttccatgtctcagctcaagggttcttccaatgtctttaattctgttccttcaaataaaactgctgttgtcaatacagcttcttgtaatactgctgttgataatgcagcttcttgtaaatctgtttcttgtactacagttccttgtaattttgtttcttgtgctagtcctgttgttaatacagcatcttgtatggctgtttcttttagcacttggcattctagactaggacaccctagtgttaatgccatgaaagtt

SEQ ID NO: 18510 - DNA, 207 bp, Glycine max
  Peptide Sequence Number=SeqID_135288
atgtgcttgattgtgaaccaatactcatggaaagtgatgagggaggaggttctaaaaagggccgctgttcgaggcggcagaggaagaggaacagtcgccgtcgaagatcatgtagtcgacgtggacgacgatgttttcgacctacaggacaaaggagtggaagcggcgcttgctctttggagagtgaaggagcgtgaagaagagtag

SEQ ID NO: 18511 - DNA, 411 bp, Glycine max
  Peptide Sequence Number=SeqID_135289
atggcaaagtctaatagttcagacatagacatcaatggatcaccaaatgatgaagtatccttcctctcaaagaagctcaataagatgttaaagaagaaggataagtataaaaacttctctagaaagaaggacaagtatgagaaagacgagaacagctttcaccaatacatatatatccttggtagacaaaggattaaaggattcctactggtacttaggcagcgattgcttacaatacatgatgagagaaaagtctatgttttagacctcaaggcacatgaaggaataatcccctttggaggtagtagcaaggaacaaatcatagctatggccggtaagattggtaacactactagaaatatagcaatttacgacagggactctaggacggttgtttgggaactggcgtag

SEQ ID NO: 18512 - DNA, 378 bp, Glycine max
  Peptide Sequence Number=SeqID_135290
atggagagaattcttttgataacaaacaaccaaacacctcggccacacttgattcctcccaaaccggagccattgaaactgcacccaaaaagtccattgacacttttggatagagaacttcaatctaccgtggtggtttttgacttaattgaaggcataggtggacgaggaggaggttatgataaagaagaaaaggcagctagagcctacgatttggcagcactaaaatacaggggaacaaccacaacaacaaattttcgacaaggtctcaacgcccatgagcctgagaaggaggaggggggagggaatgaacttacaacatcaagcaccccctcctctggtggtcttagaggccagggaattttccatgagttataa

SEQ ID NO: 18513 - DNA, 195 bp, Glycine max
  Peptide Sequence Number=SeqID_135291
atgtatgcatttaaagacccaaacaggagttcccaattgcaattgatgcaatccattggagcctccaaggaatatcaggaacctgttcaacgatccatcctcatcaagaagcaactctgccttgtgatgacaagtatggaagttattttgtttaaggaggtcgacacaaggtacataatttgcgcattcacataa

SEQ ID NO: 18514 - DNA, 936 bp, Glycine max
  Peptide Sequence Number=SeqID_135292
atggaccaagctccgggaggattgcgcggatccgtgcatgacggcgctacgctcgagtcaattcaattcaacgaagaaattcagggaatcatggcgccggtgccggcgccggaaaacgctaactcgttcaccgcgctgcttgaactcccgccgacgcaggcggtggagctccttcactcgccggaatccgacagcgctcggaaaccgcctaattgccacgtcagcgcgaaccagaaaccctacctgcccaactctttcggcagcaatttaaccttcccttccaacgccgccttaatcgaacgcgccgcgaagttctctgtgttcgccggcgagaactcgccgcttccgccggaggaggcgtgcctggttccggccgggaccggttccgtttcgaatttggatagagtgaagaacgagccacaggagaccgattcgaacccgtgctcgagctcgaggctgggttgcatttcggatcccgcggtggagaacaacaatcagaggaccgccaagagaaaggagcgagagaagaagctaacagttaaaggatcgtcgaagaagagtaaaagcatcgccgatgagacctccggtgacggcgagaagcttccttacgttcatgttcgagttcgtcgaggtcaagccactgatagccatagcttggcagaaagggctaggagagagaagatcaacgctcgcatgaagcttttgcaagagctggtcccaggctgcgacaaggaagggctggaaggcaccccacttgtgtaccctagcccatattttagtcctgacccaaaaaaaagtctggaagctcataggctgagctttaagatgcaatattgtgtaccatccaatcaaatagagcttagcctacataccttgaacccagacaaaaaagatggattattcacggataagcaagccttaaacattgctaattaa

SEQ ID NO: 18515 - DNA, 372 bp, Glycine max
  Peptide Sequence Number=SeqID_135293
atgacgaacttacttggattcttgttagagagaagatgcgtgaagatgaagaagaagaaagaatgcacgaagttgggtgtgagagagaagatgcaggcagttcagctgtttctagcaaattctagcctaatcccgatcaagcatcgtcctcagattcctcttgttggactaaactcgacgagaaccgcattaaaaaaaacatataaacaactaggtcttcgcacaacaaaatctctcgaactctctggaacttggacctttctctctctagaaatctctaaacatgcaaaagcttcgagaattgcccaaactcctctccaaaatctgattacaggcttaaataggtggctttgtttgtgcttgcacgcttag

SEQ ID NO: 18516 - DNA, 1893 bp, Glycine max
  Peptide Sequence Number=SeqID_135294
atgacctccctcaactccgacggcctctccctgttagctctcaaagcggctgtggacgccgaccccaccggagttcttacttcctggtcggaaaccgatgtcaccccatgtcattggccgggaatctcctgcaccggcgacaaagtaacccaactctccctcccaagaaaaaacctcaccggttacatcccttccgagttaggcttcttaacctccctcaaaagactaagccttccgtacaacaacttttcaaacgcgattccaccatctctattcaacgccaggtcactcatcgttctcgacctctctcataactctctctccggttccctccctaaccagcttcgctctctcaagttccttcgccatttggacttatccgataactccctcaacggctccctccctgaaacactctccgatctcacctccctcgccggaaccctcaatctttccttcaaccacttctccggcgggattccggcgactctaggaaaccttccggtcgccgtcagcctcgacctacgcaacaataatctcaccgggaaaatcccgcaaatggggacccttttgaaccagggtcccaccgcgttttctggtaaccctggactgtgcggtttcccattgcagagtgcttgccctgaagcgcaaaagcctgggattttcgctaaccctgaagatggtttccctcagaaccccaatgcgcttcacccggatggaaattatgagagagtgaagcagcacggtggtgggtccgttgctgttcttgttatctccgggctctccgtcgcggttggcgcggtttcgctgtcgttgtgggttttccggcgaagatgggggggtgaggaagggaaattggtgggtccaaaattggaggataacgtggatgcgggagaggggcaagagggtaaatttgttgtggtggatgaagggtttgagttagagttggaggatttgctgagggcttctgcgtatgttgttgggaagagcaggagtgggattgtgtataaggttgtcggtgtcggaaaagggttgtcctccgcggcggcgaatgtggtggctgttcgaaggctgagcgagggtgatgccacgtggcggttcaaggagtttgagtctgaggttgaggccattgccagggttcgtcaccccaatgtcgttcctttgagagcttattactttgcgcgtgatgagaagctgattatcactgatttcattcgcaatggaagcttgcacacagccttacatggtaatggtgggccttccaattcattgccaccattatcatgggcagtaaggttaaaaattgctcaagaagcggcaagaggcttgatgtatatacacgagttcagtggtcgcaaatatatccatggcaacataaagtcaactaaaatcttgctggatgatgagctccatccatacgtctcaggttttggacttactcggctgggtttgggcccgacaaagtctgccacaatggcaccaaaacgaaacagcttgaaccaatcttctataaccactgcaatgagttcaaaggttgcagcttccttgaaccactacttggcacccgaggtgcgcaatactggtggcaaattcactcagaaatgtgatgtatattcttttggtatagtgctgttagaacttttgacaggtagaatgccagattttggagcagaaaatgatcataaggtactagagagttttgtaaggaaagcattcaaggaggagaagccattatctgatatcatagatccagcacttatccctgaagtttatgctaaaaagcaagtcattgttgcattccatattgctctaaactgcactgaacttgatccagagttgcgacctagaatgaaaaccgtgtcagagaaccttgatcacatcaaaatacagtga

SEQ ID NO: 18517 - DNA, 1370 bp, Glycine max
  Peptide Sequence Number=SeqID_135295
cagctatcgatcaaggtaccaaagcctactataactgcacaaggaacagcacttttgctgcctatagctcttaccgttctaacgtcaaaacacttctagattttctctcctccaatagcaccaacaatgccagattctacaacactacagtttctagcaaagacactgtttacggtagcttcctatgtagaatagacaccactccaaaacactgccaagaatgcgtgacacaagctgccaaactcatatcatcgctttgcaaaaatgctacagaggctatagtatggtaccaagtatgctatgtgcgctactccgatcgtcgtttcttctccaccgtggaggagagtcctaaactctcctttatgaatgataaagattatgtgggtaacgttgggctcttcaacaacattgtgtgggatatgatgaacgatttgagaagtgaagcagcaagtgctgctaataaatcggctgataagtctgtgaacatcattgataatgaaaaggtatatggctacgcttggtgcctcccatatctgtccaaagagaactgcagctggtgtcttagcgatgccatagcagaaattccaactggttgctgcagaggaaaatctgggggaacaataatatatcccagttgtggtgttagatacgaatcatatcaattccataaggcacaaatcaggggtggttcggtgacgccgccgccacttcccagtagtccttccccttttgcttcaccagttgggaatgacagtaccactctggaaaccttgcgatttgaattagccaaaattgaagctgctacaaacagatttgctaaggaaaacatgataggcaaaggcggatttggagaggtttataggggtattcttttggatgggcaagaaatagcagtgaagaggcttactggaagctcccggcaaggagcagtggagtttaaaaacgaggttcagtccgatgtgtttagttttggagtcatggttctagagattattaatggaaagaggaaaggttgttcttctgaatcagatggtattgatgacatccggagacatgcttggacgaaatggacagagcaaacaccattggaactattggatcctaacataggaggaccatattccggagaagaagtcatcaaatgcatacacattggtctgttatgcgttcaagaagatccaaatgatagacctacaatggcaacagttgtgttttacctcaacagcccttcaatcaacttgcctccccctcgtgaaccaggatattttaagcgcgatagaatacaagacaacaagacgacccacaaagaattggataatatcagtgattccatcaacggaatttctttaactaatttctttcctcgttaa

SEQ ID NO: 18518 - DNA, 1377 bp, Glycine max
  Peptide Sequence Number=SeqID_135296
atgtcgttgctcgtactcatcatattcatccatttctttttcagcttcttcagttttgccataatcgaggccattgaccttcactacctaaatcacagttgttcaagtaacaaaaccttcaccccaatcagcttctacaattccaacctccaaacccttctcacatccctatcttcccatgccaccactgcacaattcttcaacagcacaacgggtggtggagacaccggcgaaaccatttatggctccttcatgtgccgtggtgatgtcaccaaccacacgtgccaagaatgcgttaaaactgcaacccaacaaataactctacggtgtcccaactccaaagatgctttaatttggtaccacgaatgcttggtccgttactccaacagttgttttttctccaccatggaggaatggcctaggttcgacctcttggattattataacgtaactaagaattcaacaaaggaaggaagttacgggtggttgttagctaaaacgttgagtgatgcagtgggtgaggctgcgaacgctggccctgagggtaccatgaaatttgcaacaaaaaacgcgaccttgtctggatctcagagtttgtatactctagttcagtgcacgccggatctatcaagcaaagattgcagtaagtgtttgggtgatattatgagagatattcctttatgttgtcttggaaagtgtgcgatggttctatatccaagctgcactttgatgtttgggttaagtcgtttctacagagacgtcgttgctcttggagttgttggttctaatattggtacacaagaaccagaaccttcaggaaacaaaaacagttcatcacgaccaattgttatagttgtcatccttctcattttggcaacgctaagctttttgcaatgttatttcttacgaagaagagcaagaaagcgtcattataatattcttctaagagaaaactttggtcgtgaaagtgtcactctagagggattgcaatttgagttggctataattaaaacagcaacaaataacttttcactcgaaaacaagattggaaaaggtggatttggcgaagtttacaagggtattcttccttgtggacgacacattgctgttaaaagactatcaacaagttctcaacaaggtactcaacaaaacagtataagttggtctaagcgctataaaattatagaaatgattgctcgaggagttctttatttacatgaatattctcgacttaaaattatacatcgtgatctcaaacctagtaatattttattagacgaacatatgaatcctaagatatcagattttggtatggctagaattgttgaaatagatcaagatcgtggaaaaaccaaaagaatagttggaacatggtaa

SEQ ID NO: 18519 - DNA, 2001 bp, Glycine max
  Peptide Sequence Number=SeqID_135297
atggcttggaattcctctttcaagcttatctttctctttgtccttgttaacttcctcagttttgcaacacctaaggcacaacaggtccctacttttcttgcccaggattgcccaagcaacggaaccacagccaacagcaccttccaaataaacatcaggaccctcttctcttcactatcttccaacgccaccgccaacaatgtattctacaactccacggtggcgggagcaaacccctctgacactgtctatggacttttcatgtgcaggggtgacgtcccatttcagctgtgtggacagtgcgttataaacgcaacccagaaactatcatcagacttacagtgctccttgtccaaacaagctgtgatctggtatgacgagtgcatggttcgctattccaaccgctcctttttctccaccgtagacacaaggcctgctattggcctgttgaacagcgctaatatctcaaaccaggcaaacttcatgcgtttgatgttcgacaccatgaacgaaacagcagatgaagcagctattggtgccaagaaatacgccacgaagcaagcaaacatatctgggtttcagaccctctattgtctggttcagtgcacgccggacttgtcaacccagggttgcagaagttgtcttagtgatgccatagggctccttccatggtgttgtgaaggaaaacaaggagggagaattctaaatcccagctgtaatgttaggtatgatttgtaccctttctaccgcaccaacgtctctgcaccaccagcgtctgtccctccaaccgattcttctaattcgggaggaggaggtagtgaaatttcaccggggacaattgttgcaattgtggttccaattacagtggctgtgctgctatttattgttggaatttggctcttaagtaaaagagcagcaaagaagcgtaactctgcgcaagaccccaaaactgagactgagatcagtgccgtggaatccttgagatttgatttcagtacaattgaagcagccacagataaattctctgatgctaacaagctaggcgaaggtggatttggtgaggtttacaagggcttgcttcctagcggccaagaagtagctgtcaagagactctctaaaaactctggacaaggtggaacagaatttaagaatgaagtagaggttgttgcaaagcttcaacacaaaaatttggtgaggcttctaggattttgcttggaaggagaagaaaagatacttgtttacgaatttgtagccaacaaaagccttgactatattctttttgatcctgagaagcaaaaatcattggattggacaaggcgatacaaaattgttgaaggaattgctcgaggcattcaatatcttcatgaagattccaggcttaagattatacatcgtgaccttaaagctagcaatgtcttgttagatggagatatgaatccaaaaatctcggattttggcatggcaagaatatttggagtggatcaaactcaagcaaataccaacaggattgtagggacatatggttacatgtctccagagtatgcaatgcatggagaatactctgctaagtctgatgtatacagttttggggtcctcattttggagattataagtggcaagaggaacagctctttctatgaaacagatgttgctgaggatctgttgagctatgcctggaaactttggaaggatgaagctcctttggagttgatggaccaatcattaagagaatcatatactcgaaatgaagttatcagatgcatccatatcggtttactgtgtgtccaagaagatccaatagatagacctacaatggcatcagtagttcttatgcttgatagttactctgttactctacaggtacctaatcagcccgcattctatataaacagtagaactgaaccaaacatgccgaaggggcttaaaattgatcagtctactaccaattcaacatcaaagtctgtcaatgatatgtcggttagtgaagtagatcctcgataa

SEQ ID NO: 18520 - DNA, 825 bp, Glycine max
  Peptide Sequence Number=SeqID_135298
atgttgttactcattcaccttttcattctgggcttcttcaatttttccacaacaaccgaagctactgaccttaacagtaactacttgaatcatagctgttcaagcaacaaaaccttcactccaaacagtgcctaccaatctaacctccaaaccctcctcgcatccctatcttctcacgccaccactgcacaattctacaacaccacagcgggtggtggagacgtcggtgaaaccatttatggctccttcatgtgccgtggcgatgtcaccaaccacacgtgccaagaatgctttaaaactgcaacccaacaaataaccctaaggtgtccccactccaaagaggccttaatttggtaccacgaatgtttggttcgctattccaaccgttgttttttctccaccgtggaagagtggcctaggtttagcttcatggattataacgtaacgagttcaacaaaggaagaaggaagctatgggttctggttgttatccaaaacgttgagtgatgcagtgggtgaggctgcgaatgctggtcctgcgggcaccatgaaatttgcaacaaagaacgcaaccttgtctggggcccaggaagtttatactcttgttcagtgcacgccagatctatcaagccaagattgcagtaagtgtttgggtgatatcatgagagatatccccttgtgttgtcttggaaggataggaggaatggttctatatccaagctgcactttgatgtttgggttaagacatttctacagagacgtcgttgctcttattggttctaatggaacacaagaatcagaaccttcagatagtgcacttgtatga

SEQ ID NO: 18521 - DNA, 285 bp, Glycine max
  Peptide Sequence Number=SeqID_135299
atggaagataaattcatggatgatttgatgatcgatgaaagagcattccatcttcaaacaagtgaatcagatattcctcagctgcctgtgaaagctaagcctgacccttaccactccaaacagcgccttccaaatgaaaacttgaggagccttctatcttatctatcttccaacgccactgctatcaagcaattctacaacaccaccgtcgccggtagaaaccactccgacactgtctacggaatgttcttctgctggggtgacgtccccctctcacctctgtag

SEQ ID NO: 18522 - DNA, 2338 bp, Glycine max
  Peptide Sequence Number=SeqID_135300
atggccatcagtacccttggtgatggaaaacaaggagcacagtccctgcttccgggttgtaatcttagatatgaattgtaccctttttacaatgtttccgccgtatccattcagtcagagcttacccctccccctccccctccatcttcagggaaaatcagtatctctataattgtggcgattgttgtccctattgtcgttgcgattatactattcgttgttggcgtctacttcctacgtaaaagggcaagcaagaagtataatactttcgcccaggattcaagtaatctctccttttccgtggtagcaattgttccggttgtggatgatcttatagatgtggagtccttgcaatttgacttggctatggttgaagctgctacagaagggttctcagatgagaacaagattggccaaggtggatttggagtggtttataagggtgtcttccctaacggacaggagatagctgtgaagaggttgtcagtaacctccttgcagggtgctgtagagttcaggaatgaagctgctcttgtggccaagcttcaacatagaaatttagtgagactattgggattttgcttggaggtgattgatttccctgaacagactgatattgacacctcacaagcagaatcacttcattgtgtattcgcatgtggttacatgtctccagaatatgcaatgcatggacacttctctgtgaaatcagatgtgttcagctttggtgtcttagttttggagattgtgagtgggaagaagaacactgatttttatcaatcaaatcatgctgatgacctcttaagccatgcttggaagaattggacagagaaaacacctttggagtttctggatccaactctgagagacttaggcttcgtcgtcaatgtcctcaacaccatgcacttgcagactggtgacattgctaatgttgaggtgcatcttggtgacggcgttacagggcgtcatgtcgggcacggtgagatctgggtggtggaagttagatttggtggcgaggtggtgagatctggtggcatggacggtgtaaaggcggtgaagggtggtggctgtgaagggataagggacaatttcggagagatgtgcatatccaaatcctcttcaacccacttgctgcttctatctctcttcaacttgctaacatctgcaagtcaagcagctcctacatacagcgcacatgcctgctcggatgaaggatcccattaccgacccaacacaacattcgaaaccaacctcaacatccttctctcatccctcgtctccaacgccaccctccaccacggtttctaccgcacaaacgtctcccttggaacctccgatgaggtcaagggactcttcctctgccgcggtgacgtcaccccctccctctgtctcgactgcgtcaccgccgcagcaaaaaacatcacaaacttctgcaccaaccagacacagtccataatctggtacgacgagtgtatgctgcgttactccaacagttccaccctcgacaacatagtcccaagtgtcggcatgaagaacgaacagagcgtctccgactcggactacgcgcggttcaacgatgttcttgcgtccacgttaaatgatttaaagcaggaggccttgaactcttcttcttcgggtaagaagtttgctacaaaagaagcgaatttcacgagctcaatgaagctctacaccctggcgcagtgcacgcccgatttgtccacttctgactgcaacacgtgcttctcaagctccatcggtggctttccgaactgctgtgacggcaaacgaggtgcacgggtcctgcttcctggctgtagtgtcagatatgaactggcgagccctagtgcagcggtaaagttgtgccttggtgacttgttggtcatgggttcgaatccggaaacagcctctttgcatatgcaaggggcaagcaagaagtataatacttttgtccaggattcaagtaatctctccttctccgtcctagcaattgttccggttgcggatgatcttaccgatgtcggcgatgtggagtccttgcagttcgacttggctacagttgaagctgccacagacagattctcagatgagaacaagattggccaaggtggatttggggtggtttataagggtgtcttccctaacggacaggagatagctgtgaagaggttgtcagtaacctccttgcagggtgctgtagagttcaggaatgaagctgctcttgtggccaagcttcaacatagaaatttagtgagactattgggattttgcttggagggacaagagaagatccttatctatgaatacataccaaacaaaagccttgatcgctttttatttg

SEQ ID NO: 18523 - DNA, 369 bp, Glycine max
  Peptide Sequence Number=SeqID_135301
atgcacatagtagtacggcatggagaagcaagtgaaatccagaaaagattaagtcaaaccggaaccactgaaaatatccaaaagagaatgcacagaatattacaaataacaaaatttgtccctattggtagacaatcttattctagcaagattgcactaccagcacaaatcttctcatatgaaatcgttaagcgttaccctctcctgagtggcctaacccttaaaaccgattcacgcattcattccttatccctaattaggctttaccctctcccgagtggcctaaagactaacagaaaacaaggtccgagatgcagaataagcaagaaagaaaagcagataagagaaacgggaagaaaaaccctctaa

SEQ ID NO: 18524 - DNA, 2607 bp, Glycine max
  Peptide Sequence Number=SeqID_135302
atgcctccttgcaagtactttgcaattccctcgattctcttcttcctcctaagcttcttaatctttccaaccaaagcagctccaatttacagttcccatgcgtgcacagactcttctaaataccaaccaaacagcacattccaaaccaacctcgacctcctcctctcttacctttcttccaacgccacccaaggcgtccacttttacaaaacaacagttggcagtgaaacccccaacgccgtcaagggcctcttcctctgccgccgagacaccctcaccgccgtgtgccacgattgcgtcaacgccgcagccaaagacctgacacgccggtgcccagttgagaaagaggccataatctggtacgacgtgtgcatggtacgctactccaaccaaaactacctcaacaacatagtacccgcagtggacatgtctgactccaaaagcgtggctggcgctgatcttgaccggttcaacgaggtgctggcgggattgttgaacgctctggcaacgaaagctgcgaattccgaggatgagaagttcgaaacaggggaagtgaacttgacgagttcagtaaccctttatgggttagtgcagtgcacaccagagttgtccttgttcgattgcaacatgtgtttcagaagcgccattgcatctgttccaaattgctgtgatgggaaacaaggggcaagggtgttgcttcccggatgcaatatcagatatcaagtgtatccattttacaatagcactaaaatattggccacaccggttgtgaagtctcgtccttcaggacggagtcgggttgaagtgattcttacatttgttatccctattgttgctgccatggtgcttttcacttttggtatatgtcatgtcatgagaaagcaagcaaagagtctgaaacaattatggaggaaaacgacactaaaacgagggacagagatgttaaacttgaaatcctcttcatcccacttgctactcctctttctcttcaccttggtgaccattgcaagtgaagcagcagctcctatatacagcgcacatgcctgcacagatgatggaccattttaccaacccaacacaacataccaaaccaacttgaagctcctcctctcttccctcgtctccaacgccaccctccaccagggcttcttcctcaccaacatctccctcggaaaccccgatgaggtcaagggactcttcctctgccgcggtgacgtcaccccctccgtctgtcacgactgcgtcgccgccgcggcaaccaacatcacagacctctgcaccaaccaaacagagtccgtgatctggtatgaccagtgtatgttgcgctactccaacctttccttcctcaacaacatagtccctggagttaacttgaattccgaacagaacgtctctgactccaacaataccggcttcatcaattttcttgcgtccacgttgaatggtctggcacaggaagccgtgaattctctttccgggaagaagtttgctacaaaagaagcgaatttcacgagctcgatgaaggtctacaccttggcgcagtgcaggcctgatttgtccacctttgactgtaacatgtgcttcacaagtgccataagtaacctcggtgatggcaaacgaggtgcacgatctctgcttccgagttgtaatgtcagatatgaattgtaccctttttacaatgtttccgcagtgtcctctcacccagccccagaccttccccctcctccatcttcagggaaaaacagtatctctataatcgtgccaattgttgtcccaattgtcgttgtgattgtacttttcattgttggagtctgcttcctacgtaagagggcaagcaagaagtataacacttttgtccaggattcaattgtggatgatcttaccgatgtggagtccttgcaatttgatttggctacaattgaagctgccacgaatggattctcggatgagaacaagattggccaaggtggatttggtgtggtttataagggtatcctccctaacagacaggagatagctgtgaagaggttgtcagtaacctccttgcagggtgcagtagagttcagaaatgaagctgcccttgtggccaagcttcaacatagaaatttagtgagactgttgggattttgcttggaggggagggagaagatccttatctatgaatacataacaaacaaaagccttgatcactttctatttggtgttaccgtttcccttattaaagaacagccacgttgtaggggtggttacatgtctccagaatatgcaatgcgtgggcagttctctgtgaaatcagatgtgttcagctttggtgtcttagttttggagattgtgagtggcaagaagaacacggatttttatcaaccgaatcaagctgatgatctcttaagctatgaaaatccatctgacagaccttcgatggccaccattgcacttatgctgaacagttattcagttaccttgtcaatgccacgacaaccagcatcttttctgcgcggaagaaatcctaacaggctaaaccaagggcttgactctgatcagtctaccacttgttcaattccatggtctgtgaatgaagtatccattacagacatataccctcgctaa

SEQ ID NO: 18525 - DNA, 1971 bp, Glycine max
  Peptide Sequence Number=SeqID_135303
atgattaccaagtccaaacagagtctaactctgttcctactttgcacccttttactcaccatagcagaaacctcggcatcagtgttcaacaacgttagctgcacgagcaacaagactttcactccaaacagcaccttcaacaccaacctcaacacccttctctcctacctttcctcaaacgtaaccaacaacgttagattcttcaacgcaaccgtagggaaagattcgaacaccgtctatggcctctacatgtgccgtggagacgtgccgtttgctctatgcagagagtgtgtgggttttgcaacacaaacaataccttcgtcatgtcccacatcaaaagaagctgtgatttggtacaacgagtgtttgttgcgctactcttacaggttcatcttctctaaaatggaagagtggccaaggcacaagatcaatattccattgggggatcctgtggttttgcatagtaatggattctacactgcgttaggatccattttcgatgaattaccaaataaagcagcactggatcttagtgagtctaatggatatgccgttaagcaagaaaatgcttctggcagtgtaacactgtatggtctcgcgcagtgcacgccggacttggctgccggagactgcaaactgtgtgttgccgatgcggtggccgagtttgtcaagtcttgttgcggagggagcataggggcgagtgttctgtttcccagttgcattgtaaggtatgagacgtatccgttttatcagcattcgggaacctctgcgccaacaatgattcagcgtggaagaaatattggaactgaagtgcttgtgatcgttgttgtcttgcttgtggttttggcgatgctttttggctttggctattgtttcatccggataaaagcgagaaagaaacgcaaggccagtgacagagaaaactttgggccagaactcactgtcttggagtctttggaatttgatttggctacaattgaagcagccacaaacaagttttctgaagaccgcaggataggcaaagggggttatggagaagtctacaagggaatccttcctaacggagaagaagtagctgtaaagagattatcaacaaattctaagcaaggaggggaggaattcaaaaatgaagtgttgttaatagccaaacttcaacacaaaaatttggtgagattaataggattttgccaagaagacagagagaaaatacttatctatgagtatgtgcctaacaagagtcttgaccacttcttatttgattcccaaaagcacagacaattaacttggccggagcggtttaaaatcgtaaaaggaattgcaagaggtattctttatctacatgaagattctcgtcttaagattatacaccgtgatatcaaaccaagcaatgttctattggacaatggcatcaatccaaaaatctctgattttggaatggcaaggatggtagctacagaccaaattcaaggatgcacgaatagagttgtgggcacatatggttatatgtctcctgaatatgcaatgcatggacaattttctgagaagtctgatgtattcagttttggagttatggttcttgagattattagtggcaagaagaactcttgttcttttgaatcatgtcgtgttgatgacctattgagttatgcatggaataactggagggatgaatcaccatatcaattgctggattcaactctgctagaatcttatgttccaaacgaagtggaaaagtgtatgcagattggtttattgtgtgtgcaagaaaatccagatgacaggccaacaatgggaacaattgtttcatatcttagcaatccttcatttgaaatgccattccctctagaaccagcattttttatgcatggcagaatgagaagacattcagctgaacatgaatcatcttcaggttactacaccaatcatccttcctcgtcctctgtgaataagatgtctacgactgctttctag

SEQ ID NO: 18526 - DNA, 1473 bp, Glycine max
  Peptide Sequence Number=SeqID_135304
atggcttccttaaagcttgtgtacatctttacccttctcagcttcatcaatttcgtaaccactaaagcacagcacggtcgtggttattcattccccgattgttcttcaagcataaccaccccaaacagcccctaccaattgaacttgaggagacttctgtcttatctatcttccaacgccacttctagcaggcaattctataataccaccgtcaccagtagaaaccactccgacagtactgtctacggaatgttctggtgcgggggtgacgtccccacccagctttgtagcgagtgcgtcgcaaacgcaaccaaatcaatattctcagatccagattcttatccaaattgttccttgtccacagatgcgaggatttggtacgactactgcatgattcgcttctcaaacagttctttcttctccacagttgactcaggactaatcagcgctggatgcgaccctttcgatgtgtccaaccagacaaactgggtgagtgtgctttccaaaacgattaacgaagcagcagatgaggcagcgaattcgactgttaaatatgcaacaaaggaagcaaggatatccggaggatttcagagcctttactgtgaggcacagtgcacacctgacctctcaccccaagattgtagaaaatgtctaaatgttgccataacctattctcaacagtcctgtcaaggcttcctggactattattctctcagctgtacaatcatgtgcaattcctaccctttctatcgccccggtactgctccggcaccaaaaggactcgttccagctctcacgaattcttccaatgttacagatcactcacaagatcctgcagcttatctttcccacaattgttccataaacaagatcaccaccgacatcacttttctgtcaaatctcaagacacttctctccttcttgtcttctaattccaccatcaaaaccagtttcaagaccaccgtcagcacgatcggtggcctcttcatgtgcctcggggacctttctcttaccctttgccagctttgtgtccaagatgcaattcaaagaatatcctcagagtgcccttcctccaaagaggccatcatttggtacaatcactgcttgcttcgctataacgataccccgtcttactccacactcaacacaagtagcccttcctatcgcgacttccacaccctcaatactaccaaacccaaccagcttcaaagcttcttcacttggactctggccaatacattatacaaagtgcagtatgagacagatgacagtaccattaagaattatgcaaaaaaagaagaaaaactgaatgatcaccaaaccctctatactcttgctcagtgcacgccagatctaagggacaagtactatatcctagctgctttatcaagtttggattgtccccattttacacagatgcttcccaagatgaggctcgcaggccagctacaggtgatgttccctccgttttaa

SEQ ID NO: 18527 - DNA, 2037 bp, Glycine max
  Peptide Sequence Number=SeqID_135305
atggcttggaattcctctttcaagctcctctttctctttgtctttgttagcttcctctgttttgcaacaactaaagcacagggccctaattttctttaccaggattgcccaagcaaccaaaccacagccaacagcaccttccaaataaacatcaggaccctcttctcttcactatcttccaacgccaccaccaacaatgtattctacaactccacagtgacgggaacaaacccctctgacactgtctatggacttttcatgtgcaggggtgacgtcccatttcagctgtgtggacagtgcgttataaacgcaacccagaaactatcatcagacttacagtgctccttgtccaaacaagctgtgatctggtacgacgagtgcatggttcgctattccaaccactcctttttctccaccgtagacacaaggcctgctattggcctgttgaacagcgctaatatctcaaaccaggcaaacttcatgcgtttgatgttcgacaccatgaacgaaacagcagatgaagcagctattggtgccaagaaatacgccacgaagcaagcaaacatatctgggtttcagaccctctattgtctggttcagtgcacgccggacttgtcaacccagggttgtagaagttgtcttagtgatgccatagggctccttccacggtgctgtgaaggaaaacaaggagggagaattctaaatcccagctgtaatgttaggtacgaattgtaccctttctttcgcaccaacaccattgcttcctccccagcccctacgcctacaccatcagtctctgttcctccaactccaaccacttcttctaactcgggaggaagtggtggaatttcatcgggtacaatagttgcaattgtggttcctattgcagtggccgtggtgatatttgttgtgggcatttggatcttatgcaaaagagcagcaaagaagcgtaactctgaacaagacccaaaaaacatgccgtttctcttcttagctggaactgagatcagtgccgtggaatccttgagatttgatttcagtacaattgaagcagccacacaaaaattctcagaagctaacaagctaggtgaaggtggatttggtgagggcttgcttccaagcggacaagaagtggctgtcaagagactctctaaaatctctggacaaggtggggaagaatttaaaaatgaagtagagattgttgcaaagcttcaacacaggaatttggtgaggcttctaggattttgtttggaaggggaagaaaagatacttgtctacgaatttgtagtcaacaaaagccttgactatattctttttgatcctgagaagcaaaaatcattggattggacaaggcgatacaaaattgttgaaggaattgctcgaggcattcaatatcttcatgaagattccaggcttaagattatacatcgtgaccttaaagctagcaatgtcttgttagatggagatatgaatccaaaaatctcggattttggcatggcaagaatatttggagtggatcaaactcaagcaaataccaacaggattgtagggacatatggttacatgtctccagagtatgcaatgcatggagaatactctgctaagtctgatgtatatagttttggagtcctagttttggagattttaagtggcaagaaaaacagctctttctatgaaaccgacgttgctgaagatctattgagctatgcctggaaattttggaaggatgaaacacccctggagttgctagaacactcattaagagaatcatatactccaaatgaagttatcagaagcatccatattggtttgctttgtgtccaagaagatccagcagatagacctacaatggcatcagtagttctcatgctttctagttactctgttactctaccggtacctaatcagcctgcattatttatgcatagtagaactgaatcaaacatgctgaagtgggtgcaaattgatcagtctattaccaagtcaacaacaaagtctgtcaatgagatgtcgcttagtggagatattcctcgataa

SEQ ID NO: 18528 - DNA, 129 bp, Glycine max
  Peptide Sequence Number=SeqID_135306
atgaagtcgaagagggcttcaatgtcaaagagagggagggttcaaacgaaggagcaagcagaaagggagggttcaaacgaaggagcaaggagcaagcagtctagggttcaaagcaatcttgaaagctag

SEQ ID NO: 18529 - DNA, 414 bp, Glycine max
  Peptide Sequence Number=SeqID_135307
atgcagcaaagcagcatgatttgcactgataacactgaacaagtttatgtggaagcttatacgtgtccctgtgtgaggcgccacccatttgattcaacttttgttgcccaatcaaatgggaattatgttgcaatctttactaccaacccaccttacagactcaacaaatgtaagcgatatgagggacatgtggtctctgggttcccagtcaagtgcaatttcagcttggatgggaaaaaactcgcttctggctcttcagatggttctatctacctttatgattatcagtcatccaaagttgtgaagaaaatcaaggcccatgaccaggcatgcatagatgttgccttccaccctgttatacctaatgttattgcttcatgctcatgggatggaagtattttggtatttgagtag

SEQ ID NO: 18530 - DNA, 204 bp, Glycine max
  Peptide Sequence Number=SeqID_135308
atgccagctattgtgttaaaggatttggattcctcattggctggttcaaggaagctttttgttgagcccaaaaatcttgttgtgggttgtactggtgatacaaattcaaatttaagttgttttcacagggtgaagttgctaattctactgattaatcatactgaagttgaagctaaagctgaagctgctaattctactaattaa

SEQ ID NO: 18531 - DNA, 774 bp, Glycine max
  Peptide Sequence Number=SeqID_135309
atgtcacaagtatctattgaaaggatgacgaaaatgagacataatctgttaaacatcatatgtccattggaggtaaacatatggttgtggcatggatacttactgaagacaactacgcttacctttttcttgtttataaacttagggagtatcttggatgctgatatacaccataatattttatcattgttgaaaagtaaagcaaagggtcatcaaagcccaaacctgatatctgaaaagctatctgcaactctatacgggcatacaaaagctgtcaatgctatacattggtcatcaagtcatgagttagcttacagctcacctccttgcatctgctgggatggatcatgcggtttgcatatggaatgtatggagcagaaatcagaagaaagcatgtgtgctaaacttccacaatgcagcagtcaaagatgtgaaatggtctcagcaagggcacttcctactttcttgtggggattggagactcaggttttcagagaagatcaaattgttggagttataaagttccatccagacaattcaaatctcttcctttctggagggtcaaagggccaggtcaaactttgggatgccagaactggcaaaatagtgcacaattataatcgaaatttaggtccaattctggatgttgagttcacaatgaatgggaagcaattcatttcttctagtgatgtatctcaaagtaatgccagcgagaatgctattattgtttgggatgtgtcaagagagataccattgtctaatcaggtgagataa

SEQ ID NO: 18532 - DNA, 483 bp, Glycine max
  Peptide Sequence Number=SeqID_135310
gtagagcagaccttgttagactatctcactcaagtggggatagctaacaacatattgttgccaactctgggggcagcagctaattttgagctgagacatggcttcttgcagatgatagaaagcaatcagttccatgggacagactctgaagaccccgtggcacacctgaagaggttcctgcagttgactggcaccatcaatgtgcaaaacatgcccacagagtatagggatattgggaatttagtgcaggagcaggatagtttgggtgaagcatgggagaggtttcaagagttgctccggagttgtccacgtcaaggtttcagcccacagaggattgtgcaaatattctatggaggagtgtcctctcataataggacaagcctcgatgctgcttgtgggggaaatcttatgctgaagcaaccaagatcactgaagatatgtcctttgacccctacaacaattatggggataggaggattgtga

SEQ ID NO: 18533 - DNA, 624 bp, Glycine max
  Peptide Sequence Number=SeqID_135311
atggtcattctgtggaattttgtgcaatggaattcagtggttggtaatgcctcaagagaaataaacggggcacctcttgtccttataaatggtcaggagggaaccatcgggtcccacgcccacattacagttggcgtgcatcgtgtggcgcttgctgtcccacgtggatatcttgaatctgatcacagacgtcaattccaagcggaacaccacgctaccgtcagccctatcgctctggaactccgaccagcgctgactactaacggtcaacgtcgccccactaagatcgccgtccacttccgtcgtgttcttgggctgctgataaaacgggcccggtatgttgaactcgtggatgtggaacctgggcctgtggggccggaggctgagccagaggatgaaggtgatgaggcccacaatgaaaagaaggcccaagaaggtggcacagatcatcttggagacgcgggttgtgaggctttcgtggacacggtgggcatagtaccgcatcgtgtggtgccggttcagtttaacgggcttcgggttcggaccctggacgtggtgaacggctaccccaacaatgtaaaactaacgtttactaccttaaaagactgggaacagacatcataa

SEQ ID NO: 18534 - DNA, 1206 bp, Glycine max
  Peptide Sequence Number=SeqID_135312
atggattcgaattcgcgttaccatgttcagcagcaacaccaacaacccaattctgggttacttcgatttcgctctgcccctaccgcgaatttcaaacaacaaggcgaagttgctgccaatactaatgggaacgcatgggagggctctgaaccatttttgagattcttgaattccggggacacccacgatacgacgtcgtcgcctaccttacgagaattcgtggataataaggtttctaataatagtaaacctgcgaaggagtcatcagcatcatcacctctgagtcgcatgaattcccaacaggggtatagcgcttctatgttaccctctcggagtactgtaacttcagctatgatgttgggttctatgggaatcgatcaaagtgcgaaaagctttgattccaattctctcaggcaaagtagcttccctgctggccatttctctaacaacatctcctttcagaacgggtatgatgctatgaaaggtgttggaaactatagtggggtcaatggcaatgatggtgaacttagtctatctatgaacagaatgaagaatcacattagcttctcatcaataagtccttcttcttccttgggaatgctatcaccaacctccaaaatgggcacggagggtattagggtaactagacctgaggatgggagacagggaagttgcaatggtgatgctcgatattatggtcctggattcccttatgcttcttggaatgagccctcacaccccaaaagacagcgaagtagtaatgatgagttactttttgattctcagtttcaattagtgttctttatgcaaatttgctggcgtactcagaatggagagccaggaaatcaagttcaaaggctttcgcatcatttgagtttgccaagaacgtcgtcggagatgtttgctatggataatttgcttcagttctcagattctgttccttgtaaaatcagagcaaagagaggctttgctactcatcctcgaagcattgccgaaagggtgagaagaacaaggatcagtgaacgaataagaaaattgcaagagcttgttccaaccatggacaagcaaactagcacagcagagatgttggacttggctttagactacataaaagatcttcagaaacaattcaagactctgagcgataaacgggctaaatgcaaatgtataaacatgcagaagtcagaagcagatcgagttgcttga

SEQ ID NO: 18535 - DNA, 1080 bp, Glycine max
  Peptide Sequence Number=SeqID_135313
atggagcactcgatttcaaacccaccccttcacgaggcatacaagatcctcttgagcaagactaacggagagaatggtttcgatgatcagttcttggtggaggagtgcgagttgcctttgatcgatgtgagtcgtttagcagagagtggtgatgaagtgaggagggaggagtgcaaatctgagatattcaaggcttctcaagaatggggtttctttcaggtcgtgaagcatgggatttccaatggtgttttcagtgggttgaagcttgagcaggagaagatatttaagcaaccctttgagaagaaaaccaaagagaacaagttcttcaacttttccgctggtagctaccgttggggatccctcaatgctacatgcattaggcagttatcttggtcagaagcatttcatattcctttaactgatatgctgggttctggtggatccgacacttttagcgcgacaattcaacagtttgctacccaagtttccattctgtcaaaaacattagctgatattctggctgagaaaatgggtcacaagtcaacgttctttgaggagaattgtttgcccaggtcctgttatattagattgaatcgatatcctccctgccccttggcttctgaagttcacggattgatgccacacacagatagtgccttcctcaccatcttacatcaagatcaagttagaggtttgcaaatgctgaaagatggtaaatggattgctgtaaaaccaaaccctgatgctcttataatcatcattggtgacttattccaggcatggagcaatggagtatacaagagtgtggagcatagagttgtgaccaacccaaaattggagaggttctctgtggcgtatttcttttgcccttctgatgatacagtgattgagagttgcagtacagagccgtcgttgtacaggaattttagctttggggaatatagacaacaagttcgagaggatgttcacaacttgggctacaaaattggcctaccaaagtttctcttaagcacaggggacaagatagtgtgcatgaatatgtatcacgagttcaattttccaacctctacgggaacctaa

SEQ ID NO: 18536 - DNA, 210 bp, Glycine max
  Peptide Sequence Number=SeqID_135314
atggtggagacgtggagtttagcatcagcatcggttttttatggaggagatagggcaagatgttggatagctctagatcgatgccacacaacctcgtctgttttccttagctgtcatgctattcagtatttgcaatgtggtgaagatgatggttcacccaacacagaatctgaccggtcacaatttgttacagatccgcattttatgtag

SEQ ID NO: 18537 - DNA, 450 bp, Glycine max
  Peptide Sequence Number=SeqID_135315
atggatctgagtcttgtgatggagaatgataaaacactgtgtatggaagtggggttctttgactcttttcaagaaatcaaagaaaagatagagaagttcacgggcattcccacttacaggcaaacgctactcttcaacggccaagttcttcgaaacgaggccatcatcttcaacaccgacatcagtgaagcctctcgcgttcatttccttcttgatgcggatttcggcaaccaccatgacgagattacggacatgcacataccaagcggagaggagttagaagagttgatgcggtggaatccagacgggagcgtgacaccgatgacggtcacagagaacgcgttgccgccgcggaatccagagtttacaccgtctccgccaccaccgctgcatgaaacagaaattacaccgggaggatctgtttctgatgaacggaaccctaaagaatag

SEQ ID NO: 18538 - DNA, 569 bp, Glycine max
  Peptide Sequence Number=SeqID_135316
atggatgctgctgtcccttatcacacgaagcacaaacaaccaagtccaccagcacttttcaatggcccttattggcgcttcatcaagaagctttgcatgactcagcttctctcgagctcgcaggtcgcgcacttcgtgcacgtgcgagagcaggagataaatagcctcttgaaaaatgtcatggtttgttccaatgaaggtagggttatggatttgagctttgagctcactgctttgaccaacaatatcttgtgtcggatggctatgagcactagctgtttggacagagttgatgatgctgcggaggttcttggcttggtgagggagtttttggggaaatttgactattttggctatgggaagaagcttgtcagaatagttgacaaatttgataaggttttggagcgtatcttggaggaacatgaagtgaaaaacacgggacatgatggatattctgtttcaagatattttcctagcgggttgcaatgggcaatggcggaaatcatgaacaacccaggagtgtttgaaaaggtgaagccagagattaacacagtggtgggaactaacag

SEQ ID NO: 18539 - DNA, 648 bp, Glycine max
  Peptide Sequence Number=SeqID_135317
atgcccgaatcacgcgaccgtcgcataaccgtcgtcgacctcgccgccgccatcgcccgccgccgcgcctcattcatctacatcgattctccgccgctccgaacgcctcaaagaaccgccgccatcggccgtggaagagctagcggttctcccggctctcagaacacacctccatcaactgctcgacgtggtagaggacgcgttccgtcacgcaacgtgcttcccgcgtggtaccctaggacaccactccgtgacattactgttgtcgttcaggcgatcgagaggagaagagcgaggtcaggagaagccgaaggccagcgaatcggaagcaccgatcctgcttcggatcgattagttacagaaccttccgaacctgcttctgctgattctgcggtgaaatcgccgaaatccgttggtgtgaagctccgaacgccgttcggcagcaaagtgccgaagatcttcctcgacatttcggagttaccggaagacgacgaatcggagactctgacgccgcagaagaagcttcttaacaacatcgatcaggttgaggaagccgtgcgcgaagaactgaagaagctgaagagaactccgagtgcgaagaaagcagagagggaaaagcgcgttcgcacattgatgtccatgaggtga

SEQ ID NO: 18540 - DNA, 711 bp, Glycine max
  Peptide Sequence Number=SeqID_135318
atggatgaggtgtcggagttgccgccgaggttgagatggagaagacaagcgttagagaagaagaagaaagggatgagtgacttggtggcggcaccggagaagacgcaaccaacgaatgagtggtcgccgccggagtggacgacaatcgtgctggaagtgaaagttcctgcgtgcaaagaacgcatccctatagaaatggacgtgaacgacaccgttctgaagctgaaggagaaggttcttgaacaaaaagaaatgtaccccgtaccagtggagagggttgtgttgcaaacgcacaaaacgcatgtcgaattgctcgaccaacagttactgaatgattgcccggttttcgattttcccagcaatgagatcgacgtgtacttaaagcctccgcagcggccgccgcggccagtggtgttgaaggtgacggtgttgccattgaactcgaaggagaagatagagatggaggtgaaggctgaggacaaggtggcggtgttgagggagaagctggagctggttcaccggacggttaggtttcgtcttcctactcgcggtcgttattttttcgttcacaagctgagtctgatggatgaaagcatctcgtttcgatgccacaatgttcgcaacggtgactccattggcacatactgggcgacagatcataacgacgtcgctaaagaagatgatgacaacgacgttgacaccattggttag

SEQ ID NO: 18541 - DNA, 834 bp, Glycine max
  Peptide Sequence Number=SeqID_135319
atggtggtgaaagataaagcagagaatgaggaatctccgttggtgtgggccttactctgggccattgggggcccagtggcagaagagctttcaagaaactatataagtaggcgtgaaggctggctagtgactcacacagtcacagtgattgagatggagattaagtttcagatccagagagggcactcgttcaatcttgaaattgatccctccgaaacaatccgcgatgtcaaagagaaggtgcttaactcccagaacattcccattgcccgccaaatcatcctctaccattacgaacttctcccagacgatttgatcgtttcgcaatgcgatctccagcatggcggctgccttgtcctccaaatcagccacgatcctgcagcaccgtcgcccatgtctgactcagactcagactttctcccgcaatcgcagccaacgccggacatgcagatgtccaagctgattccgaatccatacgatccgttaggtaagcggccgatgactctagatatttcatccgcgtcaaataaaaaggttgaggagaaattggaagattcacgctcacggattgtgacgctgagcttgaaggcgcataaatactggactcatcgttttcctatggaagcgaacttggacgagaccgttctgaagctgaagaagtacattcttgcagatctgagaattcttgcaggctttgagatggacaatgtgccagtagagaggatggtgctgcactcgcattcaacgggtgtggaactgcttgaccatcagcttcttcgagattgtgcggtttcagataatcatgagatcgacctctccctcaaggaaccctag

SEQ ID NO: 18542 - DNA, 1347 bp, Glycine max
  Peptide Sequence Number=SeqID_135320
atggaagtaattcttgagattctgggagggaactcgttctttattgatgtcggtccctggttctttattgaagttggtcccttagacacagtcctcgatgtcaaagagaaggtgcaaaaccttcacaacatacccatttcctaccaaacctttctcttcaatggcgaaatcctccaagacgatctccaagtttcgacatctggaatcgatcgcggctcccgcattggcctcctagtcgccccacctgatgatgcaaaccttgcgccgccacaaccgacgctgacaccgccatggcacacacgtccgttcgggatgccggagtttccaccgtcgttgcatctcaatatactaccacacgtttacgatccgtttggatatggaatgccaaatataccggagttttcatcgttaacggagttgaggccgatgccacagatgccgcaacagcttccgtcatcatcaacggaggagatgccggtgccgtcaaatagcaatgagtttgaagaaccgctgcctgacttgacggaggcgtcaccgccgtcagagacggcggtgagagtgacgttgaacgtgaaagtgcctgagatccaagatcgcatccctatagaaatggagtttgaagacaccgttctgaaagtgaaagagaagatagttgcgcgcgaagaaatgcgaggtgtgccagtggagaggatcgcgttgcagtcgcattcagcgggtgtggaattgcttgaccatcaggttctgcaggattgttgttcggttttagagaataacgagatcgacgcattctctaaaacgtgttctgagaagcggatggtgaacgtgaaactgcctatgtcgcaaaatcgtatccgtatagaagtggaggtggacgacacctttcggaagctgaaagagaagattgttgcgcttgaagggatgcaaggtgtgccggtggaaaggatcctgttgtatccgtgttcaccgattcctcaaagcgtgttgaatcctattttctacgtgtacttgaaatcatctgttccggtggccggtggtggcagtagtagtgcgtcgtctgggaagatgacggtgtatctgaagccgaacggtctcccaaagtgttatccattacaggtgaatgccgtggataatgtgtcggcgttagggcaacagctggggctgttgctacagaatcacccgcttcgtcttcccccaaatgaggtttttttcatggtttacaagggtgagtggatgaatgaacaagagtcctttgagtggcacggtattagggactgtaccaagattgcaacttttgttggatgcgttaatgattcaataaccccaatatttcgtcccaacatacgctag

SEQ ID NO: 18543 - DNA, 1047 bp, Glycine max
  Peptide Sequence Number=SeqID_135321
atggaccattgggggcccactttcaagaaactatataaagcaagtatgcatgaacgctggtttcccaaaccaatactcactcacacaatcattatgaagattaagtttcatgtcaggccgggagcgaaagttttctctctgaaagtattacgctctgaaaaaattcgcgatgtcaaagagaaggtgcaaaactctcagcgcattcccattttccgccaaattttcctttacgatgacaaacttctccaagacgaatggaccgtttcgcaatgctatctctacgatggcgcgttcgttctcctccaagtcagccccgaaaatcctccgtcgccggtgtttccgccgtgggatccctccttgcagctgattccgccgcaaggctttaactatcctcttgcgataccagggtatccctcgtcatcggaggtgatccccatgccacaaccggcgtcacagacactaccgcggctgccaacctttcggcctcatccttcaccgtcgcatatggttccaaatccgttgccacctccggcgtcacagacactaccgtggctgccaacctttcggcctcatccttcaccgtcgcatatggttccaaatccgttgccacctccggcgtcacagacactaccgtggctgccaacctttcggcctcagccttcaccgtcgaatatggttccaaatccgttgccacctccttcctcgacggtgaccctgaacgtgaaagtgccgaggttgcaagatcgcattccttttgaaatggacaaggtcgaaaccattctgcatctgaagatgaagattgctgcgctccaagaaatgggaggtgttccagtggagaggatcgtgctgcagtcgcctttaatgcgctcggaatggcatgacgatcaggttctgcaaaacattctttttactgggagtgctgacatcgacgtgttcttgagaccttctctgccgcagcagcagccgcatcatcatcatcctcgtcacgccgtgcccaaccctagttgcatagttacgcgccacaagccagctagtttctattcataa

SEQ ID NO: 18544 - DNA, 345 bp, Glycine max
  Peptide Sequence Number=SeqID_135322
atgaagaatttggaagagtcgccggcaccgtcggacatgcagacgtcgcaggtgattccgaagccatacgattcgtcacggattgtgacgctgagcttgaaggcgcataaatactggaaagatcgtttccctatggaagcggacttggacgacaccgttctgaagctgaagaagttcattcttgcatcaatgaaagttcttgcaggctttgagatggaacatgtgacagtagataggatggtgctacactcgcattcaacgcgtgtggaactgcttgatcatcagcttattcgagattgtaatgtttcagagaatcatgagatcgacctctccgtcagggaatag

SEQ ID NO: 18545 - DNA, 1560 bp, Glycine max
  Peptide Sequence Number=SeqID_135323
atggctgattaccaaggcaccatcatacttttcatcatatggctagtctccacaatagtggttcgagccatagtcagcaaaaaacagaacaagactaatagaccaccaagtccactagccttacccatcattggacatctccaccttcttgctccaatacctcaccaagctcttcacaagctctccacccgccatggacccataatgcaccttctccttggctccgtgccatgtgtcgtggcttccacaccagaagccgccaaagaattcctcaaaactcacgaaaactccttctccaaccgcccgcaaagttttgcggttgattatctaacatatggctcgcaggacttctctttcgcgccatatggaccgtattggaaattcatgaagaaaatatgcatgtctgagcttctggggggtcacacactgagtcagcttctacctgtgaggagacaagagactttaaggtttcttagacttatgcttcagagagggaaggcagctgaggccattgatgttgggagagaactactgaggctctcgaataacgttgtgtcaaggatgattatgagccaaacgtgttctgaagatgatagtgaggctgaagaggtgaggaagttggtgcaagacactgtgcatctcactgggaagtttaatgtttcggacttcatttggttccttaggaagtgggatttgcaggggttcgggaaaggactcaaggagattcgggacaggtttgatgccattatggagagggcgatcaagaagcatgaagaggaaaggaagaaaagaagggaagagggtagtggaggagagggtcatatcaaggatctacttgatgtattgttggacatacatgaagatgagaactctgatattaaattgactaaagagaacataaaggccttcatcttggatgtgtttatggcaggaacagacactgcagccttaacaaccgaatgggctctagctgagttgattaaccacccacatgtgatggagagagcaagacaagagattgatgctgtgatagggaatggtagaatagtagaagaatcagacattgccaacctttcttacctgcaagctgtagtgaaggaaactctgaggattcaccccacaggtccaatgattattagagaatcatcagaaagcagcactatctggggctatgagattccagcaaagactcagttatttgttaatgtgtgggctattggaagggaccctaatcactgggagaacccacttgagttcaggccagagaggtttgctagtgaagagggaagtgggaaggggcagttagatgtgagggggcaacattttcacatgattccatttgggagtgggagaagagggtgtcctggaacctcactggctttgcaggttgtgcaggcaaaccttgctgctatgattcaatgctttgaatggaaggttaaaggaggcattgaaattgctgacatggaagagaaaccagggttaactctttcaagggctcatccattgatttgtgtccctgtgcctaggcttaatccttttcctaatatatcaaatgcctaa

SEQ ID NO: 18546 - DNA, 498 bp, Glycine max
  Peptide Sequence Number=SeqID_135324
atggcgacgtacgctgcgatgaagcccaataagcctggcttggaggagtcccaagaacagatccacaagataaggatcaccctttcctccaagcacgtcaaaaatctcgagaaggtttgtggggacttggttcgtggtgcaaaggataagaggctcagggttaagggacctgtcaggatgcccactaaggttcttcacatcactaccaggaagtccccctgtggtgaagaaagtcaaggcgaaagtagtgaccgaaaatatctcctaggtggtgaaatgtcaaagatgaggaaccatggaaaagaacttgcttatgaaaaagaactttgtcaattgtcttttgcaatatctcttagtttgcaaggtctggattgtgctaaagggaaagcttgggagagggtgattgacctctacagttccccagatgtggttaagcagattacctctatcacgattgaacctggtgtggaggttgaggtgaccattgcagatgcttga

SEQ ID NO: 18547 - DNA, 459 bp, Glycine max
  Peptide Sequence Number=SeqID_135325
atggtctgcgagaagtgtgagaagaaattatcgaaggtgatagtaccagacaagtggaaagaaggggccagcaatactaccgagggtggtggccgcaagatcaacgagaacaagcttctctccaagaaaaacaggtgctatgcatatgtggaatgtgcttactctgatttggagatattggtctcaagattccctgcacaattatgtcactgcatactcggtttgatggtttgtactaatggctgcatgctaagcggtgcaaacttcaaaactgttccaacatgtgggctggtctatcatagatggaccccttacggaaacactaagtgcaccatttgcaagcagcaagtgcaccagaatgctaagtactgccacacctgtgcttactctaaaggagtttgtgcaatgtgtggcaagcaagttcttgataccaagttttacaagcaaagcaatgtgtaa

SEQ ID NO: 18548 - DNA, 476 bp, Glycine max
  Peptide Sequence Number=SeqID_135326
acaccatcgacaacgtcaaggctaagattcaggacaaggagggaatccccccagaccagcagaggctgatcttcgccgggaagcagctcgaggacggacgcacccttgctgactacaacatccagaaggagtcaactctccacttggtgttgcgtcttcgtggtggtatgcagattttcgtgaagactcttacgggtaagactattaccctcgaggtggagagctctgacaccattgacaatgtgaaggccaagattcaggacaaggaaggcatcccaccggaccagcagaggctgatttttgctggcaagcagctcgaggatggaaggaccctcgctgactacaacatccagaaggaatcaacccttcaccttgtcctccgtctccgtggggggttgaagtcggtcattgatagatgttatgtaaaggcaacaatgaaatttgaacaaactgagatcattgtggtgatcaattga

SEQ ID NO: 18549 - DNA, 252 bp, Glycine max
  Peptide Sequence Number=SeqID_135327
atgggtactgttccagttttgaaggagcgggagatggaaattgggtacccgacagatgttaagcatgtggctcacattggatgggatggcccctcaggaactggacccagttggatgaatgattttaaaacagcgcctgatttttcaacgtcactaggtaacttgggtgaactaaatgaccccaatggtatggctgtcaccgcatcatggtcctcccaagataaaattgtgaggcttccaaaagctatctag

SEQ ID NO: 18550 - DNA, 531 bp, Glycine max
  Peptide Sequence Number=SeqID_135328
ctaaaggcatcaagtgaggaagaggctgaaacccctgaggagagtgaggaggtgcaagccttgaaggaggaacttgaaagagtgcaagcagtcaaggaaaagttgaagacgaaaactatcaaggtccgaaaagaatgtgaagaactgagaggcgtcaatgtggccaccaccgaagcattggaacgggaaacaaagaggggccaaaaggaagaatggagccgaaataagtggctgaaagcttggatgcaagagttagcttggctcccgaagattaagacatcaagtgaggaagaggctgaaacccctgaggagagtaaggtggtgcaagccttgaaggaggaacttgaaagagtgcaagtgtcgcaacgtgcccttttgcgggcgagcgaggcgaggctcacgggtgcgttttccaaaggaggaaagatgcgcggagtcgccaccgacgtttatttgtggaaaacgtcggaaaaaccgaaggaagccgatcaaaatgaaaattctaagtttgggagttgtatttacgcttga

SEQ ID NO: 18551 - DNA, 378 bp, Glycine max
  Peptide Sequence Number=SeqID_135329
tcctacggagttcccatcacccctattaaggtaatccggccgccgatcacccgagccttcatcgagaagtgctgcacgcctaggcaggcgcagggtgatgcacatcaggccgtaggcgcaccgccacctcctcggcaagccgatccagctgggccactgggcatggagcagccaaccaccgtgggtaggtgcagatacatgagtgtctctaccggttcagcctcaatcagtaggggcagggtcgcatggcctggagactggcctgatgcccaggcaggggaggagcctgcaggatcccccggtgagacagatgaatcccgtatggatgaagatatgactgacctgctcggtttcttgggagggatcggagccgcgtga

SEQ ID NO: 18552 - DNA, 1368 bp, Glycine max
  Peptide Sequence Number=SeqID_135330
atggcttcttcaaagaccaccaacccaataacaactactacacaattggaaccactccctccacctcaacaccgtcatcatcctcatcatcttcatcagttacaacaacagcaacaccaacatcattatcatcaacaaattcatgaccatcaaatttcttttggactgatgcaatcctcttcttcatcttcctctatccccggaaactacctcggaagcaaggattccggggcttatgacttgggtgaattggatcaagcctttttcctctaccttgatggacaagctgacccttctagtgttcaagaccaaagacagaactcatcatcaggaatgaggcctccgactctcaacattttcccctctaagcctatgcacgtagagccatcatcatccaagtccaaggctaacatagagctagtttctccacaaacaagtggatcaaagagaccatcagagccgtcgatggagttggctaacccccgaaacgaaactgcttctgcccctcaaccacccaaacctgtcaagcgagagggcaatcgcaaaggtccaacgtcaagttctgaacatgaaggacctaaaacaccagatcctaaggtggcaattgatgctaatatatgcgctttaaaacgttgtgcacagacactcagaagacttgctcagaatagagaggcagctaggaaaagcaggcttaggaaaaaggcctatgttcaacaactagagtcgagtaggattaggctgaatcagctggaacaagagctacaacgtgctagaactcagggcatgttcttgggtggaggtgcactcttgggtggagagcaaggacttcctgtcactatgaataccattagcacggaggctgcaatgtttgacgtagaatatgctagatggcaagaggagaaccaccgcatagtgtgtgagctaagagctgcagtgcaagagcaccttcctgagaacgagcttagactttttgttgacaattgtttggcgcattatgaccaagtgatgaacctcaagagcttagtggccaaaacagatgtgttccatcttgtttctggcatgtggaagaccccagctgaacgttgcttcatgtggattggtggattcaggccatctgaactcattaagattattgtgagtcaaattgagcctctcaccgagcaacaaatattgggcatatgtggattgcaacaatctacacaagaagcagaagaggctctctcccaaggactcgaggctctcaatcaatctctctcggacactataacatcagattctcttagttatcctcccaatatggctaactatatgggacagatggctgtggccatgaacaaactctccactcttgaaggtttcgtgagacag

SEQ ID NO: 18553 - DNA, 624 bp, Glycine max
  Peptide Sequence Number=SeqID_135331
atgacccaaaagttaagattggaaagtgctgtgacaaagggcatagttggattgtgttcaaaaaccatagctgattgtattgaagccctcataggcgcttattatgttgggggtgggcttactgctgcacttcatgtaatgcagtggctgggaatgaatgttgggcatgattcaccattggtacatgaagccatcaccaggacattattaaggtccaatgtcccaaaagcttattatatcaattccttggaactaaagcttgggtatgaattttccactaagggtttgttattggaggccatgacacatccatctcagcaagagctggaaccgggaatttgttattgttaccaggctcttggggacatggtggaaagcattgcaggggccatgctcgttgataccgagcttgatattgagaatgtgtggagaatctttgaaccattgttgtctccaattgtgacccctgataatcttgaacttccctccctctgtaaactgaataaattgtgtgattgtcttgtctactttataaaagagacatccacaaaagagggggaaattcatcatgttgaacttcaattgcagctggaatattttttttttggtaggaagagggactga

SEQ ID NO: 18554 - DNA, 162 bp, Glycine max
  Peptide Sequence Number=SeqID_135332
atgagacgtgatgttgcagtgacgtggtggtcaagagcgacgtgcgccactattaggatgttgttgcggaaacattgggtcgttggttcagatctagacgaaggtggtgatgcgcggtgttggtgcagtggtgttgggttggatggggcaagaagaaggtaa

SEQ ID NO: 18555 - DNA, 1236 bp, Glycine max
  Peptide Sequence Number=SeqID_135333
atgacggaaccaacggagccatgcacgtcatcttccttggcaagggacccaaccaccgtgatccacccaaggcgcgagcccttcgagcacggcctcttgccgatcccgcgcctcatcttctccgacccggcgcaaaccctaattccgttgaagcagaagcttctcgagtcttcctccaaccagcgagtcgactcagcggcaatctccgagtcacttcagatctccattgagcaagccaggctcgtcctcgatactcttgcctcggttctgcactccgacgccgaacctctcgtcgccgccaagctcggagaaatcgattccgtcggcgtcgacgtccatgatctggttttgttcctctacattcaatcctacaagaggctcctcccgcgcacgcacaaggactccgccgccgtcgccgatgtctggccttccacctccgccttcgacggctacttgtccgcactctcgccgcttcaggttgatgaagaggcgcatcagctgtcgtatctgcaaaaacatttagctaacattgtatctcttgtagcacagcctgtggagggagaaggcgaagaatctctgaatcggtctggattgccgatgaagatcatggaaacattggattgtgcatttcaagtgagcggggatgttcatgggtttgcgggttgggttttaaccatggatagatttgagcaccttgggtttctaattcagtttggtgataagggatctgaaggaaattcttttagtcaatcttctcccttttttgcaaactcagaccctgatatgcctgctgttcctgttcctgctgctcaagttcatgattggcttctacagaatatagctgctgctttggaatatatttctgaacgaacttcttctaaggagaatggcccagctagtgcctctgatcaggatgttgctatgactgatgcatgcactacctcagttaacaaggtctcaacaagtactagaagtgcaagtttcattgaagggatctccaaatcgtcatatgtgaagcatgcatctgacattaaaggttcctctgttaaggttctaaattgccatgagtctgccatatacatcttagcacctttgagatatgcaactgtctatggatgttcagatgcaacagtagttattggagcagttggcaaggccatggtgcccacaattgctcatggcgcccaatgcgctgatggcagaaatgacagaaaactcacttacacagacacatag

SEQ ID NO: 18556 - DNA, 981 bp, Glycine max
  Peptide Sequence Number=SeqID_135334
cgagtcgactcggcggcaatctccgagtcactgcagatccccattgagcacgccaggctcgtccttgataccctcgcctcgattctgcactccgactccgaacttctcgtcgccgccaagctcgaagaaatcgattccgtcggcgtcgacgtccatgatctggttttgttcctctacattcaatcctacaagaggctcctcccgcgcacgcacaaggactccgccgccgtcgccgatgtctggccttccacctccgccttcgacggctacttgtccgctctctcgccgcttcaggctgatgaagaggcacatcaattgtcgtatctgcaaaagcacttggctaacattgtgtctcttctagcagagcctgtggagggagaaggcgaagagtccctggttttaaccatggatagatttgagcatcttgggttcctaattcagtttggtgataagggatcagaaggaaattcttttagtcaatgttctcctttttttgcaaactcagaccctgacatgcctgctgttcccgttcctgccgcacaagttcatgattggcttctgcagaatatagtgtctgctttggaatatatttctgaacggacttcttcaaaggaaaatggcccagctagtgcctctgatcaggatgttgccatgactgacgcaagcactgtctcagttaaggtctcaacaggtactagaggggcaagtttcattgaagggatctctaaatcgtcatatgctaagcatgcatctgacattaaaggttcctccgttaaggttctaaattgccacgagtctgccatctacatcttagcaccattgagatatgctactgtctatggatgttcagatgcaacaatagttctaggagcagttggcaaggaagatgatactgatatgatgatagctgtcaagtgggcatgccttcaagtgactgagatttccttaggatttatagttctattgggccaatttggataa

SEQ ID NO: 18557 - DNA, 603 bp, Glycine max
  Peptide Sequence Number=SeqID_135335
atggtggacgcagcagaacgtagatacttggaggatgatgattcatctctcatgaaaactatcaagggcgcaacaactggtttagtggctggaactatctggggtactgtagttgccacctggtatgatgtcccccgtgtcgagagaaatgttgctcttccagggctgattaggactatcaggatgatgggcaactatggtttgacctttgctgccataggaggagtctacataggtgtagagcagttggtgcagaactataggatgaagagggatttagtcaatggagctgttggcggatttgttgcaggtgcaactattctgggttacagagatgcattggcacttttgatgtcttgcagggaagccaatctattattggctcttctttggcttgcaagaattgatcttcttgtggttgtatgtgtgtgtttatgtgtttatggagggacaggaaggagcatcaaaactgcactttctgctggatcagcattggcattcacatctgcattccttgatttcggtgatcagacattaaaacatgatgctgggaaggagtatgcggcttacaccacaaagaaaagacccagtactgatgcataa

SEQ ID NO: 18558 - DNA, 1107 bp, Glycine max
  Peptide Sequence Number=SeqID_135336
acacctcaccttatcactccatcacctatggcttcagacgcaaaactctcatcttctgagtccctcaacggtttgaaattcggccaaaaaatctattttgaggatgtgggttttgctactcccgctacctctcttacttcttctgctactactgctaccactgttacttcttcttcttcttcctcttcaagaaaaggaagaggtggttctgttcaaccagctcaacctccaaggtgtcaagttgaagggtgcgaagtagatctgagtaatgcaaaaacttactattctagacacaaagtttgtggcatgcactctaaatcccctacagtcattgttgctggtcttcaacaaaggttttgtcaacagtgtagcaggtttcatcagcttcctgagtttgatcaaggaaaaagaagttgccgcaggcgactagctggccataatgaacgtcggagaaagcccccacccagctccctcttgacctctcgctatgctagactttcttcatctgcttttgatcatagtggcagaggtggcaactttctgatggaattggcttcatacccaaaacttagtctgagaaattcacttccaactcctaggtcatccgagctagcgcctggaaatcaaacctccaccctcagctggcacgggaactcggagacatcatctgaccttttcttgcaaggttcggtgggtgggacaagcttcgccggcccgggacatcctccaggggaaagttacactggggtcaccacctcgagctgtgctctctctcttctgtcaaatcaaacatggggttctagaaacccagcaccaagtcttgggttgaataacatggtaaatttccacgggacgcccatgacacagcctgctgcatcatctcatggtgcatcaatccatcaacttccaaataccccgtggtgtttcaagggcattgattctggtaactgttcgcccgagggggtccctgatctaggtctcggtcagatttcgcagcctctcagtagccaacttcacggtgagctggacctgtcccaacaaggcaggagacattatatggatctagaacagtccagggcatatgaatctgctcattggtcactttaa

SEQ ID NO: 18559 - DNA, 1815 bp, Glycine max
  Peptide Sequence Number=SeqID_135337
atgatagttgagaagccgaagagaaaggtgtctgcttataaaaatataaaaaatcttttaagggacctttcatacaataatttctcaggagatctgccgttctcatttggttccttaagaaaccttgccagattgaacattcaagataatctgtttagtggcattcttccacagcattttcaatccatactgaatttatggattggcgagaataaattctatgaggcggacaactctcctccctggagttttcctctggatactgtatcagttgagcataacactagtagcccacccacaactcaggcaaatgctataaagaattattcccctcccagagtaagtgaggctcctcccagagtaagtgaggatcttcccagagtaaatgaggctcctctcagagtaagtgagcacaagaagaaacgtataggtcctggaggaatagcatgtatgattggtggaggaacactgatggccaccggagtggcgctctttgttgcaacccgattgaataaatgtcgtgaagagagcccgaactcgaaaagctcagaaagcaaccatggctcattgcattctcatccgatcagtgaagccatagggatcacttctaacgcactagaggagaggcagagtccacaagtcccccccattaattccgcatcccttttgggccctgtgggattgccttccctgaaccataacaatacagaggaaccattaagaagaagtttttccaaaagaagcagattcactggaaggacgaaagtttacacagtagaggagcttcagttggctactaattgcttcaatgaagccaatgttcttggagagggatctcttggccctgtttatagagctaaatttccagatggcaaaattttggccgtgaagaagataaacatggcgggcatgtccttcagagaagaggtaaagttcttggatattattggcacgatttccagactgaagcaccccaacatagtagcactcaatggttactgtttggagcatggaaagcatcttcttgtttacgattacgttagaaatttcactctgaacgatgctcttcacaatgaggcatacaaatctctgccgtgggtccaccgtctccggattgctctaggtgttgctcaggctctggactatttgcatgcaacgttctgccctcccgtggcacacggaaacttgaaggctgtcaatgttctactcgatgaaaatttgatgcctcgtgtttgtgactgttgcttggctattttgaaaccactgatcagcaatcaagtcgaaattccggctgatgagattaatattggagagatagtctgcgttacaccggatcatggccaagcaggaaccagcagcagaaagagagacgtttttgcctttggggtattgcttctggaactgttaacaggaagaaaacctttcgatggagccaggccaagggacgaacaatatctggtgaaatgggctccacccttgcttccttacagagcaagtttggaacagctggtagatccccgtatggaaagaacattttcatccaaggctctttctcgttatgctgatatcatctccctctgcatacagaaatgtcaagggtgtgtagctgagttggttgaacaagatcctgtaaagcaactacgtcctccaatgtccgaagttgtggagtctcttgaagctttataccaaaagttcaacattgaaaagagcgatgtagcagatggcactgaagtggatccatttgagaggtctttccattcgaccaacatatgctttatgggttctccaccggcagtgagccatgcatcagcctga

SEQ ID NO: 18560 - DNA, 402 bp, Glycine max
  Peptide Sequence Number=SeqID_135338
atggtgaaagtaaaagttctgataaaagaatgtttgtttacacactttcagggaagaaatatagttgtaaaatatgctgattcccaaaaaggtaaaactggccagccaccatttcctgctggagtggttccgatggcagcattacctatgaacccaggatatatgcagcagcctggaaaagctaatgttagttcaaggcccccaatcaattacagttacccccaaactgtagcaccatattctgcacttccttatccaaaccctcccactgctccctctccttatccgacacaagggcagattccttatcctcaagtttctgcaaagaaagaccgacatgggtttctgcctactcaacctgtaggaatgaacaactacccttattactatcccaagcaatga

SEQ ID NO: 18561 - DNA, 921 bp, Glycine max
  Peptide Sequence Number=SeqID_135339
atggaggacagagacagagccctccactctcataatttcaatcaccaaaacgacaccgtacccacaaacgcaatgttcctctttcgaaaacccaacgttcataaactcatcatcctaaaaccctggcaaaaccctagaaggttccagagcacgaagaagagaccctccgaatccgccagcatcgtcgacgccgacaacatgtgcagaaactcaccctcattcctccacggcctcctcgacaccaccatcgcgcgctggcctcacacctcccgacgcggcgttgcgccgaggatgttgacgtgtgtgattgcttccagcccctgcattttggttgggggtgttgatttggattttgttagggttgtggagaaattgaagggtgttgttggaaaggatggtgagaatttgttgaatgtgttggatgatcagggttgttgtaattggaggatagtgcttcatgagtctggaggaagtgtgctgtctttgattaactttttgttcaaatttgggttgtctgtggaccgggttgctctcgtgcttctcgaatttcctgagattcgggtcgctaagtttttgtccaacctgaggcagtgttttctgttcttgaccatgattgagatggaggcttcggagattgggaggattttgcagtctcactgcttggtgttgggttccttcacttttaagaaaacgaatacattgcttactaacttgaatgttggcaagaagcagctgtatagagttgtgagggatgatcctctggtaatggagagtcgggctctgggaaggaggattcagcctttcaggaactcgtatttggagtatgagttgaaggaccagaagaagaagttcatgctcaagttggggtatgtggagaactcaaggaaaatgaatgaggcgattaggagtatgaggatgtct

SEQ ID NO: 18562 - DNA, 1197 bp, Glycine max
  Peptide Sequence Number=SeqID_135340
atgtatcagtatagttcccaactatacggaactgaatgggagtcctacatggggattagcaacctagacaaggttgttggatcagaacaactgagttttgagcccacaaaatcacccttcaacattgtgacaactcctcttcaaattactccaccaggtttttgtgcaagtgcaatcaaaagccttgtgagttttcaagctcagcaacaacaacaacatgctcatcaccagcatcagattgaagttccagctgcttggtgctttgagtttccaaagacgacaacaacaacagatacgcacatggtgatgaacaatatttgccaagcctctggagataacttcaccacaaaacaagatcgaccatcgtctcaattcacaagctccttcttgtctagcagtggtgcagattgccgttcttcttctgaaaaatattgtaaaattgcttcttattccgaagaaaaacatagtagcattcagcctgatagtattcaatattacgacctctattcacaagaagatgataaattactgagggatgatgctgccacggatgaagggccccttgaaatttcctttcagagaaatcagttggactcgtgtacaaagcgagaaaagcaagctcctcatcgaacttgtggtgttgcctgtgtagcttctaggagaggcaaaagaagaataaaatggaccaaagatctgcatgagccatttatgatgattgtcaatagccttggtggtcccgaaaaggcaaagcctaaagctatactagatatgatgaaatcagatttgctgtccatttctcacgttaaaagccatttgcagaaatgtaggtctactatacacatgcacaaagctttgcaggaagtgaaaagaggaaggtggaatattagagaaatgaaatttgataaggtatttggacatacattaccactttgtctttcagaaagatctgagaaaggacagagaactaatggggtgtctgagcttcaagtcaaaatccatatgcaaattgaggaatcacggcaactacaactagagatccggagaaatatatgccaacaactaaagatgcaacgaaatttgcacactctaattcaagagcagagtcagcagctcaaagtaatgttagattaccaaaaggaaagaaccaaactggagaagaccccttacacagaactggaagctactgtccccaaatga

SEQ ID NO: 18563 - DNA, 375 bp, Glycine max
  Peptide Sequence Number=SeqID_135341
atgcacacggtcaatcacacagcatacaagtgggagcaatacttttatggccctttttcagagaatgcaagcacaccaagcaagcagaagagccatgatgacaaaagaggacaagccttggctggcacaactaatgtcacggccttgcgtccgagacattctccactagcaaggataaggctgtttacatctatcttctgcaaatcccactatgagagaataccttgcattggctcaccctttagaaccatgataaccaagtgcactgggtctgggttaaaaacatgtcaccagctagagcctatatcatttgcaacacagcccctttcattcccacatcttgaaattgcttgcgacgggggaggaacagcttaa

SEQ ID NO: 18564 - DNA, 245 bp, Glycine max
  Peptide Sequence Number=SeqID_135342
atgccacatggaatgtgcccaacaagatttacttatggaatgccaatttccatatccctttatttccaatccagtaccttgtccctgaactcaagaaacaagactcaaaatgcatttcaagagcatggagaaattgaggaaggagctgtgatctatgataaagtgacaggaaaatcccgtggctatggatttataactttcaaaaatatggaatcaactcagcaagcattgagagcccctagcaa

SEQ ID NO: 18565 - DNA, 393 bp, Glycine max
  Peptide Sequence Number=SeqID_135343
atgcagaataaatgcatttttatacatgggaaatctgacaaaagaacccacacaaaggatgtgcatcatcttgatgtcaaaactggcatacaaattagagaggcacttaagctgcaattagatgctcaaaggtgtcttcatgaacaactagagattttcaattatcatacttttttggtccagattcagagaaaattacagttgcgaatcgaggaacaaggcaggcaactaaagaaaatgttcgaccagcaacagaagacaagtaatgacgtctctaatactcagaattcaaccattgaagagacatcaattagtcataaagacggtgaaaatgcttccgaaggggctaacaacaattccttcttcccttccaagacctctccaagccaataa

SEQ ID NO: 18566 - DNA, 569 bp, Glycine max
  Peptide Sequence Number=SeqID_135344
atgaacctggtaaacaagttaggagcgccatcgcaattaaaaacacttgcaagtctcatgtcgctttcaagtttcaaacaactgcacccaagagttgttatatgcgccctccgggtggtattcttgcacctggtgaaagtataattgcaactgtgtttaagtttgtggagccaccagagaacaatgagaaaccaattgatcagaaaagcagggttaagtttaaaatcatgagcttaaaagtgaaaggcgaaatggactatgtaccagaactgtttgatgagcaaagggatcatgtagctgtggagcaaattttgcgtgtcatttttctggaccctgaacacccttgccctgctttggataagcttaaacggctgctagctgaggctgaggctgcattggaagcaagaaagaagcccccagaggagacaggtcctcgagtagctggggaaggacttgttatagatgaatggaaagaaagaagagaaagatacctggccagacagcaggttgaagtggtagcatgtttgtggtgtttagatgcgattgagtcaatgattggtggtacttaa

SEQ ID NO: 18567 - DNA, 561 bp, Glycine max
  Peptide Sequence Number=SeqID_135345
atgaccctctttagatcgttctgtaatattccagtggttgccgcaaggaatgacgtcgtagctcctgcagaagtaataacaatcaaagccgtaggggccttcttattgggaccccccgaagaactccgcagtacaactagccgcagcaaatcactgccggctcaaggatctatatgtacaagtatatttcaagaagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccaattggaaagaactctcggttaaaaacaaagagagtacaaccactcttggaaagaaggtaacttatacattttaa

SEQ ID NO: 18568 - DNA, 147 bp, Glycine max
  Peptide Sequence Number=SeqID_135346
atgaaggcttcaatctcttctccatctctctgccgtttgggaattctatcggagcagttgaagaaaaaacttgagaaatcccagggaatcgctagagatgccgctatcgctgtcagaagacacggatttttactccctgtggattga

SEQ ID NO: 18569 - DNA, 315 bp, Glycine max
  Peptide Sequence Number=SeqID_135347
atggccgaatcgttgacgcgcgagctggacggacgcattgcgttcagcaagcccgagggcggcatgttcttctgggcgcgcctgaccggcgaggtcgacgccacccgcctgctgccctacgccatcgagcacgaagtggtctacgtgccgggcaaggcgttctacgccgacccggcgcaggccgacctgcatgccatgcgcatgtcgttcgcgaccatgaacgaagcccagatcgcccagggcatgcagcggctcagccgcgccctggacgcgtgcgaggccaaccagccggtgtcgatctcgctggcggcgtga

SEQ ID NO: 18570 - DNA, 330 bp, Glycine max
  Peptide Sequence Number=SeqID_135348
atgtcgcgggggtcaggagaccttggggacgtcaggtggggtgctattgcccaaaaccaagcttggccaatcccggcccaacccgggcatagtcagccagtgagaacctgtgacgtacctaagcaggcgagctcttggcagtcaaccaataaaggaacaaaagtccacgaagcagggaggcttgtgtggcggctggccagctatctatcttgtgttttatctgaaaaattccctctgggtttaaaaattgaaacagaacgttcagtagctactggtaatcgattaccatttgtgtgtaatcgattacacaatgttatatgctactggtaa

SEQ ID NO: 18571 - DNA, 501 bp, Glycine max
  Peptide Sequence Number=SeqID_135349
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggaagtgagatatcattctttaaaaatggcatatgccaaggtgtagcttttaaggatctccaaggtggtcgttactatcctgctgcttcaatgtttactctccccaatgaaccaaactgcacggtcaagttcaactttggtcccgactttgaatgttttcctgaggatttcaatgaacggccaattcccaggccaatgagtgaagttccttatcttggttttgacaataaagttgaaaatgaagagtctaatgagaagggtaccgagctcgaattcgtaatcatggtcatagctgtttcctgtgtgaaattgttatccgctcacaattccacacaacatacgagccggaagcataaagtgtaa

SEQ ID NO: 18572 - DNA, 402 bp, Glycine max
  Peptide Sequence Number=SeqID_135350
atgccctcgccttcagaggactacacgtccgcgccttcagaggacttcacgtcctcgccttctgaggactacacgtcctcgccttcaatgtactatgcgtcctcgtcttcagaggactacacgtcctcgccttcagagggctacacgcccttgccttcagaggactacacatcctcgccttcagaggactacacgtcctcgccttcagtgggctacacgtccttgccttcagagggctacacgtcctcgccttcagagggctacacgccctcaccttcagaggactacacgtcctcatctttagagggctgcacgccatcgccttcagaaggttgcacaccctcggctttaaagggcgacacgtcctcaacttcggagggatgcacgccccctcgcctttaa

SEQ ID NO: 18573 - DNA, 1036 bp, Glycine max
  Peptide Sequence Number=SeqID_135351
atgggatcaaatcaagcacccttgcttaagaaaagaggttgccagtttgaaagaattggggcaattgatggatcagctccaacgccaagcttttcgcaagacctatgggaagatttgggatctagctatgatagaggtctcgatggaagccatgcatccctcactcagtattatgatcagcccctaaggtgcttcaggttttgggactttcagctagtgcagactgtggaagagtttgaagagatcctgggatgtccgctgggaggaaggaagccatatctcttttcggggttctatccctccatggcaaggatagccaagcaaaataggaatgggatagtcggaataccaaggaaacatttggaggaaaaggagaaggtattagcagaccaaggtgaatggacttcattcattgacatcttagcactattgatattcaaagtcatcctctttccaaatgtggatgggctagtggacctagcagcgattgatgccttccttgcttatcaccatagcaaggaaagtccggtcacagctattttagtcgatctctatgacacgttcgaccgaagatgcgaaaagagcgacacacgaatcgtctattgtacaccaactctctatgtgtggttagtctcgcacctctttcgccacgagagtagacctgtttgtcccatgcaaggtcactacatatgcgccgagaaaggagaggtaaactgggagcaactcttggctagtgtggtaggggcatccattaattggttcccctggtggaagaaagggggagttggggttttgtcctcatgtaaaggattcccaaacattcccttaatgggaatgaggggttgtatcaattataatcccgtcctcgccataagacaacttggctaccccatgagaggagcaccatcagaggaaagcatcatgcctttgatcgcacggggtttcagtgaccacaatgcgaggatacttcaaggagtccacaaggcatggggtgcagtgcaaaggaaagataaagagcttaggggaagcgccaatg

SEQ ID NO: 18574 - DNA, 363 bp, Glycine max
  Peptide Sequence Number=SeqID_135352
atgacatgtgtgcgagtcaacgggcgagtaacccgtaaggcgcaaggaaagctgattggtgggatccccctgtggattgcaccgccgaccgaccctgatctttctgtgaagggttcgagtgagagcatacctgtcgggacccgaaagatggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 18575 - DNA, 213 bp, Glycine max
  misc_feature (205)..(205): n is a, c, g, or t
  Peptide Sequence Number=SeqID_135353
atggtcattgagggcttacaactgggggtgaaagaaagaaagggtaataaaacaaagaatataaagagaaaagggagagctcaggcttggaatgctgagaggagtgctctgaggcgaggtgtatgttctccattggtttggatctctatttataggtgcagaaatgagctttgggccttcgaaggcgcgcttagcgcgacaccgngcgcttag

SEQ ID NO: 18576 - DNA, 297 bp, Glycine max
  Peptide Sequence Number=SeqID_135354
atgaagaacggtggaaaatcttcacgaaatcgcccacggaaacgtcttggaagcgttacggaagcgcctcggcttggattttcttcacggaaacaatttttctcactaattttaagtgattctcagataccaggaggggtaaaagagggaggtggttgccgcccagctcgcccaggtgagctgggttgcttccaccagaaggcactaccttctgttggaacatcctggaaggcccaagtgggcttgattgctatttgcaccccctctgccctttttttgctgattctgtttccgtaa

SEQ ID NO: 18577 - DNA, 354 bp, Glycine max
  Peptide Sequence Number=SeqID_135355
atggcgcctccaagatctattcctttaatggatcagttcactgagatggtagcctggcccgggacccaaccttctattcacagggaagatgaaggttccacagcccaggtacctcagcatgtggaggacgagttatctgatgccaccatcccagagccatttgttataggagaagaggtagaggagacacagcctatagcagacccctccactcctcttctagagatgccagaggacccgactacatcagtcctggctatggacacttctcctccagctactccagtattgcatctgatagatgaggaggatgttcagacacaggacaccccggaccagtcacaggaattttga

SEQ ID NO: 18578 - DNA, 136 bp, Glycine max
  Peptide Sequence Number=SeqID_135356
atgaagaatacgaaggttgttgtggctggtgtctcgctaagtgaggcttgtgtgcttagcgagaatcattcgctaagcgaggcatcaacccgcttagcgagttgggagaatctggaggagaatctgtcaagcatca

SEQ ID NO: 18579 - DNA, 366 bp, Glycine max
  Peptide Sequence Number=SeqID_135357
atgttcagcaagaatcccaacatcaaccttctcaacaacgtcatcattttgtcattcttgccaaggaaacatcacaaggttctctcgcccagcatccttgacttccctacactcgttctcagccccatcacgcccctcatacctaaccccttcaatcgttcccatttcgttaatgaaaatggcgccattgtggttatggagactgttgaagcagctgaaaagaaatccatgaaggagaaagggtttttcttggacccttctcccgtgtccactccccatgacgaaaagcctcgccttttgcccttcttccccaccaccgccactgtcgccatgtccccaggttctagttcttcttcctcttcctaa

SEQ ID NO: 18580 - DNA, 303 bp, Glycine max
  Peptide Sequence Number=SeqID_135358
atgaatataaagagaagagaagatataattgatgtattttcaaagaaaagaatattgatgcggcatagagagtcgcaggggaaccggaacacgatggcgtacatcaccatactcaaccacaacattcagtcaacaatacaaggcatgatccatacccttcgcgctgctgctcctctgatcacgtgtccccctatgcccacacctgatcgacgtttcgcgagctcatacgatatttcttggagaagagaatcatcgtgtgaggaaagagtcgcaagttcgagaacaagatttcaggaactttaa

SEQ ID NO: 18581 - DNA, 268 bp, Glycine max
  Peptide Sequence Number=SeqID_135359
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccac

SEQ ID NO: 18582 - DNA, 1161 bp, Glycine max
  Peptide Sequence Number=SeqID_135360
atgcgcccggcggcatcggccagcgcgacgctcaggcaatcgctaatcggttgcagctgctgcagcattttctgctgcgcgtcttcaagggaaatcagtccggcggtaaaaggttccatgtccatctctgtcgggttaaaggcgaatgctgcctattatggtggcatttgtccgctgagtcacatgcgacaaaaaagcataatccacattaaaagggtaacggttatggctaaagcagttatcgcaattcacggcggcgccggcgcgattacgcgtgcggcaatgagcgccgaaaaagagcagcactatcgtcagcagctggccgcgattgtcagcgccggccagcagattctggccagcggcggtagcgcgctggatgccgtgaccgaagcggtgcggctgctggaagagtgcccgctgttcaatgccggcagaggggccgtgttcacccatcagggcacccatgaactggatgccagcctgatggatggccgtacgctggatatcggcgccgtcgctggcgtcagccgtatccgcaatccgattcttgccgcgcgtaaagtgctggaagccagtccgcacgtgctcttaattggcagcggggcggaagcctttgccgcgcaacaggggctgacgccggtcgagcctgatttcttctcgacgccagaacgctgggagcagctgcagcgcgcgctgggcagcgaacaaatgctgctggatcatgatggcgcggcgcaggagagcgatccgctggacccggatcgcaaatttggcaccgtgggcgcggtggcgctcgatttgcagggtaatctggcggccgccacctcgaccggcggcatgaccaacaagcaggcgggccgcgtcggcgattcaccgctggcgggcgccggctgctatgccaacaacgccaccgtggcggtctcctgtaccggtaccggcgaagtgtttattcgtacgctggcggcttacgatgtctcagcgcagatggaatatggcggtcgttcgctgcaacaggccaccgccagcgtgattcatgacaaagtgcaggagctggagggtagcggcgggctgatagccgttgatgcccacggcaacgtggcgctgccgtttaacagcgaaaggcatgtaccgcggattcgcttatgtgggcggcgaggttga

SEQ ID NO: 18583 - DNA, 1395 bp, Glycine max
  Peptide Sequence Number=SeqID_135361
atggctatgttgatatctaccatagagcaagtgggtgtatcatcatttgattttattcttccatatgctaaaatatcaacttatacgtctcccccttattatgattttgctatgaagtgtggtggtcctcaaattacgtcatcaaatggagttgtgtttgaaatggacaaccaaactcttggtccagctacctattttgttaccgatacacatagatgggccgttagtaacgtcggattattcactgggagcaacaatcctcaatataaaataactgtatctaatcagtttactcaaaccgtggatccagaactcttccagacagctcgactctctgcttcatcactgagatattatggcctgggattggaaaatggtttctacaacatcaccctccaatttgcagaaacggttattttggataattctgaatggaaaagtcttgggagaagaatctttgatatttatattcaggggactcttgttttaaaggattttaatataaaaaaggaggctgggggcatctctttcagtgttgtcctaaagaaatttagggttgaagtgttagaaaattatctagagatccatctcttttgggctggaaaagggacttgttgtataccagttcaaggtacttatgggcccctgatttcagccattagtgctatcccagattttaaacctactgttagtaacaaacctccaagcaataaaaggaacagagctggtctaattgtggggattgttgttggtgttggagctgtaagctttctagttgttcttgcattcttctatgtcattcgtaaacgaaagcgtcatgatgatgacgaagagcttttagatattgacacaaagccatacacttttagttattccgaattgaagaatgctacaaatgactttaatattggaaacaagcttggagaaggaggttttgggcctgttcataagggaacacttgatgatggaagagttatcgctgtgaaacaactatctgtacaatccaatcaaggaaagaatcagttcatagctgagattgccactatctccgctgtgcaacatcgtaatcttgttaacttatatggatgttgcattgaaggaaataaaagacttttggtctatgagtatcttgaaaacaagagtcttgatcatgcaatatttggaaattgtttaaacctcagttggtctacacgctatgttatatgcttgggtatagccagaggtttaacttatttacatgaagagtcgcgaatccgtattgtacaccgtgatgtgaaatctagtaatattcttcttgatttggagtttataccaaaaatatctgattttgggttggcaaaattatatgatgacaaaaagacccatataagcactcgtgtggctggcacaatgtaa

SEQ ID NO: 18584 - DNA, 198 bp, Glycine max
  Peptide Sequence Number=SeqID_135362
atggatggggactttgatgggcgtggtgttcatccaggggtgctggaaggcagggatggtgtcataaccgtcgtcgatgctgctatagaggatggtgacagaggtgggatcgtagatgaagagggtcttcttgttggggttggtggcaaagtcgataaggtggaaataaagttctctatgtcacccatgagtacataa

SEQ ID NO: 18585 - DNA, 390 bp, Glycine max
  Peptide Sequence Number=SeqID_135363
atgggctgtgatttgtctatgatcgagaggaggtttggggtgaagcatttggactcttttaatactactagtgtcgatatgatgatatgccaagtttggaagtgtcgatatggaggaggagaatctgatcccaaagaggttttaggggtagataacacgggtgattttgaaggatctgtgtctattgtatcagatacgattgattcgattggtatattcaatatcaatcaacagataccttcctcaaagaaggcggagaggaaaaggaaagagcatgctggcgaatcgggcgatggtggaggcaatgagaacaagaaggagccattgaaagaggtcattaagggcgatactgtggagagacttggacccagagacgaatacaggggatga

SEQ ID NO: 18586 - DNA, 387 bp, Glycine max
  Peptide Sequence Number=SeqID_135364
gcctggcagctacatgaaaacaacaatgtaactgatcttgttgatcctagattattatctgattttaatgacgaggaagtaaaacgaattgtgggaatatctctcttatgcactcaaacatcaccaatattacgaccatcaatgtcccgtgtggtagcaatgcttttaggagatattgaagtgagcactgtaacatcaaggcctggatacttgactgactggaaatttgatgatgagattagcttcatgactgaggttgcaaccaaaggatcagatacaagtttttacaattcttcagcaagttttagcatagtaggtggagcagattattcaccaattgatgcttccaaacctatccttcatgagactctaagtgagagttcgtaa

SEQ ID NO: 18587 - DNA, 1305 bp, Glycine max
  Peptide Sequence Number=SeqID_135365
atgccaagccatcttggagatgaggagtcctcgaaaagtgaaggaggcccaaagacttgccgacataatagcctccctatcaagataacattgacaacaccgcccgttttgtcaaaaccagacaccaccaagaagttgattgtttatctttcgatctcagttgaggccataagcatggttatggtacaagaggaagggagtgagcagaggccaatatattttgtaagccaagtattacaggatccagagatgaggtaccaagtgatgaaaaaggtagacctcacacttgttaatgtcacctgtcgtctctgccagtactttcagagccttcgaatcactgttcagactgatttccccatagcaaaaatgttgcgtaagcccgagttagatgaacgaaccaagaagtaccatttaggtgtaggacgatgcatgtggacaactcctccaatcgacatggaagtggagctagggttattttggaaggacccaatggcatggacatggcataatcattacgcttcggcttcaaagccacctacaatcaggccgaagatactcgagtatttgaagcatgagatactcttagccgataagagcaaagccagaaagttcagaatgcaagctgctaggtacaccctagtgataggcgaactatacaggagaggtttctcctcacctctactcaaatgccttgaccgagaccaggctaactacatttgtgaactacatgaggtgcctccaatgccaaagacattgaaatctgatacattgatcggccaaagagttacatccattggtctccctttggttgttcactatttggggaatggatattctcgggacctttgccacagctccgaggcaaaggaagttcttgctagtgactgtcgattatttcaccaaatgggtgaaggccgagccactatcaaacatcacatcccaagcgatctaaaagttcttggcattaagcataggatgacgtcggtagaccaccctcagaccaacgaacaagttgaggcagctaacaaggtcattttaggtgagctgaagaagcggttgaatggagccaagggaaggtgggccgaagagcttgcagaggtcctatgggcatatgggcattacttcgtcgagacccaaaacaacgaagcactacaggtaaacctggacctgattgagcaagtacgtgaagatgcagtcatcatgatcgaagcctgcaagtggggacctagtatggagagtctgcgaagaagaccgaaaggaccagtcagatgggaagttaacggccaactaggagggaccctttag

SEQ ID NO: 18588 - DNA, 171 bp, Glycine max
  Peptide Sequence Number=SeqID_135366
atggatgatcaagaaggtccttggcctaggaaagtgacctccattgcactatggagaaagtgttttcctaaggcatccattatccgtagctatcctggatactgtcccatgtactacaaatacaagaagactgatagtgtaatgaagtaccacattgctcaagagagataa

SEQ ID NO: 18589 - DNA, 279 bp, Glycine max
  Peptide Sequence Number=SeqID_135367
atgaatactgatttgttgactggcttatcacaaattgatgacaaggaaactaggtatagtgatcaagacaccacaaaagccttcatcaacgaatcttcacaagaggctggtttgcatgcatcatcaagtcttcctccaatgattataaacaatcctacactccgtaatcccttccaagttcagatggaggaatgcttagtcactttgtactcactcagcaagagtttaaaagtgactgagttaggaacttggtggtacaaggagtgccatttaggataa

SEQ ID NO: 18590 - DNA, 393 bp, Glycine max
  Peptide Sequence Number=SeqID_135368
atggctgaatttcctcctgtagaaataggcaccagaggcacagttggatcccttctaatgcaagaaattgagtactttagccggcttgaattcaatttcaaagactggtcacaggagaacaagtctcaaaatatcaacatgggctcctcagtcagtactgattccagacccacaattgtgtccagagtagaaagtacaaagaaaagacgaagaagtagcaagctgccaagctcctaccaaagatgtgttctatggtcaatgtatctgacaacaagcttagagaaacccaacttcttgagagaatttggtataggggttctgggaaccaagcatgggtatttgatgggtatgcttgccattaagttttgttttgaggccaatgccggggcttag

SEQ ID NO: 18591 - DNA, 180 bp, Glycine max
  Peptide Sequence Number=SeqID_135369
atgcgtagcctcaccgaaacattctggctcactattagtcggttaaataagcaagtttgtggaaatgctgattttgagccgctcgctaagccaattctctggcttagcgatccatctgctaagcgtagcagtttatggctaagcgtgaagaatatcttggaagcagatgagttttcatga

SEQ ID NO: 18592 - DNA, 480 bp, Glycine max
  Peptide Sequence Number=SeqID_135370
atggaaggttttaagggcaatgaaggaactgtcgcagtaggaaccactggaacaattggcttgttgatgacaagggaattggatcagatgtcttctgttccacaccaggaggtatattcaacaagtaaatctcaaatttcagtttcgagaggtagtgctagaccaaaaagaccgcaaccaagaaaatcatttgaagctagcagtagcagaagcagcaacatcataaaccatctaagccccggcattggcctcaaaacaaaacttaatggcaagcatacccatcaaatacccatgcttggttcccagaaccttccattggaggcaagtccagttacgaagaaaaaggataagaagaaaaaatctaaaattgttgaagtagtggacatcaaatgtggttatgtagataaaacttgggctacccctataccaaattctctcaagaagttgggtttctctaagctcttcaagagcgttacctaa

SEQ ID NO: 18593 - DNA, 300 bp, Glycine max
  Peptide Sequence Number=SeqID_135371
atggatattatgtttttaatttcaagcgtctcaatatattacgggagtcaatcggacatccaagcagcttgtattccattggcattgagtggtcgtgatatatgtggtagtgccattaccgggtcaaggaagacggctgcatttgcactacctactttagagaggttgttgttccgtccaaagcgcatgcgtgcaataagggtcctcattcttactcccaccagagagagttggcagtccactgagtatgttgtgtgtggtgtgcctactagcatatatggctttgcatcatggcaatga

SEQ ID NO: 18594 - DNA, 474 bp, Glycine max
  Peptide Sequence Number=SeqID_135372
atggcagaaatgggaaagttggatcatctagaggaaaggctcagggccattaaaggaggtgaagattatgcctttgctaacctagaaaagttgttcctagtacccaatatcatcacccctcccaagttcaaggtgctgaactttgacaagtacaaggggactacttgccccaagaaccatctaaagatgtattgtcggaaaatggggacatacgcaaaagatgaggaattgctgatacattccttccaagaaagtcttactggggtagctgttacctggtacactaatctggaaccttctcgagtccactcttggaaggacctaatggttgccttcgttaggaagtatcagtacaattttgatatggttccggataggatgcaacaacaaaacatgtgcaaaaaagggcacagatctttcaaagaatacgcccaaaggtggagagacctggcagttcaagtggcacctcaatga

SEQ ID NO: 18595 - DNA, 384 bp, Glycine max
  Peptide Sequence Number=SeqID_135373
atgcttgctgaaaagatgcaaaaacatggtgctaatggatggcttgttaacacaggccggtctggtggaagctatggttgtggaaatcgtattaaactatcttatatgagaaaaattattgatgctattcactctggaagcctattggatgcgaagtacaagaagactgagatttttggacttgagagccccaataaagtggagggagtcccctcagaaattcttgaacctgagaacacatggttagacaaacaagcctacaaggacacgttgttggagctagctggattgttcaacaaaatttttgaaacattcaccattggagagaacaaccaaatgatagaggagattcttgctgctggaccaatcattggtgatgcttaa

SEQ ID NO: 18596 - DNA, 114 bp, Glycine max
  Peptide Sequence Number=SeqID_135374
atggtaatggctttcatatacagcatgttcaagcaagactatttgatgcaggaaaagatcatttctgctttagatatcaagatgccatcaaaagaattagaaagctactgctaa

SEQ ID NO: 18597 - DNA, 363 bp, Glycine max
  Peptide Sequence Number=SeqID_135375
atgaatctcataaaagaaaaattgttgggcatgagacaaatcaagaaattacttcttaaatttaaggaaagataccttcagatggtggcgaaaacttggtcaaaagaggaaataagtcagaaaaggagaacaatgacagtaatgggtctagagacgataatgaggaagaggaatccaattcttgtggttggggtaacaaagtcacaacaagatagtgattcagtaaaagcccttaagtgttttgcatatgagagaattgaacccaccagtgaggaggagcttggtgtccaagacaaagactcgagaaccattgaggccaaggtggtagagaagatcagggtggaagaggccgagaatttgtag

SEQ ID NO: 18598 - DNA, 369 bp, Glycine max
  Peptide Sequence Number=SeqID_135376
atggatgcctctaagttccaacatcatgaatcttggttggattctcggataatcgcatccctcaagctggcttccaaagatgatatcaagacaacaaacaagggaatcaagagaagtaatatctcaccacaaaatagaggagttgaaaacgtgaatagagatgttggacaaagcatgaataactcatttcatctattatcatcgaagactacttcaagaatcacgagtaaagcccaaccatatttgatttttagaccctttttttcttcaagtgtgcccatggccatggtgttcaagttcaatccatctaaccttgttgagagcagggcagaggctcaaggaatcgataatttgactttgacaaactag

SEQ ID NO: 18599 - DNA, 1092 bp, Glycine max
  Peptide Sequence Number=SeqID_135377
atggaagagtttcatgccactccccaaggaggacactccggcttttaccgtacttataggcgtcttgcttcgaatctgttttggaaaggaatgaagggagatattatgaggtttgtgcaagattgtgatgtttgtcaacaccataaatacttaacaaaagcccttggaggtttattgcaacctttaccaatatcggatcaagtatgggaagatatatctttagattttatctcggggctcccaagatctaaagggtttgaggccattctagtcgtggtaggcaagctgtctaaatatagtcatttcattccattaagacacccttacccaatacaagacatagctgaaatatttgtgaaagaggtgattaggcttcatggggtacccaattctattccaaagggatgggtcatttggcttccgtgggctgaatcttggttcaataccacctatcaagattcaataggcattacgccatttgaggtagtttatgaaagaaagcctccaatgatggtaaagagtatacaaggagaagtgaaggtggaaatagttcaaagggaattgcaagatagggatgaagctttgagacaattgaagaattacttagcaagagcacaagataggatgaagacacaggtgattgagaggattggggaagttgcttataagttgaaatttcctacaagttccaagatacacccggttttccatgtgtcctggcgcaagaaagaacatggagattacaaagttgaaagcgcactacctagtggattggaggatgaccgtgaaggagaaattgaaccagaactggtgttggcaactcgtagtataatgaagagaggcaaaagagtcaaccagtggctagtccaatggaatgggaaaaatgtagatgaagcaacttgggaagacgaattgacattgaagagccagtttccagaaatgagtcttgaggacaagactttacttcaaggagaaggtgttgataggaaccaaatttgtaatgggcctttggagcctttagttcacaagatgcagaaaggcccaagggaatggttagtgtattcccgtagaaagaaaagaggggtagaatag

SEQ ID NO: 18600 - DNA, 252 bp, Glycine max
  Peptide Sequence Number=SeqID_135378
atgcacgcaattgttgatctgtttgaaattccagagcagtttcataatcttcaggccacagttagcgatgtgacttcatttgcaataactcacgggttctccttcatggatgcttttctgcatctcaacacctcgggcaattgtcttcgttcgactcaaatcacggtcgcatgtagcccaaaggctttatctatatggctgaaagcccccaaactttttccagttacttggtacctgcctccttatggatag

SEQ ID NO: 18601 - DNA, 816 bp, Glycine max
  Peptide Sequence Number=SeqID_135379
atggatgtgaaaactgcctttcttaatggagatttggagaagaatgtttctaacgatcttggtcttcttcatgagactaagaaatttctctctagaaactttgaagtgaaagatatgggtgaggttcaggaagctaagaacaagcttgatgttcctaaagatgcagaggaaaaattgtgtgatgaaaccaaggggcataaactggatattactagtgatacagatgtccaaattttggatgatacaaagtcaaacagaagaagtggtacttctactatggacgatgaagcaataaaattatctggttcaaataggagaccacattatgaaataactaagaactccaaaagaggaaatgcgaaagccaatatggaaactgataatttagactctattcaggaaccaaaatcagaaacgcagttgaatactgtaccaaggaagaggggccgaaacaaaacctgggaaatcagccaatccagaaaggctcgcaattgcagctctccttatccatcttctgaaaaacctacttctagaaaggataagttgcatagaatgcctaaaactgttagtgaaactctagtttgtatgcagaaaagtgagaacatagcaaaagctgtccaatccagaaggactcaaaatattggcactgattttctagctaatgatacaagcaaagttcatgaagctttagcttctaagcctaaagctgatgagaatacaaatgctgcttctgtaaataataactatcctgatgcaggtgctatctcaagtgctatctcaagtaaaaccagatcagaaaaacaagttcataaatga

SEQ ID NO: 18602 - DNA, 888 bp, Glycine max
  Peptide Sequence Number=SeqID_135380
atgtcggagagtggtaggggacaccacggcgccaccgccgagactggcagaagggaacagttcatgacggagaatgttgccggagactcgtcgtcgtcattgtcatggagactcaacgtgaaggagtttcagttgccacgcttaagtcatagccatgatcatcatcatcaacacctccctagttacttcactttccgtgaccttctacggaaaccaaagaagcaacgcaaggttgcagaatactacaagaaacaagagaggctccttgaagggtataatgacatggatacaatgactgaaactggttgttttccaggaagtctcactgaggatgaaatgaagcaattagcaagaagtgagagcctggcagttaatgtgtcaaatgcagctaacttggtgctatttgcagcaaaggtttatacttccattgagagcagatcattagcagtcattgcttccactatggattctctcttggatctcttgtcagggttcatattgtggttcactgcttatgccatgagaaatccaaaccagtatcactaccccattggaaagaaacggatgcaaccagtgggtatcattgtttttgcatcagtgatggcaacattgggattgcagattttgattgagtctggccgacaacttatttcaaagtctaagcctgaaatggatccccatgagttgaaatgggtgatcgggattatggcatctgttactgtagtgaagttcattctcatggtctactgtcgaaggtttaagaacgaaattatcagagcttacgcacaagatcatttttttgatgttattaccaattcagttggattagttgctgctatgcttgctgtcaagtactcttggtggattgatccaatgggagctattatt

SEQ ID NO: 18603 - DNA, 459 bp, Glycine max
  Peptide Sequence Number=SeqID_135381
atggcctccaggaaaagaagagcttccacctctagacctcaagagctctatgacacatcaagattcgtgtctaagaatatcctcacagagaggaatgtggagctcgcctattcacactatgacgagttccttagggagctcgagagacgcatttggcatagggccttgaccagacaaccagataatcatatagacttagccttggtcaaggaattttatccaaacctctatgatctagaggatcgctcccctaggcaatgtaaggtgcaggggaagctgatcaagttcgatgctactacactgaatgaatttttggaggccccagtggtcttggagcctggggagaggtattcagtatactcccaattttgccatactcatctagaccctcaggagcttgcagcgaagctttgtattccggggcaaggatttgttctcaatgctgagggagcaccatga

SEQ ID NO: 18604 - DNA, 405 bp, Glycine max
  Peptide Sequence Number=SeqID_135382
atggacagggtgaggtcccgtaaggccaatgctagggctacctcagacgcttctacttcagcctctgctcccacaccagcaccagtaccagctccagtccttccagctctagtctcaatccccgttggcccttccatgcagagcacagatgctatagtattgatgctgcagagccttcaccacaacctttgcccgactcaggcccctggagacgctgaggacaccccagctgacacaactatagatcaggcagtagaggatgacatgccagaggctagggatactgaggagacacttgcagccacacctatagagatcattgaggaaggaggcgcaatagataccgacattgatgaggactacgtggaaaatgtcaccgcggtgcaggggacttgggacccatga

SEQ ID NO: 18605 - DNA, 345 bp, Glycine max
  Peptide Sequence Number=SeqID_135383
atggaagacgcacccgtgagcctcgcctcgctcgcccgcaaaagggtaggttgcgacagttggcgactccggtggggactgtttttgattcacgatgtcggatacaatgtccaggacatcctgcccaaaaatactggaattgctaaaagcattgaagctgcaggattcacgatgtcggatacaatgtccaggacatcctgcccgaaaatactggagttgctaaaagcattgaagctgcaggatccacgatgtcggatacgatgtccaggacatctggcccgaaaatactggacatataaatctgttatatcgttaacagattattgtgcagttagcaagagataa

SEQ ID NO: 18606 - DNA, 612 bp, Glycine max
  Peptide Sequence Number=SeqID_135384
atggccactgatatcatgtctagtggttatgtgacaatagctattgtaccctttggggaacaatggaagaaaatgaggagaatcgttgtcaacgaattattctcccccctcaggcaccaatggcttcaaggaaaaaggaatggagaagctgataacatcatgttttatgtctacaacaaatgcaaaaatgtgaacaatgggggccttgtgaatgtcagagatgttgcgcaacattattgttgcaatgtgactagaaaattgatttttaatacaaggtactttggaaagggtagggaggatggaggccctggtttagaggaagtagaacatgtgaatactattttcacattgcttaagcatgtttatgccttttctgtttctgattatatcccgtgcttgaggattcttgatttagatggccataagagcaaggtgaagaaaggtatgaggacgatgaagaagtatcatgatccaatcattgaaaagagaatgaagcaatggaatgatggatcaaagaccgttgaagaggacttgctggatgttctcatctcactcaaagatgtcaacaataatcctacattgacattgaaggaaatcaaggccctaactatt

SEQ ID NO: 18607 - DNA, 312 bp, Glycine max
  Peptide Sequence Number=SeqID_135385
atgccgccaccaaagaaagagtggaagcgtcaggggtcgtcccttggaatgaatgaatggctcattctcgagtcaagtattgcggagttgttgctgcgacgcaagagcctcacgtgcgagggagcgtggctgggagggtttggaggggaggagtgggccataccactaacacatttggaaggtttaaggagtgaattggtgatgcagaagaaccgggtggaaaaacgggaagattgcttgttcatacaagcgagaagggacatgtccttcataacggtcactttcatgacatcatttaagctcgatcactag

SEQ ID NO: 18608 - DNA, 735 bp, Glycine max
  Peptide Sequence Number=SeqID_135386
gcttgtgtaagagaagcttttcgccttcatcctgttgtgcctttcaatcctccccatgtctcaacaaatgacacaatggttggcaattattttattccaaagggtagccatgtgctactaagcagacatggacttgggagaaaccttaaagtgtggaataatgaacctcacaagttcaagcctgaacgccacataaagaatgatggatctatgattgttttgtcagagccagatttaaagttcatatcatttggcactggaaggagaggttgtcctgcaatagtacttggttctacaatgactgtaatgttattggctaggttggttcatgccttctcttggagtgcacctccaaatgtatcaagtgtcaaccttgttaaggctaataatggggttatgcttcttgagccactcgtttggtacaattctacagctaatcttggttttgctactgccacaagtggatccgcaagaaacatattaatggttaacacattaggaggcgcattccaagtgaagccatggagcaacctagccaacaacattacagtcattgtggtttcaagcgttattcctggacaaccatgccttcccgtgtcgaatgatatcaaccttaaatggttctgtcaaaactacatccgatccataagtactcttaaggtggcgttctggcttgagctagaggggttcataattccacacttttgggtttctcccaagaccacttatgcttag

SEQ ID NO: 18609 - DNA, 351 bp, Glycine max
  Peptide Sequence Number=SeqID_135387
atggatggcttccttgactatcttagaagaattgattgttttgatgttgaggtgtatgctattcccgaaggatcagttgtttttcctatggtgcccatactgagaattgaaggtccaattgccgtgatttctactaatgatgcaaggcatcattttgttgttggaaaaacaaaaactctacttgagtttggactacgaagggcacaggggcctgatggtggagtgggtgcatcaaagtacagttacattggggcatttgatgcaacaagggaggaaaagttcattaaattatgtgtatatctagcagttatcatgcctagggtttttttggagactacaatgccaatatag

SEQ ID NO: 18610 - DNA, 195 bp, Glycine max
  Peptide Sequence Number=SeqID_135388
atggatgctaatatccaaatgatggaagatttcttcattttgatccaggtgctttaccttccagagtttaggggaagagtcatctatgcatcacaagctaactactttcctgatgcctacgctatagaacctatgtggggtgccctcgaatcactaccatatgtgggatgcactgtaacaaattggataaactga

SEQ ID NO: 18611 - DNA, 108 bp, Glycine max
  Peptide Sequence Number=SeqID_135389
atgacgaatgaaggagagcctaaggttgaaaaatcaatggctaacaaggataagaaagcaatgcttgagaaagcttacagtgcgattatgttgagtgtcagtgataaa

SEQ ID NO: 18612 - DNA, 294 bp, Glycine max
  Peptide Sequence Number=SeqID_135390
atgaggccattagcttctttttggcttattctttgtttcttctttgcttctctttgttttctctttgcctctattaagccttctccctctttactctcgggtcaatcattttttctttgcgagttctataaccttagttctgtaagacgttcctgctgtatcctcggaggtttacgtgggacaccgcggataaactctttagccgcaaaacctgtttacattgtcgacgcttccaaccccatgccatcgacgataatctttgctaagtcgctgcctgacgtctcaaaaattaag

SEQ ID NO: 18613 - DNA, 154 bp, Glycine max
  Peptide Sequence Number=SeqID_135391
atgaagcatacttatagaagaaccaagcaacaaaatcctaggaacagagaaagtgttggaaaggcagttgcagacaacaatgacatccttaacttcggagaagccggtgagagaagccctactggtggacttgccaatgcctctcatgtcaaag

SEQ ID NO: 18614 - DNA, 162 bp, Glycine max
  Peptide Sequence Number=SeqID_135392
atggaaaaagatgcgacactgggcgcgctaagcgcgagaagagataacgacctcgctgggcgggctggctgcatgctaggcgagcacatctccgacttatcctcttctaggatttgccaactcgttaagcaagcggatctgcctcgcttagcgagtcattag

SEQ ID NO: 18615 - DNA, 110 bp, Glycine max
  Peptide Sequence Number=SeqID_135393
atgtctgcaagtggcagttcttctgcattttctggtagaaccattcgccaatgccactatggaagacgtgcagctattcgaactgcaagaacaaggaggaacccaggaag

SEQ ID NO: 18616 - DNA, 468 bp, Glycine max
  Peptide Sequence Number=SeqID_135394
atggtacagggcaccccatcgagggcgacggtatcgataagcttgatgataaatcagcctaaattgcttcaaaaagccatagaagtattagacaatgtggtaggtaagaagaggttggtccaagaatcagatattcctaagctcaactttgtgaaggcttgtgcaaaagagacagtggtagccaattacttgataccaaaggatagttatgtactactaagcataaggggtctggggagaaaccctaaagtttggaatgaaccactcaagttcaagccagaacgccacctcaagaatgatgggtctgatgtaactccatggcttccttggagtgcacctcctaatgtgtcaaccattaatcttgccgagtccaagaggaatatgtttcttgctgagccacttgtggcagtagcaaaaccaggattagcaacagaattgtacaccatgaaattgagtgaacatttatga

SEQ ID NO: 18617 - DNA, 180 bp, Glycine max
  Peptide Sequence Number=SeqID_135395
atgattgtgttatcgtctacatctaagcatgcattagaatcatcgctgagtttagatgagagatgcaacttcgaatctgagatcaagtcccatatagagttaggatctgagcatattttcaccaagctgagcaggcatcatctcttttcttgctcgttgctagaaccatcagataaatag

SEQ ID NO: 18618 - DNA, 205 bp, Glycine max
  Peptide Sequence Number=SeqID_135396
gcaccccaagggaacgcctccaacgaaacaccacccctttgtgcctcctatcttcgtctccagatccaaatccagatctagaatgcgccggcagagcgtgacatcctgcgtcgccgtcgccgccatgtcctccggctgctcatggacgtcctcgagcagaggccgtcaagggagatccgaaccagaatgcgaaggtgctccgtag

SEQ ID NO: 18619 - DNA, 618 bp, Glycine max
  Peptide Sequence Number=SeqID_135397
atggtaaatgcacagcagaacccacaccctgcaatgcaaatgctgtctagtgttgaagcttttgacttgaatatatacaagtcatgtttcggttactttggatttagagagagagagagatgcacacacctcgatttcacttactcatttcagcagaatttcagggccaaattaaaaacgcacctaaatctcaagagatgctataaagaggaggataagagcacagaactttgctacaaggagagtgagaagaaaggctttgatcagctttgggattgtaaaagtggtagtggtcggaaaaaaaaatctccctacacccatcatccaagtctgatcaaaatctggattgcggcagtgtataacagtcagaacacaaacgcgttcaattctcaacaacaacagcagcaacaaccacagtgcttgatggagatgtcattacagagaacatcctcggagaataattcgggaaggaaccgtgaggaacaggaaccttcgaacaaagaaaccaccatggaagctcctgcttccggtgacgacgaccaagatctcgaagaaggattcaaaaggaggcgccacacccgccacacacaccaccaaatttcggagatggaatcgtaa

SEQ ID NO: 18620 - DNA, 1245 bp, Glycine max
  Peptide Sequence Number=SeqID_135398
atgatagaagaaggcttgtcaacttgcaaggccaaatttcagaagttgaataataaagtgaatgtggatggacacaaggattggataggcaatttacctaacgaaatcattcaacacattttaagtttacttccaacaaaagatgctgttaaaacaagtgtattgtctagaaggtggcattcccaatggatgtttgtcagaaatcttgacttcgcagaatttccaccgaatatgaaccagaagaggaaactcttcatggattttgtggatagagttattgcactccgtaaaccattggatctcaatctttttgcattggtttgtgaagtatttactgatgcttcccgcatcaattcatgggtatgtgctgcagtaaagcacaatgttcaacacttgcttcttgtactagatcagattcatctggagcctcttgaattgcctcattgcctatttacatgtgatacactcaggaaggcctttatagtggcagacattttgctcaaccttccatcttccattcacttttcgaatttgaagttgttgactcttcagtatgttgtttttcctggctatgagtccactcaacgactattttctggcttgcctgtcctggaggagctaactttggatagctgctgctggttgaatgttgaaattgttaccatagctcttcccatgcttaagaaattggatataaaagaaaatttagcagaccaggataattgtcagttctttattattgcagagaacctcaactccttttattacattggtacactcagaaatgactattggatctataactctgtatccctcgattggggattaatgggcttgtgcagcactgatgacattggagagagtagcagactaagagaagttgctcaaagagctggtaggcttcttagagggatctcttgtgcaaaagaactattgctaactccttatgcgtttgagggcgtctgtttgtctgggaatcatgaagaaggaagttggatactggatcccgtaccttcttgtttctcaagatatctcaagttgattaggataagtcaattctgtggaacagatggggaactgcaagtagtgaagagtttgcttaaacatgctgaaattttactacaaatggatataatatgtcatcatgagaaattttctgacggtttggcaagggaaagggatgttcttgaaaaattacaaatgcttcctagagcctccacttactgcacaatcaatatttcttga

SEQ ID NO: 18621 - DNA, 1119 bp, Glycine max
  Peptide Sequence Number=SeqID_135399
atgcatagaaggccccaaggggaggagaagagctcaggaaagttgataatcaatgactgcataatggatcagacaatatttaatcagctgagtgagtttgaagaacagatgccaagcaccttccattgggaaggcatcacaacacaaaaaattagtgtcaaccacatgataagtcccacaaaaggtgatcagttgagccaggatcaagaagaggagataaactttattgaaatgaaaataggcttaataccaaaacctattagtggaatgatagatcaaacaaaagtagatcagctggtccaggataaaacacaaacacaacgaagatgccatgacgatttactggatgggcgtcaaggtgaaatcattttggagaattcaaagtcctctgcatgctctatatgcaaaagtaggtgtccgaacaatgcatggaaaaaagactttaattatgaggaactcctagaagctacagaaggattttcaattgagaactcgttatcagaaagagaagatgaacctacttttgagggcttgctagagagacaggtaaaaatagttgttaagaaatatcaagttactacatcccaccaagagatgatattaaaatcagaagtgcagttgttcatcagtgctagacataaaaatgtggtcatgttgttgggtttatgcacaaataaaagccgactgatgattgtgtatgagcaagtatgcaacggttcacttgaacagtacctaacaaggggaagttgccaaccattgacttggaagcaaaggctgaaagtggcaatgggtactgcaagaggtttaaagtacctacatgggaataacataattcatggaaatataaaaccaagtaacattcttctaacacatgacttcgaaccacggattggagattttgactttggaaaagtgaaacatggaccaaagaaatccagcaaagataaaagtgtatggaattctggatatgcaatacctgagtatgttgagaatggaaaagtatcaaataagacagatgtgtactcctttagagtggttcttttagagctgattagtggccggagggctacagacaaattaccaggtggaaaaagccttgtttcctgggatgagccttag

SEQ ID NO: 18622 - DNA, 1944 bp, Glycine max
  Peptide Sequence Number=SeqID_135400
atgaaaagcaaggaaagcgcttggtcgcgagctcggattggagcctttgcaaatcaaacgcaacaagaacgatatgaaaacaatcttctgagggttgaaaatgacaagcttcgagcagaaaaccgtaggtacaggaatgcactagctaatgctttatgccctagctgtggaggccctactgctcttggagagatgtcctttgacgagcagcagttgaggatcgagaatgcacgattaaaagaggagattgctagtatgtcaggacctgcggccaagcatgctggaaaatctggaagcaattcgtactgtaacatgccatctcaaaaccagatgccttcgcgctcgctagatctgggagttggtaacaacaacaagaacaacaactttgtagctgtagcacaagcacaacctgcagccatggttggggaaatatatggtggcaatgatcctcttagggaactcccccttttttcttgttttgataaaactttaattggggagattggtctggtggcaatagaggaaatcaaccggttgtctctgtctggagatcctttgtgggtccctggcaactacggcagtgaagttgtaaatgaagatgaatacctgagggttttccctaggggcataggtccaacactcttgggcgcaagaaccgaatcttctaggcaaacagccatagttatcatgcatcatatgaaactcgttgagatgcttatggatgtcaatcaatggtcaaacatgttttgcggcatcgtttcaagggcggtaacacacgaagtgctgtcaactggagaaactataagatacgatggtgcctgccaagtgatgtcagctgagtttcaggttccttcaccccttgttcctactcgtgacaactatttcatcaggttctgtaagaagcaccaaggacaatcgtgggcggtggttgatttttcaatggatcatctgcgacctggtgcaatcacaaaaattcgaagacgaccctctggttgcataattcaagaattgccaaatggttactcaaaggtcatatgggttgaacatgtagaggtggacgacagcgaggtgcataatctttacaaaaatttggttgattctacccttgcgtttggagctaaacgttgggttgcagcaattgataggacatgcgaacgtcttgctagtgcaatggccaccaacataccccaaggggcactttgtgtgataacaagtcacgagagtcggaaaagcatgatgaagctggctgaaagaatggtattgagcttttgtactggcgttggtgcttcaactgcaaatgcctggacaccactaccaagtggtcttgaagatgttagggtcatgaccagaaagagcgttgatgatccaggcagacctcctggtatagtgctcagtgctgcaacttctctctggctcccagttcctgcaaggagagtttttgagtttcttagatcagaaaacacaagaaatcagtgggacattctgtcaaccggggctcaagtgaacgaacttgcacatattgctaacgggagagaccatggaaattgtgtctctcttcttcgagtgaatactcagaatgtgggccagaacaatatgctgatacttcaagagagtttcattgatgctacaggctcatttgtgatttatgctcctattgatgtagctgccataaatgttgtgttgggaggtggtaatccagattatgtggccctgctcccttcgggctttgctgttcttcctgatgggcctggactgaacggagggcccgggcccatatgtgaggctggatccggaggaggctgtcttctcacagttgcgtttcagatactggtggattcagctccgacttcgaaaatctctgttggttccgtgacaactgttaacagtttgataaagagaacagttgaaaagatcagagatgcagtgtcgcttgatggcaactaa

SEQ ID NO: 18623 - DNA, 570 bp, Glycine max
  Peptide Sequence Number=SeqID_135401
cccttagatacagcatcctcaaggatgcagacaagtgaatttggaaaatccaagggactctggaagaccctttctgagggtacatggagtgaagcatatgacggacttggcatttccattcttttaacaacaaatccatctattcagctgaaacagagaatattaaagggcaagataagcaacagaacaggtacaaagtcatccccggaagcactttctgcattttatgctttcatgcttggtgcagtttcaaaatgtgcagcgaccatcttgacatacccagctatcaggtgtaaggtcatgattcaggctgctgaatctgaagatgataagagtacagaagctgagaggaaggcgcagaggacaatctctggagcactctatactatttggaaaagagaaggtatattgggatttttcaaaggattgcaggcacagatattgaaaactgttctcagctctgcgttacttctgatggtgaaggagaagattgcaaagtccacatggattctaatgcttgtgattggaagatacttgtctgtgaattcccccaaattgaaggcagtttga

SEQ ID NO: 18624 - DNA, 282 bp, Glycine max
  Peptide Sequence Number=SeqID_135402
atgcaacagggacaaacatacatcactataattgggttccctgaccctaactatggtgtcaaagcggtaaacgaaaataaactcccctcacttatcatgagttctccattagctcctctctacatttctcagagacctctctcattcacattcgtcagtccaaaagcaaagttctatataccaaatcgaaggaaatttagtatatatttcaaaaacaagatcttgcctagcaagctcgttttgctaagcataaatccacttgttgagcacaattcctgttga

SEQ ID NO: 18625 - DNA, 276 bp, Glycine max
  Peptide Sequence Number=SeqID_135403
atgaagatgcacaaaacaataaagagggcccctaagtgtccatggatcaagttcaacttcttaaaggcaaacactaaccggatgaagaatgaagcacgaatgaagaatgatgtagaaatcgattgcagtcgagatttggcgcaaaacaaggcatttgggatgaaggtagctcgcctaggagagctgttacttcattttgaagcaaccttgctcgctaaggcgagttggttacttcaccatgaaataatttggtggcctaggcgagctagaggctag

SEQ ID NO: 18626 - DNA, 675 bp, Glycine max
  Peptide Sequence Number=SeqID_135404
atggttccaaaagttctcccatgccatcgccagctcagaaattgccaacaaaaatgcaccattcagctactagaagaaactgattttacatctgctagcctgcaagcctacccatggatcccaaccttaaactcaagggggtgcacaggtaggctacttaatcaactattgtatctcacagttgacagtcctaacgccagatatcatctttttgctgtgaacaaacttagccaatttatgtcagcacctcaaacaccacatttgcaagcactgcttcatatttcacagtatcttacagcctctcctggtcaatgcattctatttccttctcagtccgccaccaagctcactgcttatgtacatgctgattggggtagcttccaagtgacaaggaagttgaccacatggttctgtgtgtccctgagaggtccttttatttcttggaaatcaaagaagcaggccacagtagccaaatcttctgcagtggctgagtacaggtctcttgcatgcttaccacttgccactaatcccactgccaacaaaagaaccaaacatgtagacattgattgtcattttatcaagcaccatatcatttctggatttctgaatcttgtatacttaccttctcaacaacagctagcagatgtcctcacaaaagccctccctagtgcctga

SEQ ID NO: 18627 - DNA, 702 bp, Glycine max
  Peptide Sequence Number=SeqID_135405
atgcaagactttttgggctcccttcgccgctccttggttttccgccccggcggtgacgattcaccttttgccggaatcgccaacaagctcggctccgccattcgcaaatcgcgaatcgccctcgaacctcctcctccgatacggtggcgcaagggcgagttgatcggttccggcggcttcggtcacgtctacatgggaatgaacctcgactccggggagcttattgccatcaaacaggttttaattgcacctggtagcgtattcaaggagaatacacagagatacttgggaaccgctagagaggaggactccttaaatattctgctggaatttgtacctggtggatctatctcatcgctcttggggaaatttggatccttccctgaatccgttataaaaatgtatacaaaacagcttttactgggccttgaatatcttcacgataacgggattattcacagggatataaagggtgccaacattctagttgataacaaagggtgcattaaactcacagactttggggcatccaagaaagttgttgaactggctaccatcaacggtgcaaagtcaatgaagggcacaccacattggatgtctcctgaagttattttacagacaggacatacaatagaaaggaaagatttatctgttgtgacatggagttatagggaaattctcatattgtacaattcatattga

SEQ ID NO: 18628 - DNA, 993 bp, Glycine max
  Peptide Sequence Number=SeqID_135406
atggagagtgaaattctagcagtggttaactcactgtttttcctttgtagtgattctgccttatttattatctgcagcatccattcatcacctgcaactatcatggatcttattcaatattacgcagttcaatcaggcttggattctgtccagggatcaacttgcacgggcttaaaggatgtttgtcagatagatagcatacaattctcaactgtgtatcataaagcagattcctaccagagagcaagcaacaatgatgatgacatgtgtgagatggatgaagatgactttttcattgattcatcagtaaaatcgaaatctctattggcttctgatgatatgaagagtttcaatcctatgtgcaaacctttggatgaccggccttgcaattttgatgaaacccaatatttggagaaaaacagaccaaacttgccattttcaagtgaggctctaggaactgaagatgatgatgaagttactgagtctaaaattagagacttcctggatgctaaggcccttgaactgaagaagctccaaacacctctttatgaagaattccgtagcatatcaaatgcagccattgctccagctcccatcaaagttgccaagagtaaagttatgtcagatgtctcaaatgtaacatcatcaataggcaggtcagctagtcaggcttggagacgattctcaatggttggcagtgctaatgttgcaagccctggtgggagtcataccaaataccgatcaaagcttagtggtgctcactgtcgacctttgcaggaaattcaaccatctgatcttaatcaatcaaaggagactcttcataatgctgagctggaatcatctagtgtaagctcaagcttctctgagaggcaaaggaaatggaaggaagaattggttgaagagcttgaatggaagcgaggcaaagaacgggcagacattgccacagaacttggaaacgtccataacaagatggacttggacttggccccatag

SEQ ID NO: 18629 - DNA, 222 bp, Glycine max
  Peptide Sequence Number=SeqID_135407
atgcctagcgctgttcatgtgtcctccacctacgagtttggagccatgcgtactgactgcttagtgcaattctccgtcctcgcctttttttcggagccccacgaatgtcattgcctagtgctgttcatgcatcctgcaccaacgagtctggagccccgcgaaggtattgcgttccactgttcgccaattctccattctccactttttttcggagcgccatga

SEQ ID NO: 18630 - DNA, 290 bp, Glycine max
  Peptide Sequence Number=SeqID_135408
agccattcattttagaggaggaggcaggtgagacacaggctagacaggaagctgctgctactcttgagagatctcttgaggacacttcagagcctcttgcaccagtggtggacctatcctcgcctcagcatgcagcagaaccctccactcctatactcaagataccagaggacccgaccacaccagtcctgactctaaacacttctccttcagctactccagtacttcatctgacagatgaggaggatgttcaaacacaggacacccaggaccaatcacatgaattctaa

SEQ ID NO: 18631 - DNA, 842 bp, Glycine max
  Peptide Sequence Number=SeqID_135409
atggtgtttttacttttatgctctttttctgtatcttcagagccacactcttcattttccaaaagcgacttagagaatgatcttgacttttatgttgctagcaggtcaagattaggtgggaacttcaacgctcaaaatttaattccagaagatgtaaaggataaatcgagcttgctgagcacacgaaataagtacagtactaaggacgaaaagtgcagaagtatgccaaattcatcaaagcaaatgccatctcactactcaaactctactctccaggaagagctgggtgcacataacagttggcagtttgaggaaagaaatccttcagttgataagagttctgtagctgccccattctgtctagatctagaggcagattttgcagtattcggatccaagaataaaattgtagatccttttagtgtctttactacccctgaattaagtaacaaggtcaaggccagtccttcctctggtggatttaaaaaagctgcacctcttgcagattcacctccttgtagtttcacctctgaaaagtttgcatttgattgttcaaccgcattccccaatgttggttcatggccaaccagcccaagattatctccagattttcagaccaaggggaaaaagtctgaagacaaaaaagaaaatgtcagaatatgctccatcttccaaaaatcatatccaaagacaacaacacagtgtcttgtagaagctgattcctctgatcatgtggaggagatatcatcgttactgaagaagcctgacaaacaaggaaaccaactaggtctttcagcttatgcgtgtacagatggtattgaaggaggcatgtacatgatgaa

SEQ ID NO: 18632 - DNA, 429 bp, Glycine max
  Peptide Sequence Number=SeqID_135410
atggatacaaatagttatgacttgggtaatggtgctaagtcaattgtaaatatgaagcaagtgacgagcaacaggtttgagatattcatagatgaagatgatgtctccaccactaaggttgatatggaggtggtccctaatactccaatggatatccaggttaatgcactaggcctagatgggtttcggcctatcttttatcaaacttattgggatacggcggggaatgaagtttgggatttggtggctcaagcatttgctactagggagatcaatccaggtcttgaggagacccaagttattcctatccctaaagtgaacaatcctactactctgaaggattttcaccctattagcttgtgcaatggtctgctaaagacatatccaaggttttggtctagagaattagaccttacatggatgagttga

SEQ ID NO: 18633 - DNA, 522 bp, Glycine max
  Peptide Sequence Number=SeqID_135411
atgcaagtgactcgtccttacgagtcattgttcattgacgtttatgcttctctccttcgttgttgcttcttcttccttgcttcttcttcgttccctattctccctattgtccatattctctgctattcattgtcttccgctttgaggagtttgtcatcttctccattcatgcaacaagctttttcttcttcactgtggtttctcatcttcttcgtcgttcattggcttgacgcatttttgttctccttcgagataatggttagaactagagatctcggatgggctttagggcgagcaataggaaaagccctagggaagagagaggttagtggcgatgataatgatgtccccaatggcaaaggcctgccgcattttcccgtagaggaattaaatgaagagcaaaaacaaccacccgttgaacaacgtgttacgaatgttgagggttttccagacaaaccccatgacagatcaattttgagagattttgaaacttgcgttgctttgagagcctggaatggagag

SEQ ID NO: 18634 - DNA, 258 bp, Glycine max
  Peptide Sequence Number=SeqID_135412
atgagggttcatatcaccttgggttcattgcaagaagtaggatttgcttcttggttgatcactggacacaaaagaccatcaccttttgggttcattgcaagaagtgggtataacttcttggttgttatcactggacacaagggaccaacattccttgaggatagtggaaatctcaggcgggttgcttggggattggatgtaggcacgggttgtgaccgaaccggtataaatccagttttgcattctctatttccttaa

SEQ ID NO: 18635 - DNA, 180 bp, Glycine max
  Peptide Sequence Number=SeqID_135413
atgataatggttagaactagagatctcggatgggatttagggcgagcaataggaaaagccctagggaagaaagaggttagtggcgatgataatgatgtccccagcggtgaaggcctgtcggattttcctatagacagtgacaagaggtgcgtgttgttgaggatccgcctactgtcgtag

SEQ ID NO: 18636 - DNA, 941 bp, Glycine max
  Peptide Sequence Number=SeqID_135414
ggctgagcctcaagcttcctagcataaacaatggttcaggagttgaggctgagaagtcccaatttctagaattttcgatgaacttgctaaccactacactacggcttagcaagcctttgaactacggctcagccctggtcaaggaattttatccaaacctctatgatccagaggatcgctccccgaagcaatgtaaggtgcaggggaagctgatcaagttcgatgctactacactaaatgaatttttaaagaccccagtggtcttggagcctggggagaggaaggatctgaccacactggctgagacttggagtgtcctttcttactccaacctcgcccccacttctcacacctctgactttaacatggataaggcgaggttggtatatggactcgttatgaggatggacatggacgtgggctccatcatctcaggccagatctctcagatggcccagtccaactcctctaggcttggatttcctttactcattacaacattgtgcatagccagaggagtcgtccctgattcgctcactttcaagttcttcagcccgaccattaacttggcctatattaggaagaactgttggaacccagatgatccaactattacatttcctaggtcccgcaaggccaatgctagggctacctcagatgcttctacttcaacccttgctcctacaccagcaccagtaccagctccagtccctccaactccagtctcaatccctgtgggcccttccatgcagagcacagatgctatagtgctgatgctgcagagccttcaccacgacctttgcccgactcaggcccctggagacgctgaggacaccccagctaacacagctgcagatcaagcagtagaggatgacacgccagaggctggggatgctgaggagacacttgcagccacacttatagagatcactgaggaatga

SEQ ID NO: 18637 - DNA, 279 bp, Glycine max
  Peptide Sequence Number=SeqID_135415
atggacaatagggagaatagggaacgaagaagaagcaaggaagaagaagtagcaacgaaggagagaagcagaaaaggcgaagggcattttagccctttcaccttggatgatctctgtcccagcaaaaatgtttgttgcccaaagcaacaccccaaaacaagaccaacaacattcaacaccaaattaaatgcaccattggtgggtggcacggtggaattggagtacagttggtggaatggtgggtggcacaaggcaaagtggagagtcgacgcacgttag

SEQ ID NO: 18638 - DNA, 585 bp, Glycine max
  Peptide Sequence Number=SeqID_135416
atgaatgcgccgccttcgctgacaccgcaaccatttccttctcctcctccatccattcctgccaggttcaaaaaaggtatgagcaaatcagggcgaactgtcattgccataattatgccaattgtctccataagtacatttgtcatctttacgtgcatgtatttaacaggaaggaataggaagaattttgaaagtgaatctgaagctgaatatgaaattgaaccaactgagacattacaattggacttccaaaccattatagacgcaacaaataactttgcagatgcaaataaggttggacaaggtggatttggaccagtctacaagggtaggcttcccaatggcaaagaagttgctatcaaacggttgtccaggggttctggccaaggagatatagaattcaaaaatgaactgctattagtagcaaagctgcaacaccgaaatttagtaagactattgggattttgtttggaaacaggagaaaggatactggtgtacgagtttcttcccaataaaagccttgactacttcatatttggtaataccatttctgcttgtcttccctgtatatcactttttggttga

SEQ ID NO: 18639 - DNA, 2010 bp, Glycine max
  Peptide Sequence Number=SeqID_135417
atggtctctccaaaagtactttctttcttttttctactttttactctgatatctcaagctactgccaagccagaatacccatacgctgtttgcatcacagaaggtggagattatgcccctaatagcacctaccagaccaacctcaataccgttctttcaaggatcatttccaccacacaaaatgattatggcttctacaattcctcctatggccaagaacccgacagagtctacgcaaatgggctttgcagaggagatgttaccccacatgcttgccttacttgcctcaacaattctcatttacttctcctaaagcagtgtccacatcagaagcgtgcaataggaggatatgctgaatgcatgctgcactattcatatcgctcggtactaggttactatgattctgatttccgggtctacttgcagagtaaaactaatgtaaaagattgggatcagtacagttacgtgctgatgaagttgctgtcaagactaaaagtgaaagctgcaacaactgattcctatctgaatcgtaaatatgcttcaggaaatgcaacaattccgggttctcaaactatatatgccgttgttcagtgcgcacctgacttgacagtggcacaatgcaacgactgcttagatggtgccatttcagaaataccaaaatgttgtaatcacatgtcaggtggtgtggttattaaattcaggtgtaacttcagatacgagagctctaggttttatgagccaacggctgatacactaacactacaattgtcaccacaaggatctccatctccttcacctacaccagcatctacaactgcaaattacccagagagtacttatcatggtattaactattacaacatggctagaagaaaaggcaacaaatcacaagctgcaatcgctaaatatgttgtgcctattgttgtctttgttgggtttctgatctttgtttgcatctatttaagagtgagaaagccaacaaaactgtttgagagtgaagctaaggttgatgatgaaattgagcaagtagggtcatcactttttgactttgacaccatcagagtcggtacaaacaacttctcccctgccaacaagctaggacaaggtggatttggacctgtttacaaggggatgctcttcaatgaacaagaagtagcaatcaaaaggttatctagcaattctggccaaggagaaattgaattcaagaatgaagtgctattaatgtccaggcttcagcatcgaaatttagttagactccttggtttctgttttgaaagagaagaacgactccttgtctatgagtttcttcctaataaaagccttgactacttcttatttgaccccatcaagcgtgcacatttggactggaaaacacgctacaaaataattgaaggcattgcacgtggccttctttatcttcatgaggattctcagaggaggattattcaccgtgatctcaaattgagtaatattcttttagatgccgatatgaatcctaagatttcagattttggctttgcaaggctgtttaatgtggatcaaactctgtttaatgcaagtaaaattgcaggaacctacggatacatggcacctgagtatgcaaggcatggaaaactctcaatgaagttagatgtctttagttttggtgtaataatactagagattgcttggacaaacttgaggaaaggaacaacagctaatattatagatcccaccttaaataatgctttcagagatgaaatagttagatgcatttacattgggctactttgtgttcaagaaaaggttgctgatagaccaacaatggcttcagtggtgcttatgcttgagagccactcttttgctttaccagttccattgcaaccagcttattttatgaacaacagttgtttatcagacatccagtttttggggtgcagttctgcggaaacaggatcaaatgaacagagaagtaactctgctgatgtatcagcaaatgaggcttcaattagtagtctatatcctcggtag

SEQ ID NO: 18640 - DNA, 2028 bp, Glycine max
  Peptide Sequence Number=SeqID_135418
atggccatggtttcaagaatgcctatattcctttgtatccttgtcatactcatatccatatctcaatctaacgcccaaccaggattcttataccacttctgtatcaatgacaagggtaattacagtgctaacagcacctaccagaataacctcaacacccttttgtccaacctctcttccaacacacagattgactatggcttctacaatttttcttatggccaagaaagtgacagagtaaacgcaattgggctctgcagaggagatgttaagccagatgcttgccgcatctgctttaatgattccaaagtgcttctcacgcaactgtgtccaaatcagaaggaggcaatagggtggtatgacaattgcatgttacgctactccaatcgctcaatatttaacaccatggaagccttacctagtttctccatgcggaaccatggtaacacaacagatgttgatcaattcaatcaagtgctgaggaccttgctatatagcctcgtaggccaaggttcatcaggggactcccggcataagtttgctgcagcaaatgtttcaggaccaggctttgaaactatatatggtcttgtgcagtgtacacctgacttgtcagaacaagaatgcacttcatgcttggttgatgctatctcagaaattccacgatgttgtgatagcaagaaaggtggtagagttgtaagacccagctgtaacttcagatatgagacataccccttttacactcctaccaatgttgcaataccacaagcaccagcaccaaaggtgtctgctcttcctccttcatcaacagatacattgtccccagaagggaagagcaacacatctctaattgtaatagcaatagtcgtgccaatcattgcctttgtcatactagtaattcttatactcatctatttaagaatgaggaggtcaagggaacacatcgaagttgaacttgaaaatgatgatgaaattagatcagcggagacattgcaattggacttctccacaatcgtggctgctaccaacaacttttctgatgcaaatgagctaggacaaggaggatttggacctgtttataagggtacgctctccaatggaaaggaagttgcagtcaaaaggttgtctaggaattctctccaaggtgacatagagtttaagaatgaagttctattagtagccaagcttcagcacagaaatttagttaagctactaggattttgtttggaaagaagtgaaaggctactggtgtatgaatttgtccccaataaaagccttgatttcttcatatttgatcaaaacagacgagcacaattggattgggaaaagcgatacaaaatcataggaggcattgctaggggccttgtataccttcatgaggattcacgattgaggattattcaccgtgatctcaaagcaagcaacattctcttggatgcagagatgcatcctaagatatcagattttggtatggcaagattatttgaagtggatcaaactcagggaaatacaagtagaattgttggaacctttggatatatggcaccagagtatgcaatgcatggacaattctcagtgaaatctgatgtttttagttttggtgtgctgattctcgagattgtaagtggccagaaaaatagttgggtatgtaaaggggagaatgcaggggatctactaacctttacatggcaaaactggaggggagggacagcctcaaacattgttgatcccacaattactgatggttcgagaaatgaaataatgagatgtatccacattgcgttgctttgtgttcaggaaaatgtggctgatagaccaaccatggcttctgttgtacttatgcttaacagctactctgttacgcttccattgccctcactgcctgctttcttcattgatagtagaagttttccagccattcaatcagaagagtataatccaatggcagcaggagcatcagatgaatcaaatgctcgatctgtccaagaatcaataaacgaggcttccattactgagccatttcctcgctag

SEQ ID NO: 18641 - DNA, 1201 bp, Glycine max
  Peptide Sequence Number=SeqID_135419
atgtttctctcaaacaagcatgttgatgttacctttcttctgttcctatttatgtttgaaattggatcatcttcagcagcacccgtttacaacgctaattactgcccaaacaacacatcgtacaattccaacgtaacattccaaaccaatctcagagtcctcctcgcatctctcgtctccaacgtgtcccaatctgacggttcctataactccgccatgggaatggggaccacaagcgtcgccagcggccaattcctctgccgcggcgacgtctcccccgccacgtgtcaagattgcatcgccagcgccgccacggaaataacgcgactctgccccaacaaaacagagtccataatatggtacgacgagtgcacgctccgtttcaccaaccgctacttcgcccccaccagcatcgacccgggagcgaggttgtcggacgacaagaacatctctgcctccgacttggacagtttcaaccagacattgttcggtttgttgaacgaattggtggaagaagctgcgaattctcagtcagcgaggaaattcgccaccggcgaaagcgaattcgccgggtcctcgccggagagaacggtgtatgccctgacggagtgcgagccgagcctaactattgctcagtgtgaagagtgtttgcaaaacgccgtttcgactcttccgtcgtgttgcggaggaaaacaaggcgccagggctctgcttgcgtggtgcaatgttagatacgagttgtttcagttttacaatactagcggctcgtcagcaccgtcatcagaaagtgacactttggagtctttacaatttgggttgcccacagttgaagctgccacaaagaagttttcacatgaaaacagaataggtgaaggtggatttggagaggtttacaaggtccctgtacttagacagctttggaattctcatcactcacacagcgttgtccaacctagaaagaggccattgggtggtatgataattgcatgctacgctactcaaatcgctcaatattcgagaccatggaacctgactctacgtactttctgtggatttaacaatgcaactgatatggatcagttcaatgagggtcttaggggcatagtggatggtctcagaagcaaagctgcatctggtaattcccttaagaagtatgctgcaggaagcgcagctggtccaagctttcaagcagaattttctc

SEQ ID NO: 18642 - DNA, 1366 bp, Glycine max
  Peptide Sequence Number=SeqID_135420
gttgtcggacgacaggaacatctctgcctccgacttggacagcttcaaccgcacgttgttcagcttgttgaacgatttggcggaagaagccgcgaattctcagtcggcgaagaaattcgccaccggccaaagccgattcgacgggtcctcgccgcagagaactgtgtatgccctggcagagtgcgcgcccaccgaaacgagtactcagtgtgaagagtgtttgaaaaatgccatttcaactcttccttcgtgttgcggaggaaaacagggagcgagggctctgcttgcgcattgcgatgttagatacgaattgttcctcttttacaatactagcggaacgtcaggaaataagaaatctgtatcgcgagtaatcttgattgttgtccctgttgttgtgtcggtatttctcttatgtggtgtctgctatttcatattgaaacgatcaaggaagagatataagactcttctaagggaaaattttggggaagaaagtgccactttggaggcgttacaatttggcttggccacaattgaagctgccacaaacaagttttcgtatgaaaggagaataggtgaaggtggattcggagttgtttataagggtatttttcccgatggacgagaaatagctgttaagaaactctcaagaagttcgggacaagatccctacaagagcaaacaattgagctggtcggaacgttacaaaattattgaaggaattacacaaggaatttcatatttacatgaacattcacggttaaaagttatacatcgggatttaaaacctagtaatgtattgttagatagcaatatgaatccaaaaatttcagattttggaatggcaagaattgttgctattgatcaatatcaaggaagaacaaataggatcgtgggaacatacggttatatgtctccggaatatgcaatgcatggacaattttcagaaaagtcagatgtttttagttttggagttatagttttggagataattagtgcaaaaaggaattcgcgttctgcttttcccgatcatgatgacctcttgagttatgcttgggaacaatggatggatgaagcaccattaaacatatttgaccaaagtattaaggcggagttttgtgatcacagtgaagttgttaaatgcatccaaattggtttattatgtgtacaagagaagccggatgacagacctaaaatggcacaagttatttcatatctcaatagctctataacagagttgccacttcctaaaaaaccgataaattctagacaaagtggaatagttcaaaagattgcagtaggggaatcgagttcaggttcaacaccatctatcaatgaaatgtccgtgagtatatttattccccggtag

SEQ ID NO: 18643 - DNA, 282 bp, Glycine max
  Peptide Sequence Number=SeqID_135421
atgtgcagtgtgggtggcaccaacgtggaagaacttgatgatgatgatgatgaggatgaaccgataaccgttgaagatgaggtccacgcgggtttgaacaaggaattcactcatgaaaatgtagagcatgctgaacacgaaactgattcatacatgggtggttttgaagctaacaatggtcaacaaccttacattagaatgaaatttgagtcaaataaaaatgttggtctttcctacgcttgttatgctaaaagtgttggatttggtgggtcaatagagtag

SEQ ID NO: 18644 - DNA, 384 bp, Glycine max
  Peptide Sequence Number=SeqID_135422
atgggcgaatgggaaattccaattggtgaaaatgcttcccatcttgtgtatgctgcattgctgctgcctgagtcggttggagccttggagatgattgccgagaattttaatatacatcaagggcttcaaaatcttatgcatatgcataacttcatcaagggcttagacttgcaagttgtggagaatgttgaagaagctggatttgttttggctcatggtaccaaaatcttggggaatgccgatgtgaatgcacattctatgaaacttgaagacatggatagaattttggatccttatgtttccaaaggaactcctacggtggtaaccaatccaaattatgtaaatgttgagcaagagggtattttccggaaagaggggagttaa

SEQ ID NO: 18645 - DNA, 267 bp, Glycine max
  Peptide Sequence Number=SeqID_135423
atggatttggatttggcacttagaatggaacgacccacttccactccgaaagcctccaatgagcgctttattccagaagcgtttcagggctctatttctgagggtgaaaatgcaaagaaatttattgatgaaattgaaccgtactctaccaaaaatgaaaaggcggagacgagtaactttttggctaaactcatctccattaagtataagggaaaaagtaatacaagggagtacataaggaaatttctaacttggcatctaaactga

SEQ ID NO: 18646 - DNA, 282 bp, Glycine max
  Peptide Sequence Number=SeqID_135424
atggagtggtatttatggcatttggttcgccagcaggcggccaaccacagggggcaggtgcagacccttgggtgtctctaccagctcagcctctgtctgcagagccagggcttcgctccttttgcatgccctactccagatcagttcagggcagaggtcgcatggcccggagattggcctgaggcccaggcaggggaggctcccgacggtgcaggggacgcccacatggatgaggagatgacagatttactcgatttattgggaggaagcggagccacgtga

SEQ ID NO: 18647 - DNA, 440 bp, Glycine max
  Peptide Sequence Number=SeqID_135425
gtagctgtgtctccggcaaaaccacctccaaagcccgatccagaggtcgatgatccgctttatctgacgacattgaccatctcagagcttttcttgaggccttatcaggttacatgggatgccactgtgtttggggtctttaatccagatttcccgctctacataaagctcgaagacctctccgaaatcgcacacggtggtcaatgtctcaacatatcagtgttacagttatggattctgcatctcactgaaacatgtatgcgagcggggaattctgatatctatggattcctcgagccacagtccattcagaggtctaggcaatcgcagtttgagtctgaaagttacataaagacttggatgcagagttcaaaacgcgatgtctatcttggagcctacctaaatgggccagacaactaccttaaggggattattaacag

SEQ ID NO: 18648 - DNA, 600 bp, Glycine max
  Peptide Sequence Number=SeqID_135426
atgaagaagctgattgcttattcctccatctcacatatgggctttgtcacactgggcttttttatgttcggccaactggcgcttgagggagccatggtgcagatgatttcacatggctttatttcttctgccatgttcctcagtgtcggcgtgctgtatgaccgcgtacatagccgtgagatttcggcttatggcggtgtcgtcaacaagatgccagtgtttgcggcttttgccgtcctgtttgccatggctaacagtggcttgccaggcacctcaggtttcgttggtgagtttatggtgatattagccgcagtgaaattcaatttctgggtggctttcttcgcagcaacgaccttgatttttggggcagcctataccttgtggatgaccaagcgcgtgttctttggcaatgtgactaaccaccacgtcgcagaactcagcgacctcaataaacgtgagttcctgattctgggtattttggccgtgctggtaatcggttttggtgtgtatccggaacctctgacagaggtcatgcaggcgacaagtacagaattcctgaaacatatggcgatttcaaaattgcccgtcacaggctattaa

SEQ ID NO: 18649 - DNA, 135 bp, Glycine max
  Peptide Sequence Number=SeqID_135427
atggatacaaatttttggctgctacttagtatcggcaataggtctgaaaaagtatctaaaaatatgaaatttagatatttgtaccctgtcgaggtaaggaaccatggtgttccagaaatgtctgcgatcgagtaa

SEQ ID NO: 18650 - DNA, 360 bp, Glycine max
  Peptide Sequence Number=SeqID_135428
atggtatcaaggtacactttaaatgaaattgctactaagtatgagcatataccttatgcaggaaaaaatcctacacgttgtggatgtgtcatgaggagtacccatggtcttccatgtgcatattctattgaaaacattattgatgtcaaagcggatggtaattgtggttatcgggcaatagctgccttattgggtatgggtgaagaaacatggtcattggtgtacaactacctgcataaagaactgacaagttggtcggaagagtatatcaacctgcttgatagctgtttacgccccgatgttacttgttactgtggatgcgtaattctaaccggcaagtgttgcgagtcgtgcaagtaa

SEQ ID NO: 18651 - DNA, 895 bp, Glycine max
  Peptide Sequence Number=SeqID_135429
atggctacttcatcttcacgccgcatccgtttagggctgtttgtgcaaccggtaggacagcacgtgagcggctggcggctgacggaaaatctgggcgatccgacggatattgactggctgatcaccatcgcgaaaaaagccgaagccggtaagtttgatctgttcttcgtgggtgatgcactggcgaccagcatgtatcgtctgccttccaccatggcgcgtctggagccgttaacgctgctgtcggcgctggcggtcaacaccaaacgcattggcctggcggcgaccgcctcgaccaccttcagcgacccgttcaccatggcacgcagcttctcgtcgctggaccacatcagccgcggccgcgccgcctggaacgtggtgacgtcgttctctactgatgtggcgcgtaacttcagccgcagcgatatgcctaatcatgcggagcgctacgcgcgcgcccgtgaattcctcgatgtcacctataagctgtgggacggctggcaggcgggggcggtgcagcccaacaaagagaccggtcagtacttcattgatgacaaaattcagccgattaaccacgtcggcgagcacttccaggtgcagggtccgctgaacattacccgctcaccgcaggggcgtccggtgattatcgaagccggttcttccagcgatgggcagaagctggcggccgagaccgccgaggtgattttcaccgcctcggccagcctggaagaagcacagagcttctaccgttcgcagaaagatcaggtgattgccgccggacgcaatccggatcacgtggtgatcatgcctggcgtgatgccgattgttggccgcacgcgcgaagaggccaaagcgctgtggaaagagctcaacacgctggttgatatcgacaacg

SEQ ID NO: 18652 - DNA, 510 bp, Glycine max
  Peptide Sequence Number=SeqID_135430
atgaaatttagcaagaatgacaaatcaaaagatgaaggaaggacaaaagcaatcagaaaaacaatttatgaaactatctgtccttacgttctcccacatgatgacttgttgcaaagtaatacaagtcaaaatagtcatgatagtgatagcagcattacccgggtagtggatacagagtttttcaataatctagctttggtcgagggtgcaagtgttaaggtggttcgtcgacaagtggtagttgtgttggtggttggtgtgacggttaatgatagaggtaagatagacgaagataagtggatgcatgacaatgtaatatctgaagaagttgatatgaatgaagaaaatgaagatgaacctggtgtgtatcaacaagttgattgttctgatgccttcaataatttttcagcagaatggagaaggaagaaagatgattggagatgccacttcaaggataacatgagtcaagaagaagctcaccaccataggaagccatggataagagcttga

SEQ ID NO: 18653 - DNA, 390 bp, Glycine max
  Peptide Sequence Number=SeqID_135431
atggaaggaaggaaaagaaggagtccttttctcatgtggaggatacccaaacattccgctgattggctcgccaagttaaaagtcgtcagcgaagagagttttgaggcaccgaaagaagacgaagaagtccaagctctcaaaagcgagttaggaaaggtgaaacttgccaaggagaagccaagttggccgctacacacattcggaaggagtgtgccgggttacgggaagagaatgcaattaccgcaagagcccttgaacaagaaaccaagagggctcgcaaggaagagtatggccggaataattttcgcggagctctatggggtagcaatagtgaactcaagctgtgaagggaagagagggaccagtcgcgagcacatagcatggttctga

SEQ ID NO: 18654 - DNA, 756 bp, Glycine max
  Peptide Sequence Number=SeqID_135432
atggaggccatgaaagagcaaatggccacaatgatggaggccatgatgagcatgaagaagataatggaagccaatgcggttgcagtttccgctaccagcgctgttgctaaggtgaacccgatgcccccatctggcctcaaccaaataaatcatccaatcccaaatatggtaggtctagaaggcaaagagttgggaggtacgggcggccctcatttagtgcgaaaaacaagcatgccttcccgccatatgccttgcctcctaattatacaccaccgtctgatactcattgagagccaacaacctcaatctaatcatgcacatgtctctcaacccatgggggagacacatgaaatgccccaccacaatttagccgacttcgagccttgcctcggatatgccactgaagggcaagcagttggtgaaatgggaaagttggatcatatagaggaaaggctaaaggtcgttgaaggaagcggaggttatgcctttgataacctagaagagttgttcgtggtacccaatatcatcacccctcccatgttcaaggtgttggactttgacaagtgcaaggggactacttgccctaagaaccatctaaagatgtattgtcggaagatgggggcttacgcaaaagatgaggaactgctgatacatttcttccaaaaaagtcttactggggtagttgttacctggtacattaacttggaaccttcccaagtccattcttggaaaaaccctaatggttgccttcattag

SEQ ID NO: 18655 - DNA, 354 bp, Glycine max
  Peptide Sequence Number=SeqID_135433
atgtatcagtattctttcgaaggtcatgatactgatatgtctgcaagcgagcattcgtatggtggtgttgcggaaacacaccctcatttttcatggccgaccatgaccccttcgcagcaacatgatgccccaatggcaacacctaatgccccattagctccgcaatggaatgtacccggggcaatacctgatatgggtgatttattaggtgttgatttgcgtcacgagttttctgctgaggctgagcaacaagggcggcgacagtgggcaagaagaaatcctgatcgtgaagcccaaaggtgggatcgaccatgtggcacaggctcacgccatcacggacaccataatgactga

SEQ ID NO: 18656 - DNA, 471 bp, Glycine max
  Peptide Sequence Number=SeqID_135434
atgggtcaaccttacacactgttcctttttgcaggctttcagcagggtccctataatcaacaaggacaatggaggacacaccctggcaatcagttcaacaaagaccagaatgggccttcaaacaggccaatccaacaaggacctaacatattccagagaactactaagttggaggagaccttgactcagtttatgcaggtaacaatgtcaaatcataaaagcactgagtcagcattgaagaaccttgaggtccaggtgggacaactggtcaagcagataactgacaagtcatccaacagttttgtggcaaatacagaacataatcccaaggaggaatgcaaagctgtgatgacaaggagtaaaaggtttgtggaggttgaggatgaggatagtgttgtacataagaagaaaactgttgacaaaaaaggtattgatggtgatgcaatcctatcccgcaagggcattgggtag

SEQ ID NO: 18657 - DNA, 699 bp, Glycine max
  Peptide Sequence Number=SeqID_135435
atggagaaaaaggttatctacaatcaggaacagcagaaactgtatcgcggtcagatttcctctattgaaaaactaacaaaatcctatcagaatcagttaaaccttggaaacataagcaaatccgaatatgtgaggctgaaggcccaggaaattgaattcaaaaagaaattaatttcattacaacaggaaattgcggaacaacaggtcgagttgaaagctttactcatccttccggctacatcttatcttgttattacagatcatttgtcaattcctgaaaaggaactttctgagttggaattacccaactggctgaatatggccaaagaaaatcgtccggacatccagattacaaaaaataaagagaaatacgcacaaaaaaatcttgaattacaacgagctctcagaactcctgacatagcgctctccatgggatatgaccggggtggaaatattatgaaggattttgtagggttgggtatttcatttgatcttccggttttcgacagaaataaaggaaatatccaggaggctaaactggaggttaccaaatccaattttgagacccgcaaaaacatccttaaatcggaaaatgaaatcgtttccgtatttcagaattatacccgaacgcaaaagatttctgaggaactcgatggatcggatgaaagtaactttggatggtctattggccagtcatga

SEQ ID NO: 18658 - DNA, 1031 bp, Glycine max
  Peptide Sequence Number=SeqID_135436
atggcaagtgtaagtaacctgaacgctggaacgaacctcggcttaagcgatttatatgaccagctgcaaacggcggagcaggctaacctgacgccgattacaacacaacagacttcttataaagccaagctttcagcatggggcatcgtgcagactgcactgcaaaaagtgcagactgcggcggcagcattaaaagacacttccgctatcgcctcgaccaaagtcagcagcaccaacaccgcgttcactgccacgctggccaatgatgcggcggccggtaacttttcggtagaagtgacccaactggctaaaacgcagtcgcttctgtccaaaagtgccacgagcaaagatgccgacttaggcgatagcagccaggcttcacggactattaccattacgcagccgggtcagaaagacccaatgaccatcacgctgagcaaagatcaaaccagcctgacggacattaaagatgcgattaacaaacagcagggcagcgttaccgccagtatcatcaaatccgatgacaatacctattatctggcgctgacctcgcgcgataccggtaccaccaacgagatgacggtgtctaccgatgacagcgccctggcgcagtacattggttttaccaaaggcggcggcagcaatggcatgacggagcaggtggaagccgccgatgccaaattgagcatcaatggcgtcgccattacccgcagcagcaacaccattacagatgcgccggaaggcgtcacgctgagcctgaccaaaaccaacactggcagcccggagaccttatccgtcaccaaggataacgcaccgatgatcgccgcagtgcaggcttacgttgacgcgtataactcgctgcaaaccactatcggtaatcagaccaagtacaccgccgtggatcagggcagtacctcgcaggactccagcaatggcgatctgataggtgatggcacgctgcgtaacattcagaccagcctgcgctctaagctatccaccagtgcccagagcggcggcagcatttccctgct

SEQ ID NO: 18659 - DNA, 540 bp, Glycine max
  Peptide Sequence Number=SeqID_135437
atgctttcttttgacttccggcatgtcacagaacttcacggattgcgtaacgatgggtgtcaagtacctcgaagtggtcaaacgagggtcgcatcccaacaaacaaatggtccccggacgaaattagggtatgacaatgaaattttggctccaaagtttggctccacaaattcaaattccagagctcttttagagcacaaaatttcgtgctcttctctccttctcccttcattcatctccttcttcctccaagctcttatccatggcctcctatggtgtgacgtctcctctctctcttccttctccattctgctgccattcatcttccaagaagcaaaggaatccattgatgaagaagatcctagtcctacaagctccaatggagcttacatcaacttgtctaacacattcctcaatggattaatccaaaaggaagtttatgttgaacaaccttcaggatttgagagtgagactcttcctcatcatgtttttaaacttaataaatccttatatggactcaagcaagctcttagagcctag

SEQ ID NO: 18660 - DNA, 191 bp, Glycine max
  Peptide Sequence Number=SeqID_135438
ggtaccctacaaacctaaaatggtcacccaaaagaaggaaaacttattctaatatttacaaagaaaagtggacccaaccttggcccatgggctcagaaatctaccctgaggttcatgagaaccctagggccttctttagtagctctagtccaatcctcttggagcctcttgctcatggctctggtgactag

SEQ ID NO: 18661 - DNA, 363 bp, Glycine max
  Peptide Sequence Number=SeqID_135439
atggtgagggtttggacgaatccattgcaatgccaaccgcaccataacctctcacgcaatgttcctctcctccaacatttctctgattgctatttcacttttgtcgccaccagcaagggtttcaagaatttcagtttgggaaaaggagtcgtcgtggaggtgaattgcagcgatgacgatcagaggaggagtttgcggtatggtttaagtggattggagatgtacgttgattacaatgaggagctctctacgattgtgctcgatttgttggaaattataggatttaatcatcatatcgaagagtcgaaatggagcgatgaagtgagtggtggaaatggttttgaattggaagtaatgacatga

SEQ ID NO: 18662 - DNA, 495 bp, Glycine max
  Peptide Sequence Number=SeqID_135440
atggagagaagtatgattgatgctgccagtggtggagcccttggagacatgacccctgctgaagccagaaatttaattgagaagatggcttccaactcccaacagtttagtgccagaaatgatgttattgtcattagaggagtgcatgaagtagccttgaattcatcttcatcagttgaaactaagaagcctgagggtaaactagatgccttggttaacctgcaaaatcagccacaacagaacaactatgacctctccagcaacaggtacaatcccgggtggaggaatcatcccaaccttagatggtcgagtccttcacaacagcagcaacaacaacaaccttattttcaaaatgctgctggcccaagtagaccatacgttcctccaccaatccagcaccagcaacaacagcaacaaccccaaatgactatgaggaaaaaactatgcaaaacatgcagtttcaacaagagaccagaacctccattcagagcttaa

SEQ ID NO: 18663 - DNA, 498 bp, Glycine max
  Peptide Sequence Number=SeqID_135441
atgggacccacatacagtgatatggggtgcaaactagcccttgaagacaaaaaaagagtcgcatttaggaggaagcagaggcatgaacatgttgatgcaacaaggcatgccaaaccttgcaattgttcaagtttggcctctcagcaacaaaaagcctgtgtctgttgtttcatcaagctaccatgcagaatctgtcatcaagcactgaggtgtgcccgaaaatgggcatgttatggatcaaagaataatagggctgggtttgtgaattccttggcttttgcaaaatcaggagaattcttagttgctggagttggacatgtgaaaattttctcaaactgtgtcctgcttaccgttgtcctcaaagttggtatgtcatgtcaagggtgtgctggagcagtaaacaggattttgggaaaaatggaaggtatttttattcctgcaagctatctctactatcatatccaaaatgaaaatgatctagtaattgtagcaatgtag

SEQ ID NO: 18664 - DNA, 213 bp, Glycine max
  Peptide Sequence Number=SeqID_135442
atggttgtggaggaagccaagagcactatggggacaaatgcagaagaagaaaagatggtgatagtaaggtttggggacttgcaaacaatgagaagagtgaggactgggaagagattattaatgaagaagaagcaaatggctgcggctgcagaggctgagaagtctcttccggtgtctccggcgggtggtcctcagcctctacccttgttatga

SEQ ID NO: 18665 - DNA, 294 bp, Glycine max
  Peptide Sequence Number=SeqID_135443
atggcagaggtctccacggaggccattgcctctctcacccaatattatgaccagtctttgaggtgtttcacctttggggacttccagttaacacccacggtggaaaagtttgaagagatcctgggatgccctctgggaggaaggaaacttaccaaggaaatgtttggaaacaaaggtgaaaaccttggcaagtcaagacgaatgggccccgttcatggacgtcctagcgctcttgattttcgaagcggtcctctttccaaatgtagatgggttggtggacctggcagtgattga

SEQ ID NO: 18666 - DNA, 327 bp, Glycine max
  Peptide Sequence Number=SeqID_135444
atggggtacccgtcatatgtggtactaggtggcgatcgggcgatggtgcaagttgactctccacatccacaaatcacacataaatccaccatccccagttgcccacctttaactgagctcacttactcccacgtagccttatcctcgttcctctcaacaccgggttcccatcctcgttctctgaagattcgtcctcgtgctcagacgagcagtgttgcactcagcggatggctcgctaagccagaagattggcttagcgagagggtgaaaatcagcacttcacaaacttgcccaattaacctgaaattgagaggaaatgattattaa

SEQ ID NO: 18667 - DNA, 252 bp, Glycine max
  Peptide Sequence Number=SeqID_135445
atgggggtgcaaatagcaaccaggcccacttgggccttccaaaaaattcctccagaaggcggtggcaagcttctcccccattttcctataaatagggggagaagtgaagggaaaaaatgttcatccctcctggataaaaacaacttaaccaaacactttgttcacaaagaactacataggtctgatttccttatcgcaattaaggaatacataggagcaagggaaacaccctcgttgaccgcaaaaagataa

SEQ ID NO: 18668 - DNA, 132 bp, Glycine max
  Peptide Sequence Number=SeqID_135446
atggccactcctatgagtaatgcttgctatctggataaagatgaaaccggtcagtcaatagacataaagaaatataaagatttcaagcaaatcccaaagaatctcaccttagtgctgttaaaagaatcatga

SEQ ID NO: 18669 - DNA, 618 bp, Glycine max
  Peptide Sequence Number=SeqID_135447
gatgtgcgaaaaaaggcacaggctatccagaagcaaaacattgcccctcacgtgttgtctcatgggggttatgaatatttagaaaagaagttgatggatgagaagaaaaagaaaaaattggaggaagttgctcaatctgggagcactgacactgtcattgatcctccatctcccatcaaacgacacgtgaaatggaagctagcccgcaccaagaaaattgaccacatgacatttaaggtagcaaaggaaactgctgacaagattggacttgcactgcctcctgaacctaaggttggtcctttagctgctcgtgtcagcacaaaggagagttatgttgatccctcagggaatgatccagacacgggtgactctgacaaatgcaagttgtacatcaatgaatatcctccccgcttggttgccctaggaagagtttatgagggatccacaattgttcacaacattcctttgttgcatgatcaagtcaaggttggtgttgaggaggttagtgatgcagatgctcctattcttgtacccactaaagaggttaaggtcatagggcagacacttaacaccttcctttcttggccgacacatcttgtcaagcgtttatcagaacaa

SEQ ID NO: 18670 - DNA, 1212 bp, Glycine max
  Peptide Sequence Number=SeqID_135448
atgagcgatccttacgtcggtcagctgacctttgtgcgcgtctattctggcgtgctgcgcaagggtgacagcgtgtggatcgcggtaaaagggcgtaaagagcgcattggccgcatcgtgcagatgcaggctaacgatcgcatcgaaattgatgagattcgcgccggcgatattgccgcctgcgtcgggctgaaagaggtcaccaccggcgaaacgctgtgcgatcctgatgcggtaatcacgctggagcgcatggagtttcccgatccggtgatttcgctgtcgattgagccaaagaccaaaggcgatcaggaaaaaatggggctggcgctgcagcggctggcggcagaggatccgtcgttccggctgcacaccgatgaggagtccggtcagaccatcatctccggcatgggtgaactgcatctggagatcatcgtcgaccgtctgaaacgcgagtttggcgtggaagccaatattggccggccgcaggtaacttaccgcgagaccatccgcaaaacggtgcgcgaggtagaagggaaatttgtacgtcagtcgggcggtaagggccagcggccggaagcggtttcaccttttgaagacgcgaccaaaggcggcgtggtgccgcgcgaattcattccttcggtggagaagggcattcgcgaagcgctcaacagcggcgtgctggccggttatccggtggtcgacatcaaagccacgctgacgtttggctcttatcacgacgttgactcgtcggagatggcgttccgcatggcggcgatctttggcttcaaagcggcagcgaagcaggccgatccggtgatacttgagccagtgatgcaggtggaagtggagacgccggaagagtatgccggcggtgtgatgggcgatttgtcatcccggcgcggcacgctgcagggcatggacgagcgtttcggcgcgcgcattatccgtgctgaagtgccgctggccgagatgtttggctacgccaccacgctacgctcaatgtcgcagggtcgcgccacgtacagcatggagtttgcccactacgccgaagcaccgcgtaacgtcgcagaggcgattatcgcggctcgcgcacacgccgtcacgcccagcgcggcggcttcatcttcccagcgtttaacctcgtcaaaccagtcgcgctgcggcacagaaaagcccgccagcaggttggccttcatcacatccttgtaa

SEQ ID NO: 18671 - DNA, 243 bp, Glycine max
  Peptide Sequence Number=SeqID_135449
atggacatccttgtccctcatcctctcacaaacgcatgtttgcttattcaactttcaccggaatgtgggtgcaagccattggtctatttgctcaagcgacctgcgctcctgagtgttgacttccaagactgttcaatcagagattactcgtcttgcacgttggtgggggtcccaaagtttgtcttcttagagaagcgagttgtcaagaatatgatgttggacaaatggcctcagttaccttaa

SEQ ID NO: 18672 - DNA, 264 bp, Glycine max
  Peptide Sequence Number=SeqID_135450
atgagtcataacaacagcttccagaattgccccatgtatggtgttgcttgtcaatgttatgattcaacaagcgattctcctcaaatttcagccagcccgtatcaattagacttcacactttatgcttcggggtcatacaatgctcaatggaatgccccagggctcctccacgataagcacacgttgtgttcaagtcgtatcctcagaaaaatggaggttgaggaaccttggttggggtggtcttcgtcattggaagtgcggtag

SEQ ID NO: 18673 - DNA, 904 bp, Glycine max
  Peptide Sequence Number=SeqID_135451
gggtaatgaaatccaaggtccgattcctgttggtattcgaaatctcacacttcttcaaaatcttgacttgtctcaaaattcattctcatcttctatacctgattgcttatatggtcttcatcgtctcaagtatctggacctaaggggcaacaacttgcatgggactatttctgatgccctgggaaatttgacttctcttgttgaacttcatttgttatataatcaacttgaaggaaccattccaacttctttgggaaatttgacttctcttgttgaacttgatttatcaaataatcaacttgaaggaaccattccaccttctttaggaaatttgacttctctggttagacttgatttgtcatatagtcaacttgaaggaaacattccaacttctttgggaaatttgacttctcttgttgaacttgatttgtcatatagtcaacttgaaggaaacattccaacttctttgggtaatgtctgcaacttaagggtgataggtttatcatatctcaaactcaaccaacaggttaatgaacttttagaaattcttgctccttgtatttcccatggactcacaagacttgcagttcagagttcacaactttcaggcaatctgacagatcatattggggcatttaaaaatattgtgctgctagatttttccaacaactcaattggtggtgctcttcctagatcatttggaaaactttcatcattaagatatctcaatctgtctattaataaattcagtggaaatccatttgaaagtcttggatcactctctaaattgtcatctctttatattgatggcaatctttttcatggacttgtcaaggaagatgatcttgcaaatcttacaagcttgacggagtttggtgcatcagggaacaatttcactttaaaa

SEQ ID NO: 18674 - DNA, 1218 bp, Glycine max
  Peptide Sequence Number=SeqID_135452
atgtttggttgtttcttgtccctgccccattttgctgtttttgctttgcctgcccagacctttcttgttgcccttgcatcctttgtttctgctgatttctgcatctcttttgagatattgaaattaaaagattggcctccttctaatttatttgaggaacaattgcctcgtcattgtgctgagttcatatcttccttacccttcaaggaatatactgatcctcacaaaggttctcttaaccttgctgtgaagttgcctaatggttctctaaagccagacctggggccaaaaacatatattgcttatggatttcctcaggagcttggacgtggtgattcagtgactaagctccattgtgatatgtctgatgcagtaaatgtgttgactcatattgctgaagtgaaactggattctgatcaacttactgtcattgagaagttgaagcaaaagcatctcgagcaagagaaaagggagctacttggtgatgatcaagatggagaaactaatgttgacatggttaataattcatcttctacaataaatgctttggacaggcaaagtagtgttgaagtcatggaacaagaaggtggattatgtgatgggatagaagttgatcagtttcatcaaccgtctggtagtaatgaggttgccattgctaatgaggatggtatttcatatggatcagagctcatagaggttgacaaagtaaaaataaatcaaggtgatttgttgtttgggggggatgcttcagatggtgctctctgggatatttttcggagacaggatgtccctaagttgcaggaatatctgaagaagcatttcagagagtttaggcatgtccattgctgtcctttaaagcagttggatcatgccaatgaattatcaaactccctgaaagaaagtgccaatattaacactgttcgggcatcgcttattgttgaagaatgcacaagacttggtttgatgtatttgtgtattgctcctggatctagaccttcccctgttgctgttgctgctgaaagtcacaaattaatcacatgtatttcatgcttcgatgagcgttcacttgcatatcatgctgttggatatggaagaggatctcacattccagcagtagccattacatcatcaggcactgcagtttccaaccttcttcctgctggtaaaatacatttttggtccccctataatgctcaatctgcaattttggtctcctag

SEQ ID NO: 18675 - DNA, 816 bp, Glycine max
  Peptide Sequence Number=SeqID_135453
atgtcctccacttcagaggactacagctcctccccttcagaggactacgagtcctcgccatttgaggactacaagtcctcgccttcagagggctacatagggctacacatcctcaccttcagaggactacacgtcctccccatcagagggttacacgccttcgccttcagagaactacacgtcctcctctccagagggttacacgtcctccccttcagaggactacactcctttgcctttagagggatacacgttatcgcctttggaggactacacatcctcaccttcagaggactacatgtcctcgcctttggaggactacacgtccttgccttcataggactacacgtccttgccttcagagggttgcacaccctcgccatgagaggactacacaacctcgccttcagagggttacacgccctcacctgcagaggactgcaagtcctcgccttcaaagggctacatgtcctcacattcagaggtctacaagtcctcccctttagagggctacacatccccatcatcagaggagtacacgtcctccccatcagagggatacacgccctcaccttcagaggactacacgtccttctcttcagagggctacatgccctcccctccagaggactagcgtcctcaccctcagagggctacacactctcaccttcagagggctacacgtcctcctcttcaaagggctacacgccctcgcctccaaagggctacatgtcctcgccttcagggggcaacacgccctcagcttcagaggaatacacgtctaacattcagaggaccacatgtcctcacctttag

SEQ ID NO: 18676 - DNA, 385 bp, Glycine max
  Peptide Sequence Number=SeqID_135454
ggtgaaacttcctgcttttattgttgaccacagagtggtacctggagatatgtcgcgggggtcaggagaccttggggacgtcaggcgagctcctggcagtcaacagataaaagaaacaaagaccacaaagcaaggaggcttgtggtggctggccagctgtgaattttgtgtgatatgtggattatggcctctggtaatcgattaccaagggcttgaaaaacgaagtcaggaaactatgggagcccctggtaatcgattaccagcctgtgtaatcgattacacagagggatgggtcactggtaatcgattaccagagatgaaaagccttaagatactccttttaatgtcatgtagtggttatgagatgcattgtgcggcggcatag

SEQ ID NO: 18677 - DNA, 1363 bp, Glycine max
  Peptide Sequence Number=SeqID_135455
atgatgtcattgtggatgtcattgatcgctgccaaagaggttaatccctacgtgttgctggtgattatttctaccatctggctggctgacagtgccgcttattttgcgggcaagcaatttggtcgacataaactggcccctgcgatcagcccgggtaaaacctgggaaggggtgttgggcgccttactggcagtggctatatatgcgataggtttgaagctgttaggcgcagtttcaacctggtggatactaccgggattatggatagtgacgatcgctggtgtgtatggcgacttatttgaatcatttttcaaacggcgggccaacctcaaggacagtggccagtttttacctggccatggcggcttactggatcgtgtcgatggcgttaatttgcaactcgtcaccatacttggcagtaccggcactatcggtcagcagacgctagatgtgatttcacaacatccagcgcgttatggcgtgtttgctcttaccgcgcacagtaatgtggatagcatgttgcaacagtgcgttagataccagcctcaatatgcggtgatgcaggataatgatgccgcccagttgttacggcaacgcgtgcaagctgagaacctggatattaaagtgctgactggagtagaggggctgattgaagtggccgcacatccagatgcaaacattgtgatggcagcgattgtcggagctgctggtttgttacccgcgctagctgcagccaaggcaggcaaaaaaatcctgctggccaataaagaaacgctggtcatggctggtcaactctttatggatgccgttaagcaggggcaggccactttgttgccaattgatagcgaacataatgccatttttcaagccatgccaagagcgccttatgatgatttggctgaggtaggtgtcaaccagattatcctcacagcgtctggtggcccgttccggtgctacagtcaggcgcaattacaagaagtgacgcctgcgctggcactcaagcacccgaattgggtaatgggtgccaagattacgattgattcctctactctcatgaataagggcttagaggtgattgaagcgcattggctatttgatgcacgtcctgatcaaattgaagtcgttgtgcacccgcagagtgtgattcactccatggtttcttatgtcgatggcagcattttggcgcagttgggtaatccagatatgcgcacaccgattgcttatggcttgggttatccagagcgcattgcctccggcgtgaaacaattgagtttgattgatgtggccaagctggagtttgaggcgccggatatacaacgttttccttgcctcagattggcttatgacgcattgtccgtcggcg

SEQ ID NO: 18678 - DNA, 306 bp, Glycine max
  Peptide Sequence Number=SeqID_135456
atgaggattccttttttacaggccaaggttcaaaaaggtctaaggttgtgtttcaatggggtcttttatcgtgggaacccaatcttgatatctgggccgaaacaaatttgggtgtcaaggtgtcggtctcgggacgaactcccctatcactccgctacaaccaggtgggcactcaagcatcctgtttatggcattgtgatactacggttgggagtttacacagacagacccgacgtttccaagttatgttctttcatcagttcaatgaattcatccatccttatctcggttcattccggaaaataa

SEQ ID NO: 18679 - DNA, 165 bp, Glycine max
  Peptide Sequence Number=SeqID_135457
atggtggacgtggatgtagttaaagaacaagttccacaaaatcttgaacctaccaagtgtgatggttgggattgtttaacatattgtgatgaaaacaattatggtttgaatggcattcaggatgcacgtaaatttgtaaaacgtctaattcagaagcaacattga

SEQ ID NO: 18680 - DNA, 234 bp, Glycine max
  Peptide Sequence Number=SeqID_135458
atgaagatgaaagcaaacaaaacaagaaatgaattgaaagtctcggattcgaacacttaccggttgaagaacaaagaaagaatgaaaaacggacgaagaacggtgaagaatggaggaaaatcttcacagatttgctcacggaaatgtctcggaagcgttacggaagcacttcgactcgatttttcttcacggaaacgtgttttttacccaaaacaactgaaatgcatagcctag

SEQ ID NO: 18681 - DNA, 249 bp, Glycine max
  Peptide Sequence Number=SeqID_135459
atgtgtcaaggtatcggtctcaggccgaacttccatatcattccacaaggcatgtgcaacaatgatgatttggaaacaacgtgcaaaattagtcatggccacagccaggtgggcactcaagcatcccgtttatggcattgtgatactacggttgggaacttacacaaacagacccaacgtttccaaatcatgttctttcatcagttcaatgaatccatccattcttatctcggttattcaggaaaataa

SEQ ID NO: 18682 - DNA, 465 bp, Glycine max
  Peptide Sequence Number=SeqID_135460
atggatgtcaatgatttgaatggagcacatcttccttcaaaaagtttcttatcaggagctaatcaaatagaagttttatgtgaggaagttgagagtgctatcactgtgaccttcgtcggttgtaggttcttgaagcgtctgtgtgatgttcagaccagaataaatgcacataggttgcagatgtgcagaaagctttcaactgtccaactaactgaaagacttgactattctaatttgcctggcctgaatcccaacatgaaaaatggaagtctgaaggaaggaacacttaactgggaaatgttgcaattcaagccaaaatttccacgtcaagtattgctttgcagagttggggaattttatgaagcttggggaataaatgtatgtattcttgttgaatatgaggttttaaatccttttggaggtctgcaatcagatagtatcccgagagctggttgtcctgttgtg

SEQ ID NO: 18683 - DNA, 477 bp, Glycine max
  Peptide Sequence Number=SeqID_135461
atgggatcaagaaagccgcgcggtcccaaggatttattgaacatgaagatagtgaaaaagtccaggagcaagcaacctatacgaattgttagacgaggcatatattgcgcttcagaaattcgaaaacagaaaaatcatagagggagtaacaaaaaaagtaatgagtcgcataaatcaactgagagcagggaggaatttgtgattccgggagatattccagagcttgattcgttggtggtttatgagaaagaactacgttcagatttttttagtaatgttgccgcgggctgtttggaaccatctcgtgaaaggaaaaagaaaaacagtcacaaaagtcgtaacaaagacgaatcacatgatctagttaagagtataactgattttgtgattcctggagatgttcctgccattgattcattgatgatctttgacaataattttttttcagatttttttaccaatatacctgtattctag

SEQ ID NO: 18684 - DNA, 210 bp, Glycine max
  Peptide Sequence Number=SeqID_135462
atggagcacggagtgcctgccatcttaccagtctatgagtacatgctgctaataaattttggtctcaacactgcattgtggaggaggcaggctcagggcccaactcaagctcgatccaggaaacgtctctttatgtctggattaaaagaaggaaggggcatatggacagaggttaaggcatcatccataacagacagagatccaacttga

SEQ ID NO: 18685 - DNA, 909 bp, Glycine max
  Peptide Sequence Number=SeqID_135463
atggtcttcctcgcgattttatgcttccgtttcagtggaagtcaccgtcacttgctttttgaacgaggggaggtgtggaaggtttgtgactttgtgcgtgtgagcatcacgataatcgtaaggagatggaacgccaatacttttgcagttttggactccacggggccaaccgaagaacaaacagtgaggttaaaaattcaccatggtgggatgttcatttatcagccctttactctgtatatcaatggtcagatcgaagaagaagaatggggacccaagaaaagcactgagcagagggtgattgacacatcctcaaaaaagttgaatgatgttgaggatgacgacgttgttgtaattgatggagtggaggctcaggttaaagctgtggcggagggtgaagttaaagcagtggtggagggtgagattatggctgaggggcaagttgatcaacaggctttggttgaggttcaggtggaggttgaggttcaagttggtgaacaaggtttggtggaggttcaggtggagcctgtaggggagactaatgttcaagctcagatggaggctgaagctgaaggggaggttggtgttcaaggtgagatggaggctgaggctgaaggggaggctagtgttcaaggtgatgatgttgaagctgaggaagatgatgatgatgatagtagtgagtatagtgaagtttcagatagtgactttgaagaaaattgggattggacagaataccatgaccctgagacatttacacagacagctaatccaaaagtcaaatttcctcaatttaaggtgcttgaaaatgatgaagatgcaaagtttgaggtagggctgcaattcagtattaagaaagaaattctagaggctatcaaaacctttgctataatctctaagaagaatctgaag

SEQ ID NO: 18686 - DNA, 546 bp, Glycine max
  Peptide Sequence Number=SeqID_135464
atgattagaacacgagatgtaggtcatactttagctatgattatagacagaggtagacaggatgaggatgatgtagttgatgttcctcagaggtgtaggcctattgcatcagcccgtaggcaacgggttcatcagatgattaaggatgttcctcacatgattgaggatgtccctcatatggctgaggatgcacctgagatgactgcggacgtacaggcgacagttgcaaaggacttaggtcgtgatggtgctgaggggtcacatgctgatgatgctgagggattcccaggtgggtcacgtgacccatcagtgctgacttcatttgcggaccatgaacgtcctgagttgaagttggtgtcgcacgggaggaaggtgacgttaattgggaggccagtgtctgagattgaaggactggttgctgccacaggattaagtccattaattgggtgttcagctgtaaccggcgatcctggacttatatccgcatttttggagaggtggcatgtgacaccctctacccctcacatatatactaataaggaataa

SEQ ID NO: 18687 - DNA, 189 bp, Glycine max
  Peptide Sequence Number=SeqID_135465
tttaggagtgttctaaggctttatgctgattatatagctaaagcagaagcagcagctactatcccagtagcaacttttatgcccaaaattccattaggagcgattttagccattgttgatcttgtggtcgttgctgtttcgaaattcaaagtagtcctgcggtcattgctggaaagtcaattgtgctga

SEQ ID NO: 18688 - DNA, 459 bp, Glycine max
  Peptide Sequence Number=SeqID_135466
gaggtgcaagagcagatgaaggctgacatggaggccacgaaagagcaaatggccacaatgatggaagccatgatgagtatgagaaaaatgatggaagtcaacacggctacacttgttgttgcaagtaccaccacagaagtggacccgactcacccacccggcttcaatcaaataaatcacccagcctcggatatggtaggtcagggaggcaaagagttggaaagtgtggacagcccccattttgtgcaagttcagaacaagcattccttcccaccatatgacttgcctcccaactatacaccacccaatgttgcacacatttccaatgagaatgtcgaaaactccgcacccatgcccgttgagagccatcaaccccaatctgatcatgcacatgcccaatccaataggggcgctcagcgcgcaccaggcgctaagcgtgcagctaactgcaggcgctga

SEQ ID NO: 18689 - DNA, 255 bp, Glycine max
  Peptide Sequence Number=SeqID_135467
atgactaattttgcacgttgtttccaaatcatcattgtcacgcgtgccttgtggaataatatggaagttcggcccgagaccgacaccttgacacccgaattttttttgccccagatatcaagatcgagcttccacgataaaagcccccgtcgagacccaaccttagactattttggaccttggcctatcaaaagaatcctcatcctttccctcgaagcaaaggacagcggaatctcctcaagggatagcaaatag

SEQ ID NO: 18690 - DNA, 189 bp, Glycine max
  Peptide Sequence Number=SeqID_135468
atgaaaaagatcagagaaccttctgaccagataaattttcggcaagattgtcattcaaggtcgttctcgactggcgatatcccaccccacatgaacaaagaggaaaagaccgaaacaccaagcttcctctccaaaaacactaccctcgagaaaatcctattggtccatgatcgtacgtttgatctttga

SEQ ID NO: 18691 - DNA, 706 bp, Glycine max
  Peptide Sequence Number=SeqID_135469
tattgtcttgaatttaatcttgaaaagcccatttgcatcaattgcatcatatcatcatgatcatcatcaaaacaccaaagacaattgcatctacatacacgcccttgccctcagaggactacacctcctcccctttagaggactacacgtcatcgcaattagagggctacacgtcctcgacttcagagggcttcatgtcctcaccttcagagcactacatgccctcccctttagaggactacacatcttttcctttagaggactacacgtcctccccttcagagaggacaacacgtcctcaccatcagaggacaacacctccttgccttcagagagctacacgtcctcaccttcagaggactacacgtcctctctttctgagggctactcgccctcgcctttagaggactacacaacctcaccttcagagggctacacaccctcgccttcagaggactacacgtccttgccttcagagggctgcacaccctcgccttcagaggactacacgtcctcgccatcagagggcaacacctcctcgcatctagagagctacacgtcctcaccttcagaggactacatgtcctccccttcagaggactgcaagtcctcaagttcagagggctacacgtccttaccttcagagggctacgtgccctcggcttcagaggactacatgtcctcacctttagaggactacacgtag

SEQ ID NO: 18692 - DNA, 318 bp, Glycine max
  Peptide Sequence Number=SeqID_135470
atgtcatttatctgttgtgtggacccagcacatttgcagaagtttgcaatcaatttactcgcaaacttcttaggcggcttgaagaatttgacgtatgtaagaattgaagtggatgagtctaatattcctgctacggattttggaactacaatgcattgtcctgtggaagctccattggagcttgtaggcctaggatcttcttcatcaatagattcctttgcttctttgaagatgaatgacaacggaatggagaaggaagagagagaggagacgccacttcaaggagaagatgagtctagaagaagctcgccaccatag

SEQ ID NO: 18693 - DNA, 630 bp, Glycine max
  Peptide Sequence Number=SeqID_135471
atgaaagcctttcgcctgacccataagaataggattgctattggtggtggtccgtctccatcgatttctcctcccaaccgaacattgtggtgcttcctcttggcaaagaacctaaggggaaaggacaataagcacaaatacaagaagaggagtcattgtgaacatcgaagcggctcgggggaacttttgggtcaaaaggatgttgagtcgaaagggttggagacatgccttgtgaatgctgacaccttggttaagtctcgggatggtgagattattaggcttcgggctgccttagttgttgtggaaaaagaaaaggagaagaccaccactgagaagggaaggattcaacagaaagcttttgatgatgtgtatgacacacacgaggtgagcttcaaccattgccttcgacaggtgttgctcttatgtcaagtctccgatccaagtgtctttgatatcaacaaagacatttatcatggggagctgatgtcaattgatgacattgcaaatgatggaacccctatgctagagaggtcgatgttgaaggtgccaaggtcgatgataaggataatggagaccctagggatcaaaaggacatgggttcttaggtttctatgtacaatttttatgtaa

SEQ ID NO: 18694 - DNA, 492 bp, Glycine max
  Peptide Sequence Number=SeqID_135472
atgccttcctttcacgatttggagcagaaatggctaccaaaggttggagctttgttggagcttcaatggtggaggaagaagaagagaatggcaacggaagcttggttgcatgggaagacaaaggctgattctgttggaaacacaccttcttatcttgaggaggcaattgctactagtttattcgttatgcaaaataaagttatggaacaatgccaaaaggggacaactaatagtattgctatgactggtatgttagcattcaaaacaattggtcgtactagtgctagtgcattggcaggcctttatagaggatctgaaaacaataagatgagccttggggttttttcaagaagaaatgatgtagtggagtccatgataaagccccaatggtatgtcaattgcaatgatttggcaaaacaagcttttcttgctgctgtggatgaggaaaacaaaaggatagagattattccaaaacaatatttggctgattag

SEQ ID NO: 18695 - DNA, 320 bp, Glycine max
  Peptide Sequence Number=SeqID_135473
caatttctggacaaggtggcctggctgaagcccaacttcttttgagaagagcccctgaggttgttcttcccagtcctataccaacaaggacagagcctgcaccaactgagtcacaacctccagtagtagacccaccggcttctctagaggttgagatactatctcctccactagctccaccggcaccacctttgatactcattcttgatgactcagatgctgaagctgttgctccttctaactcaccagcctactacctagaggatgttttgtgcatgagtagtgtagttgctcattctaaagcatctggaacagtttaa

SEQ ID NO: 18696 - DNA, 525 bp, Glycine max
  Peptide Sequence Number=SeqID_135474
atggcaagatgtgtaaaacgactgctgttcagcgtgctgatcggcggcgcattactgggcggcgcgcagccgtcgctgcaggcggctgatacgcctgcgccgcaggccgcgacacacgctctcgcggtgatcgacctttccgagctgcagctggacggcgcggcggcgctggtactgaccttcaaccgcgcgctcgacggtcagcaggatttcaaccattggatcagcctcaccgacgacagcagcggcaaggtcgacggaggctgggagctggcgcagaacggcaaagtgctgcgcttccgccatccgcagccggcgcgcaagctcaccgtcactgtcaatgccggcctgaaggctgcggatggcagtaccttagccagcccattcagccagacactcaccacgcgcgacatccagccgatggtcggtttcgccagtcgtggctcgctgctgccgctgcgcctgacgcagggactgccggtgctggcgctcaacgttaaccaaatcgatgttgatttcttccgg

SEQ ID NO: 18697 - DNA, 840 bp, Glycine max
  Peptide Sequence Number=SeqID_135475
atgacagccatgtttgtgtccgctgattggttgaatgaacattaccacgaagagcgtttgcaggtgctggatgcccgcatgctgccgccaggtcaggaagcggtgcgcgatatcacggcggagtatctggccgggcatctgccggatgcgccttttttcaacatcgaagcgctgtccgatcacaccagcccgtatccacatatgatgccgcgcgcagagacctttgccgtggcgatgcgcgagctgggcatcagccaggataagcatctggtggtgtacgacgaaggtaatctgttctccgcgccgcgtgcctggtggatgctgcgcgcctttggctgtgaacaggtgtcgattctggcgggcggcctgcagggctggaaagccgctggcttcagcctggctaccggtccggttgatttgcctgagggcgagttcgacgcacagtacgacagcagccaggtaaagcgcctgaccgatgtgctgctgatcagccacgagggcggcgcgcagattgtcgatgcgcgcgcggccaaccgtttcaatgccgaagtggatgagccgcgtcccggcctgctgcgcggccatatcccgcacagtctgaatatgccgtggaacaatctggtggccaacggtgagctgaaaccggccgccgagctgcgcgatctgtttgcaaaggcagggattaagctggatcagccgattgtcgccagctgcggctccggcgtgacggcggtggtggtgattctggcgctgaccgcgctgggcgtgagtgacgtgacgctgtacgacggttcgtggggagaatggggcagccgcgacgatttaccgattgagaaataa

SEQ ID NO: 18698 - DNA, 627 bp, Glycine max
  Peptide Sequence Number=SeqID_135476
atgaccactcttacacagatatggatgatgttgctacttagcaacattccacccgacgaccacaatgccgatctccctcctacggaagtatcagttggtctgtgccatcgtgacatagggatcgcgcccacaaggcacccagtgaacccggagaagtccaacagagccctggggtttccagctctggttacgggcctctgtcattcctacagggtgcccgtccccccaacaaggggtcgcgcccataagacaccaagtggacccagagaagtccaacagggccctggggtttccagctcaggttacgggcctctgtcattcctacaaggtgcccgtccccccaacaaggattgcgcccgcaagacacccccagtggacccgaagaagtccaacagggtcctagggtttctagctctgattacaggcctctgtcagttctacggagtgcccgtcgcccccagcaagttcatcaggccgcctattaaccgggctttcatcaagaagtactgcgccctcaggcaggcgcagggcgagacaccacagcagcctagggatggccggcaacgggcaacaaacgcactgccacaacctctagagttcacctcagctcatccacaaaaaggttag

SEQ ID NO: 18699 - DNA, 294 bp, Glycine max
  Peptide Sequence Number=SeqID_135477
atgaaaataaagaaaagaacaaaagaaaagaaaggaaggattcccgatcaaagatcgaaaggaagcgaaaagggaaaagaagcaactctcgatcaacgaaagaaagaggatagaaagtctccaaagccagattgcccctcagaatcattcttgactgacaatatcccactccacatgaaaaaagaggaaaagaccgaaacacccagctcactctccaaaaacgctgacctcgaaagaatcctattggttagccctatgtttcccctgcgtgttcgtttgaaagctagaagttga

SEQ ID NO: 18700 - DNA, 219 bp, Glycine max
  Peptide Sequence Number=SeqID_135478
atgaaaccttacggattatgcaacaatgccccttttgacctttggaatgttgcagaacttttacggattgtgcaactatgcttcctttcgacttccggcatgtcgcggaacctcgcagattgcctaacgatgggtgttaagtaccttgaagtgatcaagaaaaggttgcatgccaccaaacaatggtccccggatgaaattagggttatgttcaagtaa

SEQ ID NO: 18701 - DNA, 471 bp, Glycine max
  Peptide Sequence Number=SeqID_135479
atggctatgaatgaagagatggaatcactgcagaaaaaccaaacttgggatttagttgagttacctaaaggcagacgaataacaaggtgcaagtggatcttcaagaagaaatttggattgtccactgaagaagtcatttgttataaagcacatctggtagctaagggctatggttttaaggtgaaaggaaaggaaaattttgttagtatattgaagaggcctttttatgggctgaagctatcaccaaggcaatggtataagagattcgatgagttcattgtctctcataggtgcaccagaagtccttatgactcatgtgtttatcatagcaaggtggaggatgacatgttcatagcatctcaaaatttgttggcaattcagaagttgaagtcattactcaatggtaaatttgagatgaaggacatgggaactgctgaaaagattctaggcataaagatcaagagggattga

SEQ ID NO: 18702 - DNA, 573 bp, Glycine max
  Peptide Sequence Number=SeqID_135480
atgggagccttgttaaaagaacagggcatctgggctcctctctccgatcaatcgtcaaagattgataagtcaatgcttgagttacaagaggaaaagagaaacttttatgatgaaatcaatctgcaacaagttacttctgaaaaggtagtggtttggcctgtgaatgaggcaagagaatcgggtcattggaagcgagactgtccaaagaaagcaaataaagattttcttgctgctattgttcataatggctcatcatcagaaagctatttggttttggctattggttgttcttatcatatatgcccacacagagattggtttatgacacatgagaagaagtatggtggtaacattctcatgggtaacgatgcttcttgtatgtctatcagtataggttctgtacaaatcaatatgcatgatagtgtttttagaaccttgactgaagttcatcacattccagagcttaagaaaaatcttttttctatgggtgtcatagattcaaaaggtttttcttgttgggttgaaggcagagttatgcagatcagagggaaaaagaagtttgttataatgtag

SEQ ID NO: 18703 - DNA, 894 bp, Glycine max
  Peptide Sequence Number=SeqID_135481
atgagtgaagaagaagacaaggtgaaagagcggataaaggctgacatagaggccctgaaagagaaaatggccacaatgatgaaggcgatgatgagcatgaagaagataatggaggtcaatgcagctgcagttgccgctaccagtgtcgtttctgaggtggacccggctcccccatctggcctcaaccaaataaatcatcccatctcagatatggtagggcagagaggcaaagaattgggaagtacgggcagcccccattttgtgcaagttcaaaacaagcatgccttcccgccatattgcttgcctcccaattatacaccacccaatgtggcacacactcccaatgagaatgtcaatgactccacttccatactcattgagagccaacaacctcaatctaatcatgcacctatccctcaacccttgggggggacacatgaaataccccacaacaatctagccaacttcgagcctggcctcgaatatgccactgaagggaaagaagttgatggcgaagattatgcccttgctaacatggaagatttatgcctagtacccgacgtggtcattcctccgaagttcaaggtaccagacttcaataaatacaaggggactacctgccccaagaatcacctaaaggcgtactgcaggaaaatgggagcatatgcaaaagatgaaaaattgctgatgcattttttccaagaaaatcttattggggcagtcgtcacctggtacactaatctggaaccttcccgagtccattcttggaaggacctaatgatttccttcattaggcagtatcagtacaattctgatatggctctggataggatgcaactacagaacatgggcaaaaaggagcacgaatctttcaaagaatacgcccaaaggtga

SEQ ID NO: 18704 - DNA, 288 bp, Glycine max
  Peptide Sequence Number=SeqID_135482
atgccaaagatggctccaaagaaacttaccactgagagagtcaagaagaccattgcaggaaaaggatctagcacaactccacctgtagattttgaatttgatgaacaccattttcacagtgaggagcatcagcggtgttttgaattgatcaaagattggtccttcctcaaagaaagaagggtccaattagcaaaaggcaagtatcttgagttcacaatagagatcactagagaaactggagacaacttggggaacccatgcccaaatatgaccctgaagttgtcctag

SEQ ID NO: 18705 - DNA, 246 bp, Glycine max
  Peptide Sequence Number=SeqID_135483
atgaggatcaaaaggtcttttaaggttgtaatggggccaaggacaaggcttgtagtgagcttaaaaacaaggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaatggggcataa

SEQ ID NO: 18706 - DNA, 207 bp, Glycine max
  Peptide Sequence Number=SeqID_135484
atgtcaggatttacacgcaattctcctcaaatttcagccagcccgcatcaattagaccttgcaccttacgcttcagagccctaccatgctcaatggaacgccccggggcttttccatgacaagcacacgttgcgtttgagtcgtatttttggagaaatggaggtggtcttcgtcattggaagtgcggtagacaggctttgtggttga

SEQ ID NO: 18707 - DNA, 513 bp, Glycine max
  Peptide Sequence Number=SeqID_135485
atgcatactctctcactttctactcctgatgatcagtggtacatggacaccggagcaacctcgcatatgacggctaacggaggtaatctcacgtcctacttcaatttgagtaataatattactgtcggtagtggtcaaaatattcctgtaattggttgtggacatgcatcattaccaaattcccttcatcctctaaaattacctaatgttttacatgcaccaaaactcataaaaaatcttatctctgttcgtaaatttaccatagataatgatgtgtcagttgaatttgatccttttggtttttctgtgaaggattttcagacaggaatactgttaatgagatgtaacagttctggtgacctctatcccattgccacaagaccacctaatacaaccttgccaccatccacctttgccgcgttatccacggaattatggcacaaccgtttaggacatccaggagctactatcttaagttctctgcaccgagacaactttctccaattagtgtag

SEQ ID NO: 18708 - DNA, 231 bp, Glycine max
  Peptide Sequence Number=SeqID_135486
atggcgaaatcgctcggcagcgcgctgacgccgcaggatatcgccgccaccagccagcgcgttattgaggtgacgctgcaggcgcgcagccagctgctgctgcccgacgaacagggtgagctgcagtcggcgggtgaaagcaccatcgggacgccgcccgacctcggcatcgccaaatggagctacagcaaagggcaaccggccggtgccggcaccgatacgttaccagcg

SEQ ID NO: 18709 - DNA, 774 bp, Glycine max
  Peptide Sequence Number=SeqID_135487
atggcaaagaaggaggtttcgcatacccagcagcaccatgagctatcaatcggtgccagtgcatcgctctgggaagcgtatcttacgccctggctgcagacgctatacgagaaccgggagagcctgtttcttgaagcacgtattgctcagcgccatttgctggtggagcagttacatgagcgccaactcgatttgctgatcaccaccgaagcgccaaaaatggatgaactcaccagtcagcagatcggtcatatttcactcgcgctctttcgcgcacgcaaaactgaaaagcgtgaaaaatatgattacatcaaactcgagtggggcgcggatttccatcagcatgaaagttatctttccagtgatgacgtaccggtattaactaccacttcagcacatgtgacccgcgaattgctgcataccacgggagcctgcgcttttttacctgatttctggcacggcatttacagcgatttgatggttattccagacacacctgtcgcagtgcgaccgttatatgcgttccctactctcgcatggggaggccccacactaccatcggcgctacggcgtttcacttctgagttcggcatggggtcaggtgggaccaccgcgctgttgccgccaggcaaattctgttttcgtccgcgtctttcgcgctccgactgcgttgccccgctcgcgccgctcagtcacatactcgtgtatgctccttcacgtcgtctcgcgtgccgccttgtcacagcacaaaatccactggacgtaatccggtga

SEQ ID NO: 18710 - DNA, 303 bp, Glycine max
  Peptide Sequence Number=SeqID_135488
atgcctcatggactttattctccttcacttattcctgactttccttggattgacttgtctatggactttcttttagggtttcctcaaacaaggaatggcaaggattccatctttgtagtggtggacaggttctctaagataacacatttcatgccatgtgatgaggacttcaattcaaggttgaattcactcaaagaaggaagggatgatgggaatcaaaccaggaacaaggacattgaagcaatacaaggacttggtggaacaatgacaagggcgcatgctaagaaagaaaaggagtattaa

SEQ ID NO: 18711 - DNA, 169 bp, Glycine max
  Peptide Sequence Number=SeqID_135489
atggagtcgccaactatcgcaacctacccttcagtgggagggcgacgcagggctcacgggtgcgtcttccaagggaggaaggcgcacggagtcaccaccaatgtctattcgggggaaacatcgaacaaatcgaaaagcgtgtgtggtctacgaactttgagtgtgaaag

SEQ ID NO: 18712 - DNA, 189 bp, Glycine max
  Peptide Sequence Number=SeqID_135490
atggagtctactttgatttggcaagatgcaaagaggatgaatacgaagtgcagtatagaatgtgaagaagatgaagagatgtgtactatacgtagatatatctctatagaagtgttcggtttttggaagttcagaaggcaatctgatagcagagtaagcggcgatatgaagcgtgtaggaagcgtgtag

SEQ ID NO: 18713 - DNA, 644 bp, Glycine max
  Peptide Sequence Number=SeqID_135491
ggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttaggtaaatatctaatgcgttccccgacaggagaagttatttttgggggagaaactatgcgtttttgggatttgcgtgctccttggttagaacctctaaggggtccgaatggtttagacttgagtagactgaaaaaagatatacagccttggcaagaacgccgttctgcggaatatatgactcatgctcctttaggccatttatggcacgcgggaagagctcgcgcagctgccgcaggatttgaaaaaggaattgatcgagattttgaaccagttctttccatgactcctcttaattga

SEQ ID NO: 18714 - DNA, 138 bp, Glycine max
  Peptide Sequence Number=SeqID_135492
atgatccatgcccctggtcatgtcagggattttctattcttcatcatagtggagttcaatagcacagggtactcaacaacgccgaattggaaaatgagtctgagaccaatacttggctccaactacatgtcacattga

SEQ ID NO: 18715 - DNA, 1002 bp, Glycine max
  Peptide Sequence Number=SeqID_135493
atggaagagatcaacaagaacccatcagggacttctcttttggtaccatcagtgctagagttggctaaagagaatttgactactgttccacaaagatacattcagcctcaacatcaagacatggtgctcatctctgaagaagatcatagtacccttgagattccagttattgacatgcacagattgctttctgtagaatctgggagttcagaattggataagcttcacctggcgtgcaaagaatggggattcttccagctggttaaccatggagttaactcttccttggtggagaaagtaaggttggagactcaggatttcttcaaccttccaatgtcagagaagaaaaagttttggcaaactccacagcatatggagggatttggacaagcatttgttactatatactcatatcttatggagtttatcaagagagacactctagaggcttactcacaggaaataaaagatctagccatagttattataggccttatgggaaaagctttgaagattcaagaaagggaaataagagaattatttgaagatggaatacaactaatgaggatgaactattaccctccatgccctgaaccagagaaggttattggcctcactcctcattcagacggaattggactcgctattcttctacaactcaatgaagttgaaggtcttcagataaggaaagatggcttgtgggttccggttaaacccttgattaatgctttcattgtcaatgttggtgacatattagagattataactaatggtatataccgaagcattgagcatcgggcaacagtaaatggcgaaaaagaaagactttcatttgcaacattctatagtccaagttcagatggtgtggtaggtcctgcaccaagcttgatcactgaacaaacaccaccacgattcaaaagcataggagtaaaggactacttcaagggcttattttctcgcaaactcgatggaaaggcctacatagaagtcatgagaatatag

SEQ ID NO: 18716 - DNA, 951 bp, Glycine max
  Peptide Sequence Number=SeqID_135494
atgaatttgatcttcaggccattccttcgccgctttgtcatcgtgttctttgatgacattcttatctatagcgggaccttcgaagatcatctccgacacttggatatgactttccaggtcgagtatcttggacacctagtttctggcaggggagtcgaacccatggcagacaaagtggccgccattgttaattggccaagacctcaatccaccagagctgtacgcagttttttgggattagcaggcttttatcggagattcattcgtggatacgctatgatagcagagccattagttcgtctcaccaccatggaaacctttcaatggacctctcaagctcaacaagctttcgagaatcttaaggttgccttggccacagctccagttcttgctctacccgattttcagattccattcacgatggagaccgacgcgtctggcagtggtatgggggcagtcctgtcgcagaaaggacacccaattgcttacttcagcaaaccgttctctccgaagttgttaacagcctcgacgtatgtccgcgaattgtttgccatcacttccgccgtgaagaagtggcggcaatatctcttgggccaccaatttacgatcatcacggaccacagaagcctgaaggagctattaacccaagtgattcagactcctgaacagcatacatatatggcacgtctgatgggattcgattaccaaattcaatatcgattaggagcacataatctagctgcagacgccttatcaaggtcatcggaaaatggtccaccagaatattctgcttctcaatttctgattctctcagtcccctgtctgacgtttctagacgaattaaagcaacaagtggccactaatcagcaatactctcaacaacgacaagctattattgactttccagactcgcattctgatttcaccattcatcaagatctcattctttag

SEQ ID NO: 18717 - DNA, 1368 bp, Glycine max
  Peptide Sequence Number=SeqID_135495
atggagaaagaggagagcacggaacagcgaaagcaagcgaggcttgccattatggagctcgccaacatgataagcgttcccatggcgctaaacgccgtcgttcgcctcaacgtcgccgacgccatctggcaaggcggcgccaacaaccccctctccgccgctgagatcctcccccgcctccttcccgccggcggcggcgacgccgagaacctccagcggctcctccggatgctggccagttacggcgtcttctacgagcacctctccgccggcgagcggaagtactccctcaccgacgtcggcaaaacgcttgtcaccgatgaacaaggcctgtcgtacgcgcattacgtgctccaacaccaccaggatgcgttgatgagagcgtggccaatggtgcacgaggcagtagtggaccctacaaaggagcccttcgagagggcaaatggggagccagcatatggatactatctgaagcacccagagatgaatgacctaatggtgagggccatgtcaggggtgtcagtgcccttcattagggccatgttggagggctatgatggctttcaaggtgtggagaagcttgtggatgtgggtggtagtggcggtgattgccttcgtatgatcttggaaaaacaccccaccatcaaagaagggatcaactttgacctacctgaagttgtggccaaagccccacaaatcccatttgtaacccatgtgggtggtgacatgttcaagtttattccccaaggagatgctatcttcatgaaggaggcccctggccctcgaagtccaggacgtcctcagtcgtttaaccaagcaacaactttatttgggggaatccgtcaacgctatgaccctcaagatagaggaacttcttcagcgtgtttcctcgactgtatcctctccttagccaactccaaccccattaccacctccttaacctgcaacaccaattcatcgtttaaaattagagataagcttatcgtggcgtctttctatatggagggccgggctcttgcctggtttcagtggatgaacaccactaaccagtttccatcttggcctgcgttcttggaagctttgcggacccgatttgctccttcacagttcgaggacccctcgggggctttgtgcaagctcacgcagagtggcatcgtggcccagtacttggctgattttgaggacttggctaaccggaccataggactccccactccgtttctcttgagttgttttatctccggcctcacgccggagattcgtcgggaagttcaagcgaataagccggccaccctcgttcaagccgccggactcgcgaggttacaggaggaaaagtttgcggacatgcgaactccctcacgtctttga

SEQ ID NO: 18718 - DNA, 1308 bp, Glycine max
  Peptide Sequence Number=SeqID_135496
atgggaggacatgctggggtcgccaagacaatagcacgattgtcggagaacttcacttggtcagggctcagggcagatgtcgttacctatgtagccaattgtgtggaatgtcaggtcacgaaatatgaaacaaagtgcattgcggggttgctatgtccccttccagtccccttcagaccttgggaagacctttctcttgacttcgtggtgggtcttcctccctttcaaggcaaaacggtgctcttggtgatcgtggaccgtttttcgaaagggattcacttgggcattcttcctcaggcccatacagctcacatggtggcccagctctttatcgacattgttgtcaaactgcacggcattcccagaagcttggtgtccgatcgtgatccattattcattagtgggttttggcaagagctcttcaagcttagtggcactcatcttcgaatgagttctgcctaccatccacagagcgatggtcagacagaagtcatgaataaagtgattgaaggatatttacgagcttttgttcaccgccggccaacatcgtggggaaagttcctaccatgggtggaactatctcataacacttcgtggaacagtagcacgggttccaccccttatgagataacatatgggcgcaagccattttcttttccagatcatatcgccggttcttccaggattgattattcgccggaaattactcaaggcacaagcttccatgaagaaaacctcagatgcaaagcgacgagagaaaatgactatcacagacataaggagaaagacacgtgggaagtgttggtccaatggcacggactatcccctgatgagtcatcatgggaagactgggaacaactcaagcaggatcatcaccttaaggacaaggtgattctccaagggccaaaggaagttgatagcagtgtgacaacagaggcaacatcagaagggcagtttggggaatcaatcaacaagggaggtgtgcaattagtaaaaacaaagagaaagtgggtgctaacaacatggactgatgaagaatgcaagcacataatgcagaactgtcacaaggcactccctgagggaggaaaactaatagcatgtgagccagtgctcccggaggactcagacgagagtcacagaacgagggcattgcttgaaggtgacatttttgtgatgacaatctacagagccaaagggaagcacaggactgaagaacagttcaggcaattagccattgatgcaggcttccctcgtttcagagccttccatgttgaccatttctacactgtccttgagtttcagaaatga

SEQ ID NO: 18719 - DNA, 714 bp, Glycine max
  Peptide Sequence Number=SeqID_135497
atgactctgaactcaatgtccaagatgagttcgaaatgccgtcttgggtatgtcagccaaatgcatgcggatttgatgataaccttggaggagatcaagcttggaaaaacactgtgctcctcccaattcgtcaagcaactcatcaattgtcagtatgggaaagcagtccttgacggtgagggaattcaatgccctgtaatcgacgcagaagcgccaggttccatcatgcttcctgacgaggaggaccggagaagaaaagggactgttactaggttgtatcagtcctttctgaagcatggactcgacctgcaactcaatctcctgcttttggaagtgcggataccggacattatatttggtgagcaaggcctgaatggcgaaactgagaagaagagatggagctcagagttgcgtcgggatcaccttgcagcggtctccggggcaacgtggcctgctagggagttgagtgaaatttgggccggcgggtcatgggttatgatgttgggtgggtctaaagcgggtataagagaaggtgctggagacccttctccctccgagaagcaatctcttcaggggaaaggcgcttccatgcctgaggtggggttcggggtgggaacggcggaggtagtaaaggaggaaggttggctggggatacggggagaggtggtggttgggtgggagacgaagggggccggagaggtggtgagagggtag

SEQ ID NO: 18720 - DNA, 1083 bp, Glycine max
  Peptide Sequence Number=SeqID_135498
atggatgagtcatctgattcaaatgttgttggctctagcacatgcaaggaaaaactttcaaagaaggtgaaggcaaaggaaggtgctgaaagcataatgaacaagctacctgaacaacttataaatgctgttcgtacaagtgttttgtccaagaaatgggcatatcactggacatccatcaccaagttggacttagatgatagtgtgttctattatccaaagagaaagacaggtggaaaacagtactttatgaactttgtgtatagggcacttcttcttactaaaaatcctagtattgaaagtttctctcttgtgatgactaacaagtatgatgtatacatgttcaatacgtggatatctggtatcttgaaccgaaatgtgaagaatcttcatatatgttcacattttgaggtccctttcaatgctcatacatccgattccctttttgactcggaggtattagaagaactggtgctgaagatgatttgcactataccagttgtcaaaacctttcttcattttggtcacctaaaatgcctgaggttgtgttcagttgtatttgatcttgaatcaagcagctcagaagatctgactcttagcttaccagtcctcgaggtgtttgagacaaaaaattgcacttggtttaatgctgagagtgtcactttaagagtgcctctacttgaaagtgtccttatagaacatgaccccgctgcagtattttatgagctggattccttgccaatcaagatttctgcttcgcgtctgacaaaatttacattttgcagttattgttatatggcacaacatgttcttctgttagatccatcatcagctcataatgcttctgctgatataactatccgatgtgatgaggacagtgacagtgtatcagaaacaggatcttatgcttctctgcttctcaggcaattcagtgaagtgaagtatcttaaatttgatggggcggagccttacccttgcatatgcaaagaggctgtttccggattcgaacccatgaccaacaagtcaccaaggcacaactttaccgctgcaccagggttcgccctcagtgttgaaataaagtag

SEQ ID NO: 18721 - DNA, 1365 bp, Glycine max
  Peptide Sequence Number=SeqID_135499
atgaaggaaccccaaacaagcatgcactcaattaggggaacgagcagagaatccaattatgaaggccaggacatattcagcgacctacctgatgttattattggtcgcattctttccattcttcctactaaagaagccgttcgtacgagtattttatccaagagatggagaaacctctggaaatttgtcactaagctacactttcaagatatagagccataccgtcgcaataagatagacaaattccactttttagactttgtgtatggggtactatttcatctgaataattcaagaattcaaagtttctcactttatctttcagagaaatatgaccctaatcatgttaatcggtggttagctaatattttaaatcggggagtcacagagctttcaatcaattcggaaaaagatctcagcatttcctcatattccattttggaatcccagcccttagaaaaattggtgctgaagatgaaattgggttttttcacagttcccacctttgtttatctctcatccctcatctttctcaagttgtccggaatcatagtcatatgcaataccccttctaatgactcaaaaaatctcacccttaacttcccagttcttagagagtgtgagatagtgaattgcagttggttaaatgtagaaggtgtcactttagaagttcctctacttgaagtgctttcaataaagcacacaagatcactgtctccagatttccattctataaccaaggtttgtgccccgcatcttagagagttatcttatactggtcatggtcacctgttacgagatcccaccttgttagacctatctgcaacacatatttcttctgcttatatttatccgtggcattctaaacgggagactgaagaaaaaactgtgctttttgtttgtgagcttctgaaacaactcaacaacaatgtggattgtctaaagattaggtggccaaaggatcttgttctagcccattatgatcttcctgttcctacatttggaatgctgagttgtctggagctaggtaatgttaatggtgaaattttgttgatattcctacgaaacacaccatgtctcaagactcttattttacaggaactatggcaatttgatgaggagcttttgaatcctgaaaatgttccttcgtgttttacatctaaccttgaagaggtaaagtttagaaaaattaaaggtgttcaacatgagctgcgttttgccaaatttgtaatggaatatgctcaagtcttgaagagggcaagtttctctcccaaaaggaatatgcacgggtggatttttgaaaaagttaaaaagaagatactctcatttaagagaagtgatagcttttcgttaatagaattttga

SEQ ID NO: 18722 - DNA, 339 bp, Glycine max
  Peptide Sequence Number=SeqID_135500
atggttttggtgtggtgggtggcggcacaacattttgatgatggaggttggatcgttggcaatcgcacgggtggttatggaggacaagtggtgttgtgggcactaaggtggtgcaggcgacacgacaatgtcagggttgggcacaggtggtacatgacgatgctagtaagggttgtgtcgatgtcgttgaaggcacaagggtgcaggagtttggaggcaaaagggtcaaattggctattggctgggaaccttagacagagagcaatggaggctatgcagaaactcacaaaccctagagtaccacaaagagagagactgatgttgttgagagtgagatag

SEQ ID NO: 18723 - DNA, 750 bp, Glycine max
  Peptide Sequence Number=SeqID_135501
atggtcggaagtacagtgaagaatgtcgaggcctacttggaaacaccggtgaagaatgcagtgattactgtgcctgcttatttcaatgactctcaaagaaaagccactatagatgctggtgccattgctggtgtgagtgttatgcgaataatcaatgaacccatcgctgcagctattgcatatggacttgagaagaggactaatagtttactgatgctaagatgcacaagagcagtgtgcatgatgttgtccttgttggtggctgttctaggattcccaaagtgcagcagctattgcaagactttttcaaatgtaaagatctgtgcaagagcatcaaccctggcattgttgtgtgtaggcattaagaattttccagtaaagaggacacatgaatatgttacagttaaagataaccaattcgctgtcaagattatggtttatgaaggtgagagaacaagagctagtgataaccatttgctgggtatttttaggatttctgttcttcctcctgctcctcgtggccttcgtttgtatatatgttttgccatagatgaaaatggcttactatctgtgtctgctgaggaaaagatcacttgcagtaagaaccaaattactataagcaacggcagagaaagactgttagcagttgagattagaagaatgattcaagaagcgcataattatcgggttcaagatatgaagttccttaggatagccactgcaaagaatgatctggattattgtgtttaa

SEQ ID NO: 18724 - DNA, 582 bp, Glycine max
  Peptide Sequence Number=SeqID_135502
atgggtgctgttccagttgtgaaggagcgggagatggaaattgggtacccgacagatgttaagcatgtggctcacattggatgggatggcccctcaggaactggacccagttggatgaatgattttaaaacagcgcctgatttttcaacatcactaggaaacttgggtgaactaagtgaccccaatgctatggctgtcactacatcatggtcctcccaagtttttccatgtgctgtgacagtgactgtgactctgagctactatgcctttcttgaaggggaaaattttgaagtgtccacaggaagccaaccaacatcaaacatttacaaaggcatcccatctgcaggggtttctcatgctcctaagaaatccaagaagaaaaagaccaagtcagcttccccttccgagttggtatctgcttcatcaagacactcaagagcaacaaagtctaaggctacatatagtgacagagaagcaacaccctcttccgaatcgctatctgcctcatcaagacactcaagagcaacaaagtctaaggctacatatagtgacagagaagcaacaccaatctctcaaaagtag

SEQ ID NO: 18725 - DNA, 776 bp, Glycine max
  Peptide Sequence Number=SeqID_135503
gttggtatggtgagaatggggtctttgatgacataggaagtaagacctttgtgatgttggaagaatggcctcaatggtcttgtgtgaagagtaagctgaccaagggggtgccttgggttttgaaagggtgtctaccaagggtggaccttgggcaaaagaggggctcaccaagggtgaaccttaggtttaacgaaccttggactggggacatgtttgccttgggttttaacaagcctggctcaccaaggacaaaccttgggttttttgagccctttggagaattgaccaacgatgcttctgtcctagatgttggcaagacttaccaagggtggaccttgggtttgatgagcttgtggagctgtgaccatggatcccttagacttgttgattctagtacactaggccctgaggatgacaattttggctgcctttgcctagtcgttggtctgaggatgttcgatagaggtgacgaggtgcttaacgccttgcctcgtcaagaagtcctcttaggtttgagatttgaattgggttccattatcggtgacaatggtgtatgggaggccatgccttcatatgaggcgttaggcttcattcttgatgtagctccaggtagagcttgtaggccttggatcttcatcatcaatggagtccttttcttcttgaggtatgattgcaacagaatggagaaggagaaagatgattggagaagccacttcaaggagaagatgagtctaaaagaagctcaccaccataggaagccatggataagagtttga

SEQ ID NO: 18726 - DNA, 426 bp, Glycine max
  Peptide Sequence Number=SeqID_135504
atggattcttcgttgatagaatggaaagaattaggggaagagggatccccggacaatgaaaacgaatgggaagatcgaaaaggtgggaggagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatcgctcaacaacaagtagatctactccaggagaattagtaatgtgtcaggagaaattggtacaagaagccgtggatacacttcttgataatggaatccgcggacaaccgatgagggacggtcataataag

SEQ ID NO: 18727 - DNA, 279 bp, Glycine max
  Peptide Sequence Number=SeqID_135505
atgattgagagtttcattctataccgaatccttgagatgggttttgaatattttgctccaattaaagtgtttatctctgttcggtggtctagcagtaagcggcgacagcttgtggcgatcattggtggtcgtgggtggtggagaaggagcgcgcctgtctcgctaagtgagctatccaaaggtgttgcagtcaaaccatgcaaacgtggatcaggaacctacggtcgaaatttgaaggtgatccaacggttaacaagtcaaagattaggtttttgctga

SEQ ID NO: 18728 - DNA, 327 bp, Glycine max
  Peptide Sequence Number=SeqID_135506
atgattcatgatcttgaacaagagtcttttcagcaggcacatgcccctatgtatgatgcattgaaaagtgattcaaagaagcctttgcatttgggttgcaataagtcattggcgatgttgtcagtgatgttaagtctggatgaggacgagtgtagtaatggcgaaagcacaaagaaaggcccaccaatgaaggtattatggtatcttttaatcattcgaaggtttaagcatctgtttgctaatggggatgagacaaaagacattacatggcatgaagatgggagaaactgcgatggaatacttcaccatacggctgattccttctag

SEQ ID NO: 18729 - DNA, 153 bp, Glycine max
  Peptide Sequence Number=SeqID_135507
atggtgaaaacaccattgaggcatttcaccgagcacttggtggacgcacttttgggtaccaacaacaagggaatgggggcaatgtggcttgccccatcatttcagaacacaactaggcctaaggccatcccctacaaccccccaattcaatga

SEQ ID NO: 18730 - DNA, 630 bp, Glycine max
  Peptide Sequence Number=SeqID_135508
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccacatggaagactatgagaggttagggaacattgcactgaagataaacaagggttttgctgtttcagcacctttgctcacaggaatagcagcactagggtctgtgttttcaggagatggattagttcctgcccttgcgggggccttggccacagtggttaatgcttttgagcatggaggccaagttggcatgggtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 18731 - DNA, 366 bp, Glycine max
  Peptide Sequence Number=SeqID_135509
atgaccaagagcaagggcaaggatccacttgaaggacttggaggacctaagacaagggctagagcaaggaaagccaaggaagctcttcaacaagtgctgtccatactatttgaatacaagcccaagtttcaaggagtaaagtccaaggttgttagtgggtcattactaaaatctgctgtaaagcttctatataagctgaaccattttatcaataaagacaagttgagttttattcagaaaattagagtttatctcttttatcttagtgagagtgattctcctaaattcttgagtgattcaagaacaccttggctgtatcaaaggactttcacaacctttgtgtgttgccctcgctggaaagagtga

SEQ ID NO: 18732 - DNA, 333 bp, Glycine max
  Peptide Sequence Number=SeqID_135510
atggacttgaaagaaaattgtacttatgtcatgcacaattttaaagagctaaaaaacaatggtcagtacagagtgtgtgatcaccaatttaaattggtgtttattggggttactgttgtgaggcagtgtgttctaagggacatcccttttagaaaatacaggtttgctggatttgcggatgttgtggctggccagtttgaacctggactattggttgatgttattggtgttgtggaggaggttgtctttcaccaagtttcaggaaaaggtagaagggtagtctttaaactaaaggacttgaggcttgcagagttgggcattgaggcccggtga

SEQ ID NO: 18733 - DNA, 481 bp, Glycine max
  Peptide Sequence Number=SeqID_135511
ccagcaattgctatcttgcactttgtgggatgattattgcttgcagtttttggagttcttagatgattatgaaggatcttatcccacatcgatcaacaattctttcaaggcttcaaagttaattattaaccagcctgtgatggagattcaagaattcaatgaacggcttgcagagttgggcattgaagcccggtcaggttttaaatcccatggtgaagggagtacacaactttcaggttctatccaattatcatcaaaagaatcattctttggcaaggctgagggaaagactattgctgacattaacaccatctctgaagaaattgtttgtgtcactgttggcacaattactaggattgttctggacaatcattcatggtgttatacatcttgcattcagtgccataaaaaaagtgatgcagagatgacgccctttacatgtgcatgcggcaaatacaataaggaagttgtgcttaggtga

SEQ ID NO: 18734 - DNA, 330 bp, Glycine max
  Peptide Sequence Number=SeqID_135512
atggctccaaaacagattttcgcaaagagatctaggaaggacgccgcggctgaagggaccagtgccgcccccgagtttgatagccaccatttcagggacgatgagtacaccgattttcaagagaagatagctcgcagacattggatgccgctggctactcccatggctaagtttgaccctgaggtagtcctggagttttacgctaatgtttggcccatagaagagggagtgtgggacatgcggtcatgggtgaggggtcagtggattccctttgacgcagatgccctcagccagctcctgggtgacccgctagtgttagaggaaggctag

SEQ ID NO: 18735 - DNA, 246 bp, Glycine max
  Peptide Sequence Number=SeqID_135513
ggggaggagcttgccgcccaactcgcccaggcgagctggtggcttattccagaagctacttgctcgcctcggcgagctgctgactttccacctgatcgaccactagcccaatcagggaaacctgtcaaaagaaagagcataagagacatcaggtgtatcagcaaaagccttggtgcttggaaagcgataaaagtggatgaccgtgacggtctccgcatgccaccagactcagttgtctcaggatag

SEQ ID NO: 18736 - DNA, 258 bp, Glycine max
  Peptide Sequence Number=SeqID_135514
atggagaactggcgaacagcgctaggcaatcaattcgcgagcctccagactcgttggtggaggatgcatgaacagcgcttggcaatgaattcattgggctccgaagagaaggggagaatggagaattggcgaacagcgctaggcaatcaattcgcggggcgccagactcgaagaataaaagtggagaatggagaactggcgaacagtgctaggcgatcaattcgcggggctcctgactcgttggtggaggatgcatga

SEQ ID NO: 18737 - DNA, 288 bp, Glycine max
  Peptide Sequence Number=SeqID_135515
atggacagaggcatgacactaactgatgctcctagatctagcatagcattctcaaatttactgttcccaataatgcaaggtgggaatggaagagggataagaggctgcgactctgaatggaggcttttgtctcttgctgaaattgcatattctggatggtcatttgcctcactaactcttctaaggaaggttgaggaggagcctcagttgcttattgtctttgttgtgactgctgctgttgctgctgctacattggaggaggaacatatggcttgcttggaccagtag

SEQ ID NO: 18738 - DNA, 268 bp, Glycine max
  Peptide Sequence Number=SeqID_135516
gaaaacttcttggtttgcccaagtggttgatgttttccatgcagtggcaatcttcaacatttgggttaatattaatggtaatagcactaaggctattatgagcccctctatttttgagcttctcatcttaaagcagttgggtattaatggccaccttagaaagtccattcgcatcatggatgtcatttggcatcccctaagtgatgcaatcctcactaggaaaggaccagtcactagagccatgagcaaaaggctccaagaggattag

SEQ ID NO: 18739 - DNA, 471 bp, Glycine max
  Peptide Sequence Number=SeqID_135517
atggtggggtacgctccttcaagctttgtggatttggtcttcgccggcaaaaggatcgaagcgggtctgaaaataggcaaatttgatcatcctactttgatgagtgagaaagctggggcaaatgaagaggatgagaatgagggagaaacccttgatatgactgccattcctacacggtcaaatttcccatcagcccaacaatgtcattactcagccaataacagtctctcacccaatcatccacaaaggccatccctaaatcaaccacaaagtctgtctaccgcacttccaatgatgagcaccacctttagcacaaaccaaaacaccaaccaaaaaggaattttgcagcaaaaagcctgtaggattcaccccaaattccggtatcatatgctaaacttgctcccatatctactcgataattcaatggttgctataaccccaaccaaggttcctcaacctccatttttctga

SEQ ID NO: 18740 - DNA, 906 bp, Glycine max
  Peptide Sequence Number=SeqID_135518
cgcctctccaatttagttgacagcagcatcgacctagccttggtgaaggagttctatgccaacctctacaatcccgaggggccttgcccaaaacaagtcaaaatccgaggccacttgataaaaattgatgaagacagcctaaacaccttcctagagatacctgtggtattggctgagggagaatccttacccgcctactccagctactgcaggatgcccactgatataagagagattgaggctgctttgtgtatacccggccgagggtttgttttaaatgctgaaggccatcctgggaagatcctcaagaaagatctgacaactcttgctcaggtttggagtgttctctcatactccatcctggctccgacttcccacacctcggatttgactttagatagagctaggttaatttttggtctagtctctcagctggacatgaatgtaggagctctcatctttggccagatcacatctatggcccagtctaactcctctagacttgggttccctactcttatcacagaagaactgttggaacctgcggatctggcagttactattagaggggctaggagagcgagggcaaggccagctgaggctccttccatatctacagctcctcctccagcacataccttagcagcttcttctaccctatcttctacaaactttcaatgtcttgaagccatgcttcgaagcatacatcaggggcatattattttattacaaagtttacagctggacgaaggtctcaccgctcaagtaccacagtacagggaggatgagtcatccgagacttccactctagagcccctgattagaaggaagagggcagttgaaacacaagaagctgcaaccacttctgagaaatctcttgaggccacttctgagccttcagaacca

SEQ ID NO: 18741 - DNA, 540 bp, Glycine max
  Peptide Sequence Number=SeqID_135519
atgtttaagcagggaatgacaaccaaagaaagtgacaaagaggacttgaatgaaatagaagaagatgatgatttcagtttcttcgtaaagagatttaataagtttctagggaacaaaggaaatcaaacaagaataaacttcaattcaaagaaaagaggagaagattcatctttttttccaaagttctatgaatgtaatcaacctggacatctaagagttgattgccttagtttcaagagaagaatgaaaaaatctgattggaaaaccttcaaagataagaaagcaaagaaaacttacatcacttgggaagataatgatatggattcatccggagactcagaaaatgaaatcgtgaatctaagtctcatggccaaaaactatgaaagcgaagaagatgattttttgaagaaaagttggtacattgatagcggatggtctaaacacataacgggagatgcatcaaagtttactcatatttctcctaagaatagtggacatgtgacaacaacaaaggtaaaattcttggagttggaaaaatag

SEQ ID NO: 18742 - DNA, 1125 bp, Glycine max
  Peptide Sequence Number=SeqID_135520
atgtttatccacaagcttgaggtctggtggatcaaggacaaacgcattcgcaaccagatgctgatcaccgataagcgtcagatcgccctgatccgtaacgaggggatccagcaggtatggatcgatcccgagcggtcggtgcgcgcgcctgccacgccgcagccgaagaaagacattccgcagacgccgtttttccgcgagatggatcaggcgcagtgcatcttcaaccagggcaagccgcaggtgctggcgatgttcaacgaagcgcgcatggggcagggcctcgatcttgcctttacccttgagctggtcgatgaaattgccggatcgattacccgcgagccgaccgcactgctcagcgtggcgcggctgaaaaaccatgatgattacacttacctgcactccatggcggtgtgcggtctgatgatttcgctgggcaagaaaatggggctggatgagcagcagctgcgtcgcgtgggcatgggcggattgctgcatgacgtcggtaaagccgcggtgccgctgaccatcctcaacaagccggataagctcaccgacgaagagtttacgattatgcgccagcatccgatcgtcggtgcgcaaatgctgatggaagcccatgcggatgaagatttgctggatattgcgctgcatcaccatgaaaaattcgatggcagcggctatccgcatcggctgcagggcgaagagatttcgctctacgcacgcatggcggcggtgtgtgacgtctacgacgcggtgacctccgatcgcccgtatcgcaaaggctggacgccggcggaggcgatgcacaatatgctgagctggcgcggccactttgacagtgcgctgctgcacgcgtttgtgcgcaccatcggtatttatccggtgggctcgctggtacggctggcctccgggcgcgtggcgctggtggtgcaggccggggaaaaatcgctgctgaagcccaaagtgcatgtgttctggtcgctgcattcgcagcgcgaggtcaaaccggaagcgctggacctcggcgacagcttctgcaccgataccatcaccggcgctgaggacagcggcttgtggcacaacgttgacctgaatcgcatctgggcgctggaaagcgcctga

SEQ ID NO: 18743 - DNA, 942 bp, Glycine max
  Peptide Sequence Number=SeqID_135521
atgttggtaaacggtaagtggagcgcagagtggcatccggttcaggccaccgataaacagggtggctttgtacgccagacttccagctttcgtcactggattagcgccgatggcagcagcgaatttgccgccgagccggatcgctatcatctgtatgtcgcgctgatctgcccatgggcctcgcgcacgctcattgcgcgcagcctgaaagggctggagcatattgtcagcgtgtcggtggttgagccgcagcttggcgcgcagggctggcgcttcggcgattatcccggtgccgatcgcgacccgctgaacaacgctgagtatctccaccagctgtatacgcgcgccgacgccgacttcaccgggcgcgccaccgtgccggtgctgtgggataaaaaaacccagaccattgttaacaatgagtcggcggatattctgcgcatgttcaacagcggctttggcgatctggcagacaaccggctcgatctctaccctgaggatctgcgcccggagatcgacgcgctgaacgcaacgatctatccgcgtctcaataacggcgtttatcgtaccggtttcgccaccacccaggtgagctatcagcaggcgtttaatgaagtatttgagcagctggatgagctggagcaacggctgaaagatggccgcacttttctgctgggtgaacgactgaccgaagccgatatccgcctgttcgtgaccctgatacgctttgacgtcgcctatcacggcctgttcaaatgcaacctgcgccgcctgcgcgattacccgctgctcgatcgttatctgaagagtgtgctggcggtctccggcgtgcggcaaacggtgaacatcgaccacatcaaacagggctattattcgattaaagcgctgaatcccaacggcatcgtgccagcgggaccggatttggcggactacggtttttaa

SEQ ID NO: 18744 - DNA, 850 bp, Glycine max
  Peptide Sequence Number=SeqID_135522
atgcctttgcttcacctgtcatcgctggcggagatcaccgctgccgaatgggatgcgctgttacctgacaatcaaccttttttgcgttacgccttcctgctcgggctggaagagagtggcagcgtgcgcgcggaaaacggctggcagccggattatctgctgtggcgcgaagacggcaggctgcgggcagcgctgccgggctaccgtaaacgcaattcgtggggcgaatatgtgttcgatcacgcgtgggccgatgcctgccagcgtgccggcatcgcctattaccccaaatggctcggcgccattccgttcagcccggtgaccggtgcacgtctgctgggcgacgaggcggctatcatcccgatgctggaagcgctgcccgatgcgttgcagcggcacggcttaagcggggcgcatatcaacttcaccacgccgcacgccaacgcgctgctggcaacccagccggactggctggcgcgtctcggcgtgcagtatcactggcacaatcgcggctaccgcgattttcacgactttctcgacacgctgatgtcgcgcaaacgcaagcagctacgcaaagagcgcgaacaggtggccagcagcggctttgcgtttaactggtatcgcggtgatgagctgcgtgaagatcagtgggattttgtgtatacctgctacgccaacacctacgcggtgcgcggccagcgtccctatctgacgcgtaccttcttcagcctgctggcggagcggatgccgcaggcgattcgcgtggtgatcgccacgctacagcagcagcccgccgccatggccttctgtctggtggatgacgacacgctgtatggccgctactggggct

SEQ ID NO: 18745 - DNA, 915 bp, Glycine max
  Peptide Sequence Number=SeqID_135523
atgagcagaacgcgccgcctgcactcacttcagcgtgccgcattccgccacggcgagataatcggtatacagctgcggcgaaccggaaaaggacgccagttgcttccactcttcatacatctgtttggtatcccggtgcgcgcgcgcaaagtcagccgcgctggcggtggcgatatcaggctgcggataaaacacattcagcgccgcttcactctcaatctccatcatcaccacatagccgtccagccggttgccgctgtggcctttcagcagatgaaacttccagccgggataatcaacgatacgcgcggcattctgcgcgatgaattgctcaaattcctgcggctgcacgcccggtcgcagcgccagatagtgggtaccgagaatgcgcgcggtgccgctgcgggcatcaaaacgcgggccacccggcagcgtactgtgaggattctctgccagcagatcgaaatgggtgaaaatcgtcgggcgccgcgcgaaggttgccagctggcgccactcgctgagcagcgcgtccgcgtcgggatgcagatgccagaagtgctctgcctcggcggtaagttcaccgtcatcctgcataaagtgcgcgcgctgtgccgcatctttcatttcaaacagcatcaggtattgatcgacgcgctcgccgcgcagaccgcgaaacagcgtccagcgccagccgggatagcaggggagatgcacgcctttttcgcgcacgaaggtttccaactgttctgcggtaacgcccgcttcggtgtcgatggcgatataaaaaaagctataaacagactaggacataacaggttccatgcacgccgtcgcgtgccgttgagaggtaagggcggtttattccaactgggtgttgatgatggcttctaccaccacgcggccggtgggggttag

SEQ ID NO: 18746 - DNA, 1443 bp, Glycine max
  Peptide Sequence Number=SeqID_135524
atgaaaaccatcagtcgcgagatcattaacgatctcattgaccgcgtgggcggtcgggaaaatattctgtcactttcgcactgtattacgcgcctgcgctttgtgctgcaggatgtcgacaaggccgatccagaggccatccgcgccacgtccggcgttaaaggatgctttaattctgccggacagtttcaggtaattattggaaccgaagttgacacttattataaagcgttagttgaagcactaaatattagtgagacctctaaggagcagattaaatctgcggcgcgcagccagatgaaatggcacgaggcattattatcccattttgctgagatatttttcccgttattaccggcgttaattagcggcggtttaattctcggtttccgtaacgtgctgggcgatattgccgtggcggatgataaaaccctggtgcagctctatcccggtgtgaaagggctatacgatttcctctggctgatcggtgaagcgatcttcttctatttgccggtggggatttgctggtcggtggtgcgcaagctgggcggtacgccaatcctgggaattgtgctgggcattacgctggtttcaccgcagctgatgaatgcgtatctgattggcagccaggtgccggaagtgtggaacttcggctggttcagcattgatcgggtcggctaccaggcgcaggtgattccggcgctgctggccgggctggcgctggcaaaaatcgaactggcgctaaaacgtatcgtgcccgcctatctgacgctggtggtggtgccggtgtgtgcgctgctgctgtcggttttcctcgcccacagcctgattggcccgtttggccgtctgattggcgacggcatcgccttcgcggtgcgtcatctgatgaccggcagcttcgcgccgattggtgccgcgctgtttggcttcctgtatgcgccgatggtgatcaccggcgtgcatcagaccacgctggcggttgatctgcagatgattcagagcatgggcggcacgccggtgtggccgctgattgcgctgtccaatattgcacagggtgctgcggtggtcggcatcattgtcgctaacaaagatcgtgctgaacgcgacctcaccgtgccggccgccatttcagcgtggctcggcgtaacggagccggcgatgtacggcgtcaacctcaagtaccgctaccctatgctgtgcgccatgattggctctgcgctggcggcgctgctgtgcggcctcaacggtgtgatggccaacggcatcggcgtgggcggcttgccgggcattctctcgattcagccacagtactggacggtttactcgctggcgattctggtggcaattctggttccgctgctgctgaccatcatcatcaccaaacgtaaagcggcaaccgccatcatcagccaggccgaggtgcaacatgaacaggcacgctga

SEQ ID NO: 18747 - DNA, 582 bp, Glycine max
  Peptide Sequence Number=SeqID_135525
atggatagattcggcaaaactgtctgccagctgctgctacgttacggtgatgtcgattacaccgggtccgaacaatctgttactggccacgtccggcgtcaattttggcttccgacgcacgctgccgatgctgtttggcatcctgctcggctgtgcgttacagatgctgctggcgagcgtggcgctggagctgctattgcactggatggcgtcggtgcggttgccgctgacggtggtgggatgctgctatctgctgtggctgtcgtggaaaatcttccgcgccggtgcgccgcagctgcgcgaacgtccgcgtccgatgaccctgctgggcggcgtgtgtttccaggcggtgaatcccaaagcctggctgatggtcaccaacgtggcgctgatgtacgccaacagcaacggtgtgctggcggtgctgctcggctttgccgccctcaacctgccgtgcattttaatctgggcagcgctgggcgaccggctgcgccatcacctgcagattgcgtggaaacgtcaggcgttcaacacgctaatggcgctgtcgctggtggcgaccaccggctggatgctgtatga

SEQ ID NO: 18748 - DNA, 847 bp, Glycine max
  Peptide Sequence Number=SeqID_135526
atgagcgccagcgttaatgaccccagcacgcaaaaactggaactgatcgagcaggtgttcgccgcgcagaatcacccggactacaccaatatttcgctggcctgcccgcaggatagtgagctgtttccggcggcgaaactgggacgcattaccgcctcccttattcgccgcgataacgacatcattggtcgttatgcgcttccgccgggtagtgagcgcttacgggaggagattgcgcgccgtagcctgcacaccggcctgaatctcactgtcgcggacatcaccctgacccacggctgcatggaagcgctgcagctggcgctgcgtgcggtgacgaagccgggcgactgcgtcgggctggaatcgccgacctacttctttttgttcccgctgctggcctcactcgggctgaaggcgctggaaatccccaccgatccgcaaaacggcctgtcgctggacgcgctggagatgctgctgcaggagcagcgcattcaggcgctgatcgctatgccgggcgcgcagaatccgctgggctacgtgatgccgctggagaataaaaagcgtctcgcgaagttagtgaacacttaccacattccgctgctggaggatgggctgtatgacgaattgcagtttgactggccgctgtcgccgccggtcaaagcctttgaccgcgacggctgggtgatttactgcaccagcttcaccaaaaccgtcgcgcccgattttcgcgtgggctggacggctgccggccgcttccacccggcgattgcgcggctgaaagcggtatcgtcgatgaccgaatcaaaactgctgagcgaaacgctggccgaattcctcgccagcggcg

SEQ ID NO: 18749 - DNA, 1758 bp, Glycine max
  Peptide Sequence Number=SeqID_135527
atgagcaacactgcggtaaatctggcgctagccgccgctggcatggaaagcacacaccttcaggaacgaaaagacgtggatgtcctgctgatcggcgcgggcgtgatgagtgctaccttaggcacctggctgcaggatctcgagccagactggtcgattgagatggtcgagcggctggatgacgtcgcggtcgagtcgtcgaacggctggaacaatgccggcaccggccacgcggcgctggccgagctgaactatacgcccgaaagagcggatggcagcatcgacattgctaaagccgtagcgattaacgaatccttccagatttcccgtcagttctgggcgtatcacgtgcagaaaggcaacctgcgcaatccagccagttttatccacagcacgccacacatgagttttgtctggggtgatgccaacgtggacttcctgcgcaaacgcttccaggcgctgcagaaaagcaccttgttccgcggcatgaactattccgaagaccgtgaccagattgctcagtggattccgctggtgatgaacgggcgcgaccgcaaacagaaagtagccgccacctggaccgacatgggcaccgacgtcaacttcggtgaggtgacgcgtcagctgattgccgcgctggagaagaaagcgcatttccgcctgcgtctgcgtcaggaagtgcgcgatatcaagcgcctgagcgatgggcgctggcaggtaaacctgcacaacctcgccagcggtgagtcgcgggtgctgaccgcgcgccagctgtttatcggtgccggcggtgcggcgctgccgctgctgcaaaaaaccggcatcccggaagtaaaaggctacgccggtttcccggtgggcggctcgttcctcgtcacggaaaatccggacgtggtggcgcagcacatggcgaaggtgtacggcaaagccagcgtgggcgcaccaccgatgtcggtaccgcacgttgatacccgcgtgctggatggcaagcaggtgctgctgtttggcccgtttgcgaccttctccaccaaattcctcaagcagggctcgctgctggatatgttcggcgcgatgaacagcagtaacctgctgccgatgatgcaggttgggctgaaaagcttcgatctggtgaaatatctggtcgatcaggtgctgcagagcgatgacgatcgtatggaagcactgcgcgcttatgtgccgcaggcaaaacaggaagactggaagctggtcacggccggtcagcgcgtgcaaatcatcaaaaatgatgagaaagagggcggcgtgctgcgtctcggtaccgaagtggtcacctcggccgacggctcgatctctgcgctgctgggcgcgtcaccgggtgcctccaccgcagcaccgattatgctggagctgatggcgaaagtgttcccggagcagatgcgctcgcccgagtggcaaaccaaaatccgcgcggtaatcccatcgtggggccgcaagctgaacggcgacgtggcgctgaccgagaaggtgctggccgaaaccagtcgcgtgctgcagctggattacgcacccgtcatcacgccggaagctgccaacgacgaaggccgtgaaaccgcccatgtggtgggcaagaagcgcgcgtttgttagcggcacaatacattgcacattgcgcgataaatcgcgccgctacatcagggtgcgtcgtacggcttcgttaactgaccagcccccatattgtgcccctgcttaccgcgccatccaacgccgtggcatcagctga

SEQ ID NO: 18750 - DNA, 867 bp, Glycine max
  Peptide Sequence Number=SeqID_135528
atgaggaaaggagcgaacatgcaggtggcgtttaaacaagtggatgtgttctccacaggcgcgttcagcggcaatccgctggcggtgattatggatgcccggggtctgagcgacgcacagctggcggccatcgcacgctggaccaatctgtcggaaaccaccttcgtgctgccaccacaggatgccacagccgactatcgtgtgcgcatttttacgcccggcggcgaactgccgtttgccggacaccccacgcttggcaccgcgcatgccttgctggaagccggctggcccctgaaaacagcgggtaagattgtgcaggagtgcggcgtgggcctggttgaggtgcagattggcgctgacggtacgctggcctttgccgcgccggacgccagcctgacgccattcagcgatgcgctgatgagcagcgcgctgcacagtgacgcgttcgatctcagccagacgccagccgtggcggatatggggattcgctggctgttgattccgatgagcagcgcgcaggcggtgctggaggtggtcacccaggcggacgatttactgcggctgcagcagcatgcgggcgtgaacggcatcgccctgtttggcccgctgccgcaggatgcagaggcgcagtacgaggtgcgcgcgctgctggtcgagaacggtagcctggtcgaagatccggtcaccggcagcgccaacgcctgtctggcacgctatctggcggcgcagggccagcggcaggattattgcgcgcgtcagggcagcgccatccagcgtgccggtcgcattgtggtgcgttttgccggtgagacaatctggatcggcgggcaaaccctcaccctgattgatggcacgattgaggtgtaa

SEQ ID NO: 18751 - DNA, 708 bp, Glycine max
  Peptide Sequence Number=SeqID_135529
aatggcgcgctaaaactggccgctaagggcgtcgatattctgtttacctggcgcggtcatgctgaagaagcgcaggcggtcgtgaaggagattgaggcgctgggcgcgcgtgcggtggcgctgcagctggatgtgggcgacagtaagcagttcgatgactttgcggcgcgggtcaaagcaacgctgaacgagacctggcagcgccatagctttgattatttcgtgaacaacgctggccacggtcattacaagctgctggccgaaaccagtgaagatgagtttgatgcgctggtgaatgtgcattttaaagggccgtatttcctgacgcagaaactgctgccgctgatcgccgatggtggacgcatcctgaacatttccagcggtctgacgcgcatgacgctgccgggttcaggtacttacgccgccatgaaaggggcgatggaagtgctgacgcgctatcaggcgaaagagctgggcgagcgccacattcgcgtcaacatactggcaccaggggcgattgaaaccgactttggcggcggtcgcgtgcgcgacacgaaagatctgaacgctcatattgcttcagtgaccgcgctgggccgcgttggtctgccggatgacatcggtgatgccatcagcgcgatcctgagcgatgaaaccggctggattaccgcccagcgtatcgaggcctccggcggtcaggcactgtaa

SEQ ID NO: 18752 - DNA, 744 bp, Glycine max
  Peptide Sequence Number=SeqID_135530
atgaatagattaacaattctgccagcggagtccgctatgttaaaaattctgggccgtaactcgtcaatcaacgttcgtaaagtgctgtggctctgttcagagctggatattgcctgggagcacgagccgtggggcgaagacccgcagtcgttgcactcaccgcagtttatggcgctcaatcccaacgccatggtgccggtgatcatcgaagatgacttcgtgatgtgggagtccaacgcgattctgcgctatctcgccaacagcaacggcggtgaatggctctacccggataatccgcgcgcgcgtgcgccggtcgatcagtggatggactggcaggccaccgagctcaacacctcatggcgctatgcttttatgtcgctggtgcgcaattcgccagcccatcaggatccgcgcctgctggctgccgccgtcaaaggctggagccacaccatgggtattcttaatcagcagctggaaaaaaccgggcgctacgtcgcgggccgaaactttaccctggccgatatcccggttggcctggcggtgaaccgctggtttgaaaccccgctcgaccatccggactttcctgccgtgcaaacctattatgagcgcctgacggaacgcgagggttacaccacctggggccgcaacggccagcgcgccggtgcgtttcagtgcccaggtgtaacgctcatcaaacggatagcagcaggagagacgcagcgcatggcgatagcgatcgcttag

SEQ ID NO: 18753 - DNA, 3066 bp, Glycine max
  Peptide Sequence Number=SeqID_135531
atggacagtctgttccagcacgatcctgccacgctgagcggtaagctgcgcgtcgatatgtcggtggcgatggcaaccggttttatcctgccgcgcctgccggagtttttgcagcactatccgggcgtggagattgagctgagcagcagcgatcgccaggttgatgtgattcgcgagggctttgactgcgtgttgcgcgttggcgaactgaaagattccggcctgattgcgcgaaaaattggctcgcacgccttgatcaactgcgccagccctggctacctttcccgcttcggcatgccggtgcggctggacgatctcggccagcacgccatggtgcactatacccaacagctggggcagccctcgccgggctttgagtactttgatggcaaacagtgccactacgtgcagaccggcggcgtggtgacggtaaacagcaccgaaacctatcgcgccgcctgtaccggcgattggcgtgcagccgctgctggaatccggccagctggtcgaagtgctgcaccatttcccggccaaaccgatgccgatttccctgctctatcctcaccgtcgcaacgtggcgcgccgcgtgcgggtgtttatggagtggctgagtcaggatgcagaaggtctatgacggacaaaaccacaaaagcctcagcggctgaagctaagccgctgattgatatcaaaaccgggaacaaaaccgtagatggctcaatcaggcgcgtctcacgctttgccgcctggtttcaggcgatcccggcagtggcgcactttttgcgcgcgctggagcgctttaacgatcgcctcggcagccagtttggtgcggcgatcacctatttttcatttctttcgctgataccgattttgatggtctcctttgcggcggtcggctttgtgctggcgtccaatcaggacctgctttctgagttgatcaacaaaatcgttaacagcatcagcgacccgacgctggcgaccacgctgaaaaataccgtcaataccgcgattcagcagcgcgcgactgtcggcctgaccggtttgctgctggcgctctactccggcattaactggatgggtaacctgcgcgaagcggtacgcgcccagtcgcgtgacgtatgggaacgcacgcccgatgaccaggagaagtggtggaagaagtatctgcgcgacctggtttcgctgctgggtctgatgctggcgctggtgataacgctgtccctgacctcaattgccggcgcagcgcaggcggcgatcgtgaatgcgctggggctgggcgatatcgagtggctgcggccggcgatgaccatcatcgcgctgtcgatctccatcttcgccaactatctgctattcctgtggattttctggatcctgccgcgccacaagccacgcaaaaaagcgctgctgcgcggtacgctgctggcggcgattgggtttgaggtgatcaagtttgttatgacgctgacgctgccgaagctggcgacgtcgccctccggtgccgcctttggatcggtgctggggctgatggccttcttctactttttcgcgcgtctgacgctgttctgcgccgcgtggatcgccaccgcaaaatacaaggatgatcccgagatcagcaaaaaccagcaggaaacgctaaagggtcacttttatttggcccttttgcagagaatcacgccagaaaagccgcgcttccccttcccatccgccgccgattgccgtaactcagaaattatcctctttttcgccgctaaagcccggtttatgcaagcctccatctccgaaacacccgaccaaccacacgacggcacaccggttaactcacgcagtaaagtggtagttgcctcgctggttggcactgcgatcgaattcttcgatttctatatctatgccaccgccgcggtaatcgtatttccgcatatcttcttcccgcagggtgatgctacggttgccacactgcagtcgctggccaccttcgctattgcctttgttgcgcgccctattggctctgcgctgtttggtcactttggtgaccgcgtgggccgtaaagcgacgctggttgcctcgctgctgaccatgggcgtctctaccgtactgatcggcctgctgccgggttatcagaccattggcgtggcggcaccgctgctgctggcgctggcgcgttttggtcagggcctgggactgggcggcgaatggggcggcgcggcgctgctggccaccgagaacgccccggcgaagaaacgtgcgctgtacggctcgttcccgcagctgggcgcaccgattggcttcttctttgccaacggcacgttcctgctgctctcgtggctgctgaccgatgagcagttcatgaactggggctggcgcgtgccgtttgtgctctctgcggtgctggtgattatcggtctgtatgtgcgcgtgtcgctgcatgagagcccggtgtttgccaaagtgcagaaagagaagaagcagctacggcaccgcgccggcgccggttggtctcggttattcgcgcaacagcttcctgtggatgctgatggtggcggtcatcggttttggcgtgatggtgccgattgccggcctgctggcggaccgttttggccgtcgcaaaacgatgatcaccattacgctgatgatcatcgcctttgcgctgatgttcccgctgctgctcggctccggctcgcagattctggtgatgggcttcctgctgatcggcctgagtattatgggtctgacattcggcccgatgggcgcgctgctgccagaactgttcccgaccgaacgccttatattgcgacctggctgaatgcgaactacggcttgcaggcggtgggcttctatctggcctccatggcagtgctgacgctgatcgcgctgatcgcctgtaaagagacacgccatcagacgctgtacgaagcggctgatgtttctgcacttatccatcaacaccgcgcagatactccctctcccgctggcgggagagggaaccgtttggtgcgggctgatgttgctgcacttatccatcaacaccgcgcggacgctccctctcccgtttacgggagagggccggggtga

SEQ ID NO: 18754 - DNA, 465 bp, Glycine max
  Peptide Sequence Number=SeqID_135532
atgtctttatcgaaagtattaacacgcgcggcgctcggagtgcaggctccactggtgacgattgaagtgcatatcagcaacggtctgccagcattgacactggttggtctgccggaaaccaccgtcaaagaagcccgcgaacgcgtgcgcagcgctattattaatagcggtttcacctttccggcgaagcgcgtcaccattaatctcgcgccagcagatttacctaaagagggtgggcgctacgacctgccgatcgctatcgccattctcgcggcctcagagcagctgccaggcgataagctggcccattatgagttcctgggtgagctggcgctaaacggcgcgctgtgtggcgttcaggccgcgattcctgctgccatggcagcgctgcaggccggacgtcagatgatcttagcggagcataatcaacaggatgtcggcctgatacaacagggtgaaacgctg

SEQ ID NO: 18755 - DNA, 4422 bp, Glycine max
  Peptide Sequence Number=SeqID_135533
atgacaggtgcacagtgggtagttcaggctttacgcgcgcagggtgtcgacacagtgtttggttatcctggcggagcaatcatgccagtgtacgatgcgctctacgatggcggcgtggaacatctactgtgtcgtcatgaacaaggtgcggtgatggcagcgatcggttatgcgcgtgcgaccggcaaaaccggggtttgcattgcgacttccggaccgggcgccaccaacctgatcaccggactggccgatgcgatgatggattccgttccggttgtcgccatcaccgggcaggtctcttcagcgtttatcggtaccgacgcctttcaggagatcgacgttcttggcctgtcattagcctgcactaaacacagcttcctcgttgaatcgctggatgatttaccctcggtgatggcggaagctttcgccatcgcgcagtccggccgtccgggaccggtgctggtcgacatccccaaagatattcagattgccagcggtgacctgacgccgcacctgctgccggttgaagaagcactgagccactcaccgcagcacattgccgaagcgcgcgcgctgatggcgcaggcgcaaaaaccgatgctgtatatcggcggcggtgtcggcatggcgcaggccgtcccggcgctgcgggctatggcgcaggagaccggcatcccgatggtttctaccctgaaaggcctgggcagcgccgaagccagcagcgatctctatctcggtatgctcggcatgcacggcaccaaagcggccaacctggcggtgcaatcctgtgatttgctgattgccgtcggcgcacgtttcgacgaccgcgtcaccggtaagctggataccttcgcgccgcacgccagcgtcattcatattgatgtcgatccggcggaattaaacaaactgcgtcgcgctcacgtttcactgcagggcgacctcaaccaggtgttgccggcgctgagcatgccgctgcagatcgacggctggcgtactgaagttaaagcgatgaacgcggagttcgcgtggcgttacgaccatcccggcgaggcgatctacgcgccgctgctgctgaagcaattgtcagatcgtaaacctgacagcgcggtggtaaccaccgacgttggccagcaccagatgtgggcggcgcagcacatgcgcttcagcgcgccggaaaacttcatcacctccagcggtctgggcaccatgggctttgggctgccggctgcggtaggtgcgcaggttgcccgtccggatgacaccgttatctgcgtgtccggtgacggctcaatcatgatgaatattcaggagctgggcaccatcaagcgtaagcagctgccggtaaaaatcctgctgctggataaccagcgtcttggcatggttcgccagtggcagcagctgttctttgatggtcgctacagcgaaaccatcctcaccgataaccccgatttcctcacgctggccagcgcctttgatattccgggccagcgcattagccgtaaagatcaggtcgacgccgcgattgatgctctgctgaacagtgaaggtccttacttcctgcatgttgcgattgatgagcatgaaaacgtctggccactggtaccgccgggtgccagcaacgcaaacatgatggagaaaaccgtctgcgcgatgaatatggcgtccgccgtcaatgcggagaacattaatatcgaaatgaccgttgccagccagcgctctgtcgatttactgtcttcgcagttaagcaaacttatggatgtcgcctactttatctggttcaatggagagatggttaagtgggaagacgctaaggttagcgttatgtctcacgcactgcattacggcacctctgtgttcgaaggcgttcgctgctacgactcacacaaaggtccggtggtgttccgtcaccgtgaacacatgcagcgtctgcacgactccgccaaaatttaccgtttcccgatcaaagccagcgtggatgagttgatggaagcgtgccgcgaagtcatccgcgtcaataaactgaagagtgcctacattcgtccgctggcctttgtcggcgacgtgggcctcggcgttaacccgccagacggcttcaccaccgatgtgatcatcgctgcgttcccgtggggggcttacctgggcgccgaagcgctggagcagggcatcaacgccatggtttcttcctggaatcgcgtggcgccaaacaccctgccaaccgcggcgaaagcaggcggtaactatctctcttccctgctggttggcagcgaagcgcgccgccacggctatcaggaaggtatcgcgctggatacccagggttatatctccgaaggtgctggcgaaaacctgtttgaagtgaaagacggcatcctgttcaccccgccgttcacctcttcggcgctgccgggcatcacccgcgatgcaatcatcaagctggcgaaggatctcggtatcgaagtgcgcgagcaggtgctgtcacgcgaatcactgtacctggcggatgaagtgttcatgtccggtactgccgcagaaatcacgccggtacgcagcgtggacggcatccaggtgggtcagggcaaacgcggtccggtgaccaccaaaatccagcaggcgttctttggcctgttcacgggcgagaccgaagacaagtatggctggctggatcagagcatgcctaagtaccgttccgccaccaccacccatggccgtaacatggcgggtgcacgagccctgtggcgcgccacaggaatgaccgacgacgatttcggtaagccgattatcgccgtggttaactccttcacccaattcgtaccgggccacgtgcacctgcgcgacctcggtaaattagtcgctgagcaaatcgaagctgcgggtggtgtggccaaagagttcaacaccatcgcggtggatgacggtatcgccatgggtcatggcggcatgctgtattcactgccttcacgcgagctgattgccgactccgtggaatatatggtgaacgcccactgcgccgacgccatggtgtgtatctccaactgcgacaaaatcacccccggcatgctgatggcctcgctgcgcctcaacattccggtgatctttgtctccggcggtccgatggaagccggtaaaaccaagctgtcagacaaaatcatcaagctggatctggtggacgcgatgattcagggtgcgaacccgaacgtcagcgatgccgacagcgaacagattgagcgttccgcctgcccgacctgcggctcgtgctccggcatgttcactgccaactccatgaactgtctgaccgaagcgctgggcctgtcgcagccgggcaacggctcgctgctggcaacccacgccgatcgtaaagacctgttcatcaacgccggcaagcgcatcgttaacctgaccaaacagtactacgagcaggatgatgcgcgcgtgctgccgcgtaacatcgccagcaaagccgcgttcgaaaacgccatgacgctggatatcgccatgggcggttccaccaataccgtgctgcacctgctggccgccgcgcaggaaggcgagatcgatttcaacatttccgacatcgatcgcctgtcacgtaaagtgccgcacctgtgcaaagtagcgccgagcacacagaaatatcatatggaagatgtgcaccgtgcgggcggggtaatcggtattcttggcgagctggatcgtgccggcctgctgcacaccgacgtacgcaacgtgctgggtctcaatctgcgcgaaaccctcgatcagtacgacatcatgctgaccaaagacgaagcggtgaagaagatgttccgcgccggcccggcgggcatccgtactacccaggcgttctcacaggattgccgctgggacacgctggatgacgatcgccaggagggctgtatccgtacgcgcgaacacgcgttctctcaggatggcggtctggcagtgctgtacggcaacatggcggaagatggctgcatcgtgaaaaccgctggcgtcgacaaagagatcctcacctttaaaggtccggcaaaagtgtatgaaagccaggacgatgcggtggaagcgattctcggcggcaaagtggtcgccggtgacgtggtggtaatccgctacgaaggaccgaaaggcggtccgggcatgcaggaaatgctctatccgaccacttatctgaaatcgatggggctcggcaaaagctgtgcgctgatcactgacggacgcttctcgggcggtacctcgggcctctccattggccacgcatcaccggaagcagcgaacggcggcaccatcgcgctggaagcgcgtggcgaagcggcttatacgccgcacggtcgtgtgcgtcaggtctccttcgcactgcgtgcttatgcatcgctcgccaccagcgctgacaagggcgcggtgcgcgataagtctaagctgggaggctaa

SEQ ID NO: 18756 - DNA, 132 bp, Glycine max
  Peptide Sequence Number=SeqID_135534
atggtcgacgacaacgatgacactgctggtgtgcttcacgacgacactgctggtgtgattcacgatgacaaccaacttagagagtcaaagcttaagggcgcaatagtactcaggaaactccactccatgtag

SEQ ID NO: 18757 - DNA, 541 bp, Glycine max
  Peptide Sequence Number=SeqID_135535
atggataaccatgagcatgcaaatcatcgtgatacagcacaagccaagataaagaataaacgtatcaggcagcacaaagttaatgatcaggctcaaaatattgattttaatattcgtgattcatcagaggatgagcgttctgaatcaacacaagtttcttcacctgagaaccaaaattatatgtcctcagctaatgaccccgcaattaatagagaaggatattctgatcttggtgatcagctcatgcaatgtagtcactgtaatgcaaatatgtggtatgatgaaagagtctcaaaagataaaagaactacaaatccaagactcagtttatgttgtggaaatggcaaagttgaacttccattgttacagaatccacctaaatatctctaccaacttttgtatgatcatgatacatctgatagtaaaaattatcagcagaacataaggacatatagcatgatgtttgcctttacttctgttggtattaagtttgacaaatcaattaatcattcaagaggacctcctacaataagaattcaag

SEQ ID NO: 18758 - DNA, 321 bp, Glycine max
  Peptide Sequence Number=SeqID_135536
atgtccccatgcttttcatatatcgctggcactatcagcaatatcacggacactgcatcatcagagcaaaggagaaagcagattagcactaacttgcacttcagtagaaccagttttaacatacacgtatctttgcatattagagttgctgcagtgatccaacagtcaagaactgagacagctcccaatgtcactgtaacctgcagattaatttcttgtcagagaaaaccacatggcactgttgacaacatgactgtactgacaagcaaccctttgggcaagatgaatgctgataattcagggggtggtgatctgtattaa

SEQ ID NO: 18759 - DNA, 267 bp, Glycine max
  Peptide Sequence Number=SeqID_135537
atgaagttatgctttaaagaaagaaggaccactaagtttctttctagttcacgttgtaaaatcgctcccttgattccttccttccatgagtctgtgccatacatcaactatgatcttccctcagttatggtctacttgcagacattgctagtcaccttccccaaccttagactagattctgctgatggatcatgcttctttctgctaacgaatattggctttgctagttatgacacttgccaacatctaaccctgtgccctggatga

SEQ ID NO: 18760 - DNA, 324 bp, Glycine max
  Peptide Sequence Number=SeqID_135538
atgactcgaccaacagaattcatggatgttgcagattctgattttctcggtaacaaagaatttgatgaggaagactcagaatttgagactgattttgagaaatactttgtctactccactgccaagaaccgcttctttggccggaaaaggcctcttcgtgtgatcctaggctctggactgagtatgctcttctgcttcttttatactccttcatacatgacatgctttgaaagtttcatttgtgtttcaaaaattacattgaacatgttaacttggggcatgtttggaagtgcttttagaaaaatgcatccaaatagaccctaa

SEQ ID NO: 18761 - DNA, 891 bp, Glycine max
  Peptide Sequence Number=SeqID_135539
atggaggccatgaaggatcaaatgacctctatgatggaggccatgttaagtatgaaacagatgatggagaacaatgtggtcgcagttgccaccaccagcaccgtcgctgaggtggatccgactcacccatccgccataaaccaaacaagccaaccagccctggtcatggtaggtcaaggaggggaggtgttaggcagcataggtggtccctatatggggcaaaataggaattctttcccatatgacttaccccccaactatacaccacccaatgcagtgcacctgcccaacaaaaacgccaaccactccgttcccattccccttgaaggccagcaaccccagttgggacatgcacccttcgctcaacctgtgggggaagcctgtgaagagcctcgggatcatgctctgggtgacatcgaaccataccctatgtatgccattgagggaccagcgtttagtggtatgcctcaacccaatgccacgggagctcctcaacaccgcccactgcaacctctgcacttctcagtggggagactgcctccggccatggaagaaagggagaagttggatctcatagaagaaaggctgagggccatcgaagggatcggtgattacccgtttgccgacatggcgaagttgtgcttagtgcctgacatcatcatctctccaaagttcaaggtgtcggatttcaataagtacaaggggactacttgcccgaagaaccacttaaaaatgtactatcggaagatgggggcatactctagagatgagaatctcttaatgcactttttccaagaaagcttggtcggggcggcggtcaccaggtatactaacttggaagcttttcggatctgttcttggaaggacttgatggttgccttcatcaagtag

SEQ ID NO: 18762 - DNA, 348 bp, Glycine max
  Peptide Sequence Number=SeqID_135540
atgggtggttttggagtggcggagacggtgatggtgggatctaggggtggtggcatttgttctggaggggggtatttagggtttggacttggaaggagaatgtttgagaaaaagacaacgtcgaagacgaagaagaaaaagaggaagacgaagtggaagagaaatagaagggtaaggataagtcatccccatcgaagagcttatggatttcgatcagttagtcgattgagcttctcttctatcaattactcagttttgatgctcattatgttgcttttgatgaaaataggaggaccagaagtgaaagcaagcagaggatgctttgaagatactcaagaagcgtcttaa

SEQ ID NO: 18763 - DNA, 378 bp, Glycine max
  Peptide Sequence Number=SeqID_135541
atgaccaatagagaagcatggaaattagaaaaggaggtgaaaaaattgatactccagggggtgaaagaaagaaaggaaactagttttgagaaggacttgctgcaaatggttcttgaaggtgctaggaatagtaatctaagtcaagaggccactaaccgttttattgttgatagttgcaagaatatatacttggcaggctatgagacaactgtagttgcaactgcatggtacctgatgttgttggcctcaaatcaaaattggcatgatcgcgttcgcgccgaggtgctagaaatttgcagggatagtatcccaaattttactatgctttgtaagatgaagcagaaattaaagtgtcagtgtacacttggtttatactaa

SEQ ID NO: 18764 - DNA, 372 bp, Glycine max
  Peptide Sequence Number=SeqID_135542
cgagaattcgctaagtgcaaccttcaatggctaagcgcgaggaagaatctagaagaagatgagctgtcaagttcgctaagcgcaccgctccaggtcatcaagcgcaccgcttcataccatccgctaagcgaaacaagcgtgctaagccaaaatccacttatgcgcgctaagctatccagatctgtgctaagcgcacgagcacgaaccaaggccacctatttaagcctaaaatcagatttacaaagggagtatggaacttttcttgagaagctctggatgcacgaagcctttgagaaacaacatttcattcagcatgtccaacatttaaccaatatacaatgtacatcaagtatggcccaaaatacatcatga

SEQ ID NO: 18765 - DNA, 594 bp, Glycine max
  Peptide Sequence Number=SeqID_135543
atgggctatataggcaaagatttatcaccaactggcattgtgatagttgtgttgattatctgcaccattcttgggtttccactggcaataatagtgtcactgggaagtggaccatgggatcagctatttggtggaggaaactccctaacctttgttgtggcagctatttcagcccttatcagtggactcataactgtgttggctattcctcgatctggtgctcaaaaggctcgaagccatgtcaactatgagaattttggtacccacacttgtcctcctgcactacaaatagactggaaagctgccaatgtgcttttggatgattgtttcaggctgttgttggagattttggccttgcaccaatgtgatgccaatgtgcttctggatgactattgtctacaggctgattcccatgtcacaaatactatctgtggcattgttggacacattgcaccagagtacctctccaccagccaatcttccgacaaaacaaatgtctttggatttggcattctcttgttagagctcataactgtaataacaacacttgagtttgggaaaacaattaatcaaaaaggtgctatgctagagtgg

SEQ ID NO: 18766 - DNA, 261 bp, Glycine max
  Peptide Sequence Number=SeqID_135544
atggcaccgctggcaagcggcacgctgccggcctcgtcgctgctgaaatcctttgctaactggcaatccattgtggcgattatcgttggcgtatttgttgcctggctcggcggtcgcggcgtcagtttaatgagcgtgcagccgtcggtgattggcgggttgctgattggcacggtgattggtgtggcgttctttcgcggcgtgccggtcgggccgctaatcgccgcagggattgtgtcgctgtttgtcaccacgaagtag

SEQ ID NO: 18767 - DNA, 804 bp, Glycine max
  Peptide Sequence Number=SeqID_135545
gatttgatcgtgcgtaaagggcagctgatgttctccggcccgccggatcagccgctgctgaatatcgaggcgatccgcaacccggaatccaccgaggacgatgtgaccgccggcgtgcgcgtgaccggcctggcggatgcgccgaagctggaagtgttctccgatccggccaaatcgcaacaggaagccctgtcttatctgctgcgcggccagggcttgagcagctccggcgccgacggcaacgccatgacctcgatgttaatcggcatgggggttgcacaaagtggtcaacttgtgggtaaaatcggcgaggcattcggcgtaagtaatttggctctggacactcagggggttggcgacagttcccaggttgtcgtgagcggctatgttctcccaggcttacaagtaaaatatggagtgggcatcttcgactccttggccacgctgacgttgcgttatcgcctgatgcctaagttgtatcttgaagcgggaaacagccattggatgaccaatgcgcaatggctcggcgaccatcagattgaagggtttgcgctctacaatctcggtcactatccgggcgtggttgagggggacggcacggtgtactgcgaagtgtatcgcatcgacgccagcaccctcggcgagctggatgccttgcgcagtaagaacggcgagtataagcgccagctgatccagacgccctacggcagcgcctggctgtacgtgtatcagcgttcgattgccggtcgcacccgcatcgcgagtggcgactggttacggcgcgatgacgccgcagaagcgtaa

SEQ ID NO: 18768 - DNA, 1710 bp, Glycine max
  Peptide Sequence Number=SeqID_135546
atggatctttttatgcgcattcacatccttgggatttgtggcacttttatgggcggactggcgatgctggcccgctcgctcggacacgaagtgaccggttcagatgccaatgtctatccgccgatgagcacgctgctgcaacagcaaggcattgaattaactgaaggttacgacgcctcgcagctggatccggcaccggacctggtgatcatcggcaacgccatgacgcgcggcaacccgtgcgtggaagcggtgctggaacgcaacattccttacctctccggaccgcaatggctgcacgatttcgtgctgcgcgatcgctgggtgctggcggtggccggtacccatggcaaaaccaccacagccggcatggcagcgtggattctcgaggcctgcggcctggaaccgggctttattattggtggggtgccgggtaacttcgacgtatcggcaaaattaggaaaaagtccattcttcgtcattgaggcggatgagtacgactgcgcgtttttcgacaagcgttccaagtttgtacattactgcccgcgcaccctgatcctcaacaatcttgagttcgatcatgccgacatcttcgacgatctgcgggcgatccagaagcagttccaccatctggtgcgcatcgtgccgggtcagggcaagatcctgctgccggaacacgatcacaacattaagcaggtgatggcgatgggctgctggagcgagcaggagagcgtgggtgataacggtcgctggcaggcgaagaagctggtgccggatgcctcgcgctgggaagcgtggctcgacggtgagaaagtggcggaagtgaactgggcgctggtcggcgaacacaacatgcacaacggcctgatggcgattgccgccgcacgtcatgttggcgtgaagccgtgcgatgccggtgaggcgctgaacagcttcattaacgcgcgtcgtcgccttgagctacgcggcgaagtgaacgcgattaaggtgtatgacgattttgcccatcacccaacggcgattctcgctacgctggcggcgctgcgcagtaaagtcggcggcaccgcccgcattctggcggtgcttgagccgcgctctaataccatgaagatgggcgtgagcaagaacgaactcgctccttcgttagggcgtgccgatgaggtattcctgttccagccgcaccacattccgtggcaggtcgcggacgttgcggacgcctgcattcagccggcacactggagcgcggacattgatacgctggtggagatggtggctaaagcggcgcagccggggccgagaggcgatctgccctcatcccagccttctcccgcaagcgggagaaggggccgtccggtgcggacgtcacatccagcgctcgtcctcagctacctcagcactctgcttcagctaccccagcactgcgctttacattccctctcccgcttgcgggagagggttagggtgagggcagggaaaccgtccgcagcggacttacgcttcagccagctcgcgcaggtactggaaaatctggcgggcggcttttggcggcttactggcggctttctctttctgcgcgttgcggatcatactgcgcagctgctgacggtcggcgtgcggatagagattcagcacttccgccaccgcatcatcgccgggatcgataagccgatcgcgcagctgctccagcttatggaacagcgcaacctgctg

SEQ ID NO: 18769 - DNA, 2244 bp, Glycine max
  Peptide Sequence Number=SeqID_135547
atgaaatttcaagatgaaatagaatggatgggcagaagaaggagttctagaatcattgctttggaagaaaaaaagctcaaggaaagagaaaggaaactagcgttggcattggaaaggaagaacaagtcaatgaatcatgacaaacaaaaaggaaaggcaacaattgaagtacaagatgacttgagggattttagtgagcatgaagagggttcaaccaagaaaggacacaaaagcaaagaattttatcaactgatctcttcaatcaaggaattagaaagacactctgagaatgtaagcacttcaggatcaaatgactcatctttaaatggtgtgtcactaaagaacatccttcaaataatcatagatttcctacaaagggaagacccaaatgagctacttgctcaaccaattagttttgatgtggtggaaaattactacgaaattgtgaagcaaccaatggatttcggtaccataagggcaaaaattcacgagagcttgtacacaaatctcgaacagttcaagcgtgatgtctttctaatgctctccaatgcaacggatgtctatccaacaacctcaaaatatcaccaagtggctgaaaatattagcagggatgctaagtgcgtttttgaggctcttgctgagcctcaaaattttgattcagaactttccctagacaagacatgcccaactagaaagccacaaaatgggaaacttggaacctcacggagggtttctccaaaagttgctagtatggaaactcgatcctcatttaaccttcatagaaaaaatgttactcatgttatggtacctgaaatagaaaagaggcatatgtattggccaacaagcaagccactgatttcagaggttctgtgtgctagcaatcctaatattcaattgaagacaaattcaattaagtacaaagaaagtctgttacggtttgtacaagatttgggaccaacggctaaaagggttgcggcgaaaaaactagaagcactaagggatcaacaactatgcaatgttgacactccaactccacaaacacagcctacagttctcaatgctcagacacttgctttagccattccctttctcaataggtcactcaccaccattcctggctctgcagctcagggaaacaaaattttcaacaacaataatgttggtggagttaacataaaggatgttccttatcaaggaaacaagaccaatacaaatgatagctggaatgcttatgttgctactcttttgagcaacaggtttttaaataatgacaaaggagaaagttctagtggaagaattgagaacttcaacacattgtctccccgtgtttatccgacaacaagtgtgatctcaggacctagcattagcctcccagagtcatcatctcttgtgcctcaatcaaggataagaaacttcatgtctagcatgccaagcaataatctctcacaaatttctcatgcgcataagccgaggccagaagatattattaacctctcagatttgtctcttgtgtctcaacaaaggccagaaaacttcatttcttacatgccaagcaataatctctcacaaatttctcatgcgcataagccgaggccagaagatattattaacctctcagatttgtctcttgtgtctcaacaaaggccagaaaacttcatttcttacatgccaagcaataatctcaaacagatttctcttacacaagagccaaataatctctcacagttttctcgtgctcatgagccaaggccagaagatattattaacctctctgatttatctcttgtgtctaaagcaaggccagaaaacttcgtgtcttgcatgccatgcaacaatctcaaacagttttctcttgcacgcgagccaagaccagaagattttgttaacctctcagacctgtcccttgtgtctcaaccaaggccaagagactcaatgtatgccatgcccagcaataactctattgatccatctcttatgccccgtccatggcaagcaaactccatgtattgcttgaattccacaagtgtatctcctttgccactaccaaatcaaggaatgtcagtttcaagcacatcggactcgtcatccatgaaccatagtacttccacaatgttgcatggaattcatgatcaggtcctgcacaatgctacaccatacactccatttgacatgcaagtacagaatcaatattcctcatattttcagctggatgaaacaagtggtggttggagacaacgcttataa

SEQ ID NO: 18770 - DNA, 498 bp, Glycine max
  Peptide Sequence Number=SeqID_135548
atgcaagaggcacaaaagcaatttctggtgtgctctttggaagaggaaagactcctgcatggacgtgatgcatgccctcagttgttcattgtaaatatggtagttatttgttgggacttgggacccagattagagttgtcaagccaacttttagctccccattggtctgatgcacaggctgatttctataggttattttctagcagatctggcaatgattctttggcattttccagctttaggaggtctggaatacgttttacaccatgggctgtccatgttttctattatccaatctttgctaagtggccaaggactgatctacatactaatggcacttggatattgctggtcttaagagctccaaactttacgtctggaatggcattgctttgttcttcgggtggttggtactgtataatatacttttggtctcaattctattctattatagtacctgaaggaattgcttatggtcatataggatttgcttcttaa

SEQ ID NO: 18771 - DNA, 543 bp, Glycine max
  Peptide Sequence Number=SeqID_135549
atgtggggtaggtggtggtggcgtgctggtggcggttttctgaggcaaagggtatcttcaattggtagtgttagccatggttatggggaaaagcttcatcctttggaccctcctttgttgggtttgaggggcgttgttgaagtgatgtgtggtggaagaaggacacctttatctgttgtgttgaaccaaatcaagaggggtgtatcaacttccactgggaatggtggtgtcagcaatggcaataatggaacaacagaagattctatatcattctctgaagccaagaagcttatgaggttggtgaatgtggagtcattgaagatgaagcttggtatggaagggaaggaagtcatttgctattctgagcttcttgaggcctgtgagagtgtggggattgcaaggagtcctgaggaggctgcagcatttgccagggttcttgatgaggctggggttgttctcctcttccgggacaaagtgtatttgcatcctgataagaacatagcttgtgcttgtggggctcacgaaaagcgtgatcggatctaa

SEQ ID NO: 18772 - DNA, 501 bp, Glycine max
  Peptide Sequence Number=SeqID_135550
atgccttctagagtggtggatctggttcgaagagctgttccactggtgctgactgctgacaacgatcctatgagggaggagttgaagaaactgcaggacaagaaggaggaaattgatgtgttggcacatacgcaggcgcggcgcatcctctggtctggactaggatttggtgtaatcactgtcggcttcttcttccggctaacattctgggaattttcatgggatgtaatggaaccgattgcgttttttaccacaaccactgggttggtcataggctacgcctacttcttattcacttcaagagaccctacataccaagacttcatgaagaggctctttctttcaaggcagaggaagcttttcaagaggcaaaattttgacattgagagattcaaggagctccagtgcaagtgcaaaacacccttacatgctagtaccgttttaaaaaatcgcataggggtggaactggatcttgaagatgctttacatagagatcattaa

SEQ ID NO: 18773 - DNA, 558 bp, Glycine max
  Peptide Sequence Number=SeqID_135551
atggcttatgcttccattcctcctcctccccctcctccgccagggaatggtgctacttcacttggttcttcggcagttatcattgccaaggaatttttgcattccatttcgcagaaattaaacaattccaactatcttctatgcaacaagatcaactccttttgtcgtggcttcaatcaaccatctttggcgaggttcttctgcaactcgttagatgcaaaacagcttggcatctttgggacaaacttccacttgatggtttgtgcgaaaaagcgacaactccgcaatgatttgcacaatatctttctcaacaatagttctatctctgattatttgtttcggattcaaactatcattgatttgctctcatggattggagaacatgttttggaatctaatcatgctgacatcattcttgatggattgccaaatgagtttgagtcacttattacctttgtgagtggaaagtttgaatcactatctattgatgaggttgcgactctactttttgctcatgaatcgcaagaaaaatcttgcctcgtctatggcttcaattaa

SEQ ID NO: 18774 - DNA, 660 bp, Glycine max
  Peptide Sequence Number=SeqID_135552
ggagaattgtgggcgaaagtattggattccaaatatggaagttggagaagtctggatgaatcaagaagaaatagtagagattcaatttggtggcgggatttaagtaacgtctgcaatgcatttgaggaggggagttggttcagaagtgggataaaatggaaaattggatgtgggtcaaaggtgaagttttgggaagatggatggctagatggagggatcttgctgttggagaaatatccacgtatgtatagcatatctcaacaacaacatcactttgtccagcagttgggggttgcatcactaggaggatgggattggcaactgcagtggaggagtttacttagggaagcggagatagacatagctgcaaaattcatgaaggacatcgagggtgtggtagtgcaggctaatcagcaagatagttggggctggggggtggatcccagtgggatatactcagtgggtagtgcttacaaagcgctcaataggcacttatcaaaggaaaatgataacgaagtgtttaaggaattatggaagctcaaagttccaagtaaagtgtcaccctttgcttggaggttaattcgggataggctaccaacaaaggccaatttgaggaggaggaatgtagatctgaatgatatatctttgccctttctgtag

SEQ ID NO: 18775 - DNA, 1041 bp, Glycine max
  Peptide Sequence Number=SeqID_135553
atggtgcttcttcaccttgccaattcaagcatccaaaatttctctctttgtttgacatgctatcagtatgattcaagcttgataagtgcatggatctcctctatctttgaaaggggtgtccataatcttcatattcagtatgctgatgatgtccactttccttcccatacactctttagttgcatctctctagtacaattggtgcttcaaatgaaatgtactattagtgttccaatcttttcttctctcccaaatcttcaaaaccttagcatttctggggtcagtttatgtgagtggttaactaagcagaacattagtatgaaagcacctctacttgaaaagttttccatagcaatctgggggtctctatcaaatgaatcacataaatctgccatcaagatttttgcccctaatctaacagatttctcttacgagggtgatcttgagcaacatgtgattctgttgaattcatcaattcgtagtgtatatgttgtggttgttattgatgaggacaacaaggacagaatggaaaatgttgggtttaaagtgcataatcttcttgcacaaatccgtgaagtggagcaattgaaactattgttttacaaggttttaatgcatgccagagatagtttcacccatccacctgcttttggaaggttgacatgcctacaattaaatgaggttactggtgaagctttgttgaacatacttcacaattccccaattcttaatactcttgttttacaaaatggggtatctgaatcaaacaaagatgtcttggcttctgcaccagtgcctcagtgctttttgtctagccttaaagtttttcagtttaaagaatttaatgtgcatgagcttgagcttcttttggtgaaatttgtgatggcaaatgcagcaatgttggagcaaatgactatatgttctgctttttggctgcggtattctgatattgacatggagaaagtcaaggagcaaatactctcttttccgaagtgttccaactttgtcatgatacaatgttctaatgttaacagttactga

SEQ ID NO: 18776 - DNA, 609 bp, Glycine max
  Peptide Sequence Number=SeqID_135554
atgccccatggaagtttggattcctttttgcatgggagatcaagggagaagaaggttttggattggccaaccagatatagaatagctgcaggtgcagctagaggaatatcatatcttcaccatgattgcatccctcacattatccacagagacataaagtcaagtaacatattgttggatcgaaatatggatgctcgggtttctgattttggattagcaacgttgatgcaaccaactaaaactcatgtgtcaacaattgtagctggaacttttggatacttggcacctggaagagcaacactgcaaggggatgtttacagctttggagttgttttgctggagcttttaactgggaaaaaacccagtgatgaagcatttatggaagagggaaccatgcttgtcacatgggtgaaggctgttgttcgagacaagaaagaggagttagttcttgataatagcctagggtcttgttcaatgcaagaggtcaacaaggtgttcagcattgcaatgatgtgtcttgaaccggatcccttgaagaggccaaccatggccgaagttgtctctttgcttgagcaaacagaagcagataaactcattactgcatcctga

SEQ ID NO: 18777 - DNA, 1170 bp, Glycine max
  Peptide Sequence Number=SeqID_135555
atggcggatagagaaattgaagcctcaccacgctaccatccagataatgatgtcaaagaatcaattgcagtaggtgtttcaaccacaaccgatgaagatgaaccatcatcgctcttccagcttagccgttggagatggtggtttttagtagtaatcaacatagccttactcttgatgggccaatctggtgcagtcttgttggggagattctactttgaccaaggtggagaaagtatatggatggcaacactagtacaaactatagcattcccaatccttttcttcccactcttcttctttcctcaccccaaaaacctttctaacaccactcacctcaccatgcactcttatactctcactctcatcatggtttacttcctcttaggtatcctcttagctggagataacatgatgtacacaataggccttctatatcttccagtgtctacctactccctcatttgtgcatcacaacttgctttcaatgccatcttttcctttttgatcaatgctgagaaactcaccatgttaatacttaactcagtgattcttctcaccatatcagcttcacttatagcacttcattctgactcctcagaggataacactaagaatgttacaaagaacaagcacatggttggtatttggtgcactcttggtgcatcagcagggtatgcccttttgttgtgcctcatgcagctaacatttgagagggtcttgaagagggaaacgttttctgtggtcctggagatgcaaatttggacatcttttgttgcttcatgtgtttgcatagtgggactttttgccagtggggaagggaagggcttggaggatgaaatgaggaggttcaaagcaggaagagaggtttacatgttgactcttgttggaactgctttggcttggcagatttgttctgttggagttgtggggctaatctatctggtgtcttctttgttctccaatgttatgagcatgctgagtttgccacttgttcctgttgctgcagtgcttctttaccgtgagcaaatggatggtgtcaagattgtggccatgttgttggccatcttgggttttagttcttatatttatcaaaattatttggacgaaaataagcccaaagaaacagcaattcttgctattgacaccccagaaacctctatttctggatag

SEQ ID NO: 18778 - DNA, 1740 bp, Glycine max
  Peptide Sequence Number=SeqID_135556
atggattcaaatgctgcaacaatgcatggtacaacaaaacagctcaagtatggagcaaaagacataataagccaaatacatgacagcattcttggtcatatcttgtctttccttccaacgatggaggcagtccaaacaagcgtgttatcaacaaggtggattgatgtttggacatccatcaccaacctaaagttgaatgatggtgtgctaatttgttctgggaagaagatgcagaaggaacaatatgagtattttgtaaacacaatgcttcttcaccttgccaatttaagcatccaaagtttctctctttgtttaacatgttttcattatgagtcatcccaggtcagtgcatggatctcttctatattggaaagaggagtccaaaggcttgaaattcaatatgctaataaaatcttctttccttcgcataccctctttagttgcaactctttagtacaattggtgcttcaaatgagatgcactcttagtgttccaatctttgcatgtctcccaaaccttcaaactcttggcctttcggggatcaagttagtgagtgatcatgaatcctccacttattcaaaagatctagttcttagcttcccaattctcaaagtgtttgaagctaaaggatgtgagtggtcaactaagcagaatctttgtatccaagtacctctacttgaaaggttttccatagcaatgtggaactccctatcaaatgaatcatgcaaatcttccatcaagattttctctccccatctaacagatttctcttataagggtgatcttgaacaggaaatcattctattaaatacattattaattcgcactgcttctgtagtgagtgtcattgatgctgataaaaaggaaagcatgagaagacttgggttccaagtacataagcttctcacacaaatctgtgaagtggaacaattgaaattactattgtacaaggttttagtgcatgctgctgatattttcacccatctaccagtttttggaaagttgacttatctgctactgaatgaggttaccggtgaagctctgttgaacctactccacaattctcccatgcttaatactcttatattacaaaatggagtatttgacttaaatgaagatatgttgacatctgcatcagtgcctcaatgctttttgtctagcctcaaagtttttcagtttaaaggatttaatgtgcatgagcatgaacttcttctggcgaaattcgtgatggcaaatgcaacagtcttggaaagaatgactttaagcacagcattttggctgcagtattcagatattgacatggagaaaagtgcttcttcaccttgccaattgaagtatccaaagtttctttgtttaacaagttgtcattatgattcatcccagaacagtgcatgggtcattagcttcccagttctcaaagggcttgaagctagagaggatattattactaccaacaatttaacagatttttctaatgagggtgaccttgaacgagaaatcacgtctattaaattcacactactgagtggaaaagctcttcagcgagatggcagtgcttgcacaatggtatattcacctgttcttgcagggcaaaggctgctgtatcacaatttcacaaagtatgaactatacaaaagggctattacttttatgataaatgaaagtaggaaacagaataaccgaagtttgaagcaagtaataaatgatcaagttgtcatgaaagtaagatatttgagctga

SEQ ID NO: 18779 - DNA, 639 bp, Glycine max
  Peptide Sequence Number=SeqID_135557
atgaaccatgagagatcctattctttttccttttccatcgctccaatttttaaggttgttatggtacccattttagatttcacgtgggctaaggcttatcatttggcgagagcagtaaatgctgaatacgtggaggaaccagcaacaaatgtgaaattccagacatctttgagttttcccggttgctcaaattcattaactttgtttggaacaggatacagagaaaaagtttttgcgattattggtgtcaaggtctatgctgcagcttccttcgaaaaatcattgcaaattattctagtcagagatgttgatggtaaaactttttgggatgccttaagtgatgccatatcaccaagaattcaacaacccacaaccacagatgaaactgctttgacaactttccgtggtgtctttctagatcgccctcttaagaaaggagctatcataattttgacatggttgaacccctccggattgcttgtttctgtctcctcaaatgggcttccatctaccatggatgctacaatcgaatctgcaaatgtggcttctgctctttttaatgtattccttggagatagtccggtttctccctccttgaaagcttcagtggctgaaagcttgtcaaaagtactgaaataa

SEQ ID NO: 18780 - DNA, 285 bp, Glycine max
  Peptide Sequence Number=SeqID_135558
atggagcacattgttcaaatgaagggaagattgaagttgaatgttaccacaaccagtaatggggtagcaccagagtctataatccagatattttcagtaccagaagcattaaaggataggaagctagaactcttaccagccatggttagggaacaagagctagatgtcttattgaaagggttcataaaggctcgtagatgttccaatgacgacgacgaaaggtggttgacagtggaggacggcatcgaacagcgaccaatggtatacgtagtgactgggcactga

SEQ ID NO: 18781 - DNA, 153 bp, Glycine max
  Peptide Sequence Number=SeqID_135559
atggcgccttccggaagaagggttcttccgaaagtaataaaacgtattccggaagaacagattttccggaaagctcccgaaacacctcttccggatgacctttccagtggttctggaagcacttcccggaagaccctttcttccggaatttga

SEQ ID NO: 18782 - DNA, 1056 bp, Glycine max
  Peptide Sequence Number=SeqID_135560
atggaattcggaacaaagaaggataatttttttttggtgaacccagggcaccccttgagggagccaaaaactagtccctcaaaggttcaatatgacatcatcggttccctaaagctgaattatccttttgttacgattggttcagttgatcgcacaaatcttttctatggtgtcaaactattgaaccgtggacaatcttttattgacgagcttgtgcgagaaatttcaaaagaagtcactaatggtggttccactataatttattgcacaacaatcaaggatgtagagcagatattcaagtcatttgcagaagcaggcattgaggcagggatgtaccatggccagatgaatggaaaagctcgagaggagtctcatagattatttgttagagatgaactgcaagtcatggtggccaccattgcctttggcatgggcatagataaacctaacataagacaagtgattcactatggttgccctaagagtctagagtcctactaccaggaaagtggacgatgtggtagagatggtatagcttctgtttgttggctttactacacaagaagtgactttgccaagggtgacttttattgtggagaagtgaaatcagaaaaacaaagaaaagctattatggagtcattgctggctgctgaacgctattgtgtgctgacaacctgcagaagaaagttcttgcttgaatactttggggaaaaattcccagctgatagatgtgggaactgtgataattgcaaaatctcaaggaaggagcgtgacatgtccagagaagcatttcttttaatggcttgcattcattcatgcaggggtggatggggccttaatatgcccattgatgtcctgcgtgggtctcgatccaagaaaattcttgatgttcagtttgacaagcttccacttcatggactggggaaaaattatccagcaaattggtggaaagcacttggatatcaattgatttctcaaggtacttttagtggaaataatttacccagttatagtctgataagaacagatcataatggaacagatttgaaaagatga

SEQ ID NO: 18783 - DNA, 144 bp, Glycine max
  Peptide Sequence Number=SeqID_135561
atgttagagttgggtgactatggatgtgcgatagtggtggtggcttgggtggtagcagagtgggggaagatgaagtggttggggcgtgggaaagggttggtagcggagcatttgatggcgagtgagcatcacgagccagcatag

SEQ ID NO: 18784 - DNA, 318 bp, Glycine max
  Peptide Sequence Number=SeqID_135562
atggaagcagcgtggatcacaattctggtactgatattgatcctctctctgataggcgcatggaagttgctgaactggttatggctcacacccaagagactagaaaggcttctgagagagcaaggccttcaaggcaatccatacacgcttcttgttggggactccatggaggttatcaagatcagaaaggaagccttatccaaacctatcactctcttctctcatgacatagtgccgcgtgtctcttcctatgctcaacacactctcaacaaacatggtatatgcttatgcccatcattctcttttttgcatttctaa

SEQ ID NO: 18785 - DNA, 546 bp, Glycine max
  Peptide Sequence Number=SeqID_135563
atgagatttgtaggttacatagcgcaatggagaagcgcagcgaaggaggcgttggatcgcacagccatcactgtgaaattcctgtgctggcttcacttcaccggcaactacctctgttccccatgtcacacctatggggttagcatgctccccaccctcaacgtcgccggcgacgttcttctcgccgaccacctctcgccgcggctcgggaacatcggccacggagacttggtgcttgttcggtcccctctgaaccctaagataaggctgacgaagcgcgtcgtcgctgtggaaggggacaccgtcacctacttcgaccctttgcactctgaggctgctcaagttgcagtggtgccaaagggacatgtttggattcaaggggataacatttatgcttcccgtgattcacggcattttggtcctgttccatatggtcttatagaaggaaaagtgtttttccgggtaactgttgtacctcatacatactacattcttgtatattatattttaagcattggttttttaggtttcactcctttatcttga

SEQ ID NO: 18786 - DNA, 642 bp, Glycine max
  Peptide Sequence Number=SeqID_135564
atgaccgacgaagacaaacccaaagccttctccggcggccatcacaaccaccctccgccgcagccacaacccttccccgccgcccagtatggcaccttccaaggcgtcgccaactaccctccgccgcagccgcaccccgccatcggcttccctcacccggttccgccgcccggcgccgtcgactcctccgcccctcctccgccctactacccgggctaccaagccgttcccggttatgcagttgctgaaggaagacctgtaagagaacgccgccttggttgctgtggccttggatgcggctggtgtctgtttatattaggcttctttcttgctggcattccgtggtatgttggggcaataattatgctttgttccagagtagactatcgagagaaacccggatatattgcttgtgtagttgctatgttcccgaggggaattgtgtggctttataggcttattgcacttggtttttatctccacatcacccaagctttttgtatttttagttgcatattgaggattaaattgcttgaagttgttgtgtttacttgtatcattgatgacataatgcacgagaaggctgttctgggcacaattgcaattattcttggtgtgacagagggagtagatgactggtaa

SEQ ID NO: 18787 - DNA, 1788 bp, Glycine max
  Peptide Sequence Number=SeqID_135565
atgatggtgaatccagatatgattagcaatcttccagacgagatcaaaaccaatatcctatctaagctttgcatcgatgaagctgtgagatgcagtgtcctctcaaagacttggaaaggtctttggaaaggaatgtcacacatggagttaaacgcgaccaacatggtggagcctttcacaaagctattgcgatcacggaagcctcgcacattccccgatttcagtgctattgctccaccgatgctcaaaagtgtcattggctacaatgctcttgtcgtcccgttgttatttaatcacttgggcgtcatttctagctgtcgtattcaacatttcaagaaaagcctggcatttgagcatgtagagaattgggttgaaattctagttgctatacacacacgtcttaaagatctgagtttagagtgtgtggctcactgtgaagaacttactgaaaagatcatgcctgaagagtatacttacataccccgttttaggcatggggcttttgaatgtttggcttcactggagttgatcaactacacacttaactcttggatcccttttctggaatgcagtcaactcaaaagacttaaaatgaagagcatatacctagatgatgtgaccctaagtgggattttagaaaactgtgtggtggttgaaaattttagtttgctagagtgcattggtttcgagagagttatcatcatgagatcgacacttaaagttttgcagctccaagccctatgtgtggacgagcttcaaatttcctgtgaaaaccttgatgttatgatgcttgactctataatttgtccaatgcaaagtttgagcatttatgccccatgtctccggacttttcatacttactgcaactcaatgtatggaagaatgctttctgttagaaatggaaattctattgtgaaaacccatgagattcttacacattgttgtgggcttctgaacaatagacaaacctacccagtcatagaaacaacccgcaaaccttgtacatcaaaggacaagcagatgaaagaagtggggtctccaaatgggaatatatttcagaatgtatcaaccttgtgcatagacctggatttgaataacataagagaagctgaggttctttcttatgtcttgaaattatgtccaaacttacaagtgcttgaaattgctttaccggcttttaggcccaaaagccaaattagcaatagctcccaacgttgtgatttatcatatcccataccaatgttttgggagaggcgagaattatgcaactgtatcagtcaaaagctgaagtttgtgtgcattaggggatttagaggtgaagaacaagaagtagaattttccaaatacatgataacaagagccaccatgatgaagaggattaccataatcagtagcaacagtcttagaaacataatgaaagcagctgacaatttgttttcactaccttgggcttccggtaatctctccatgaattttaaagcaagtaatccgacggataaatttgctgaacatcaaaacaagttgctaaaatgcttgtctatggagcttgaggcttgctgcaggaggcatattggtttgtatttggatacattggaatctaaatacgtagttacccatcatatgaacgttttgggtatctttgtcgatcaccaaaggaagaagccatttagggatctttggaaccacaaaatttcctcctccctcaaggtttcttcatatccttcaataacctacacttcctcaacaacaaggggtgtcccaagttacccaattcaagctatgcaatag

SEQ ID NO: 18788 - DNA, 2568 bp, Glycine max
  Peptide Sequence Number=SeqID_135566
atggtaacggtagtgattggcgatcgtctgggtaaaggacagaaagtggcagctggcgtggaaaaagccggcggccgggcagtagtggtgccgggcgtggcggcggatatgaaactgggcgatgtgatgaaggcggaaaacgctgatttcggcatctccttctgcggcagcggcggcgccggggtaaccgccatcgacgaaagcgcctccgtgctcggttttggcttcatggataaagaacagctgggcgacagcaaagcaaaagccttcgccgatgcgctcagcaaggtgcagcagcaggtgctgcgcaccagccagaaaattctgttgcgcattgaaccgctcgatgtgcggcgtggagctggaaattaccgtcagcgtcactgtgatcgacaccgagagcgtgaccttcacagcaattcgttgatcataggtggattagtcggcgtgggcgttggagcgggcgcggcgcgcatgttccacgcgcctgtcacgcaggggatgggtgccttccgtacgctgggcgagctcaactcctgcgagggcgatccggcttcgcacttctcctttggtctcggcttcttctttaacgcctgggcatcctccgttgccgcgggctccttcacgcaggatgtggatcaccgcattctgccgaactggggcgcggccgcactgatggtaaagaaccgcaacgtcgcggaaacgctgcataacccgaaacgcatggcgattgcctgcggcatcatcggcatgatcgtggtggccttcctgaacagtactgcttccgccgtaccgactgcgctgcaggtgaccgcggtaaaagtgctggtgccggcggcgaatctgctggtgaacacggtgatgccggtgatcttctggctggcggcgatagatgccggtaagaaatcgggcttctgggcaaccatttttggtggtctggcgcagttgatcatgggtaacgccgtgccgggtctggtgctgggcattctgatcggtaaaggcgtggaagagagcggctggaacaaagtcaccaaagtgatgatggctgcgattgttctgctgtttgtgctgagcggcttcttccgtggcttcgataacgaaaacaaagggttctggtacgccgactggtctttcccgctgtttgtcggcctgctctcctccggcgtattcgccgggacgcacatgtactacctgtacggcatcggtgcttttaacgaagtggcattcgtttcgatgctgcgctccggcatggaaaccggcgtgtacggcgcggtggcggcgtttggtgccagcttcctgtttgcgcgcatcattgaaggctcgctggtagggattctggatatcggcggcgcgattcagaccggcgtcggcctcggtgtgccagcgctgctgctgggagccggtatcgtgtttccggtggcgaactttgccgcctcgctggcaaccgggctggtgattggcgtggcgattggctacgtgattatcctcgcgcgtaaattcaccatcaaccagagcgattccacctacggcgcggacgtaatgatgggcgccgggaatgcgtccggtcgcttcctgggtccactgattattctgtctgccatggcggcatcaattccgatcggcctcggttcgctggtcggtgcgctgctgttttacctgtggaacaagccgattaccggcggcgcaattctcggtgccatggtgctcggcgctatcttcccgctggtggatatcgcgattcgcgccggcaaaatcgcggcggtcggtaaggtggacggcgcagcgcaacaggagcgcgatctcggcggccgctactacgtcagcgcgggctggattgacagccacgtacactgctatcccaaatcaccgatttaccacgacgaagccgacgcgattggcgtggcgcagggggtcaccaccgtggtggatgcgggaagcaccggtgccgatcacatcgacgacttttatcagctgacgcgcagcgcgaagaccgaagtgcgcgcgctgatcaacatctcgcgcaccggcatcgtcacgcagaacgaactggccgacatggcgcagatcgacggcgaagcggtggtgcaggcggtacagcgtcgcccggactttatcgtcggcctgaaggcacgcatgagcagcagcgtggtcggcgacaacggcattcagccgctggtgcgcgccaaagccattcagcaggcggcgggcaatctgccgctgatggtgcacatcggtaacaacccgccggtgctggaagagatcgccacgctgctcacttccggcgacatcatcactcactgcttcaacggcaagccgaaccgcattctgtcaccgcagggcgagctgaaagcggcggttaagcaggcgatcgcgcgcggcgtgaagctggatatcggccacggcagcgccagcttcagttttgcggtggcgcgcgaggcgattgcccagggcattctgccggacaccatcagctccgatatctattgtcgcaaccgcatcaacggcccggtgcacagcctggcgcacgtgatgtcgaaatttttctccatcggcatgacgctgccgcag

SEQ ID NO: 18789 - DNA, 3257 bp, Glycine max
  Peptide Sequence Number=SeqID_135567
caggacgcctggtccctgttttgctcgcgggcctgattctggccgcctgtagcggccagggaccgcagcaaacctcaagcgtaaacgtgcagggtcctgccacgggccgctctgactattatctgcagcaggtgcagcaaagcagcgatgatagcaagaccgactggcaattacttgccatccgtgccctgctgaaggaaggaaagtatccgcaggcgcaaaatcagctcggtcagctgccacagcagctctctgacgtacaacagcaggaattgctgctgctgcgcgcccagctgcagattgcccagcaggatttcaacggtgctcagcagctgctgggacagataaaagccgctgacctgtcgcaggatcagcaggtgcgctactacgcgctgcagattgccgctgcgcaaaatcgtccgtcgctcgcgctgctgcgcgcctatattgctcaggaaacgctgctgaaaggcgccgatcaccagagcaatattgacgccacctggcaggcgctgacccagcttacccaggatcagctcaacagcgtggtgatcaacgccgacgaaaatacgctgcagggctggcttgacctgctgaatacctggcacgccaacagccaggatgcccagatgctgaaagccgccattagcgactggcagacgcgctatccgcaaaaccctggcgcgaaaaccctgccgacccagctcagccaggtgcagaacttcactaaagcctcgaccagcacaatcgcgctgctgctgccgcttaatggtcaggcgcaggtgttcgccagtgccatccagaaaggctttaacgatgcaaaaaacggtgtgctgactgcgccagcagcccctgccgcaccggccagcagcgatgccagcgcctccacgcaacagcccgccagcacggcaacgccagccaatggcgatgccaacgcggtagtcagtccggcggccgcggccatcacgccgtcagacagcgcacagccgcagcagcccgccgcacagccagccgtcgcgcagcctgccagcagcgcccaggtgaaagtgtatgacaccagcagccagccgattgctcaggtgatgcagcaggcgcagcaggatggtgccaccctggtggttggtccgctgctgaaaaataacgtggaacaggtcgccaacagccagacaccgctgaacgtgctggcgctcaacgagccagagcagatccagaaccatccgaatatttgctattttgcgctttctcctgaagacgaagcgcgcgatgccgcgcaccatatctgggatcagggcaaacgccagccgttgttgctgatgccgcgcagcagctatggcgaccgcgtgggcaaagcgtttgcgcaggagtggcagaagctgggcggcgcaaccgtgctgcagcagcgtttcggcggcgtgggcgagctgaaacagggcatcaacagcggcgccggtattgcactgagcggcacgccgctgacggtacagccggaccagccgcagggcgtggcggtcgccggtctgacgattccggcaccgcagaccagcgctccggcacctgagagcgccagcagcagcggcagcgttgatgcggtttacattattgctacccaggacgaactgcagctgatcaagccgatgattgccatgcgcaccagcagccgcaataacatcgccctatatgccagctcgcgcagcgcgcaggccggtgccggtccggacttccggctggagatggatggcctgcagttcagcgatattccgctgctgtccggtgccaatcctggtctgatgcagcaggcggcgcgcagtttcaacaacgactattcgctggtacgcctctatgcgatgggcattgatgcctggacgctggcgaaccagtttaaccagatgcgtcaggaagttggcatggaaccagtatcgtcagggacaaatcgttccggtgcagtaaaccgccagcgcctcggcgctgagcaggagcagcaggcgcgtcgctaccttgagcgcgccggactgcagtgggaagccagcaatgtgcgctgccgcagcggggaaatcgacctgattatgcgcgacgcggattgctgggtgtttgttgaagtgcgctatcggcgcgatgcacgttttggcggcgcggctgccagcgtgacgcgccagaaacaacaaaagctgctgcgtaccgctgcgctgtggttgctggcacgcggcggcagtttcgatacggtgaattgccgttttgacatcatcgccatcaccgggcgcgaactgacgcaaatcgccgcagccgaagcgctgccagatgcgatttcccgcgccgcgatgacgctggtgcagtcactgctgaacggcaacaaaatcctcagctgcggtaacggcgcctcggcggctaacgcccagcattttgccgccagcatgattaaccgttttgagaccgagcgtcccagcctgccggcgctggcgctgagtgccgacaatgtgatgctgacggcaatcggtaacgaccgtctgcacgacgaaatttatgccaagcaggttcgtgcgcttggacaggccggcgacgttctgctggccatctccacccgtggcaacacccgcgatattgttaaagcggtggaagctgcggttacccgcgatatgactatcgtcgcgctgaccggccatgacggcggaatgactgaaggagctcaaatgaaagcattgaacgctatcgccattctgttaaccgccatgctgctgcagggctgcgtggcggttgtcgccggcggcgctgcggtcgccaccaaaaccgccaccgacccgcgtaccgtgggcacgcaggttgatgacggcacgctggagctgcgcgtcactaacgcgctggcaaaagatgagcagatcaaaaatcaggcgcgcgtggtcgtgaccgcgtatcagggcaaagtactgctgaccggtcaggcaccgtcagccgatctcgccagccgggcgaaacagatcgccatgggcgttgatggcgcgacagaggtgtataacgagattcgcaccgggcagaaagtgagccttggcacgtcttcatcggatacgtggatcaccaccaaaatccgctcgcagctgctgggcagcgatcaggtgaaatcgtccaacgtgaaagtcaccactgagaacggggaagtgttcctgctgggtctggtaacgcaggaagaagcgaaggcagcagcggatatcgccagccgtgtcagcggcgtgaagcacgtcaccaccgcctttaccattctgaaataa

SEQ ID NO: 18790 - DNA, 3231 bp, Glycine max
  Peptide Sequence Number=SeqID_135568
atggtggcgctgggcggcggacgcctgattgaggccggctacagtaatgagtgctcgccagaacagctggcggcggccatcacgccgaccaccgcggcgctgctgtacgtcaagtcgcatcactgtgtgcagaaaagccatctcagcgtcgaacaggcggcggtggtcgcgcgcaaacacggtattccgctgattgtcgatgcggcggccgaagaggatttgcagtgctattaccagatgggggccgacctggtgatctacagcggtgccaaagccatcgaagggccaaccagcggcctggtgattggccgcagccagtacgtcgagtgggtgaaacgccagagcaacggcattggccgcgcgatgaaagtcggcaaagagggcattctcggtctgactcaggcgattgaaaactacctgctgcagagcaaaaccagcggtgctgacatggtggcgaagatgacgccctttatcgataacctcaacacgctgaacggcgtcagcgcgcgcgtggtgtgggatgccgctggtcgtgacatcgcccgcgctgagatcaaatttgatgaagcggtgacgggctggccgaccggcgagctggtgcaggcgctgaaaaacggcgacatcgccatctatttccgcggctataaagccaacgaaggcattatcgaagcggatccgcatccaggcgctgctcagcggaggaaaacgcgcatgaatcttaacgccaatttctatcagggccgtctgtgcctcaacgtgctggccggttcaaagcagaatgcgcaggcgatctggcaggcggcagaagggcatgtgctggtcggcgttttgtcgaaaaactacgcctcgaatgaggccgcgattgccgatatgcgcgagtacgcggcgctgattgataatgcgctgtcggtcgggctgggcgcgggcgacccgaaccagtcggcgatggtcagtgaaatctcggcggaactgcagccgcagcacgttaatcaggtctttaccggcgtggccaccagccgcgcgctgctcggacagtcacacaccatcgtgaacggtctggtttcaccaaccggcacgccgggcaaggtgaaaatctccaccggtccgcgcagttcgcaggcggcggacggtattgtgccgatcgccacggcgattgccatgctgcaggatatgggcggcagttcggtcaagtatttcccgatgggcggcctgaaagcggtggaggagtatcgcgcggtggcggatgcctgtgcgcgccatgatttctggctggagccgaccggcggtatcgatctcaataatttcgaagagatcgtacggattgctctggaggccgggcgtttagctcaactcttcgcggcgctgcaaagcgaaacgctgccacaggatgagctggcgcggcgtttttccgtttcaacgcgcacggtgcgcaccgacatcaccgcgctcaatgcgctgctggaacagcacggcgctcagttcgtgctggcgcgcggcgcgggctatcagctaaaaatcgacgacgcggtgcgcttcggccgcctgcagcaggagagtgcggcaccgctgcgggtaccgcgcacctcgcaggatcgggtgcgctatttgctgagccgctttctcactgccgcgtattcgctcaagctggaagatctgtcggaagagtggttcgtcagccgcgccacgctgcagagcgatatggcggaagtgcgcgagtggctgggccgatatcatctcaacatcgaaaccaagccgcgctacggtatgaaactgtttggtagcgaggcggcgattcgcacctgcctgaccgatctgctgtggcaaatcgaccagcagacgccggacagcccgctgctgacggtcgaggcgctgcacagcggcatgctggcgcagctgcagccgctgctggcgcagtgcttcacgcagcacgccatccggctgagcgatgaaggcgagcgctacctgctgatttactgcgcggtggcggtgcgtcgcatcagcgaaggcttcccgctcagcgatcccggcgcggaggatgtcggcgaggagatacgcgaggcggcgcacgatctggttaatctgatgcgtccgctggtgggtaaaggcatctcgcaggcggaagagaactggctgcgcgttaacattgcggcgcggcagattcaggcgctggcccccagcaccatcaatgcggatgacgcggatgcgctggtggattacctgcttaactacatcaacactcattacaactatcggctgcagcaggatgagcagctgcgcgccgatctgctcacgcacatcaaaaccatgattacccgcgtgcgctatcagatccacattcccaatccgctgctgagtaacatcaagcagcactatccgatggcctacgatgtgacgctggcggccgtcaccagctggggcaaatacacgccgtataccatcagcgaaaacgaaattggctttctggtgctgcacatcggcgtcgggctggagcgacattacgatgtcggctaccagcgacacccgcaggtgttgctggtttgcgacagcggcaactccacgctgcgcatgatcgaggcgctgctgctgcgcaaatacccgcagctggtggtgacggcgcggctgtcgcagcgtgactacgaagtgcgtgcgcacattgatgaagattttgttatttcaaccgcgcggctcagcgagaagaacaagccggtagtgatgatgtcgccgttccctacggagtttcagctggaacagctcggcaagctggtgctggtggaccgcacccggccttacatgctggagaagtacttcgacgcgcagcatttcatggtgctcgaccggccaatgagccagtcggcgctgttccgcctgctgtgcgatcggctcgaggcggagggctatgtcgatgctgatttttatccttcagtcgaagagcgtgaagcgattgtcagtaccatgctgggcgaagggattgcgctgccacactcgctgggattactggctaaaaaaaccgtggtttataccgtgctggcaccgcacggcgtgagctggggcgatgagacggcctcagtgattttcctgctggcgatcagtaagagtgaatatgaggaggcgatggcgatttacgatctgtttgtcaccttcctgcgcgaaagggcggtgacaagattgcgcgactgcgctgatttcgtcagctttaaagcggtggcaatggattgtctgagccggttgtga

SEQ ID NO: 18791 - DNA, 1248 bp, Glycine max
  Peptide Sequence Number=SeqID_135569
atggtaacgatcgcgctcggcggcaaagccggctttcccggttggcccggcgctgccgtctgccgtgatccagttacgccagactgcttctgtgtcatgccagacaccgtcaatcagttgtcccataagccctccataaaaaaaacggggcgaggaaaatccccgcccctgctattcagtatatgtgctgttgcacggcttgtgtgcttagcgtgcggttgctggcataaagcgctgacgaatcaggcggtcaatgctgtaggcgcccggacctaccagacccagcaccaggaaaccaccggcgatggacaggtttttcatgaacatcagctggttaacgccttccgcaaagttgctgtggaacaggaacgcggtcagcagcgtgaagccggcggtgaacagcgcggtgaagcgcgtcaggaaaccgaacagaatcgccaggccgccccccagttccagcagaatcaccagcggcagcaggaagccgggcacgcccatcgcctgcatgtactgtgcggtgcccgcataggcggtgattttgccccagccggcagtaataaacaggatggaattctgaaggaggaaaaccgaaccttttcgatccggtttaaggtgggaaagttagcgtggcggcatcgccgatttgatcatgcgccaggtgctccacaggccgagtccgcgtttggcccagcgcatgatgcggttggggctgcggatcgaccagatggccagcgcgctgctgccaatcgccagatagcggcgcaggctgagaaacgtcagccagccgcgatcgtactgcgcggtgctttccagccagtcgcggcgggcagcgctgagatccagccgctgctgctgtacctgattaagcaattcatgaatgcgtgcttcacgttcacgctgactcatgagcgatgctcctcgagtaaggtgcgatcggtgtccagctctttgcgtgtatggcgcaacagcgtggactgccgggatttacgcaacgtccataaaccaaaaatcagcgccagcgcgaatagcacgccggtggtgatggcaatcgccatcagccggtactgcgcatccaccgcccagataatcagcaccatcaggctcatcaatccgaaggcggtaaacagcatggtcaggcctatcatgatcagcatctggatcagattggccttttcctcttccagctcggcaacggccagccgcacgcgtgtctcgaccatgccaaccagcgttgtcaccacgcgctga

SEQ ID NO: 18792 - DNA, 1011 bp, Glycine max
  Peptide Sequence Number=SeqID_135570
atgccgatagccagcagcgccagcacgccagcgcacagccaggggagtaaacgcctggggaaattacgcaaccctgtcattactgtgacttcccgttctgacccgcctgacaccgatgaccagcagcaccagcggcagcagcatcaggcagaacatcagctcatcttcatagcggcggaaaatgggtgttttccccagcgcaaagccgagcacggtaagaatcagcacccacaggaagccgctcatccagttaaagaactggaagcgggcattgctcaggccagagaggccggcaatggtcggcagcagggtacggacaaaagcgataaagcggccaatcagcagcgcagacaagccgtggcggtggaacagactgtgggcgcgctgatgatactgcgcgggcagatgggagagccatttctgcaccgtcggcgtattgccaagccagcggccctgaatgtaactgacccagcagccgaggctggcaccggtggtcagcaccagcagggtgagcgggaagctcatggtgcctttcgcgatcagcacgccgaccagaatcagcagactatcaccgggcagaaacgcggcgggcagcaggccattttcgagaaacagaatcatgaacaacacgccataaatcgcccacaccagcgtggggtcggagagcatttcgtaatcctgctgccacagggcatgcagcaatgcttgcaaaatatccatcaatcattcctgaacatcattgttaaacgtgcccgtgaggggcttaggcgcaggcgggttaagttatacattttaggtatgccacctgagcaggatttccggatccatccagaattgattgttaaatcagcgactttttatagccctgtcgcaaagggtaagaaaagggcgataactgtaacaaaaatcgcgggattcagacagtgtaaagtcgcggtcgcacaggagttttaccttttgacgcagatggtcaaaaggagctttacacgagctgacactattgcagattaa

SEQ ID NO: 18793 - DNA, 567 bp, Glycine max
  Peptide Sequence Number=SeqID_135571
atgcagcatgaaacggtggtgaagatccgcgtggcacacagcggcaccaatctgccggacggcttttatctctaccagcagctttcggcgcagggcgtgcggattaaaagcattacctcggcaggcgatgcgctgcgggtccgcaggcgtcacagcaggtggtggacgctaatcgccccacctatagctgatccccgccgtcggcgcgagcagacgacaagctgggatgcccctcctgtccggtttgcgacaggtcgtcaacaatggaagcaaaaacagcaggatattcagcgcgaaattgagatggcgaaacagcacgacaaccagcgccgggtcaccggactggaacgcgcgctgactgaagtccgcgctaactgcactgacgagaaactgaaatccgcccacgctgaacgcattgaagcccagcagcataaagtagctgagcgcgagcgcgaactgcagcaggatcgccaggaaggcaaagaccaggagaagatcggtaagcgcgaacggaagctggaagaggcacgccaggagctgaaaaagctgcaggccgagccttattaa

SEQ ID NO: 18794 - DNA, 969 bp, Glycine max
  Peptide Sequence Number=SeqID_135572
atgttgcgactcaaccgccgcgatttccccggcgcacgctatagcgaacgcgtgatccagttcggcgaaggcaactttttacgtgcctttatcgactggcagctcgactggctcaatgaacatcagggcaccgatgccggcgtggtggtggtgcgaccgcgcaaccggatgcagacggagacgctcaatcagcaggatggcctctacaccacgctgctgcgcgggctgaatgacgccggggaaccgctcagcgaaacccggctgatccgcagcctcaatcgtgaaattcagccttatcagcagttcgaagaattcctggctctggcacgcgcgccgcagatgcgttttgtgttctccaacaccaccgaggccggcatcgtgtatgccgaacaggatcggctggaggatcaacctgcgtcgtcgtttcccggcaaactgacgcagctcttgtgggcgcgttatcagcactttgccggtgccgctgataaaggctggctgatcgtgccgtgtgagctgatcgaccataacggcgacacgctgcgcgcgttagtgctgcgttactgccagcagtggcagctgcccgcggcctttgcgcagtgggtgacgcagcactgcgccttttacaacacgctggtggatcgcattgtcagcggctatccgccggatggcgcacagattgcagcgcaactgggctatgacgatcgttatctggtggccggggagcgctattaccagttggtgcttgagggaccggatgcgctgatgcacgagctgcagctgacggcgctggcgccagccgtcaggcgggtagatgacatcacgccgtacaaagcgcagaaggtggcgatcctcaacggggcgcacactgcgctggtaccggtggcgtttcaggccgggctggagagcgtaggtgaggccatgaacgatgcgcagctggccgcttttgtcgacgccctgctgcgcgaagag

SEQ ID NO: 18795 - DNA, 2431 bp, Glycine max
  Peptide Sequence Number=SeqID_135573
tgcaggagagccagccgtgatacgttttgccattgtgggaaccaactggatcacccgccagtttatcgacgccgcgcatgagagcggcaaaatgaaactgagcgccgtctattcacgcagccagcagcaggccgacgcctttgtcgcggattatccctgtccgctgacctttacctcactggaggcgctggcggcaagtgcggaaatcgacgcggtgtatatcgccagccccaatgcgctgcactgtgagcaggcgctgctgttcatgtcgcacggcaaacacgtcatctgcgaaaaaccgctggcctctaacctgcgtgaagctgaggcgatgattggctgtgcgcgtcagcatcaggtggtgctgtttgaggcgttcaaaaccgccagtctgccgacgttcctgcgcctgcaacaggcgctgccgcagctgggcacactgcgcaaagcgctgttcaactactgtcagtactcgtcacgctatcagcgctatctcgacggtgagaacccgaataccttcaacccgcgctggtccaacggttcgatcatggacattggctactactgtctcgccgctgccgttactctgtggggcgcgccgcagcaggcgaaagctgaggcctcgctgctggcaagcggcgtcgatgcgcacggcgtggtagtgctggactacggcgatttcgacgtcacgctgctgcactcgaaagtcagtgattccctgattcccagcgaaatccagggcgaagccggctcgctggtgatagaaaaaatttctgagtgccagcagttgcgcctgattccgcgcggcggcgagagccagaacctgacgcagccacagcacatcaatactatgctgtatgaagcagagaccttcgcccggctggtggaaacgcgccaggtggagcaccctgcgctggaggtttcacgcataaccgcccggttgctgacagagattcgtcgccagaccggcgtggtgtttccggcggatcggaaagaagatacgactatgcactctgtaggcacaccgttactctggggcagcttcgctgtcgtcgtgctcatcatgctggcgatcgatctcttcttacagggacgacgcggcgcacaaaccatgtcattcaaacaggctgccgtctggtcgctggtatggatctccgtttctctgctgtttgccgccgcgttctggtggtatctcgacggcagcgccgggcgcgaagtggcaaccgcgcaaaccctggctttcctgacgggttacgtactggaaaaagcgctggcggtcgataacgtcttcgtctggctgatgctgttcagctacttcgccattccgtctaatcttcagcgccgtgtgctgatttacggcgtgctgggcgcgattgtgctgcgtaccatcatgatctttgccggcagctggctggtcacacagttcagctggatcctctacatcttcggcgctttcctgctgtttaccggcatcaaaatggccttcgctaaagagggcgatgacgctgccgtcggcgataagccggtggtgcgctggctgcgtaagcatctgcgcatgaccgatgaactgcacggcgaaaagttcttcacccgcaaaaacggcgtgctgtttgccacaccgctgctgctggtgctgattatggtggagctgagcgatgtaattttcgctgtcgacagtattccggctatttttgccgtcactaccgacccgttcatcgtgctgacctctaacctgttcgccatccttggcctgcgcgctatgtacttcctgctggccaacgtggcagagcgcttctcgatgctgaagtacggtctggcgatcgtgctggtgtttatcggtatcaagatgctgatcgtcgagttctaccacattccggtggcgatctcgctgacggtggtcggcgtgattctcggcggggcgctaatcgcccctgctttgtttcgccagtgccaaccttcgcgtttcatatctctgtcacacttcccgtcatcagcagatcaaaaaaccgatctggcgcgcaccggcagaattatctcttttctcgtcagctcttttccttatactccgccgggcaaaccgaagcctggtaaaacaaatcatgatcggcctgattgccggcgtggcgctggcgtggctttcacgcgatgccgcgctggccgtgggcctgctggccgtggcaccgctgctggtactggtgctggtgatctcctcgattgccaaccatcagcaggggcaaaaaaccaatattcgcccgatcattatgctgtacctgctcagtaccttcttcgcggcggtggtcgcggtgattttcagccatctgttcccgcagacgctgtcgatggacgtcggcgcgaccgaaattaccccgccgtccggcatcaccgaagtgctgcacggcctgctgatgagcatggtcgccaatccgattga

SEQ ID NO: 18796 - DNA, 1215 bp, Glycine max
  Peptide Sequence Number=SeqID_135574
atggagagtccggcgattgtcaaaatggtgctgagcgccggcgttaagggctttattggaaaaagccacaatatgcaggagatcgtccaggcgattcgccaggtggcgcaggggcggctattcctgtcgcaggaagtggcgtacgaggtggaaaacctctacgtgatgaatgaagacgccatcaacgaaaacctcgatctctccagcaaaggcaatatgtacgagaaggtcaaaaccctcagtccgcgcgaagtagaagtggtgcgctgttttctggatggacttagtgtgtcgcaaattgccgtgaagtttaaacgcagccgcaaaactgtgagcggacaaaagcaggatggccgccgtctgcttttccgcctctctgcatcacgttcccgcactgaaggggctacaatgaacattgaaacgcaatcctgcgtcattaccggcaaaaaacaggtcagcgtcgcacagcagcaggtgcagtgggacggcaccggcacgctggtgcgcatcacgcgcggcggcatctgcgggtccgatctgcactactatcaggaaggtaaagtcggcagctttgaagtgaagatgccgatgatcctcggccatgaagtgatcggctacgtggtggagagcgacgatccgcagctccagcccaatcaaaaagtggcggtcaatccctcaaagccgtgcggcagctgtaaatactgcctgcgcgagcagcaaaatcagtgcacctctatgcgctttttcggcagcgccatgtatctgccgcacgtggatggcggcttcacgcaatacaaagtggtcgatagcgcgcagtgcgtgccgtttccgcaggaggccgatgacagcgtaatggtgtttgctgaaccgctggccgtgtgcatccacgccacgcagcaggcgggcgatctgagcggcaaaaccgtgttcatttccggcgtcggaccgattggctgtctgattgccgccgcagccaaagcccgcggagccgccgagattatttgcagcgatatcagcgaacgctcgctcagcctggcgcagcagatgggcgcgaccggcgtgatccacgcggctgacggtgatttcacgccttaccttgcagataaaggctttttcgatgtcgctttcgaggcttccggccatccgtcttcgctgcagcgctgtctcgacgtggtgtgcgccaaaggcacgctggtacagggtgggatcctctag

SEQ ID NO: 18797 - DNA, 1200 bp, Glycine max
  Peptide Sequence Number=SeqID_135575
atgagatcaatatcttttgctgcggatagtgatttcgcagctgtttcaccagggccaggccatccagttcccgctcgcccagcaaaaaatccagcaccagcacatccaccgtggcataactcgaaaacggcgcaggtcaaacctttgcagcttttagcgcgttacgataccgcacagcccgctctgcagctggctgagcccatctcttctgcctttcgaaataaagtgattaaagtcgcagtggccggtaaatcacagccaccgatatatatggataccgatacgcgccgcttcgaaggcctgagcgccgactacctgtcgctgattcaaagcatgctggagaccagcattgagctttatcacttccccagtcatagcgccgcgcagcaggcggtgctgaaaggcgaaatgcatatgctggcgatttacgtcgcccagccgtcgtcaccgtcgcagccgctgctggccagcgccccgtggatgctggattacagcgtgatggggctgaagaccgacagcgacctttttctcaataacggcatgcccgagcaaattgcctggtcaggcacgccgctgcagcgccagtatctggaagagacgtacgaaaacgcgcagctggtgcgtttcccgggctactatgatgccgtcgccgccaccgtttatggtcagacggcgcgcgtctggggaaatgcggcgacgctgacgcacctcaatcgctatctgtttgccaacgcgctcactattctggccgacgagcatacaattccgcttaacgtcggtttcggcatcagtccgctatatcctgcgctggccgacgccatcaaccaggcgctgccgcagattccgctgtctatccgcatgcagattgccaaacgctggcagctcgatccccatcatgtactgcaacgcaatccgctggcgctcaccgccgacgaagagcagtggctgcaaaacaacattcacatcgagaccaccttgccgctggcgcaggcaccgctcagtagccggacgccggcagagcagtttcgcggcatggcgccggacgtgctggagctgatcaccagccagaccggcctgaattttgtagcgcacgccagtcatgaacaccccggcggacgtcctttgccaaagctgtttccgctggaaattctggagccacagttcgaagcacaaccggctctgattacgcgtccgtggctg

SEQ ID NO: 18798 - DNA, 1016 bp, Glycine max
  Peptide Sequence Number=SeqID_135576
tcgcgtaccggcagaagtgctgaccggctcgcatccgggcgagctattcgtgcaccgcaatatcgccaatatggtactacccgatgatgacaactttatcagcgtgctgcagtacgcgattttttatctcggcgtcgagcgcattgtgctgtgcggtcactacggctgcggcggcgtgcaggcggcgctgggtctgcctgccagcccgttagcgcaggaggattcggcgcttgccaggcgcattgccgcgctgcgccgcgcgttgcagcagggattagtggcgtatcacgccagtcccgcgcaggaagaggagagcagcaagcttaaccggctggttgaagccaatgttatcgcccagtttagccagctggtgcgctgcgagccggtgcaacaggcgtggcaggccggacagcaactggatgtatttggctgcgtcaatcgtcagaggaatcctcatcatgaatctgcaaacgcttcgtcaggatattcctgctggtctggtggtgtttctggtggcgctgccactgtgtctgggcatcgcgcaggccagcggtctgccgccctttgccggtctgctcaccggggtgatcggcggtctgctggttaccgcgctcagtccctcgcgctttgccgtgagcggcccggcggcggggctggtgaccattgttgtggcctcaatccagacgctcggcagcttttccgcgtttctcaccgcgctgattctggctggcgtgctgcagtgcatgctcggcctgctgcgcgccggtcgttttatctcgctggtgccagcgatgccggtctgcagtcgctggtcagcggggagttttcgttttcgctcagcgcaatgctggtggccggtagcgggctgctgattctgtggctgtggaccacgcccgcgatcaaagcggttaaagcgctgagctggatccccggcccgctggtggcggtgctgtttggctgcctcgccacggtgttgggcgatcgcctgtttcccagcctcggcgaaggcctgccgc

SEQ ID NO: 18799 - DNA, 225 bp, Glycine max
  Peptide Sequence Number=SeqID_135577
atgtttttttggagctgggttgcttccctgggtgagctgggcggcaacctcctccccctttttcttataaataggctgaagggggctgttctaaggatcccggatgcccctgaaaatccaagccgaggttcttccgtaacgcttccgagaggtttccgtaagcaaatccgtgaaggttttcctccgttattcaccgttcttcatccgttcttcgttcttcaacgg

SEQ ID NO: 18800 - DNA, 552 bp, Glycine max
  Peptide Sequence Number=SeqID_135578
gatatgcgcaagaaggcacaagccaaccagaaacataacattgcccctcacgtgttgtctcgtgagggttatgaatattcagaaaacaagttgatggatgagaagagaaagaaaaaactagaggaagctgctcaatccggaagcactgacaccgtgattgatcctctatctcccatcagacaacacatgaaatggaagatggcccgcacaaagaaaactgggcaaatgacgtctgaggcagcaaaggaaattgctgagaagattgaatcgttggaggagcaggcgtcatacggtttcttcgttgccattgggcgaccagaacaccgtagtcgtgtaggtgttgttggagttggtgtcacgatcaagaaatactttggactggctccaaggacctcccgtatgtcttcctccatggctcccgaagacctggagcagctgatgcaacaaattagggaccagttggaggagtcgatcactgaaaaagtgactcaacggctaatgttatcctttcaagccacagtccatccagagatccgagcaattgaaatttga

SEQ ID NO: 18801 - DNA, 333 bp, Glycine max
  Peptide Sequence Number=SeqID_135579
atgtataatagtataataacctatattggtctccactgcagtgcacattggcaaatggtcgtcattttgcctaaggaaaatgttgtcatctggttttgttcattgcatactaggccagacaactacctcaaaggaataattaacagcatccatgtttgtattcaacagtgctttgaaggacttgacgatactccacaaagtaaatccaaggctggtgctaggttgattgttgttaaatatttcaatgatgtcagaccattggaacctgagagattgaaggcgcttcgcatccagtgggcaaagtattatttgaaagttagaaatgaaacttag

SEQ ID NO: 18802 - DNA, 375 bp, Glycine max
  Peptide Sequence Number=SeqID_135580
atgaattcatgtcgtggagggtttggagggccatgtccacgcgctggaaggagtgcgcgtaggctttggttaaggtgtggaagaagtcatccgagaaacggcgtcgttatattagggtttggtggagggtgggatagggttgagaggggtggaagtctttgcgggagggtggaggaagggtgtgtgacggaggttaagagagaaatggcttctttcggagtcagccagtatttgtgtttcagacgcaccagagttgcggtgtcggtgttttgggtggtggaaaattgggacagggagaacaacaacaagaacctcgtcggggtggtggttttcagaggaaccacgacacgagcaaggttttcaactcacatgtaa

SEQ ID NO: 18803 - DNA, 1674 bp, Glycine max
  Peptide Sequence Number=SeqID_135581
atgtcatatcaagagaccagctttgtaactattggtcaaagggttctggctaatcctctcagggtgcggttccactatggccatccagatgtatttgatagggtttttcatatcacgagaggaggaataagcaaagcatctaaaacaattaacttgagtgaggatgtttttgctggatttaattcaactttaagacggggatgtatttcctaccatgaatacttgcaaattggcaaaggtcgtgatgtagctctaaaccagatctcaaaatttgaagccaaggtagcaaatggaaactgtgagcaaactataagccgtgacatgtttcgccttgggcggcaatttgattttttccggatgctatcatgctatttcactacagttggattttacttcagcagcttgatttcagtgataggaatctatgtatttctctacgggcagttatacctggttcttagtggattggaaagagcacttatcattgaggctcgaatcaagaatgtacagtccttagaaacggctcttgcctcccagtcattcatacaacttggacttctgacaggcttacccatggtgatggaaataggacttgaaagaggtttcctcacagccctaaaggactttgtccttatgcaattgcaattggctgctgttttcttcactttcgccctaggaacgaaaacacattactatggccgaacgcttttgcacgggggtgcaaagtacagaccgacagggcgcaaagttgtattccatgctagcttcactgagaattacagattgtattcaagaagccactttgttaaggcatttgagctattgctgctgttgattgtttataacatgttcaggaggtcctatcaaagtagcatggcatacgtgttgataacatatgccatttggttcatgtcattgacttggttgtgtgcaccttttctttttaaccctgctgggttcagttggaccaagacagtagatgattggaaagagtggaataaatggatcagacaacagggtggtataggaattcaacaagatagaagttggcattcttggtggcacgatgagcaagctcatcttcgctggtcaggttttggctctaggttgactgaagtattgctttctcttcgttttttcatctatcagtatggtttggtctatcacctagacatctctcagcatagcaaaaattttcttgtttatgtcctttcttggattgtgattgttgcaattttcctcttggtgaaggctgttaacatgggaaggcaactactcagtgctaattatcagcttggattcagacttttcaaagcattcttgttcctggctgttcttgccatcatctttactctttctgttatatgcgagttgtcgttgacggacattttcgtttgctgtctagcattcatgccaaccgcgtggggattgataatgattgcacaagctgcaaggccaaaaatagagcacacagggttgtgggacttcacacgtgcacttgctagagaatttgattatggaatggggatagttctttttggacctattgctattttggcgtggttgccaatcattaaagccttccatgctcgttttcttttcaatgaggcattcaaaaggcacttgcaaatccaaccaattctatcaggaaaaaagaagaagcacagaacttga

SEQ ID NO: 18804 - DNA, 405 bp, Glycine max
  Peptide Sequence Number=SeqID_135582
atggaggttggaggggtggaagccgatgtggcggtgtacaatgtgttgattggggggttgaggaaagtggggagggtgttggaggggatggtgaggagaggggtgtgtcccaatgaggtgttgtgtgggttggtggagaaggggagggttgaggaggggaaaggggttgtggagaggatggggaaggaggggtttgtgcctagctttggggcttataagggtttggttaaggggttttgtgagaagggaaggattggggaggtggagtgggttgttagggatatggtatggaaggggtttgtgcccaagatggggatgcggaggaggattgtgaaatgtgttgttgaaagggaaaggagtgatgagtgggtggctggtgccattgatggagtttttgaggattaa

SEQ ID NO: 18805 - DNA, 1035 bp, Glycine max
  Peptide Sequence Number=SeqID_135583
atggagggagataaagaccatcagcacaaagttgtgaaggccttgctagatgtgtgcccccccctaacaaatgagatgatgtttgattccagaatattggatatgttccactttcccgaacaaaatgagtgtggctttgtctattttagaaatgatgatcaactatttgacagtgtggaaatgaatagagatttctatccatttgccaaagagaattccatccattttccattgccagaaagtggtcctctgatggaaaagatcaagcgtttccatttgttgcttacagtaaaagatacagcgatggatgtgccttcaaacttagatgcccgtaggcgcatatcattctttgctacttctctgtttacagatatgcctgatgctccaaaagtgcacaatatgatgccattctgttcaatcacagaactctgtctgatatatgacatgattggtagtgttataactccacattacatcgaggacattaatttttcgcttaaggagcttggttcagataaagaggaggactccatcatcttctacatgcaaaagatatatccagatgaatggacaaattttttggaacgtatgggttgtgataaccgtaagagtttagaagatgaacacaaaacagaagatcttagactgtgggcttcatttcggggtcagacactaagcagaacagttagagggatgatgtactacagagaagccttaaaattacaagcattccttgacatggctgaagaagaagatattcttgagggctatgagactgctgaaagaggtaaccgggcattgtttgctcgtctagaagcactagcagacatgaaatacacctatgtcatttcctgtcaatcatttgcatcacaaaaggcttcaaatgatcctcgttatcaagatatgatcgacttgatgataaggtatccatctcttcgtgttgcttatgttgaggaaaaagaggagatagtgcagggtaaacctcacaaagtatattcatctaaactggttaaagttgtcaatggttatgaacag

SEQ ID NO: 18806 - DNA, 1095 bp, Glycine max
  Peptide Sequence Number=SeqID_135584
atgataagaaaggttcccatgttttttgtcccagcaattttagacgttgcttttatgtggaaagcaagatataccatggaatcttctcaaaaggtgaaacttgtggtgaagctggtcttagctactatatggactattgttcttcctgtatgctatgctaattcaagaagaaaatatacttgctattccacaaagtatggaagcttggttgaggaatggtgctttacttcctatatggttgcagcagcaatatatctgacaactaatgcagttgaagttttgttattttttgtccctgctgttgctaagtatattgaggtctctaattacaagatatgcaaagttttgtcttggtggactcagcctagaatctatgttggtcgggggatgcaagaagaccagataaaaccactcatagcacctaccagacagattatgaaaattggtgtaaagaagtatgaatggcatgagctttttccaaaagtcaaaagtaatgcaggtgcaattgtggctgtatggagccctgtagtaattgtatattttatggacacacaaatttggtattctgttttctgtacaataattggtggactttatggtgttttgcatcaccttggtgagataaggacacttggaatgctgagaagtaaatttgattccttaccttcagcatttaatgtctgtcttatcccaccatcttccaaacgtggtaaaaagaaaagaaaaggtctcctcagcaatatatttcaaaagttgccggatgaaaaaaatgccactgccaaatttgttgtggtatggaatcaaattgtaaatcatcttcgtcttgaagacttaattagtaacagagagatggatttgatgatgatgcctgtgtcttcagaattgttttctgctaaggttcgttggcctgttttcctattagcaaataagttttctacagctttgaccattgctaaagattttgagggaaaggaagagattcttgtcaagaaaattacaaaagacaaatacatgttttatgccgtaagagagtgttaccagtcactgaaatacgtgcttgaaattcttgttgtgggtagcattgagaaaaggtaa

SEQ ID NO: 18807 - DNA, 384 bp, Glycine max
  Peptide Sequence Number=SeqID_135585
atggcatatgaattgcatggaattttaagtggtgctatcagcttaacaacatgggaaaaggtcatgccggcatatggaggagaaacagagtctttccttaacaatgttgtcaccccaatatacaccgttataagacaggaagttgccaatagcaaaggaggggcggctgattattctgtatggagaaactatgatgatcttaatgagtatttctggtcccctgattgtttcaaaattggttggcccatgcgtctggaccatgactttttctttgtaaagcctagaaataaaccagaaccagatgtcaagaatgctcttgttgtgtcacctggtaaaacaaaagagaagaaaaagagagaaaagagggatgaagaagaaccagag

SEQ ID NO: 18808 - DNA, 279 bp, Glycine max
  Peptide Sequence Number=SeqID_135586
atgaaaatccctttttattttcccatcctcgtgcttgttgtcttcattgcttctggaaaacaagtgcaaatgacagtggtaccaaattgtgtggtagaaagcttgtcagttcattgtgaaatattcaagaatccttgcgaacttctttgccaacaacattttggatcacccgcagcacatggagcttgtggcattaagttccatcgttcaatgttggcttattgtgacaaattgagcaatccttgcgactttcgttgcaataaaatttacgcaccataa

SEQ ID NO: 18809 - DNA, 537 bp, Glycine max
  Peptide Sequence Number=SeqID_135587
atgacaaccttggactttaataacttgcagtctttcaaaggaatgagttggaagtgtactgtagcttatgtcttccttattttccagattgctaagaatcagtgtctccaaattgtggaatgcatcggtactttggatatcttcgtagctttccaaaaacaaacatatcttcttgtaaaactgaaatatcctggattgataagtccaaagttgttagctgattcaaattccttagcccacctagacttgcattgttggtttcaccttttccttcttcaacctcccattggatattacaattacccatatgatagggaagcagcagaccacagagcaaaggtgcaaacagaacaatcagcagaggtgcaagcaggacatacaagggtgcagatcaaggaaaagcccaaaaggagagtcacaagactaaattaccttcgaagactatgcttgagggcaggaagggaattgagtagcaatccttatcgtgtgatgctgttgctagagcaggagacaagcttaacggatttgattctgtaa

SEQ ID NO: 18810 - DNA, 2754 bp, Glycine max
  Peptide Sequence Number=SeqID_135588
atggattctaaaactgttgaatccaaagttgaacctgtttcaagtcaatttggtcttggttacataacttcctataaaagcaaccttgaaagcctcaaaaccgaggtccaaaagctggaggctaccaaaaatagtgtgcgagactctgttgatgaagctacaaaaaatggagaagtgattgtgaatgttgtggagatctggctgaagaaagtggatgccactgttgctgaggcaaataaacttataattgagagtgatgcaccagcacagcaagaaatcccagaagatgacacaaagatttatcaagtcctagaagaaggaaatttcgatagaatttcttactctaaaccatcaacactgaaagagattcaacaagcattgaaggatcctaacatcttcaggattgggttgtatgggactgatgttatggccgaggtatacaattctctagatgttgaaaacattcaaggccaaattgctaatgccttgggtctgaaattggatgaagagacaaaagaaaggagagtgcaacaattgcgtcaaaggataagaaaggagaagaatattcttgttattctggatgatatttgtgggaaacttgatttggcagaagtggggattccttttggtgatgaccacaaaggatgcaagttagtgttgacatctgaatatctaaatgtgcttaaatgtcagatgggtactcaaaaagattttaaacttgaggtattatctgacaatgatagttggaagttgtttgagaagattgcagttattgtagcaaaggctttgcggaaaaagcatgtgaaattgagtatattagaatgcatgttgctgtttgacatggctaaagcaatggcctctagaactcacctgaataatgaagaacagaaattcacacaaatggagcaatgggacatagatcagcttcaaaaatgccattatattaatttgccttcatataatatcgatgagcttcctaagaagttggattgcccagagttgaagctaatatcactaagaagaaatcatggctacttaacaatccccgataactttttctctgggacgagagaagtaaaggttaataatttacatggaatgaggtttgccccttccccactaccttctcttcgtctcttgacaaaccttatatcattgaatctgtatggatgtgtattggaagatatagcaatagttgcagaactcagaaggaatattacagaatcaaatccgttaagcttgtctcctgctctagcaacagcatcacacgataaggattgctactcaattcccttcctgccctcaagcatagtcttcgaagctagagcactcgtcaaactgcaacatcttgagattaaagggtgctttatattggtggagatatttgtccgacaagaagaggttgcattccccaacttggagacactgcttatcagtcgcatgattaatcaacaagttccgaattctctttgcaagctgaataaaataaaaattacttcaagtctaggcctgcatcatgtttttccagttgttgtggctaaggagcttcgacagctccaagtgcttgaaatatggaggtctagtaaaaaagagaccattgttgaaaagagtgatagtggtgatgcacaagatgagattgcttcaacgaaattggaggaacagaaagttgaaagtgagaagaagggcgatgcattaggtgagtttgcttctacgaactcggaggaattaatacccggaagtgggaataaaggtgatgctccacaggaattgaaactgtacggcttaccaaggcttaattacaagcttatgcaagtcactccaagcctctcgaaagtgcgttatggatatgaccatcgagaactagactgggttgatattaatgctctaattttgatgggtattcagactagcaaaaggaatttgagtttgtcatcaaaatctgaagaaaagaagctattatttgctcacttgagatatctagcaatgtcagagattgtgcctgcagaacccattggtggcatctatttcgagcgaggagagacatcaacagcatcagcatcagcatcagagacaccccatgtcacgttggccattaccaatggaagcaacaacgttgaatatgttccagaaccgtttgacagtgaaaggttgccaacagtttttgcttctgaaatccaaaggttccttcgagtggccaacttgcttggaaaggaagagcctcgtgttgcttatctttgccgtgttcatgcctttgtgattgcacacaacttggacaaaaattctagtggaaggggtgttagacaattcaaaacttcactacttcatcgacttgaacaggatgagcatgttacgaaaaagaagggaacaagtgacattcgtgaacttaaaaatgtttaccgtgcttacagggactattatatcagacatgagaaagcatttgatctagaacaaagggagagattgataaatgcccgagatattgctactgttatgtttgaggtgctaaagacagttacagatccagctagttcccaggcgcttatccaaggaaatgcaatccataaaaaaactgaatttagcatccttccacttgagcaaggatgcattcagcatgcgattatgcagaagtctgagattaaggctgccattgcagttattcgcaatgttcgtggtttacccccagtgcaagatttcaagaaggacggagcctttgtggatctatttgattttcttcagcattgttttggattccag

SEQ ID NO: 18811 - DNA, 183 bp, Glycine max
  Peptide Sequence Number=SeqID_135589
atgaaagacttgacaattatcatgatgtttggtcctcgggagttgctaggtgcacccggcattattgttggtgcacctagtaccctacgtgcaaagataaaaatacccccaagtatatttaaattgatccgcaagtttgttaaggatcaagttgatctgcaagttactcacagatcaacttga

SEQ ID NO: 18812 - DNA, 984 bp, Glycine max
  Peptide Sequence Number=SeqID_135590
atgtcgactccctattctgcatttcctaatttggagactctggttcttttcaatctatctaatatgaaagaaatatgctatggtccagttccagcacattcttttgaaaaacttcaagttattacggttgtagattgtgatgagatgaagaatctacttttgtattctctcttaaagaacctttctcaacttcgtgagatgcaaattactcgatgcaaaaatatgaaagagatcatagcagtggaaaatcaagaggatgagaaagaagtttccgagattgttttctgtgaattgcattctgtcaaattaagacaattacctatgctcctgagtttctgtttgccattaacagtcgagaaagacaatcaacccattcctctgcaggcactgtttaataaaaaggttgtgatgcctaaacttgaaacattagagttgcgctacatcaatacatgtaaaatatgggatgatatacttccagtcgattcctgcattcaaaacttgaccagcttgtcagtttacagctgtcatagattaacaagtttgttctcatcctctgtgactagagcactggtcagactagaaagactagtgattgttaattgctctatgctgaaggacatatttgtccaagaagaagaagaggttggacttccaaacttggaggagttggttatcaagagtatgtgtgatttgaagtcaatatggcctaatcaactggctccaaattccttttccaagctgaaaagaattatctttgaggactgtgaaggctttgattatgtctttccaatctctgtggctaagaagcttcggcagctccaatctcttgatatgaagcgctgtgtcataaagaatattgttgaagaaagtgatagttctgatatgacgaatatttaccttgcacagttatcagtagatagctgtgataatatgaataccatagtccagccctccgtgctatttcagaatttagatgaattggtg

SEQ ID NO: 18813 - DNA, 240 bp, Glycine max
  Peptide Sequence Number=SeqID_135591
atgggaagcagctatgggaggtggagttggcataatgagaggtgggaagcagccatgggaagcggagtcgatatgggtgctggagtgagggtagcaaggcgatccaagatggcgttaagcttgttgttcaaagcgcattgggtgaggcagttcaccgcttcctctaggcattcaatggtgctcagacacatattaagcttcgacatgttgactgtgcccaggtcaggtcggaccaattga

SEQ ID NO: 18814 - DNA, 1651 bp, Glycine max
  Peptide Sequence Number=SeqID_135592
atgacacaaaagatttcagaagtcataggaaatggaaaatttgatagaatttcttaccgtgttcctgctgaagtcacgcgtacgccatctgatagaggttacgaagcactggactccagaacatcagtgctgaatgagattaaggaagcattgaaggatcctaaaatgtacatgattggggtgcatgggatgggtggcgtgggtaaaactacacttgtgaatgagttagagtggcaagtaaagaaagatggctcatttggtgctgtggttattgccactataacctcttctccaaatgtgaaagaaattcaaaacaaaattgctgatgcgttgaataaaaaattgaaaaaagagaccgagaaagaaagagcaggagaattgtgccaaagaataagagagaagaaaaatgttctaattattctagatgacatttggagtgaacttgatttgacagaagtgggaattccttttggtgatgaacacagtggctacaaattagtgatgacttctagagatcttaatgtgctgataaagatgggaactcaaatagaatttgatctcagagctttacaggaggaggatagttggaatttgttccagaaaatggcaggtgatgttgtcaaagaaatcaatataaaaccaattgcagaaaatgtggccaaatgttgtgctggtttaccccttttgatagttactgtgcctaagggtttgagaaaaaaggatgccactgcttggaaggatgccctaattcaactagagagttttgatcataaagagttgcaaaataaagtccatcctagtctggagttgagttataattttttagagaacgaggaactgaagtcactattcttattcattggttcatttggcataaatgagatcgacacagaagagttgttttcatattgttgggggttgggcttttacggtcacctgcgcacattgacaaaggcaagaaacaggtattacaagttaataaatgaccttagggcctcttcattgttgcttgaagaccctgaatgcattcgaatgcatgatgttgtgtgtgacgtggctaaatcaattgcatctaggtttcttccgacttatgtggttccaaggtacagaataataaaagattggcccaaggtagatcaacttcaaaagtgtcactatattatcattccttggtcttatatttatgaacttcccgagaagttggagtgtccagagttgaagctacttgtacttgaaaatagacatggtaaattgaaagtccctgacaactttttctatgggataagagaagtgaggactttgagtttatatggaatgtcattcaaccctttcctacctcctctctatcacttgataaaccttcgcacattgaatctttgtggatgtgaattaggagacataaggatggttgcaaaactcacaaatttagaaattctccagttgggaagttctagtattgaagagctccctaaagaaataggacatctaactcatctccggttgctaaatttagcaacatgctctaaactaagagtcattcctgcaaatcttatatcaagtttgacgtgcttagaagaattgtacatggggagttgccctatcgaatgggaggttgaaggaagaaaaagtgaaagcaacaatgcaagtttag

SEQ ID NO: 18815 - DNA, 234 bp, Glycine max
  Peptide Sequence Number=SeqID_135593
atgggaacgtgctttagtaaagagacaaaacttccaactgatcagagcaacatatgttttttggatgaaaaacaatgtgtctaccggggaaggagaggcaaggtttatggtaagttgggattttggctcaaggtttgtagaacggctggacatggtatatgtcagggtttggccagcggttcggggataaagggaatgtcccacgttatttccatgatacatatgcaacaatga

SEQ ID NO: 18816 - DNA, 243 bp, Glycine max
  Peptide Sequence Number=SeqID_135594
atgacaagaccattgcatttgcctgagagccaaagggacatagggttgaaaggcttaaatggacaacttgaattttataatgtggatgagcttgaaactatggccatggccgagcattttatggcgaccagtgttgaatgggatcctaccggaaggccaccgtcaccactgagtcctgagaaagaggaggagatgagtaagaacttgaagaagtatagcaagaagtatgaggcagaggactaa

SEQ ID NO: 18817 - DNA, 450 bp, Glycine max
  Peptide Sequence Number=SeqID_135595
atgttggtggcaactctgctcgttttctccctgggagatgaacgctttggcttatctatttggccttcaccgtcccgtcgtggggtaaaacgcaacaagctcaacttgttgacgtggcaaatctttggctctaacaacacaaaaagtcaaagcctctccaacatgcaaaaatcttcattcagatttatgtctagaagctcatccaaagctatctacactgatacatcttatgatgatgagtctgatgacgatagctcagacgaagatgatcagttagcctttatctcaaggaagataaggaacatgtggaagaaaaggagtggattagacaggaaaagatccaagaaaccatatagagaaagaaaggacaaggatataagttccatcatatgttataagtgtaagaaaccaggatacttcaagttagaatgtccataccttggtaagtga

SEQ ID NO: 18818 - DNA, 465 bp, Glycine max
  Peptide Sequence Number=SeqID_135596
atgggccattttgcccttaaattaaaatttaaaaaaagcgcagctccctcctcccccacctttttggcttctttcttttcttcttctgctccttcttcttccccgcgccttcctactgccatttctgaccaaccgtcgttgctgcgtttttgccatcgagaagacgttgtcggaaaaaatggggaaaaagcggacttggaatgtttggttcgtccagaagaaccttctttcggaaactttccggaagaaccacttcttccgagagttccggaagaagttgttccagaagtttctccggaagaaggttcttccagaaactttctggaagaaattgtcccggaaactttccggaagaaggttcttatggatgaccatttggttcttctgaaagaaccttccggaacaacttcttctggaagtttctctagaagaagtggtttttccggaagtaggaattttttttaa

SEQ ID NO: 18819 - DNA, 211 bp, Glycine max
  Peptide Sequence Number=SeqID_135597
gagcagtcgcgctaagcggaccctgtgggctcagtgcacatccaccgctaagcgcaacttcagtgtgcttagcgtgacaagggaatctggaagagcacaaggatcaaggtcgcgcactaagcgtgagatcagcttgccaagcgagatgtttgtctcttgccaggctcagcgcacaactggcgccaagtccaaatccacttactctcgctaa

SEQ ID NO: 18820 - DNA, 336 bp, Glycine max
  Peptide Sequence Number=SeqID_135598
atgtcatattgtctcgctaagcgcgactgtgcactaagcgagcaatacgaattgtgcttaaaagtaactgctagttgtcgcaacctacccttcggcgggagggcgacgcgagggctcgcgggtgcgtcttccaagaaaggaaaatgtgcagagtcgccaccaacgtttattcgaggaaaatgtcggaaaacccggaaaggggaaaagagggaggtggttgccgcccagcttgcccaggcaagctgggttgcttccaccagaaggcactgccttctgttggaacaccctgaaggcccaagtgggcctggttgctatttgcacacccctttttactaa

SEQ ID NO: 18821 - DNA, 735 bp, Glycine max
  Peptide Sequence Number=SeqID_135599
atggttgatgcatctactggtaaaacagaaccaacactggacacaagttcaaacgatgaggattcccagcctaataaaaccgtaaactctgatggtgaagagctaatcttcgaatctagagaagatttaattaaagggcacaatcaactactttttacctctcctcacgtctctaaatcttataagagcataaggatcacaagaaaggttcatcaagctcatttagttgactttgtcttggaaaccacctcacctggtggtgtacaagacacctctatttgtgaggaggtcaaggcattactgaacgaaaaggtatccaatggacaaaagattcttcttaaagattttcaagacttggaagaaagggtgaaatccttaaccacaactcttgacgattcaaaagaagagcgcaaggaactacctcctaagattgaaaaactctataaagagatagacaccttcagagataacctaggcaaatttatttgtggtcatgaagcccttaaaaaaattattaaggtgcaaagaaaccccaaagacaaatctagccttggtttcaaaggcaaaaaggttatgcatgctgaagaagtcaatgttttctatttttatggaaaagtgggtcatgaggctcataagtgcaaggacctctctgaagagggcaacccatcaaagggtttgtccagtgcttatcagcacacacaagctaacaagaaaaaaggacccaaaaagatttag

SEQ ID NO: 18822 - DNA, 348 bp, Glycine max
  Peptide Sequence Number=SeqID_135600
atggataagagcttgaaagaggagaagatgagggtagggagaaggagagaagaagcacgaaatttccgagaggagaagatgagtcaaacacaagctcaccctacccttcaccgcctcattctccggctttggcgatcccatcccctggctcattgccctcactttcttcttcaccaaggggaggcacttcttgcgctagcaattccctcggtgtcgatgagggtggggggaattttcctgccactggtgaaggcactatgcatggtgtgtgggagcaacaccagtgacgggatggagcacaagttggggaatgtccatggcaagcttgcggaggtcatgacagggtga

SEQ ID NO: 18823 - DNA, 282 bp, Glycine max
  Peptide Sequence Number=SeqID_135601
atgcaagaagagctagaccagtttcagaataatgatgtatgggagcttgtagaactccccaaaggaaaatctgttgttggagcaaagtgggtgttcagaaacaagtttgatgaaacatgtaaggtagggaggaacaaggctaagcttgtagccaaaggctgcttggttactgtgatgcggattttgctggagatagagtggaaagaaaaagcatcagtggaagatgtcacttcactgatggatgcttggtctcttggacgagcaagaaacatgggacaatag

SEQ ID NO: 18824 - DNA, 186 bp, Glycine max
  Peptide Sequence Number=SeqID_135602
ctcaaatctaaatggtccagactatttaccatcaagaaagtccgaccatatggagcagtggagctttatgaccctcaagctaaagatcccgacagaacatgggtggtgaatggacaaaggctaaagttgtaccatggtggaaccattgagagattaaacattattctatactttcaagaagcataa

SEQ ID NO: 18825 - DNA, 348 bp, Glycine max
  Peptide Sequence Number=SeqID_135603
atgatgtgtgggtaccaatcatcaaatggaagtgatctatggtgtgagacaagtgacaatgatacacgatactgtgaagaggagacatccctaaatacaatcctagtgatgagggacagcaagagagcgtttgagcctgtagacgagtgggtggctacagatgcttttgatgttttattgtgggaaaagaagaagaataaaagattttggagttggagtggctcactcagcgcgtctatacgtgctaagcgcaagcaacacaacaaggaaggtcacatgacaagcatttggaagaaaagaggccaattggaagttcttgaaggcgctcaatgcgtcaatacttgctaa

SEQ ID NO: 18826 - DNA, 2253 bp, Glycine max
  Peptide Sequence Number=SeqID_135604
atgaagcagcactccagaaccttacacaaacgtatcactaagttgaacctcttccaatccaagcttaatcagagccataataatgactccataaacagtggtggtaaaggcagcaagtttttgattcaatgcaacactcagatagcagagaatggacgaaacggcaacgtcaaagaggcagaatccatattccacaagatgcccataaagaacactgcctcttggactgccatgctcactgcctttgcgcaaaatggccaaatacaaaatgcccgcagattgttcgatgaaatgcctcaacgaaccactgtctcaaataacgccatgatctctgcttatatccgcaatggttgcaatgtaggcaaagcttatgagcttttttcagtgttggctgaacgcaacttggtgtcatatgctgccatgatcatgggttttgttaaggcagggaagttccacatggctgagaaactgtaccgtgagaccccatatgagttccgggaccctgcttgctcaaatgcattgataaatgggtatttgaagatgggtgaagtaaatgaggcgttgcggatttttgagaacatgggagagagggatgtggtttcttggagtgccatggttgatggtttgtgcagggatgggagggttgctgctgctagggacctgtttgacaggatgcctgacagaaatgtggtttcttggagtgccatgatagatgggtatatgggggaaggtttctttcaagaggggttttgtttgtttatggatatgaagagggaaggtctggttgaagttaattccactacaatgactataatgtttaaagcatgtggaaattgtggcaggatgtcagagggcatgcagatacatgggttggtttcacgcttgggatttgaatttgacaatgttctgagtaattctgttattactatgtatagtatgcttggttgcacagacatggcagataaagtattttgtactgtgagtgacaaggacatagttacatggaattctttaatttccggatatattcataacaatgaagtggaagctgcttatagggtgtttgggaggatgcctgtgaaagatgtgatttcttggacggccatgattgcggggttcagtaagagtggaagagttgaaaatgctatagaactttttaatatgttaccagcaaaggatgattttgtttggacagctattatatcagggtttgtgaataataatgagtatgaggaagctttgcattggtatgctcggatgatttgggaaggatgcaagcctaatccgttaactattagcagtgttctagcagcttcagctgctttggtggcgctgaatgaagggcttcaaattcatacttgtattctgaaaatgaacctagagtataatttgtctatacagaactctcttatatcattctactctaagtctgggaatgtagttgatgcctacaggattttcttagatgtcattgaaccaaatgttatctcttataactcaatcatcagtgggtttgcacaaaatggctttggtgacgaggctctcggtatctataaaaagatgcagagtgaaggccatgaacccaaccatgttactttccttgctgttctctctgcctgtactcatgcaggactagttgatgaggggtggaacatatttaacaccatgaaatcacattatggaattgagccagaagctgatcattacgcttgcatggttgatatccttggtcgtgctggtttgctagatgaagctattgatttaatccgttcaatgccatttaagccccattctggagtttggggggctattcttggtgcaagcaagactcacctacgtctcgaccttgctaagcttgcagctcaacgcattactgacctggagcctaaaaatgcaactccttatgtggtattatctaacatgtattctgctgctgggaaaaagattgatggtgacttagtaaaaatggccaagaatttaaaaggaataaaaaaaagtccgggttgtagttggattacaatgaaaaataaggttcatctgtttcttgcaggggatcaatcacatggtagtattgaagagataaaaaccacaatactgacaatggatagggagatgcagtgtgttgaatcctcattctctcagacttcaactactgtattgattagtaataaccgcataaaatcagatgtatcaaagaagctctcctattctatcatcatttattgttattttctggttattcgttatctttga

SEQ ID NO: 18827 - DNA, 612 bp, Glycine max
  Peptide Sequence Number=SeqID_135605
atggagtttgggaacaacgctgacgaacgggcacgggaggctcaaacccaagttcttgatttggaacgagatttgctctttatggggaatgaattgaacaaatataagaatcaacatcaattgtggaatagagaatacgaaaagatgcaaaatcaaccggttcctctatggactggcatagtcccaattctcaatggatttttgctatttctcgtagagccatggaagcaactaatgttcatcctccccgcatttctgaatttggaacgctggatcaatctcttggatttcgcattgaagataccaattcctgaaaggtgtgaatccagtggatcaaaagataaatcaaatcaaaaggttacattaagacggcttgctcaaaattgtgaggctgccaggaaaagtcgactgaggaaaaaggcatatcagcaacaattagaaagcagtaggtttaaactgacccaacttgagcaggagctccagcgagcacgccaacaggtattgtatgactacaaagacaaaatcaaccaacctgttttccctggattgcaaggtggcccttacaatcacactattattggtttagctgttgcattgaagcagggcacctaa

SEQ ID NO: 18828 - DNA, 222 bp, Glycine max
  Peptide Sequence Number=SeqID_135606
atgactaacctgagatttcttcgaatccacaaagggtggcggagtaacaaccaatttaatgtgttccttagtaatggtcttgagtcattgtctaacaaattgaggtaccttcattgggatgaatgttgtcttgagtctttgccgtctaacttttgcgctgaacaacttgtagagatttccatgcctcgtagcaagctcaaaaagctctgggatggggttcag

SEQ ID NO: 18829 - DNA, 1026 bp, Glycine max
  Peptide Sequence Number=SeqID_135607
atgtgtgctaggaatgatgttgaattgcttaaggacattgttagagctgtttcggaaaaattgcctcgcagataccaaaaccaaagtaaaggattggttggaattgaggaacattataaacggattgaatcatttctaaataatgggtctagtgaagttagaacccttggaatatggggcatgggtggcataggtaaaagcacccttgctactgctttatataatgaattgtctcctgagtttgaaggtcattgcttcttcataaatgtttttgataagtctgaaatgagtaatctccagggtaaaagagttttcattgtcttggatgacgtggctacctctgagcaattagaaaagctaattggagaatatgattttttgggactaggaagtagggtcattgttacgagtagaaataagcaaatgcttagcctagttgatgaaatatattcagtcgaggaattgagctctcatcactcccttcagcttttctgtttgactgtttttggagaagaacaacctaaagatggatatgaagatctatcaagaagagtaattttctattgcaaaggtattcctttggctttaaaaattttgggtaaaagtcttcgtcaaaaatgtaaagacgcatgggaaagtgaattgagaaaaattcaaaagattctaaatgtggaaattcataatgaattaaaattgagttattatgacttagattgttcacaaaaagagatctttttagaccttgcatgcttcttcaaaggaggaaaaagagattgggtagcaggattattggaagcttttggtttctttccagcatctgagatagaagtacttttagataaatctctcataagaatttcaaaatacaatgagatagaaatgcatgacttgacacaagaaatgggtcgagaaattattcgtcaacaatctatcaaagatcctggaagacgaagtcgattgtgcaaacacgaggaagttgttgatgttttgaaacataacaaggcaagtgcaattgcttttatttga

SEQ ID NO: 18830 - DNA, 1437 bp, Glycine max
  Peptide Sequence Number=SeqID_135608
atgcagcaagatcagctcaagaaggttgtttctttctccatgattgccccttttgtctgcaaagtctgttacggtgctgatattaaggaggtagagtttttcactgagtacggggatgccaacagatacaagattcttgaagtggttgggaagggtagctatggagttgtttgttctgcaattgatacacacactggaggaaaggttgcaataaagaagattcatgatatttttgaacatatctctgatgccatcagaatcctcagggaagtcaagttgctaagacttttaagacaccctgatattgttgagattaagcggatcgtgttgccgccttcaaagagggagtttaaagatatttatgtagtctttgagctcatggagtctgatctccatcaggtcattaaagctaatgacgacttgactcgcgaacactatcagttttttctttatcagatgctacgtgcattgaagtatatgcatacagctaatgtatatcacagagaccttaagcccaagaatatactggcaaatgcaaactgcaaactcaaagtttgtgactttggattggcaagagttgcattcagtgatgccccaacaacaactttttggacggattatgttgctacaagatggtacagagccccagaactatgtggctccttcttttcaaagtacacaccagcaattgatgtatggagcattggatgcatttttgcagaggtgttgacaggaaaaccactgtttcctggtaaaagtgtcgtgcatcaattagatttgattactgatcttctcgggacaccatcacctgaaactattgcaggagttcgaaatgacaaggcaaggaagtacttgatggaaatgcggaagaaatctcctgtgccatttgaacagaaatttcagaatgcagatccattggcacttcgcctattacaaaggcttttagcatttgatccaaaggatcgaccaactgctcaagaggcactggctgatcccttctttaagggtttgtccaaagttgagagagaaccttcttgtcagccaatttcaaaattagaatttgagtttgagaggagacgagtgacaaaagatgatgttagggaactaatatatcgggaaatactggaatatcatccccagttgcttaaagattacatgaatggaactgaaggcactcacttcctttaccctagtgcagtagatcaattcagaaagcactttgcttatcttgaggaaaatcatggtaaaagtggcccagtgattcctccagaaaggaagcatgtctcccttccaaggtccattgttcactctagtacaattcctcctagttcacaaccatcttttacttcatacgagaacaagcaaatggcattagaggcatcaaaggtttcgagatcagtagaatcaaattccagaagtcaattaaggagctcgtga

SEQ ID NO: 18831 - DNA, 418 bp, Glycine max
  Peptide Sequence Number=SeqID_135609
atgctggaaccttttcttgatcctggcattgctgtaccaaaaagcaaaatagcttttggagatatagcttcttcatttccagaaaagcaggaacacaattgcacaattgctctaaatatcatccgtactgctgtacgaaagccagctgtgctgccttctttggaatcagaatggaggcatggatctgtggctcctagtgtgcttctctcgatattggaaccgcacatgttattgccacctgatgttgacctctgcaaatcagttttaagaccaactgatcatgaaactgcatctatttcacatctttcctctgccattaatggtggaggcgctttttccaagtcaaatggtcaagatgagtctgatggaaaaacaaatgtttcagaaatggctggaaaatctgattttgttgaagatc

SEQ ID NO: 18832 - DNA, 246 bp, Glycine max
  Peptide Sequence Number=SeqID_135610
atggaggtggtttctgcccagagacttcttgaggtggtcaaacgaaggtcgcatgccgataaacaatggtccccgaatgaaattagggttcggcaaagtccgttgcctacgtccggtccccaagaaagccgcttgggagttccactatctcgtaatcctttacaccttctgaaacacacaaggacatcccttcctttgtgttcaaatgctttacaacaagagactctctgtctcttagccctttga

SEQ ID NO: 18833 - DNA, 1908 bp, Glycine max
  Peptide Sequence Number=SeqID_135611
atggcaaatgcggggagcacacccttcagttcccttttggcttctcccaaggttgtccaatccagcttgactgttccaacgaccaagtccaacttcgcagcgaattcgccaatttttactgagaattttgccccaacgattaacaatagctttctggtgcaagattgtagagaggtgtttggtgggtgtgttattcctgctagttttgtgagcaaccaaattgatgttgagaactgcagcaacaaaagtgctaatatcagttgcttttcgaaacaagatgaagtttttgtgacgtacgctgatttgaacgggactaagtgtaagtacttgttctctgcggtttcttttgggcagagcaaggagattccgctgcagtttcaggttgttgagttggggtggtggcttcctgggcagtgcgatgatcatcaatgttctaacaacgctacctgcacaacggtcgacagggttgggttccggtgccagtgtatcgaaggtttcaccggagacggcttcaaaaacggcatcggttgccggaaagcttcggcttcaagttgcagtgcttcaacactaacgtccggtggatgtgggaaagcaactaaaatcggtgttgttgttggagtaatcaccactggagctttggtggtggctggtctgtttcttctatgctactgtgccaggcggcgttctacttggttgagaaaacataccatggtaaagcgccaattacgcgaagctgcaggcaactctagtgtacctttctatccctacaaagaaatagaaaaggcgacaaattttttctctgagaaacacaggcttggaactggggcatttggtacagtttatgctggaaaactgcacaatgatgagtgggttgctataaagaagttaaggcaaagagacaccaacagtgctgatcaagtcatgaatgaaatcaggctactttcttcagtgagtcacccgaatttagttcgcctcttaggttgctgcatagagaagggagagcatatccttgtttatgagtttatgcaaaatggaacactttctcagcacttgcaaagagagaggagtaaaggactaccgtggacaataagacttaccattgctaccgaaactgctaatgctatagcatatctccattctgcaattcatcccccaatttaccacagagacataaaatctactaatatactcttggattatggcttcaaatctaaaatagccgattttgggctttctaggcttgcattgacagaaacatctcatatctcaaccgccccacaagggactccaggttatgtcgatccccaataccaccagaactttcagctttctgataaaagtgatgtctacagttttggagtggttttggtagagataataactgccatgaaagtggttgattttgctcgacctcgaagtgagattaatttagctgcacttgctgttgataggattaggagaggtgctgtagatgagatcatagaccccttccttgaaccacatagagatgcttggacactgtattctattcataaagtggccgagcttgcatttagatgccttgcttttcatagtgacatgaggcctactatgatggaagtagcagaagagctagaacacattagacgcagtggatgggcatctatggaggaaactctcacggcttcaccgattgggtccactagttcatcacctcgtcatggaagtgagaagtcactgggtggtatcaaaaaagctcggcaaggccaagggagtgagagattgattgttccgcagaagacggagagctttttgcaatctatggaggtgaaggacagctcccctgtatcagtgcatgatccaattccttggtcaagtggacacagctcaccttcatcaaacagcttgttgggaaatgtcatcccttga

SEQ ID NO: 18834 - DNA, 690 bp, Glycine max
  Peptide Sequence Number=SeqID_135612
atgggaggaaaaagtgagaagggtgaagttatggagtggtcagttgcaaacacaaaggctttcattgaaaaaatttatgagagagtgaaaaatgggcaattacaagggtcaaccttcaaaactaccacatgggaagaaattaacaaggacttgtttgagatgatccaaactaattatggtgtggacaagctgaagtctaagtttaatcgtctgagacaaatgcatcgtgatttttcaactttgctagctcgtaccggagtcacttgggaaatggaatccaacaaagtgaatgcccctgatgaagtatgggacgaattgattaagaaaggaaggcattacaagaatttcaagaaacatggttttgagtacaactatgatatcctcggtgacatattcaattcaagcacatcaactgggaaactaagtcattcttttactcaagagccaccaaattctaacgaggagaaagccatggaaggtgatttccttacaaaggggattcatattaatgttttcgatgatgagaaggatgatatgaaagggcctaggcacaaaaggaacatgcaagatgttcccacttcagcttactttaagttgatggagaagtttacgagtgagcattggaggcaaatgttcatagtgatggatgcagagcgaagcaaacaattgacagaatctcttactgagtag

SEQ ID NO: 18835 - DNA, 333 bp, Glycine max
  Peptide Sequence Number=SeqID_135613
atgggtagtaataaaacggtgcggattaaatggcccgcgggtttaaatccttctgacgactcttattatttatgggtgggtagaaggataaggtgtgaagagagagcaaagaataatgatggagagggagaagagaaagaggcatttgaagaagagcaagtaatccttgtgggtcatagctttggtggtctatgcatatctgtagccatggaattgttccctaccaagattgcagctgcagtatttgtttccgcttggctgccttctcccgacctaaactatttggatctcctccaagaggaaataaaaacactgaaaatgcgtttggtttga

SEQ ID NO: 18836 - DNA, 237 bp, Glycine max
  Peptide Sequence Number=SeqID_135614
atgacgataaaacataaattatgcaacttaaaagacaagaactacttcaatgtaaactcgacatacattacaaagatgagtgtgctgctgtgtgtagctgtgcggctaggtcgcagcagagaatgggtcatggtcgtggcggagagtgggtctcaagtcgctacctcgacggagagtgggtcgaggcgtgactgcgttaggcgtcaagctcgagcggctgtgatggaaagggagtga

SEQ ID NO: 18837 - DNA, 435 bp, Glycine max
  Peptide Sequence Number=SeqID_135615
atggtttgtgcaatctcgtcatcaccgttctcaactctctcgtttcggcgtctcgtcgtacgcaatgcgacgccgtctccgtgcaagccgcgtgccgttaaacccttaacggcacttccgagcgcggggcggaggcagttgctgttttttctgacggcgacgacggcgttgacggcgagggaagcggcgtccgtggcgcaggacattcccttgttcgggatacggaagagtctgaagaaggtggaggaggaagcggaggagattgtgagagagggatttgaggctgcggataagggattggtggcggcggagaaggggctggagacggcggagaaggggttggcgggagcggtggcgggagcggaggtttttgggattttggttgcaacggcggtggtgaacggtattttgggtcctgaagctcaaaaatcgtga

SEQ ID NO: 18838 - DNA, 381 bp, Glycine max
  Peptide Sequence Number=SeqID_135616
atggtttggggacactatagagtgttaccatcatcatgcattccccacttttggcaacatagggggatgatcaaggacacaaggcaaaatcagtttggtgggcgtttggacatccattatcgttcaacgacagtctgttggctaaatggtgttggagatttcttcgacaaaagggatgttttgtgggcggggctgcggaaaataaaatatggggacttccagaatgagccttactcacagccaaagtcgactaaatggtcattatggtggcgagacatatggagttttgacaagcgaaatgctgctgcattaggaagagagtgggtgatggacactctacaagcttctgggagcacaaatggattggggaaaagccactaa

SEQ ID NO: 18839 - DNA, 156 bp, Glycine max
  Peptide Sequence Number=SeqID_135617
atggtgctgaaatgcacgccaaatgaaagtccaaaggaagtctctggagtagtggggtgtcggggaaccgggtgggtcggtgggagggaaagtggggagtggaagggattgctaaagagagaggaggggttgaaccggttgaccgttttaaagtag

SEQ ID NO: 18840 - DNA, 105 bp, Glycine max
  Peptide Sequence Number=SeqID_135618
atggcaaatcgggccaagaagcccaagtgcaactcggctgttgatgagcaaggaaaaccaagcccacaattcagagcagcttcgatcccttttctagctttataa

SEQ ID NO: 18841 - DNA, 1383 bp, Glycine max
  Peptide Sequence Number=SeqID_135619
atgacagggtcatcgagaaaaggacgcgggtacatggatgaaggaagtatccatggaagaaagtacggaaagttaaagaaagacgagttcgatggttacaactccgatagccatccaagaaaaaacaaccccatcacattggacgcgcctcatttggatcctcaaatggaagcagacaacgctccctacgacccttccctctctcccttatccaaatctccatggtcctctcacacgaacgatgacgctttttccggctctaacgaaaatgacgctctcgtgggctcccttgtccgcgaagagggtcacatttattccctcgctgcaaccaaggacttgttatacacgggttccgacagcaagaacatccgcgtgtggaagaaccagaaggagttcgcggggttcaaatccaacagcggcttggtgaaagccattgtaattgccggagagaaaatcctcacaggacaccaagacggaaggatcagggtttggaaagtgtcggggaaaaacgagcaacaacacaagcgcgtggcgacgctgccaacgctgagaaactacatcaaatgttccatgaaaccgagcaactacgtggaagtgagacggcaccgtaacgtaatatggatcaaacactacgacgctatttcctgcctcagtttaacggaggatcattctctcatatactccgcctcgtgggacaagacttttaaggtttggcgaacatcgaatttcaagtgtttggagtccgttaaggcgcacgacgacgccgttaacgcgcttgttgtggggttgaatggtatggttttcacggggtccgctgacggcaccgttaagatttggcggcgcgaggttcaggggaaggggacgaagcattttttttcgcagacgctgttgaagcaggagtgtgcggtgacgtcgctagcgataaatgaagaggggaatgttctatacgcgggttcctctgaagggttggtgaattattgggttcatgaaacgaatttggagcataaaggggttttgaggggacacaagttggcggtgctgtgcttggctgcggcggggagtttggtgttcagcgggtctgcggacatggcgatatgcgtgtggaagaggacgctgagtgaggagcacacgtgcgtgaaaattctgtcggggcacactgggcctgttaagtgtttggcggcggagaaggaccctgaagcgatgtgtaacgagagaaggtggattttgtatagtgggagtttggataagtcggtgaaggtgtggaaagtgtcggagaatattaatgcgggtgcgcagaacaacaaccaccagccaccgaggcttagtgttgatcagttccccagagtgtcttccttaaggaaaatggggtcaaggagatactag

SEQ ID NO: 18842 - DNA, 876 bp, Glycine max
  Peptide Sequence Number=SeqID_135620
atgcctaggattgtatcttcctatcaaactggttttattccctcaaggagtattcatgaaaatattattgttgctcaagaaatacttcactctatgcgtctcataaaaaggaagccgtggttctttgttcttaaagtggaacttgtcaaggcttatgaccgcatgagatggtccttcattgcggatatatttcatgaagtgggaattcctgacaaacttgcttctgtcattatgcattgcatatctttggtgcaatcaaatattgctcctttcaatgaggtcacttctttaggtcgttatcttgaagtttcccttcttggtaaagcgcctagacgaagagattttcagtatcttgtggaaaaactggctcatcgggacattcagaaaacccagggagcttttatctggggtgaccaaggcatgatgaggaaaatacatgcagtgagctggaaaactatgatgtttcctaaagaccatggtggtatggcgatgtctaacttagtgcagatggacaaggtttatttgatgaagttaggatgggccttacgctcttacaagtatggtctttggggcgaggtgctgttgggaaaatacaatagaggagctgaaggtaattctggccaaatcctaactctagctgcaaattcccatatctggaaagccattgccaatttatggccaatcattgtggagaatgaaatttgtattattggtgatgggggtaatattaatgtttggcaggaaaaatggatcaatggctcgattaaattgattgatgttattcctcatattccttccaattttcttaatttgagggtcaaagatctaactgatttaaatggggaatgggatattactctgttgaattccctataa

SEQ ID NO: 18843 - DNA, 447 bp, Glycine max
  Peptide Sequence Number=SeqID_135621
atgtctgacagagaagacaacgcccccgaggaattcacaaccgaacagggtatacaacaagacgaagagattcggaggattcaaagagaaaataaggccagggttgttcgtgaaggaaaagagcgtaggaggagatgggcccaaaaaataactcctcgaccatccaaagctggtaaaaaatctgaagatgtagaagactctgaaccacagcaagaatcaaatacagcagcaggatttcttcctgacaacattgtccaaatgcttgcagctcgtgagaatttgaaacctgttattttgagcgaaataggtcctcctccatgcttaaacagtgccttagatttcttgaagaagaagcaaatgtcagttcaaagatcttcttcggttttgaataattctaacaaagcatttcgtctcctttctcggtcaggggtgcttcgcagtaaatga

SEQ ID NO: 18844 - DNA, 505 bp, Glycine max
  Peptide Sequence Number=SeqID_135622
atggctgccaccgaggaaccaattctctctaggattgaccgtttggataatatggtaatcagagggtgcaatccatctccaaagagctcgtgtgcatctactccaacaagtggaagtgatggacacgtgtcatccactgatttctccccaaagagtttagagaagcactgccgtccgattgaattcgtgatgatggagaccgaagtcaaaggaacgatgatagagaggctcaaccaagtggaggatcgaatgctaaaggaagagttggtagcaaagaagaaagaggaagagaagaaaatgaatagcccgaagaagggttttaaacagcttgtgaagcaatcatttgatgtatatcccgcaacaatagcattcaaaatcccttgcatccattgttcaaaacaaagcttttgcttccctcgtgatgatgaggttgaagatgaagtcggagggttatggagaaagagggatacacaagggatttgggccgaggaagatcagcctaaag

SEQ ID NO: 18845 - DNA, 2766 bp, Glycine max
  Peptide Sequence Number=SeqID_135623
atgaggatgttgcggtggatgtgtggtaagactcgacaggataaaattggaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgagacagaggaagacccaaaaagactataagagaggttatcaaaaaagatctcgaaattaatggtttggatagaagaagtcctgcaattcttggagacatggaagaggatggtgctcctgctgctgatggtgccagcgacttcaattatgattcagaaaatcaaaatcaaaaccaaaaccaaaagcagaagatttcagagcgcatgttgagctggcaattgacatactcacgaggagaggaggttggtgctccaaattatgataaggatgtttctcacaaccacattcctctactgaccagtggacaagaggtatctggagagttgtctgcagcctcacccgagaggctctcaatggcatctcctgcagttggtggcggaaagcgtgtccataatattccatattcatctgacattaatcaatctccaaatatcagggccggggatccaggattgggtaatgttgcatggaaagaaagagttgatggctggaagatgaagcaagaaaagaatgttgttccaatgagcacaggcctggcggcttctgaaagaggagctggagatgttgatgctagtactgatgtgcttgtggatgattccttgttgaatgatgaagctcgacagcctctttccaggaaggtttctattccatcatctaggataaatccatatcgtatggtcattatgctgcggctggttatcctttgcattttcttgcattatcggataacgaatccagtgcccaatgcctatccattgtggttggtatcagttatatgtgagatttggtttgccatatcttggatattggatcaattccccaagtggcttcctgtaaaccgtgaaacatatctcgacaggcttgcactaaggtatgatcaagaaggagaaccatcgcaactagctgctgttgacattttcgtcagtactgttgacccattaaaggagcccccacttgtgactgccaataccgtactatctattcttgcagttgactatccagtggataaggtctcctgctatgtgtcagatgatggtgctgctatgttgacatttgaagcacttgctgagacatcagaatttgcaaggaaatgggttccttttagcaagaagtatagcattgaaccccgtgcacctgagtggtattttgctcaaaagattgactacttgaaagataaggttcatccatcatttgtcaaggatcgtagagcaatgaagagagaatatgaggagtttaaagttcgtgttaatggacttgttgcaaaggcacagaaagttcctgaagaaggatgggtgatgcaagatggtaccccgtggcctggaaataacatcagagaccatccaggaatgattcaggttttcttgggccaaagtggaggacttgacactgagggtaatgaacttccacgtttagtctatgtttctcgtgaaaagcgtccagggttccaacatcataagaaagctggtgccatgaatgcacttgttcgagtatctgcagtccttaccaatggacctttcttattgaatcttgattgtgatcactacataaacaacagcaaggccttgagggaagctatgtgctttatgatggatccaaaccttggtaaacatgtttgctatgtccagtttccacagaggtttgatggtattgataggaatgatcgatatgccaatcgtaatacagttttctttgatataaacttgagaggtttggatggcattcaaggtcctgtttatgtgggtactggatgtgtcttcaataggacagctttatatggttatgaacctcctcttaaacccaagcacaaaaagcctgggttgttatcatcactctgtggtggaaatcggaagaagagttcaaaatctagcaagaaaggaacagacaagaaaaaatctaacaagcatgttgacccaactgtgcctatttttaatctagaggatatagaagaaggagtagaaggcacacctttacttctcatacatatgtttttaggtactggatttgatgatgaaaaatcactacttatgtcacaaatgagtcttgagaaaaggtttggtcagtctgctgtctttgttgcctctacgcttatggagaatggtggtgttcctcagtctgctactccagaaactcttcttaaggaggctattcatgttatcagctgtggttatgaggataaaactgattggggaagtgagataggatggatttatggttctgtcacagaagatattcttaccggatttaagatgcatgcccgcggttggcggtctatatactgcatgcctaagcgcccagcgtttaaaggttctgctcccatcaatctttcagatcgtctaaaccaagtgcttcgatgggctttaggttccgtggaaattctctttagccggcactgtcccatctggtatggttatggtggaaggttgaagtggcttgaaaggtttgcatatgtgaacaccacaatctatccagtcactgccattcccctactcatttattgtatcttgcctgctgtctgtttgctgactaacaagttcattattcctcaggtagtgtcattggatgaataa

SEQ ID NO: 18846 - DNA, 2220 bp, Glycine max
  Peptide Sequence Number=SeqID_135624
agattgggcgtccctgagtcagtgctgagtttggagtatccatcaactcgggtttcttctctcaaggctgaggatatcgatgccaaacgtccccctattgttactttcgatgtggacactgatgatgcgttggatgaggagtttgatgtggacgacactgtgagtaataaacctgttaaaagggcacctctcacgaaggggaagaaagggtcttgttataggtgcttcaaggggagtaggtttactgagaaagaggtttgtctcgtctgtgatgcgaaatattgtggtaattgtgtgcttagagctatggggtctatgcccgaggggaggaaatgtgtgacttgcattggattcccgattgatgaagccaaaagagggagtttggggaagttctctcggatgctcaagcgtttgcttaatgacttggaggttcgccagattatgaaggctgagaggttttgtgaagcgaatcagcttccacctgagtatgtttgtgtgaatggacatccactttcttatgaggaattggttacgttgcagaactgccccaaccctccgaagaagctgaagccaggaaactattggtatgataaagtatctggcctttgggggaaggagggacagaagccttcacaaattattagtccgcatctgaacgttggaggccccatccaaccggatgctagcaatggaaacactcaggttttcatcaatggtcgggaaataactaaagtggagcttcgtatgttgcagttggcaggagttcaatgtgctggcaacccacatttttgggtcaatgaggatggttcctaccaagaagaggggcagaagaatacaaggggatatatatggggaaaggctggaacgaagcttgtatgtgctttcctgtccctgccagttccttctaaatcttcaaattctttgggagaacaaccctccagtctggctagcagaacaatgcctgactaccttgagcatgggatagttcagaagcttctcttagttggttgcagtggatctggaacgagcactatttttaagcaggccaagattctgtacaaaagtgtcccattctcagaagatgagcatgaaaatataaagttgatcattcagagtaatgtttatgcctaccttggcatgctgctcgagggacgtgagcgttttgaagaggaaagtttgggggatttaaaaaaaaggcaatcatctgtacaagataccacaggaactagtccaaggcttgatgagaagactgtatattccattggtccaagattgaaagcattctctgattggttactgaaaactatggtgttgggcaaacttgatgccatctttccagctgctactcgtgaatatgcaccattgattgaggaattatggaatgatgctgccattaaggctacatacgaaaggagaagcgaattagaaatgctgcctagtgttgccggttatttcttagagcgggctgttaaaatattaaggacagattatgaactctctgatttagatatcctttatgccgagggagttacttcatctaatggggtggcttgtgtggagttttcatttccccaatcagtgtctgaggaaactgttgacactaccgatcgatatgattctttggtcaggtatcaactaattagggtgcatgcaagggggctaggagaaaattgcaagtggctagagatgtttgaggatgttgaaatggtcatcttctgtgtttccttgactgactatgatcagttttctgttgatggcaacggttgtctcactaacaagatggtactaagcagaaagttttttgaaaccattgtcactcatccaacctttgagcaaatggacttcttgttgatattgaacaaatatgatctgtttgaggagaaaatcgaacaagttcctttgaccgagtgtgaatggttctctgatttccatccaataatcagttgcaatcgtcccaacagcaatagcaacagcattaataataatccctcccttggtcagctggcttcacattacgtagcggttaagtttaaaaggctttattcatctcttacaggacgaaagttgtatgtgtccctggtgaaggggttggagcctggtagtgttgattcatcacttaaatacgccaaggaaattttgaagtggagcgaagagagaccaaactttagcttgagtgagtactcgatgtatagcactgaggcgagttcatgctctcattga

SEQ ID NO: 18847 - DNA, 1074 bp, Glycine max
  Peptide Sequence Number=SeqID_135625
atggatgcttttcagttcaaaattcttatttcaagcattcttgccctgttagtgtgcgccttgttttatcaatttaagagaacactttgtggcaatacaaagaagatctgtagtgcacctcaagcagcaggtgcatggcctatcattggccatttgcacctcttcaatggtcatcaactcacacacaaaacacttggcatgatggctgagaaacatggtccaattttcacaataaaacttggttcatacaaagttctagtattaagtagttgggagatggccaaagagtgtttcactgtccatgacaaagcattctccaccagaccatgtgttgcagcctcaaagctaatgggctacaactatgcgatgtttggcttcactccatatggttcttactggcgtcaggtaaggaaattaactaccatagaacttctttctaacaatcgtcttgagccactcaaggaaacaagaacgtttgagttagatgctgcagtaaaagagctttataagttgtggacaagaaacggttgtccaaagggaggggttttggtggatatgaagcagtggtttggtgatttgacgcataatattgctctcagaatggtgggagggaagtcttattgtggggttggtgatgatcatgctgaaggtgaggcaagaaggtataggagagttatgagagactgggtgtgcttgtttggggtgtttgtgtggtctgattcatttccatttctggggtggttggatatcaatggatatgaaaaggatatgaagagaactgcaagtgaattggacactctagttgaagggtggctagaggaacacaaaaggaaaaagaaaagaggtttgagtgtgaatggaaaggaagaacaagatgatttcatggatgtcatgttgaatgttctgcagggtacagagatttctggttatgattcagataccatcatcaaagctacttgcctgtatcacaagatatcaaagctattaacacccatagcaggagtgcaacaacaacaacaacaacgccttatcccactaggtggggtcggctacatggatcaacttccgccataa

SEQ ID NO: 18848 - DNA, 600 bp, Glycine max
  Peptide Sequence Number=SeqID_135626
atggtcacgctaacatgggcactatctctgctacttaaccatcaaacagaacttaaaagagcccaacatgaactgggcactcttatgggaaagcacaggaaagtagacgaatctgacataaagaagttagtgtacctccaagccgttgtgaaggaaactctgcgcctgtatccaccaagtccaattatcacccttcgtgcagccatggaagactgcaccttttcatgtggatatcacattcctgcaggcacacaattgatggtgaatgcttggaagatccacagggatggtcgtgtttggagtgaccctaatgatttcaagcctgaaaggtttttgacaagccacaaagatgttgatgtaaagggtcagaactatgagctcgtcccttttagttctggaaggcgagcatgccctggggcatcactcgctctgcgtgtggtgcacttgaccttggctagactcttacattctttcaatgttgcttctccttcaaatcaagttgttgacatgacagagagcttcggactcacaaatttaaaagcaaccccgcttgaagttctcctaactcctcgtcaagacaccaaattttatgaggactag

SEQ ID NO: 18849 - DNA, 228 bp, Glycine max
  Peptide Sequence Number=SeqID_135627
atggagtcggaaggggaagctggggcaaaaccagtgacagcattgggtgcccaagtgtgccagatttgtagtgatggtgttgggaagactgtggatggtgaaccgttcgttgcgtgcgacgtttgtgctttccctgtctgcaggccttgctatgagtatgaaaggaaggatgggaatcagtcttgcccccagtgcaaaacccggtacaagaggcacaagggtaaatga

SEQ ID NO: 18850 - DNA, 474 bp, Glycine max
  Peptide Sequence Number=SeqID_135628
atgtcacagtacaagattggtaagattggtctcaggtggaggacagagaaggaagtcatatctggcaagggacagttcatatgtggtaacaagcattgcaatgagaaagatgggttagcaagctatgaggtgaacttttattactttgaagctggagaaaacaaacaagccctagttaaattggtaacatgtgagagatgtgcattcaaactcaactacaagaggcagaaagaaaaggagcagttagaaaaaagacaacaagaacaggataggcgaaagaggaatcgttcaaagagtgatgatgatctagatgacttccatgaaagcaaagagagaaggcggaaagggaggaaaaagttccatttctattcccaagggagggaggggaaaagggctttgacttcagccagtgatcataaaattgatgatgatgatgataacttggatgagtttcttgaggggatgtttccatga

SEQ ID NO: 18851 - DNA, 1392 bp, Glycine max
  Peptide Sequence Number=SeqID_135629
atgtcattttcgttgttcgccacgccgcagcaacagcagcagcagtctccttttcagccacagcaaactagtttgttccttccgcagcagcagcagcagcaacaacaacagcaacaatttcaacaacagcaacaacagcagcagccgcaacaacagttgtttttgtttactaacgatagaactcccgctagttatagtaccaattgggcggatctacatcctgattcccagaagattctccttcagatcgagtatgctctaattttccctcattcctcaatggagcggatattagagtatagggatgaaagccagagactagatcagtgtagtcgtctttatgattcttccgtttccaacgatggatttgagcttgatgcaggtcatattgttcaggaacttggtggaattaacacagctatggaacgacagaaaacattgctacaggaactgatgtccactgttaaggatatgttacgcaacacagaggttgctgttcgttcctttatgatgctacgccctaggttccttcatcccagtgggggtacatcaagtgccactgccccatcacagactcctggtgcaactatagcacctagttcgagtagccaacctacaactgcatctatagtgcctgtttttgatttctacagtggtcttccaaagaaaccatctccgtttttacagcaaacagttttaagatttgagaagtatcttggtgagtgccatcagtggattgaagagttggagcagctgcttctcttggactctgagagaaatgcatccgctaatggttcctcattgttgcaatctcttcccaaggtcatgacaaatgtgcacgacttttttgttcacgtggctgcgaaggtggagagcattcatcagtacattgaatctatgaaatcagcatacctagctgatcagcgtcgacggggggaggtgaatgatccatttttggaggcagatcgacgagaaactgcaagacaagaagccgcctcaaaaagagttcatccaacattgcatttacctgcaaattcacaaccctcaactcaagttgctgggttgttttccagttcagggactcaagcagcattgactgccccacagacatctgcagcaacttcatctttgtcatcaggaagtggattctctctttttagcacaccatcttctgctccatcgtcttctatgttgtcatctttgtttacaacaccaactcctgctccaggacctcaaacctcactttttggttctacatctgtacctggttctgcatcaactccctctctgtttggtaatactactccattgtttagtacaactccagctacaaattcactcttttcaagtccatttgtttcaggtactgtcttgttttatagttcttcatag

SEQ ID NO: 18852 - DNA, 1635 bp, Glycine max
  Peptide Sequence Number=SeqID_135630
atgtacttgaattgcgtggatttgaattctgctgaattggttttctgggatatggttgatagagatgatgttgcttggaattctctcattactggatatctgaggaatagtaagatcaaggagggtgtttggctatttattaaaatgatgagtgttggtttttccccaaccctgttcacctattttatggttttgaatgcctgtagtcgtctgaaggattatcgttctgggagattgattcatgcccatgtgattggtaggaatgtgccacttgatttacttctgcaaaatactctggttggcatgtactgcaacgttggcaatatgcgaacagcatataagatttttagtagaatggaaaacccggatttagtttcttggaattcaattatttctgggtattctgagaacgaggatggagagaaagccatgaatttgtttgtcccgttaagggagatgttttttcctaaaccggatgactatacttttgctggcattatatctgcaactcgtgcattcccgtcttccagttatggaaaacctcttcatgctgaagtcattaaaacaggatttgagagaagtgtgtttgtaggaagcactctagtgtctatgtatttcaaaaatcatgaaagtgaagctgcttggagagtattttgttcgatatcagtgaaggacgttgttctctggactgaactgatcacagcccatgaggttgatgactatgttctcagtggttgtgctgaccttgtagttttaagacaagatgaaataattcattgctatgctgttaaattgggttatgatgctgaaatgtctgtttctggcaatctaattgatatgtatgcaaaaaatggtagccttgaagctgcgtatttggtgttttctcaggtttcagaatctgatttgaagtgttggaactcaatgcttggaggatatagtcaccatggaatgattctcaaacaaggtcttattccagatcaagtgacattcttgtctcttttgtcagcttgcagccacagtaggttggttgagcaaggaaagttcctctggaattatatgaacagcattggtttgattcctgggcctaagcactacacttgcatgataactttgttcagtcgggcagcattactggaagaggcggaagaaatcatcaacaaatctccttatattgaagataatctagaactgtggagaactttgttaagttcctgtgttataaataaaaattttaaagtgggaattcatgcagcagaggaagttttgagattgaaagcagaagatggtccaacgcttgttttgctttctaatctttatgctgttgcaaggagatgggataaagttgcagaaataagaagaaatgtgaggggattgatgctggagaaagatccagggttaagttggatagaggccaagaatgacattcatgtgttatcttccggagatcaatcacatcccaaggctgatgaggtgcaggctgaactacataggctaaaaagaaatatgattagaacagaaaatgatgacagagagacgcaaaatgcatgctacataagttgcagagacgaagcttatgctctagaggtcgaatttaattcaaagacaaatgaagtacatactggactgaagttttag

SEQ ID NO: 18853 - DNA, 1125 bp, Glycine max
  Peptide Sequence Number=SeqID_135631
atggcagcgaaatatcataacacatttgcccttttgcttttgcttgtgaatctgagatttcatggaaatgttgcggctcagaatgctaagttagcagcttctttcatctttggggactcgttggttgatgcaggaaacaacaactatctctcaactctttccaaggcagacgttccccctaatggaattgatttcaaggcctctggaggaaatcccacaggacgtttcaccaatggaagaaccattagtgatattgttggagaggaattaggacaagcaaattatgctgtcccatatttggcaccaaacacatctgggaaaaccatactcaatggagtgaattatgcttcaggaggaggagggattctcaatgcaacaggaagcttatttgtgaataggctcggaatggatattcaaattaattacttcaacataacaagaaaacagattgacaagttgctaggcaaatcggaggcgagagagtacataatgaagaaatccttgttctccatcattgttgggtccaatgattttttaaacaattatcttcttccttttgtttcctctggagttagagcttcgcagaatccagatgctttcgtcgatgacatgatcaattatttcaggatccaactttacagactttaccaactggatgctcggaagtttgtgatcagcaacgttggcccagtagggtgcataccttaccagaggattataaatgagctgaacgatgaagattgtgtggatttggctaacgagcttgcaacccaatacaattcccgattgaaagatttggttgctgagctaaatgacaacctccctggagccacctttgtcctcgcaaatgtgtatgatttagtgtcggaactgatcgtaaattatcataaatatggattcacaacagcaagcagaggttgctgtggaattggaagtgggggtcaggttgcagggataatcccttgtgtgccaacatctagcttgtgctcagataggaacaagcatgtgttctgggatcaataccatccaagtgaggcagccaacataatacttgccaagcagcttattaatggagacaagagatacatatctccaatgaatcttagacaacttatagatctttga

SEQ ID NO: 18854 - DNA, 315 bp, Glycine max
  Peptide Sequence Number=SeqID_135632
atggagcacgcgacacgtggcacagcgtggcgcacgaggcagcagcagggtagcgacccaggcgactatgcgcctgggtcgtgcccgcgtcagaggcactaccagtcgagaccacgcactgggcactaccagtcgcgcccacgcactgggcactaccagtcgcgcccacgcactgggcactaccagtcgcgcccagcggcagggcgctaccagacgtgcccgcgtcaggggcgctaccctgctgctgcctcgtgcgccgcgctgtgtcacgtgtcgcgtgttccatggaagcgccttcctgggggcgctttgtaa

SEQ ID NO: 18855 - DNA, 384 bp, Glycine max
  Peptide Sequence Number=SeqID_135633
atgtttgacgaggacaccagcaatcatcgaaatggatcaaggatatttgggcctcaattcttagcatccaacttataccaactatgtccacccgaggacttgaccctagcaatgtcactgttgagacctactcgcatttatggtgatgaagaactgatgcgtgagaatacaagactcacaaaagacaaatatggaactgtggccaaagtctatatagtgtgtgagcaagacaacgagttaaagcaagattttcaactgtcaatgattgaacgaaaccctcataatgaagtcaaagagattgttggtgctgatcacgtgcccatgttctctaaaccgcaagagcttttctcttaccttcatgagatcgccaacacctattactag

SEQ ID NO: 18856 - DNA, 783 bp, Glycine max
  Peptide Sequence Number=SeqID_135634
atgtttctcctaaggtcacattctataattgagaaaaggggttacttagagagagagagagataatgggtctcatttcaatgcaattcaggttctgaaaaccaaagcttttcataggaaaagttgtgctaagatgccggggaaagctgacactgatgattggcgagtagagcggggtgagcagattcagtttcagtcttccatttactctcatcatcagccttggcggtgtggagtgggggaaaatgcctctaaatcatcttcagctgatcagttaaatggttcaatcgtgaatggtatcacgcggtctgagaccaatgataagtcaggtgaaggtgttgccaaagaataccaaaacatcaaacatgccgtgttgtcaaccccatttaccatggacaaacatcttgctccaaatccccagatggaacttgttggtcattcagttgttttaacatctccttattcagatgcacagcatggtcaaatcttgactacttacgggcaacaagttatgtatttctttataagattgattgtttcagaggaggatgccagattggcacttgatgtgacgcagtataagataaaccctcaattgtacggaatgtatcatgctagaatgcctttgccacctgaaatggaagaggagcctgtttatgtcaatgcaaagcagtatcatggtattttgaggcgaagacagtcacgtgctaaggctgagcttgaaaagaaagaaggggattatacagctaagaggaagggattaaatatcctgaaaaagaattag

SEQ ID NO: 18857 - DNA, 1575 bp, Glycine max
  Peptide Sequence Number=SeqID_135635
atgggggatgatggaaagaagattagtggagagggggggttagtgaaggttgagccaaaacccagcaatggtttcacctcaaaagtggttgatttgttggagaaattggtggtgaagttcttgtatgattcttcactgccccatcactacctcactggtaattttgctcccgtgagtgagacccctccaaccaaggaccttcctgtcaaagggtaccttccggattgcttgaatggggagtttgtcagagttgggcctaatccgaagtttgctcctgtagctggatatcactggtttggtattgatatgcatgcttttaagtttatatctattaaaaaatgtgttcttcaactggactttgaagcttaccaggctttacctgactgtttttgtaggtttgatggagatggaatgattcatggcttgcgcatcaaagatggaaaagctacatatgtttcccgttttgtgagaacttctcgccttaaacaagaagaatactttggaggctccaaatttatgaagattggagatctcaaaggtctattcggacttttaatggttaacatacatatgctgagaactaaatggaaagtgctggatgcttcttatggaactggaacagctaatactgctctcgtatatcaccatgggaaacttctagcactctcagaagcagataaaccctatgctattaaagtttttgaagatggtgatttgcagacacttggcatgctagattatgacaagagattgggccactccttcactgctcatccaaaagttgacccatttactggggagatgtttacatttggctatgcgcatacaccaccatatatcacatacagagtaatttcaaaggatggttatatgcatgatcctgccaaaggtattccaggtgtttctgttcttatattctggcaaaagcttatattccaggaaatggtgaagaataagacactgatattctcatttgattcaaccaagaaagctcgttttggtgtgctacctcggtatgctaaggatgaaaagcttattagatggtttgagttacccaactgcttcatattccacaatgccaatgcttgggaggaggaagatgaagttgttctgatcacatgccgccttcagaatccaaatttggatttggtcggtgggactgccaaggaaaagcttgaaaatttctcaaatgagctgtatgaaatgagatttaacatgaaaacgggtgaagcttctcaaaagaaactatcagcatctgctgtagattttcctagggtgaatgagagctacactggaaggaagcagcgatatgtatacggaaccacattagacagcattgcaaaagttactggcattattaaatttgatttgcatgctgaaccggataatggaaaaacaaaacttgaagtaggaggaaatgttcagggtctctatgacttgggaccagggaagtatggctcggaagctgtttatgtccctcgtgtccctggtaccgattctgaagaagatgatggatacttgatttgttttgtacacgatgaaaataccgggtattgctttcctccacacacttga

SEQ ID NO: 18858 - DNA, 978 bp, Glycine max
  Peptide Sequence Number=SeqID_135636
atgaccaccttgggaattatctccacggaggccattgcctccctcacccagtattatgaccagcctttgaggtgcttcacctttggggacttccagttaacacccacggtggaagagtttgaagagatcctaggatgccctttgggaggaaggaaaccgtatcttttctcaggtaccaaggaaatgtttggaagcaaaggcgagagccttggcaagtcaagacaaatgggctccattggtggacgtcctggtgctcttgatcttcggagtggtcctctttctaaacgtgagacacgtttgcccgctagaaggccactgctcatgcaccgagaagaaggaggcaaactgggaccgactcttagcaagcaaagaagaaccgtctgtcagttggttccccgatggaaagaaggaagaatcgggattcttattttatgcggaggatttccaaatgttccgttgatggggacaaggggttgcattaattacaatcccgtcctcaccataagacaacttggctaccctatgaggggggcaccattagaggaaggcctcacaccttttattgcgcaaggtttcaatagcaccaacacgggggtgcttcagggggtccgcaaggcatgggaaatggtgcaaaagaaggacaaagaacttaggggaagtagcaacgggcccatcagcggttaccataagtggttgaaagcctacgcacaaggtctggattggctcccgaatttgagagccactaaagaggtggagggtgaagctccgaaagaagacaaagagttacaagccctcaaaataaagcttgagaaagcccaagcagtaaaagaaaaattcaagtcagcagccgttaggatccgaaaagagaacgccgaactgagagacgtcaacatagccacaaccaaggccttggagcaaaagaccaagagggcccgcaaggaagaacatggttggaacaagttccaaggggctctgtga

SEQ ID NO: 18859 - DNA, 414 bp, Glycine max
  Peptide Sequence Number=SeqID_135637
atgtttttgtttccaccaaaacagaaaaaggtaacagaagaagacaacgaagttgtacggcatctaagacagcctggacctttaccccctctctcaacaacagttctcaacttgggccatggggctggtttattttgtgtaaccaatagccatattaacaactcatctcttagtcaagatagaataagaatgaacaagataaaaagaacaagtggttacaatcatagagatgatgataccggtagactgatagtgacaacgggagcaattgtagcagaggcacatataattgaggctcactctgatgatgcggatgctcctgccaacagccaaatgtcatttgaaaatctctttccaccccatttgatctctattcgtctcatccatcattttctccacttctcctgctcatag

SEQ ID NO: 18860 - DNA, 327 bp, Glycine max
  Peptide Sequence Number=SeqID_135638
atgggtgcagcggattgttctgcacgaattcagaggaagccagagttcgagttcagatcggcgattttcgccagcgacgttgaaatcgggaaggggaaggtggaggagactcacctggtgaccgacgacggcgacgcagacaatcatcttgttctccggcggtgtgccgacgccgatcagggtctagctcggtttcgctgcacccgcacccaccgaatcaatggactgaaaggaaaggctcgtaagaggaggaagcaacccgccgcagtaggcagtgttctggtgtgcatgggtctactggaattaaatttagaacgcattatgtga

SEQ ID NO: 18861 - DNA, 264 bp, Glycine max
  Peptide Sequence Number=SeqID_135639
atgttaggaaaaccaaaaagaggtctgcgaattttgaaaataagggttcgggagttgtttacgcatagggaaggtattagcaccctatgtgatgagaatcctgaaactggccaaatacaggctaaaggcccaagtaatccttgtggcgtctaccctgacttatcttccttcactggaagtggtgtctaccctgacttatcttccttcactggaagtggtgtcatccaaatcctcgttgcctgtatcaaacattctgccccgtaa

SEQ ID NO: 18862 - DNA, 348 bp, Glycine max
  Peptide Sequence Number=SeqID_135640
atgggtactcttccaattggcattaggaagaattggctaacatactttaagtatgaagaagtaagggacacaccaagagaaacaagaaacattcttttgataatcttcactttggttgcagtagtgacatttcaagctggagtgaatcctcctggtggagtttggcaagagaataaggatggacacttgcaagaagagcaatatatgcttcagatgagcatgcttactatgtcttcctcatcttcaattctttggccttttttaattccatctttgttattttgttactcactcacaagtttcctttccattttgagatatgggctgccactgtttccatggctatga

SEQ ID NO: 18863 - DNA, 390 bp, Glycine max
  Peptide Sequence Number=SeqID_135641
atgtcatcgggcccaccgcctctggatgacaaaggtgcagatgaccataatttgtctctgcctgtcaacgagctcgcttgcctctggttgacaaaaggacgacaaaaggtgcaggagatgatgttagtctctgtgcgtcaacgggctcgtttgcccctagttgacaaatggtgcaggaccataaggttcccccgcatgtcacctgacttcacgggtcaggacgacaaaagagatagcaaaagaatgtttacgggttaccgtcaggtgtcttcgcatgccaccggactcttgggtcacggtaacaaaggtggggtggttgacaaaagtagggcttttgctcctacgtatcctcaatttgtgatgaggaactcagacctacgtagttcttga

SEQ ID NO: 18864 - DNA, 3057 bp, Glycine max
  Peptide Sequence Number=SeqID_135642
atgtctctcaacaagcaaccaagaatcgtaggaactcgtgtaggaatccgtgggtttgatgtcggtgcttacctttcggagtttgaagaccttgtgaatcgtatcattaggttgccgccaccattccttttgagctgtttcatttttgggctgtcaccggaaattcgtcgggagatccaggctctgcaaccgttgatgttggtgcaagcaactgggttagctcggctccaggaagagaaattccttgacactcgtcggcccttccgtgatgatgatgagggtggcctcgcatcggaccctaatatagacccattgcccaaaccgcctgatggttatcaccaagtagtgatcctggttgatgggggcagtacccacaacttcatactggaacacttggtccatcaattgggcttaccaacgcaaaccacaactcctctcaatgtcatggtgggtaatggacaccaccttgattgtcgccatgtctgtgcaacacttgccgttcatattaaggacattgttttcaatattgacctgcatgtcctacccttgtgtggtgctcacatcgtattagatgttcaatggcttaaatctcttgggtcggtgctaactgattataacgacttatccatgaaattctctcgcgacggacgtgttattgaatttaaaggtgatattgcttccaacctttccctccttacaccaccccaactccgccgtctagtgcacaagagcggagccagtgccttatttcacattcgcatcctttccactgagcttccttccaaccaggcctcacccacccaattgttgtcgggaattcaaaccttaatcactaaattcaactctccgtttcaacaaccaactaccttacctccttcccgacctaccaatcaccacatacacctttttcccaactcgaacccagtgaatgtccgtccgtaccgttatccatatttccaaaaacaagagattgaggctcaagtatattcaatgttacaacgaggggttattcgtcctagtaccagcttgttctcctcaccagtattgcttgttaagaagcatgatggcacctggagattttttgtcgactatcaagctttgaacgcaatcacgataaaagatcattttccgatcctaaccattgacgaacttctcgacgaacttggcggatcacagtggtttactaagctcgaccttttgcaaggttaccaccagatcttgatgcatgaggatgatattatcaagactgccttcaaaacttatcacggtcactatgagttcaccgtgatgccgtttggcttgtgtaatgcaccttcgtcgtttcaggcgacaatgaactccctcttccgcccataccttcgtcgtttcatcattggtcaattcttcattaagctctcgaaatgttccttcgcccaaacccaggtggagtacttgggccactggtgtccaacaaaggggtcgaaccagtccagcaggagatccaagccatacagcaatggccaataccacgctcttcacgagggctctgctcaaactgcttttgatacattaaagattgcattgacttcggcaccggtattgcttctccttgacttcactatcctatttatagtggagatggacgcctctaggactggcatgggtgcgagaattattcgccattactacggcggtcaaaaaatggcgtcattacctcttgggtcaccaattcacaatcattaccgatcatcgaagtctaaaggagttgttaactcaagtggtccaaactttagagcagcaaatgtatccaatctgcctcatggggctttcgttcaactacaacaagctattctcgccgaaccgacaacatatcctgatcactctgtcattcaggacctaatcttaaagaatggttgcatttggttaccctctgggttctccttcatccccacattattgctagaatatcattcctccccaaccgacgctcatataggggtgactaagaccatggcgcgcttaagtgaaaacttcacttggataggaatccgaaaagatgtcgagcaatttgttgcagcatgcttagattgtcagtacactaaatacgaagcacaaaaaatggcggggttgttgtgcccattaccggtaccgtgcagaccctgggaagacctttccttcaatttcattatcggcttgtcagagtttcgcggttacaccgccattctggtagttgttggccgtttctccaaggggattcacttagggatgcttccaacttgccacacagttgtcgtgcttttcattgagattgttagaaaaattcatggcatgcctcgtagcctggtttcagaccgggaccccttgttcatcagccaattctggcgagagttgttccggctaagcgacactcgcttgcgtatgagctctgtttatcagccacaaacagatggacaaaccgaagtgcttaaccacatcattgaacagtcactacgtgccttcgttcacaacaaaccatctacatggggaaagttcttaagctgggttgagtggtcatataatacgtcatgtcactcaagctctggcatgtcaccttacaaaattacttttggcaagaaacctttcaatattctacaatatcttgcgggaacatctgtcgtagctgccaatgatgacatgttgacgaacatggaagctgtttctgcagaagttcgaaagaagctcttgaaggctcaagctctcatgaaacaaaatgctgacaagaaaataaaggatgccaatttgaaggaaggagttattggattgagtaggtttctgagtggtggttgtgcgtgtgacaacaccgagccaggagcggcacgtgcagtgcattccctgatcaatgcttgcatagagagtggtcaagtgattgccacatcccccccacagaacctccatggagcatatattgcattcgacgactgcaatgatgccacgtccttaggaataatcgctcgagaaaaaacatcactctcacttcttgtcctcggtctctttcatttgttgctagaccttgtacctagtaatttctcacagctttga

SEQ ID NO: 18865 - DNA, 1428 bp, Glycine max
  Peptide Sequence Number=SeqID_135643
atggcggaagaagctccagcatctgaaacctccgtcacaatgcctcaaccgtcggaggttatcaccgtcgacggcaccctaaactcttccgagaacgacaagagcggaatctccgtcgatgcggccgcgcacagcggtgaagagacggtgtctaacgctgaagcttccggtagcgatcctcagaagtctctggagttggcgaatgagctgatggaaaaaggaaacaaggcaattaaggaaaacgattttggagaagcagctgataactttagccgtgctctcgaaatcagagtggcgcattatggtgaacttgctcctgagtgtgtgcacacatactacaaatatgggtgtgctcttttgtacaaggctcaggaggaagctgatccattggctgatgtgcccaagaaggaggatggatctcaacatggctccaacaaagatggttctgtgaagagttctttgaatgctgaatcttccactgcttctttttcaagcaatgccgagcaggatgtgacttcaaatgaccagggtggagcagtggatgatgggtccactaagaatgaccaggaagaagatgatgaggatagtgatgctgaagacttggcagaagctgatgaagatgagactgacctggacctggcatggaaaatgcttgatattgccagagccattgttgaaaagcaatctgtcaatacaatagaacaagtggacatattatcaacattggcagatgttgcattggaaagagaggattttgaaacttccctctcggattatcagaaggcactaaccatcttggaacaactagttgaaccagatgatagaaaaattgctgacttgtatcctttgtataattcttatctagatgttagttctaagcctcaagaagcaattgcttactgccagaaggctacatctgtttgtaaggcacgattacatcgtcttacaaatgaagtaaagagttgttcagatttgacatctgcttctgagttagctcaggatgttccagcatgtcccaaatctgagtctaataactcaattttggataaacaatcagagattgaaactctcaaaggtctatcaagtgagctggaaaagaagcttgaagatttgcaacagttagtgtcgaacccaaagtcaattcttgctgagatcctaggaatagcagctgccaaggcaggcaatgtgaaggaatcatcttcagcaatggtgagttcctcacagttggctactgccaacggcagtggaggttttgattctccaaccatttcaactgcccacaccaatggatctggtggagtcacacaccttggtgtggtgggaagaggagttaagcgagcatcaaatgccactccggcagaaggaagcacaccaaagaaaccaggattggaatctactgaagacaaagatgatggcaactcacactga

SEQ ID NO: 18866 - DNA, 210 bp, Glycine max
  Peptide Sequence Number=SeqID_135644
atgacagtgaaaaaacaaggttttggaaagaagctacaaagccacttttcggagaattaccttgtgtggacaaagataaaaagttttaggacagcacatggacagttggggaatgaacaacaaagaagccaaatacgtgattcgcatgagccggcaacggtggttgacacacgcgagggcaggccgcaccgtcgtccgcatcgtgaatag

SEQ ID NO: 18867 - DNA, 1554 bp, Glycine max
  Peptide Sequence Number=SeqID_135645
atggcaacaggggcacaactgagctcgagagggcaagcatggttttgcacaattggattgccaagtgacattgtgattgaagtggatgacatggacttccatcttcacaagactttcccgcacggctcctacacctttgaattagccgcgaaattctgtttcggcgtcaaaatcgctttatcctcttccaatgtggttcctttgtgctgcggcgaagagtttctcgagatgacggaacaacactccaaagaaaacctcatctccaagacgaagacctttctctctcactccgtgctcaacaacatcaaggactccattaggtgtgtcgattccatcatctccgaaacattgttcaggtggccggtgagcgattccgcttccacgttactcctcctccacaccaacggaagaagaagcagaagaaacagtgaagatggttcttggtttgaggagcttacgcttctaggtttacctgtgttcaagcaattaattctcgccatgaaaggatctgagttgaagccagagataatcgaaacctgctttatgcaatacacaaagaaacacattccaggtttatcgaggtccaatcggaaagccttggcattatcttcttcagaaacggaacagaaagagctactcgagattgtgatattgaacctttcattgaagcactctacgcctttgaggtttctctttagactgttacgaaccgccaccgtattgattgcttccgaggcatgcagaaacgtgatggagaaaaagataggttcgcagctcgatgaagttactgtagatgaccttctcatacctagctattcctatctaaacgaaactctatatgatattgattgtgtggcgaggattttaggttattttttgcaaaaagaacgaaacgttgctgcagtcgacggcctcgctccgagatcggcgacgctgatgctagttggaaaactcatcgacggttatctcttggagatcgctttcgatgcgaatctgaagccgtcgaaattctacgattttgccatctcagttcctgatctagcgagacgtttcacgacggctcattcgtgggtttcgaaatcggatagggagaagattagtagagtgtttgactgccagaagcgtaagctagaggcgtgcatgcatgctgcacagaatgaaagacttccactgcgagcagtggttcaggtgctcttcttcgagcagcttcaactgcgacacgccatcgccggaatgctggtggtagcaaaggagccggcgtgccattcggcgacgatggcggaggaagaggagatggaggatgatagtggaacggggaagcgtgcacgtggcaggaggtgggtgcatgagctagaatgcgagtgctcctcaatgaaacgagtaattgagaagatgagcccacgagatggtgggccttggcgggcctcgctcgctcttggaaggaagttcggttgcaagttcaaaacacagataaatgagttattcccgcctggatctggcttcttgcctaaatcaaagcatcaaagcaagtgtcttcttccacaagctaaatga

SEQ ID NO: 18868 - DNA, 276 bp, Glycine max
  Peptide Sequence Number=SeqID_135646
atgtcaacgaaggtactgataagaataacagtgagctcgcagcagggtttgaaatccttgataaggcatcgacgaccacgttggatttgctacacaaaggagtttggggctgaattgtttactgaaaaggcgatggggtgcccgttttgggagagaaccgcacccatgccagtcctagaggcgtccatctccactataaataggatagtgaagtcaaggagaagcaataccggtgccgaagtcaatgcaatctttaatgtatcaaaagcagtttga

SEQ ID NO: 18869 - DNA, 417 bp, Glycine max
  Peptide Sequence Number=SeqID_135647
atgcgtacctccgacgaaataggaagaacaacgactaacaaaacttcaaatacagaacacctgcttcacggggaccaccaaatcttcaaatacttcacgggaccaccaatggaaagcaacatcaagaaaacgaaagaaagcaaagaaggaagaaggcgtataaaaggatatcttccagaaaaagcttcttctggaaacattccggatgacgttcttctggaaagagtttctgagtacttccggaatcacgaattcttcttccggaagaaggttctttcgaaaagtttccgaaaaaggagtcttccggaaaaaggttcttcaggaaatggttttcccggaagagcattttcgccacttcactacttgttgggtgccccaacaataatgctgggtgcacgtagcaactccctcaaataa

SEQ ID NO: 18870 - DNA, 2004 bp, Glycine max
  Peptide Sequence Number=SeqID_135648
atgttctccgctttgaaactgaaacctgcgagcgttggttcccgccttttttgtgttggctctctacaaacacaaatcaacaaaaccatatggcaccagttgaagtcacccactcaccaaacccttcaccatctcttggaccaatgttcctccatgaaacgactcaagcttgtccatgcccagatcattctccatggacttgcagcccaagttgtcacactgggcaagctactctctctctgcgttcaagagggtgatctccgttacgcacaccttctgttcgatcaaattccccaacccaataaattcatgtacaatcatttaataaggggctattcgaatagtaatgacccaatgaaatctttgttgctcttccgccagatggtgagtgctggccctatgccaaaccaattcaccttcccctttgtccttaaagcttgtgctgccaaacccttctattgggaagctgttattgttcatgctcaggctattaagctcggaatggggcctcatgcctgcgtgcaaaacgcaattttgacagcatatgttgcttgtcgtctcatactaagtgcacggcaagtgtttgatgatatttctgacaggactattgtctcgtggaattccatgattgctgggtattctaaaatgggcttttgcgatgaagccattttgttgtttcaagaaatgctacagctcggagtggaggctgatgtgttcaccttggttagcttgctttccgcttcctcaaagcattgtaatttggatttgggaagatttgtgcatctttatattgttattactggagttgaaattgattcaattgtcaccaatgccctcatagatatgtatgccaagtgcgggcatttgcaatttgctaaacatgtttttgatcaaatgctcgataaagatgttgtttcttggactagtatggttaatgcttatgctaatcaagggctcgttgagaatgctgtgcaaatttttaatcacatgccggtgaagaatgtggtttcttggaattcaataatttgctgccttgttcaagaagggcagtacacagaagctgtggaacttttccacaggatgtgcatttcaggtgtgatgcctgacgatgcaactcttgttagcattctttcatgctgcagtaacacgggcgatctggcattgggaaaacaagcccactgttatatttgtgataatattattacagtgagtgtgacactttgtaactccctaatagacatgtatgcaaaatgtggtgctcttcagactgccattgacatcttctttgggatgcctgagaagaatgtggtgtcttggaatgttattattggagcacttgctctgcatggttttggagaagaggcaattgagatgttcaagagcatgcaagctagtggactctatcctgatgagattaccttcacagggttactttctgcttgtagtcacagtggtcttgtggacatgggacgatattactttgacataatgatttctacttttaggatttctcctggtgtggaacattatgcatgcatggttgatcttttagggcgtggggggttcctaggagaagcaatgaccctaatacaaaagatgcccgttaaaccagatgttgtcgtttggggtgctttgcttggtgcttgcaggatctatgggaatctggagattgctaagcaaatcatgaagcagttgctagagttaggacgattcaattctgggctttatgtgcttctctcaaacatgtattcagaatctcaaagatgggatgacatgaaaaagatcaggaaaataatggatgacagtgggataaaaaagtgtagggcgattagcttcattgaaatcgatggctgttgctatcaattcatggtggatgacaaaaggcattgtgcttcaactggtatatactccatattggatcaattaatggatcatctaaagtctgtaggatatccatgtaaatcttctgaggtggaggaaatttactactctagcaatatttaa

SEQ ID NO: 18871 - DNA, 544 bp, Glycine max
  Peptide Sequence Number=SeqID_135649
gaatttacaagatagtggaactctcaagcgggttgcttggggacttgacgtaggcacaagggagtcgaagtggaacgagatccaagcatgccggggtcagacagaatgtccagagcgtattttcgttagcataagtgaataccgcgatgagaacaagaaacttcaagtccaaggaagaactttaaggaatgttgaaggcgacaaacaagatgaggattatccacagaaagaccctaaggaatgtgcatttagggcgaggagtaaacgcacagtggtgagttttgctaccggagagaaggtgtctagaaagtccaaaccttccatttgggtataccctttcgcgactaggcgtaagagtccaagtttggttctgttgaagagcatgataccgaacatttggcaaggtggtaacagtgagcgaagtgagatcatgatgatagtcttagagtcgtgggcagttgaagtaggggatgggtttatagtgggtgctataggaacttcaaaattttctttgttgcttgagaatggtgccggggaaagggag

SEQ ID NO: 18872 - DNA, 1353 bp, Glycine max
  Peptide Sequence Number=SeqID_135650
atggccaccccactcatcgatccaagccaagactcaaccaaccctctttgggaagaattagccggttacaaaccaaccttctcatgcacttgcgaaggtcaaattcttctctctgatcctttgccttcaattggtaatgttttctcactaattcttcaagaagaagctcaaagggaaatcgtggtcactcactcacccaccaatgctttagacaatatagctttttctgttaattctgcatcaaagaaccaatatgacaacactaaagggaaatacatcaagaaagaaagacctaaatgtgctcactgtgatatgttggggcacacgaaggacaaatgctacaagcttgtgggttacccaccaaattacttcaaaaatcataccaacaactcggcaagacttgtagtgcgtggtttcacacaacaatatggcctagatttcaaagagaacttttcccctgtggctaagattactactctcagactccttttgtctcttgctgcttcccagcattggcacctagctcagctagatgtgaacaatgcattccttaatggtagcttggatgaagaaatctacatgcaaatccctcaaggctacaaccatcaagcttcaagaagctggttcaataagtttggcaccacattgacctctcaaaaatacattcagtcaaagcatgattacaccttgttcaccaaaggaacatgttcatcattcatagccattatggtctatgttgatgacattgtcattgccagcccggctaaaacagctattcactctgcaaaagacactggaatgcttgcttgtaagccatctgcagttcctatggcagctgatctaaaattgaatgcagaatcaggctcacaacttccagatctagaagcttatagaagactaattggaaaacttctctacctaaccatctcaaggcttgatatttgttacactgttcacaaactaagccagtttgtatctgatcctcgctcaggacacatgaatgctgccaacatcctgctaagataccttaagcacacaactggacaaggggtcctctttaagaccaaatcagacacatcactccatgcttatgtagatgcagattgggttgtctactgtgacaacaaagaagcaatctacattgctacaaaccccacataccatgaaagaaccaagcacttagagattgatttacattatgtcagagaacaagttgataaaggagcactaaagctgattcatgtcaggaaatatcatcaactagcagatgttttcacaaaatctttgcctcgaagtgcttttctcagcataatttccaagttgggtatcgagaatatctttctcccatcttga

SEQ ID NO: 18873 - DNA, 231 bp, Glycine max
  Peptide Sequence Number=SeqID_135651
atggatcttttggaagaggaaagatgtttgagtgatgtggaaatagctagaaaggttcacctacaagaggaattttggagacttgctaaacttaatgagtccttcctgatccaaaaatctagagcttcttgggctaatgaaggtgattgtaagtctaagctctttcactcaatcattaattggaggaggaggaaaaatagtctcaaaggtctcaatgtcaaaggttcttag

SEQ ID NO: 18874 - DNA, 468 bp, Glycine max
  Peptide Sequence Number=SeqID_135652
atgggaaactgcagctcctccgattcgactcaggttgccacggcgaagcttgtgctgcaagacgggaggctgcaggagttctcgtacccggttaaggtttcgttcctcttgcagaagtatcccgcgtgcttcatatgcaactccgacgaaatggaattcggcgacgtcgtttccgccatcgacgaggaccaagttctgcaacccggtcagctctatttcgcgcttccgttgagccgcttgaggcaccccttgcagccgcacgagatggccgcattggccgtcaaggccagctccgcgctcatgaaaactgccgacaaatgcggctctcgccggaaacagattttgttctctaacgaatatgactctaaccctaagcgcgtgtctcccgcactcgctgctggcggtggaagaggaaggaccaccgctggtgccggtgagcttgttttaggaaacaatggaagcgattag

SEQ ID NO: 18875 - DNA, 798 bp, Glycine max
  Peptide Sequence Number=SeqID_135653
atggaaagctatttgtatcttcatccaagcgaaagctcaattgtggctcttgtctctccagctttggattccaacaattatcattcatggagcaggtccatgataacagtattaagtgccaaaaataaggtagaatttgtgaatggaaatgcaccagaaccattgaagactgatcgaatgtatggagcatggtgccgctgtaataacatggtagtgtcttggatcgttcattcgggggatctcttgaggatttccgaccttcagcaagaagcatcatcgatgaagcaagacccgatcccacctgttcttgcaccattaagtgcacttgttcaattcttaccaccattgcacaacttatcaggtaacaattctttgacaagcatcagccttgaatccaaagagagttctaccaatgttgttaaaactgtttgtgagttttgtggacgtgttggacacattgaaagtgttttctacaagaagcatggtgtaccttccagttatgacgggaaaaacaaaggatacaatataaaaaatggaaagacatgcacccattgcggaagaagtgatcacaccgttgatgtgtgctataggaaacttggatttcctacaggatacgtgtttaacaatggaaatacaacaacaattagcatagtggcagtggaaagcaaagccacagatgaccaaattcagcgctatgagtctcaagaagtggttaatttctcacccgagcagtacaaagcgttgcttgctttaatccgacaaccatcttcagggaactcagtacctacccaatctcag

SEQ ID NO: 18876 - DNA, 639 bp, Glycine max
  Peptide Sequence Number=SeqID_135654
atgatgttatttgcgcattacaacatcgtttttggaacaccgttgttgaactgcattattcaaggacacggtggtaatattagtgttccagaatcaaaacttgtttcatccaccactctctcattctctctccttcgccctcgatcccttcctttttccctcaaattccacgcctccttctccttgaagtccccgacctccaccttttgcgccttctccgacgccgaggaggacgaagaagacgatgaagaagaagaccaagaccaagacaacgtttctgccgacgaatacgacgacgtttcgggtgaggctgacgtgttcgctcggcatggtggattcaagtggcagagagtcgacaagctatgcaacgaggttgggttgagactgctcctttcacccgttacttccaaccttcttctccgcacagcatgttgttctatagggcttgcgcttcccgtgtattccacgtttaaagctattgagaacaatgacccatatgagcaacaaaggtgcttattgtattgggcaggattacaaaagcttgctttgttaaatttggaagggtgccaggtctatgctgaaggacctgctcggcctactggtggagccgctgctgttgccatgctaattggtccctga

SEQ ID NO: 18877 - DNA, 219 bp, Glycine max
  Peptide Sequence Number=SeqID_135655
atggtgttggagactgaggagtcttttgggagaaaacaaagaggcaccagcggtacaaggtacaaaattcagcctatagctaccaagccgaacgacatctatacaagtagcaaggtatcacagggggtctcttcctgtatggatgccgtcagaagttcagccattgcagatggcgagaacgatgctgagctggaggatgcacgttggtgtcgccactga

SEQ ID NO: 18878 - DNA, 513 bp, Glycine max
  Peptide Sequence Number=SeqID_135656
atgtcattttccaaacaattagttgaacttcaagtcccaaaacaattaaggcagcttccaacaataggattgtacaacggatcctttgatttaaacgatcacttgtggaggtttgaatcggcattagcatacataggaacctctgcttctataatgtgtcatgcatctccactatcactgaaatccactatgttgaagcggtttcaatctcttccgttgagattcatcaattcatggctagatttaagagaaaaatttaggtttgccttcgcaactagcaaggaaagaccaaagatagaagtcaacctaaggttgatccagcaaggacttggggaacctctcaatggatacatcttgcgattcaacaaagaggcaagagtcatggaacaaccaggagttgtgttgatgttggctaaagacagtgtgtgggaaggatcctttcttcatattcatcacaaaaacgccacctatcactttggaggaattcttgaaaaaggcggagaaatatattaa

SEQ ID NO: 18879 - DNA, 1650 bp, Glycine max
  Peptide Sequence Number=SeqID_135657
atggcggttgaaggcgtaggagaaaatagaatgctgagactgaaatttactccaaggcacaaacgttcaaagagttttcctgataagaaaagaattgaggaggataaaccagataatcgcattcaggcctcaggtcgaattaaggtggacatgggatacctcgcggaatgtgataaagctaggaaaaaccgaagccctacaaatgaagtccacagtactccgaagcaagagattctacagcttgagagaagattacaagaccaatttcaggtcagatccacgttagaaaaggcacttggattcagatcttcatctctcgttaattcaaatgagatgatgatacccaagccagccacagaattaattagggaaattgcagtgttagagttggaagttgtgtatttggagcaacaccttctctccttgtaccgtaaagcttttgatcaacaattatcttctgtatctccgacttctaaggaggaaagtgtaaagttccctctaacaacacatagcgcacgattcatcaatttttctatgcctgaggtcttaaccaagagagaatgttctacagtacaatctaatgagcataataagcttgagactttgagaaaggagtatgacagatatgagcctgagacttttaggaaagaacagagtagagatctgctagaagaaaagcatttagattctggagtttaccgttgtcattcctctttatcccattgtccagcatttacaagagaatctcctccagcagattctttagctaaatctctgcgtgcctgtcattcccagccgttgtccatgttagagtatgctcaaagctcctcatcaaacataatcagtctcgccgaacatcttggtacacgaatatctgatcatgttccagtggcacctaataaactttctgaggatatggtcaaatgcatatcagctatatattgcaagcttgcagaccctcctatggcacaaccaggactttcatctccaagttcatccttgtcctcggcaagtgccttttccattggagatcaaggtgaaatgtggagtccaaggttcaggaataattcctcttttgaagtgcgcttagataatcctttccacgtggaaggacttaaggagtttagtgggccatatagcaccatggttgaagtatcatggctttatagagagagtcagaagtcggctgatactgagaagctgctccagaatttcaggtcacttatttgtcgattagaagaagtagaccccggcaggttgaaacacgaggagaagatagctttttggatcaacatacacaatgctttagtgatgcatgcatttttggcttatgggattccacaaaacaatgtgaaaagagtctttcttctattgaaggctgcatataatgttgggggtcatacaattagtgcagacacaatacagaatacaatactaaagtgccggatgtctcgcccgggacagtggctgcgcttgttattttctcaaaggtcaaaattcaaagctggagatagacgacaagcctatgcactggagcaagctgaacctctttcacactttgcactctgttcaggaaaccattctgatcctgcggtattccctcaattctcattggcgagcaatttcgttactcattttcgcaaagcttga

SEQ ID NO: 18880 - DNA, 726 bp, Glycine max
  Peptide Sequence Number=SeqID_135658
atggctaaacctcaagtaaatggtttaggacttttgaatatgcaaacaaaaacactgaattggccaaatcttaatccaagagagagatcactaagcacccccagtttcaccttccaaatctctagatatgttttattttatcagtactatacaacggacagagcgagcgagctagataaggtcacatatatgaacaacatgttcggtcaatatcctttgttttcactggcttctctagccacattccttgtcttaacccacgccgccaccgcgccggagaatcctcctcctccgctcacagccgcggcgagggagttcttggaggcgcacaaccaggcaagagccgaagtgggcgtggaagcactcagctggagcgagaagctggggaacgtgtcgagtctgatggtccgttaccagcggaacaagaaggggtgcgagttcgcgaacttaacggcgagcaggtacggcgggaaccagctgtgggcaggggtgacggaggtggcgccgcgcgtggtggtggaggagtgggtgaaggagaagaaattctacgtccgggagaacaacacgtgcgtggggaagcacgagtgcggggtttatacgcaggtggtgtggaggaactcgacggaggtggggtgcgctcaagccgtgtgtgtgaaggagcaggctagcttgaccatttgtttctatgacccacctggcaacgtcattggggagatcccatactga

SEQ ID NO: 18881 - DNA, 846 bp, Glycine max
  Peptide Sequence Number=SeqID_135659
atgcattattggatgagaccttctaaagattgttgggatggtcgttttgttgttaatgaaggaaaaaagaagagttgtcttaagaagaactccgcttctgcgaattccattgttaagttgtttaacaagattggaggccacccctttgctcttaatgttagtaaacattctgttgttgtagggaagctcatggaaaagtcaaaggataagcctatgtcggtagcctctctttatgccgctagtggggtcatcattattgatgatgatgtggagttaaccaactctagtttggtgcctgctaggaagtttgacggtccttttatgtggaggggtaaaagagtatctgactcatgttaccctaagggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtgtatcttttcttgtaaaggagaatgtgaatcaacagaccgagaagcttattaacactaaagcgacttgggaccagtgggaggagaattttaaaaaggttgtcaacgtttctttcaaaaatgccttaaagcaggttgacgatggtgagcttcatcaaactcatcctggagctcctaagatcatgaatgaaaattttgtgggacaggaaactgctgatgtggagactcttgatgaagagatggttgattggtttattaataccccagaggctaactctgatgataagattgtcgaggcttctaacgctaatgctaaccttgagggatctaaaagg

SEQ ID NO: 18882 - DNA, 1197 bp, Glycine max
  Peptide Sequence Number=SeqID_135660
atggaagtgctgccttgttctggtgttcaatatgctggggaatctgattgccctcagcagagttcaggaacagcatttgtataccaggaacaacctaattgccccgaaaatggtgaacatgtcaactttgtagctgctcaactgaatgaatcatcacataagatgcaagggcctcagatagaaagacatttgtcgactaattcagattgccaatgcattggaacttcatgttgtgattgtcaagtggatgaccaacatgaatattgtggttttcatgattttgaagaagacatgattaatgaaccttgcttgacatctgagaactttatctctgttgtggatacaattgaaattgaatcaccaaacaacagtagggaaggagacttgtcatgttccgaacccaagtggctagagggagatgaatctgtggcattgtgggtcaagtggagagggaagtggcaggctggtatccggtgtgcaagggctgactggccattatcaactttgaaagcaaaaccaactcatgacagaaagaaatattttgttatattttttccacacacaagaatttattcttgggcaaacatgctgcttgttagatcaattaatgagtatccccatcctattgcatataagactcatcaggtgggattgaaaatggtaaaagacttaactgttgcacggcgctttataatgcaaaagctagttgttggtttgctgaacatggtcgatcagtttcattttaatgctttgacagaaactgcacgtgatgtgaaggtctggaaggaatttgccatggaggcttctcgttgtaagggttattccaattttggaagaatccttctaaagctgcataaattgctgaatatagttgtctgtgtagatttttctgacccttggcattgttttgctaaaactagcatactgcagcaccatataaatgctgactggttacagcattcttatctctcttgggctgaaagatgtcagagttcaaatagcgctgaatcagtggagctgctgaaggaggtaccttgtgattttgactaccaattcattacagcattcttatccctcttggtctatagttttctctttgtgattgggatgctgaaggagatctatggcttcctaattcttgcactacagcttgtattaggacaccatagctctacacatagtcaatcaaggatgtaa

SEQ ID NO: 18883 - DNA, 3450 bp, Glycine max
  Peptide Sequence Number=SeqID_135661
atgcaatcaacattaggttctgaatggaaaacctggaagcaggatgtgatgaaatggttttctgcaccaccttccttatcgagcagcaaagacacccagcaacagagttctgatgatttgtaccaagcaaaccttcaggtttgtagaaaaaggcccaaacttgaagttcgtcgtgcagatacacatgcttcacaagtggaaatcaaggaccaaactattgctcttgaagctgaccctggcttctttaagaatcaggacacgttgagcacaatagcagctcagtcttgcaaacaggaaggtgttagggaggtgtctatgacaacttcacctagtaatttggcaaataaatggaatgaaattgtagttgaggctaccgcttcggatttcttacatatcaaagaaatggaatcaacacctacaaatgaaatgagtgttgcaaaatctgtagaacctggtagtaagaatcgacaatgtatagcttatattgaagcaaagggaagacagtgtgtgagatgggcaaatgatggtgatgtatactgttgtgtacatttgtcctctcgatttttgggcagctcaacaaaatccgaaaagcctgttccagttgatactccaatgtgtgaaggtacaactgttctgggtactagatgtaagcatcgtgccctacctgactctttattctgtaagaaacacaggccacatgctgaaacagtgcagacctcaaatttaccccagaatacactaaagaggaagcatgaagaaaattatactggttcaaaggacatgtatgcattggtaaatgttgagagtccactgcaagtggatccagtgtcatccattggtggtgattctgtacatgtagaaagcaactttaatgagaagcccaagcattctgaaaatgatcataatgcagtggtgtcaatgcactgtataggttctcctccctatgattacaagaatccttgtagggaaggtcctaaaaggtattgcttgtactgtgaaagacaccttccaagctggcttaagcgtgctagaaatgggaagagtagaatagtatcaaaagaagtgttcacagaacttttgggggaatgtagctcgtgggagcaaaaggtacatcttcataaagcatgtgaacttttttacaggctgttcaaaagcattttatcattaagaaatcctgttcctaaggatgtccaattccagtgggctttgactgaagcctctaaagattccaatgtaggagagttttttacaaagttagttcatagtgaaaaggcgagaatcaagtcaatatggggattcaatgatgacatggatatatcctctatcatggaagaaccacctctcttgccatccactattaatgataactatgatgaggaaaatgccatcaagtgtaagatatgctctgcagaatttcctgatgaccaagcacttggtaaccattggatggacagtcataaaaaggaagcacagtggctgtttagaggctatgcatgtgccatttgtctggattcatttactaacaaaaaactattggaaactcatgttcaggagaggcatcatgtgcaatttgttgaacaatgcatgcttctccaatgcattccttgtgggagtcattttggaaatactgaacaattatggcagcatgttttactagttcaccctgttgattttaaaccatcaacagctcctaagcagcaaaatttttctactggcgaagattctcctgtaaaacatgatcagggaaatttagcccccttggagaataattccgagaatacgggtggtttacggaaatttgtttgcaggttttgtggattgaaatttgatttactacctgacctaggtcgacatcaccaagctgctcatatggggccgaatctggctagcagtcgccctgcaaagaggggagttcgctattatgcatatagattaaaatctggcagacttagccgccctaaatttaaaaaaactttggcagcagcatcatacaggctcagaaataaggctaatgctaatttaaagcgaggcattcaggcatcaaactcacttggcatgggaggaataaccatacaacctcatgttactgaaagtgaaacaacaaatattggtagattggcagaacatcaatgctcagctgtttcaaagattttgttttcagagattcagaaaatgaaacctcggcctaacaatcttgatattttatcaattgctcagtctgcttgctgcaaagttagtcttgcagcctcactagaggagaaatatggaatcttgcctgaaaagctctatttgaaggcagcaaaactttgcagtgagaatagtattttggtaaattggcatcaggaggggtttatttgtcctagagcttgtaatgtatcaaaggatcaagctttgctctctcctttagcttctcttcctaatagttctgtaaggcccaaatctgtgaatttatctgatcctgcaagtgatgagtgggaggtggatgaatttcactgcatcatcaattcgcatactttaaaaataggttcactgccaaaagctgttatcttgtacgatgacattagctttgggaaggaatcagttccagtgagttgtgtggtagatcaagaacttatgcattctcttcatatgaatgggtgtaacagacaaaatataagcccttctatgccttgggagacctttacctatgttacaaagccaatgcttgatcaatcccttagtcttgactcagagagcctgcaactgggatgtgcctgcttatgcagtacttgctgtccggaaacttgtgatcatgtatacctttttggcaatgactatgatgatgcaaaagacatatttgggaaaccaatgcgtggcaggttcccatatgatgagaatggccgaataatcttagaggaaggttatcttgtctatgagtgtaatcatatgtgcagatgcaataaatcctgtccaaacagagtattgcagaatggagtacgagtcaaattggaagtctttaaaacagagaaaaagggatgggcagtaagggctggtgaagctattctacgtggcacatttgtgtgtgaatacattggagaagttttagatgtgcaggaggcacgtgataggcgcaagagatatggcgcagagcattgtagttatttgtatgacatcgatgctcgtgttaatgatatgggcagattgattgaagaacaagctcaatatgtaattgatgctactaagtttggaaatgtctcaagattcatcaatcatagctgctcaccaaatcttgtcaatcaccaagttcttgtagagagcatggattgtgaacgtgcacatattggtttttatgcaagtcgagatattgctttgggtgaagagctaacatatgactatcagtacgagcttatgcctggagaaggatctccttgtctttgcgaatccttgaagtgcaggggacgcctttattag

SEQ ID NO: 18884 - DNA, 561 bp, Glycine max
  Peptide Sequence Number=SeqID_135662
atgtcttcccgaaagtctagtttgaagggatcatttggtcgtagttcccctagctattttgaaaaccgtaggaacactcaagttgttgatggtagaggcgagggcggctggactattcaagacaacgaggacatgactgagaagggaattgagttgtgtcctcaaaggtggttgaatcctcgtttgatggcaattgttccttctaccaatacagattctaatgcccatcctttggcgactgagcctaacaatgaagggatccctagttcgaaagtgattatatgttgtgagtttttgaagtcattagagcaactttactcttatgaggatggactagaacttgctaaggcttcccttttgtacccccaatatatgcatggtagtatggaaaattgtgttgaagttgttaggatggaaagacaacttattggtcttaagggcgacaaggctcctggcttagaggatatcaactgggccgatgagaaaattcatggtattcgttttgttttgactcctatggtccttgaccttttgacccatcaatttccgattactaaggag

SEQ ID NO: 18885 - DNA, 1422 bp, Glycine max
  Peptide Sequence Number=SeqID_135663
ccattccccacaattgagcatgcttatgcacatgttcgaagggaggacacttgtcaaactgtaatgacatctggggcagagaatacaacaagtggtgctggtccatctgatggaggaaagtgcacacattgtggaaatgtcatacatactcatgatacctgtttcaagctacatggatatccagagtggtggcatgagttgcaagctaagaagaagaaaaacaccccgacacttgaggaaggcactagtaaagttgttgcagtcactgtcgagtctcaactctcactttgtcctatgactagttcctctaccttaatgaaaccagacttctcccattcaactctgccacataggacttacattgcgaatgaaaatggagttgcatacccagtcacaggccctggaactgtggcattatcatccccagtctctttatctgacactctccttgttcctacattatctaataaatttatgtttgtgagtcaaataactgaagagctcaattgtgtggtattgatgtattatacttttcgccttcttcaggatgttcttagcaagaagattattcggcgtggtgagtttgttaaccatcatttcaaagcatatttccaacaacatggtctccttcatgagacctcatgcttagaaactccacaacataatggtgtcgctgaacgaaaaaatcgttatattgtgaagacaacacatgctcttcttcttggcacccatgtaccaactcgtcattgggatgatgctgtaactgcagctgtatacctcctcaaccgcatgccctccaaggctatggactacacaaaaaagggctacaaatgtttggaccctaccaccaacaaaacttatattaccatggatgtaactttcctagaatctgaacctttcttttctcctatgttatccaattcagctcttcagggggagtccatgaaaaaagagctaaattggtacttggcggctccatcatcaattgttgaaatgaaacaaattggagagcatgagtctgaagtagaaggagtaatctatgatgaacctatagaaatgcaacatttaaatataattgaagttaagagtgaagaggatccttctactaatgaaggaattgctaatgaaaaaatttccgtcaatgaagattatattgatcaagctaggatagtggaacctttgggtagaagacgtcggaaaaaatggggaaagcggactggttacagtggccgtttccggaagaaccttgaaggctttttccaaaactttcggaagaagttgtttcgaaaaatttccggaagtaaccaagggtcatccggaagaacccttcttccggaaattttccagaacacttcttccggaaattttccagaagaagtagttcttccagaaaatttctggaagaagggttcttctggatga

SEQ ID NO: 18886 - DNA, 2223 bp, Glycine max
  Peptide Sequence Number=SeqID_135664
atgtcccaagattttcaacaaggaatcttcagcttcccgaatgggttggagagaggaagggtgatgagtccgcagcagcagatccggcgggacaaggtaaggttcgaggcggcgccattggtagggatagaggaggaggaaccagtgtacgagaccgccggaatgttgtcggagatgttcaattttccgccggcgacggaattgctggagcagcagcacgccacggcgacgttccgggcggcgaggcaagccggagagtggtacggaaacagacagcagcaacagcaacagatttcaggcattaatgctgactcagcagcagccatgcaactttttctgatgaaccctcaaacgaggtcgccttctcctcctcaaagccacactactccttcttcaactcttcacatgttgcttccaaatccttcttccaattccctccaaggatttactggttcggccgcgggagggtcttttggtcaattcacatgggttcctgagggtgctcaccaacaaggaggcgtggtggaagggcaaggtctttcgttatcgctgtcttcttcgttggaggcagcgaaagccgaggaattgaggatgggcgatagtggttttctatattacaatcaccaacaaggtggtggtggtggtggtggaggtggtggtccttcttcttcttcttcggcggttcagtttcagtacaagaataataatagccatcatcatcaagcattgcatttacaaggggcgatgggacacgacaacaaccaccagggacatgttgggtttgggtcatcctcgttaggtgtagttaatgttctgagaaattcaaagtatgtgaaggctgcacaagagttgctggaagagttttgcagtgttgggaggggtcagtttaagaagagcaagttcaatagacagaattcaaaccctaattcaaatcccggtggtggtggttcttcgccttcatcaaaagatgcgcctcctcctcctcctcctttgtcagcggctgataggattgagcatcagagaaggaaggtggacaggagatacaaccactactgcgagcaaatgcaaatggtagtgaactcatttgacctgatgatgggatttggggcggcagtgccatacacagcactggcgcagaaagcaatgtctcggcatttccggtgtctgaaggaggcgataacagcgcagctgaagcaaagttgtgaagtacttggagacaaagatggggcgggaagctcaggaggtttgaccaagggtgagaccccaaggcttaagatgttagaacaaagcctaagacagcagagagccttccaccagatgggcatgatggaacaagaagcttggagaccccagagaggcttgcctgaacgttctgtcaacattttgagagcctggcttttcgagcattttctccacccaggaacagtaagcagtaatgttgcagtgtccttggatgttgtctcggcagcaaaaaggtggaaaaagatgcacacagcatcatcgatcgatgctttaattacgatgaatatttcttggtatccaagcgatgcagataagcatctgttggcacgacagactggcctatcgcgaaatcaggtatcaaactggttcattaatgccagggttcggttgtggaaacccatggtggaagagatgtaccaacaagaacttaaagaagcagagagtgcagaagagagagaaaaggaccaaagcaacaacattagtggcaaccaagcacaaattccaacaacaccatcagcggccacaacatcaacagcaacagcaacagcgccaccaccaccaccatcaacaacgacaaaaacaacaaaaccgacaggcaaaagatccgataccatcaatgcccccgaaagcgacccttcacagcaccttgcaatgaataacagacaaggcttctcggaaaaccaagcaaagaagtccaccgcatccaccaccaccaccaccatcgcctctgaggtggcgccacccgtgtctcagtgcttcgacgactcagacctgcccgcacacagattaatggcctctgatgacacgtgtcatttggtcacagcagattttgggaccgcatctgcaagtgctgacattggatccacactcattaggtttgggaccacacccggtgacgtgtcactcaccctagggcttcgccacgccgggaacatgcccgagaaatctcctttctctgttagagactttggagccatttaa

SEQ ID NO: 18887 - DNA, 273 bp, Glycine max
  Peptide Sequence Number=SeqID_135665
atgaagagagaagaaaagcaatttagagaagagatgtttaagtttacatgcttcatacgtggttgtcatgatgctagcaaactcttgcaatacaagaaatatggtgatgaagagattggtgcaaagaaaggatatgcttacctctcattctctgatttgtatgggtcatcaattccacgtttatacaactggatgacaagtccactctcaacaagtatagggctcccttcagtagaacaagtatatacttctcatcatcaaggactgtcatga

SEQ ID NO: 18888 - DNA, 866 bp, Glycine max
  Peptide Sequence Number=SeqID_135666
gactacatgtcctcgccttcagagggcagcatgccctcgccttcagaggattgcacgtccttgtcttcagagggctacacgccctcgcctttagagggctacacgccctccctttcagagggctacacgccctccctttcagaggactacacttcctccccttcaaatggctacatgtcctcgccttcagaggactgcatgtcctcactttcagaggactacacgtcctcaccttcagaggactacacgtcctcaccttcagagggctgcacgcccttgccttcagaggactacacgtcctcgccttcagagggctgcacgacctcgccttcagaggactacacgtcctcaccttcataggactacacgtcctcgccttcagagggcagcatgccctcgccttcagaggatttcacgtcctcgtcttccgagggctacacgccctcgccttcagtggaatacatgtcctcaccttcaaaaggctacacgtcctcgcctttagaggattacacgtcctcgcctttagaggactacacgtcctcacctttagagggttgcatgccctcgccttcagaggactgcacgtcctcgtctttagagggctgctcgcccgcgccatcagaggactacaagtccttaagcctcttgagaaagcttctcaaagaagccacgaggaagcttctggaggaagtctcttaatgaagcttctagagaaagctacatggagctgcctcggtaaaaacgctgtccagccttcgttaaccaagcctcttaatgaagcttctggaggaagcctcataatgaagcttctagagaaaactacatggagctgcctcggtaaaaatgctggccagcctttgttaacc

SEQ ID NO: 18889 - DNA, 483 bp, Glycine max
  Peptide Sequence Number=SeqID_135667
atgtgttctaaactttcatttctacagcttttgcctgaatgtgctccacattctgtttcctacattctggagctgttggcattgccacattgtgttggttgccagcttcatcgtgctgaaagccgaggaagcttttgggattcagaaggaaaccacattaaaaaggctccatatggtcctcctttcgcacttattcaaggaacattggaatcctatgggtctatgttcaaggatattcctaaagagcactgtcctaccataagaagaggatctgttgcatgggttggttctggtccagaattcttcatcagcctcgccgatcacggggaatggagaaatgcatacactgtgtttggttctgttctatctgaagatatggaaattttagagaaaattgctcagcttccaactaaatcagaaatttggaatatattaaagtttctgtcttggagaacccagtttcattacggtttcggagaatga

SEQ ID NO: 18890 - DNA, 627 bp, Glycine max
  Peptide Sequence Number=SeqID_135668
atactcgagaaggtaaaaatagcttatgacattcctatagtgacagatgtgcatgagaccatccagtgtgaagcagttggcagagttgcagatatcattcagattccagcattcttgtgtcgccaaacagatcttctagttgcagcagccaaaactgggaaaattatcaacattaagaagggccagttctgtgctccttctgtgatgacaaattcagctgaaaaggttcggttagctggaaatcctaatgtgatggtttgtgagagaggaacaatgtttggatacaatgatttgattgttgatccacgtaacttggagtggatgagagaagccaattgtcccattgtagctgatataactcactcactacaacagcctgctggaaagatgttggatgggggaggtgttgctagtggaggtcttcgagaactaataccttgcattgcaaggacagcagttgccgttggagtggatgggatcttcatggaggtgcatgatgatccactgaatgcacctgttgatggcccaacacagtggcctttgcgccactttaaggagctacttgaagagcttgtagccattgctgttgggtttaggcaatcatcggtgcaacctgatcccatttga

SEQ ID NO: 18891 - DNA, 2358 bp, Glycine max
  Peptide Sequence Number=SeqID_135669
atgcctccgagaatagtgaagagaggtgctgcggcaaagagggcatcgaggggatcctcaaaggctgcacctgagaaccagcctgagcctgaaactacggaagtggttgtgaaaaataatcaagaaaatccggttgttgatgctgtggtggaagagaagctcgttgatgtggagcaagaacacgaggaagtaccaaatgagtcggctaaggtggaaaacactgaagaggaggttaaggagtctatagatgaatatgaaaaagatgaacacttagattttgaggataattaccctgagtacgaagcagaggagtatggtggtgttgactatgacgagaaggaaattgaacaagaagaaggtcaggaggagggagatgaagtagaggaagatcctgaagagattgtaggtgaagaagagggtgatacaggtgatgaagaagttgaatatgtttatgaagaagttgaggatgatgatgatgatgatgatgagcatgctgttgaagagtttgagcatgatgagcatgcacagaagcctgatgcggaggaagaggaacaccgtgaagttgtaaaggagaggcgaaagcggaaggaatttgaagtatttgttggtggcctagataaggatgctactgagcatgatctgaaaaaggtttttggtaaagttggggtagttactgaagtccggctgatgataaatccccagactaaaaggaacaagggatttgcattcttgcgctttgaaacggttgagcaagcaagaagagctgtggtggagctaaaaaatccagtgattaatggcaaacaatgtggtgttactccaagtcaggacagtgatactctctacttaggtaacatatgcaagacatggaaaaaggaagctttaaaggagaaactgaaacattatggagtagaaaatgtggaggatttgactttaatagaagatggcactaatgaggggatgaaccgaggatttgcatttttggagttttcatctcgttcagatgctaaggaagcctacaggcgactgcagaagagagatgttgcatttggagttgataagcctgcgaaggtttcctttgctgactcctttattgatctgggtgatgaaattatggcacaggttaaaactgtatttgttgattcgctgcctccttcatgggatgaagtttatgtccgagatcttctcaagaaatatggagagattgaaaaaattgagcttgctaaggacatgccagctgctcggaggaagaattatggatttgttacatttagtacacatgctgctgctgtggaatgtgctgatagcattactagtgcagggttaggtgaaggtgacaaaaaggcaaaagttagggctagattgtcacggcctctttcaaaacctcttcagagaggccgtggaaaacatgttaatcatggggactttcgttctggccgcaattctggaagattggtaagatcttcacggagtcgacctgcaccacgtagtcttcctgcccgtgtggtgagaggagttggaagtcgtgttccgcctgttagacctattagtgtgagaagtagacgtcctgtcacatccatgctagaaagatccaggccagtggctcctccagctagaagctatgacaggagattggctgctcctgcatatccaaaaagtggcatgaaaagagattatagacgacgtgtgaatctaccacctccgagaaatagagttgctgcagattatggctctaggttagcctctcagaggcacacatctcatagggattatcctgcccgtggctctaactaccctgagctgcatagaagtacatctcgtggttctgcaccaaagagaggttatgttgatgatggccatggccaaagatttgagagggctcctcctcctcctcctcctcccccccatctaagttaccgtgaaggacggccacgcgattatgacactctatctggctcaaaacgtccttatactgatatagatgatgttcctcctcggtatgataccagtgctcgccaatcaagatctcgtttaaattatgactatggaggtagtgcttcacagtatggagatgcttatggtgacagacttggaagatctagtcttggatatagtggcagcagaaattctatttctagtcaagacttacatggtacatatggcagtcgacaaggcatgagttatggcggaggttcttttggtggtagtgatggtggtatgtactcatcaagttatggtggcgattatgtatcccgtggaagtgatgttggtggccgttcatattcatctatgtattctggtagaggggtgggtgatagcagcaattatatgggtggtggtggatctgggtcatattattga

SEQ ID NO: 18892 - DNA, 111 bp, Glycine max
  Peptide Sequence Number=SeqID_135670
atggggctcatagattatggattacaaatccgtaaagggcccaatgaacatgctggtggctcatcatgtgatttgctcattgctcattggttggagagttggaggccctag

SEQ ID NO: 18893 - DNA, 258 bp, Glycine max
  Peptide Sequence Number=SeqID_135671
atggatgaagagagcaagtcaagatcgttgatgattgaaatgcaaagatatcgaatggagttggacgatataatgttagagatggaaagtagtaacaattgttgtagcttcgtcaatggtgatcatgacggtgatgttactaaagtgtatgatgatgatgatgatgatgatgatgatgaagatgatgatgatgacgatgctgatgaggaagatgttgaccataatcgtgttccatttttgcaaatttgtttctgctaa

SEQ ID NO: 18894 - DNA, 174 bp, Glycine max
  Peptide Sequence Number=SeqID_135672
atgaagctgcagagagtggaaataagaaaagatgcaagtgagaatgagagatctgaaaagagaaacaacgttgcgttgcgttgcgttgcggtgtaccttcttctcctagttgatgacggtagaatcagaattattgcactccaaattccaaagcacagttatgtcggtggctaa

SEQ ID NO: 18895 - DNA, 312 bp, Glycine max
  Peptide Sequence Number=SeqID_135673
atggcggaatccacccattctaagtccaatatggactgcatagaggacaccattgccaaacttaccgccactcagcttcacctcactgctacccagaactccatgtccatgaagctcgacgatctactgcagaaaatggctagctcaaaactagtcggccttcaccaacatcatccatggcttctccccacacgggtcctattttggcttggtaccaatgaatggcgcacaatggtcaaattgcttcctggcccgatctacttcaagctccggaggcttgctttgctccgtcataatacgactacccgacag

SEQ ID NO: 18896 - DNA, 1374 bp, Glycine max
  Peptide Sequence Number=SeqID_135674
atggtcttgaagggtctatgtgagaggattgtttcttcaaaatgctcttctaaaagctcaaccgagactgtagataatacacaggtgcccgtttattcaaaagcaggatctagtgactgtaagtttcccaaggcttccttatggtcaagcatctttacatctggtttttcagtggttgaaacatatagtgaatcatcagcttctgaaaagaaagcagttccttctcgaagtagtgggtgggcagctgctgtgaggaaagttgttactggtggctcaatgaggagatttcaggagcgtgtactaggatcaagcaggactgacatttcaagttctgatggtgatatatggcttctaggtgtatgtcataaaatttcacagcaagaatctactggaggtgttgatactagtaatggattggcatcatttgaacaagatttttcatcaaaaatcctagttacatatcggaaaggctttgatgctattggagatacaaagtataccagtgatgttaattggggttgtatgcttcgaagcagtcagatgctggttgctcaggcattactttttcataaattaggtagatcatggagaaaacctattgacaagccactggataaagaatatattgacgtcttgcaactttttggtgattcggaggcttctgccttttctatccacaatcttcttcaagccggtaaaggttatggccttgctgttgggtcatgggtgggaccatatgccatgtgtcgcacatgggaagttctagcccgtaagaaaaatgaccttggagaaccgccacttccgatggctatttatgttgtttctggagatgaagacggggagcgtggtggagcaccggttgtctgcattgaagatgcctccaaacgctgctctgagttttcaagtggcttagctgtttggacacctctacttttattggttcctttggttcttggacttgataaagtcaatcctagccttggcatcatgggcggcaaaccaggtgcttcaacatacattattggtgttcagaatgagaaggcattctaccttgatccccatgatgttcagcaggttgttaatatcagtggggatactcaagagcctactggtacttcatcataccattgcaagcacatacccctagattcaattgatccatccttggctattggattttactgccgagacaaagatgattttgatgatttctgctcccaagcttccaagcttgcagaagaatcaaatggtgcaccgttgttcactgtagctaagtctcggagtttctcaaagcaagtgagtaatgatgtgtcaggtgacaacactggattccaagaggatgatttccctggcatggactgcggcaatgataca

SEQ ID NO: 18897 - DNA, 1803 bp, Glycine max
  Peptide Sequence Number=SeqID_135675
atggccgcttcagcccattcttctcttaagaagatgtcatgggctaagggtcaatcctctggttggacagcttttgatctcaagcagagaaagaataaggattttgaatctgaagttgacgacgaccctttcccagctataggccctactgatcctataatcaagaagaatcatgttcccgcaaagcctttctcttcagtacttctcccaactaaaaatttccccccattgaatgaggatgggaatagcaaaaaggcaatgctaggttctgattctgatggaaaatattgtggggctactactcaggaagatgttaatttagctatcaaaaagcttagagagcagcatctttgggctgaacatagcttgatagacgatatcttcactgctgttaataacaatatcgacaaggccacatctttattggaaacaatggcccctgcagtgaattttgaagaatccaaagtatcaataaatcctagatcaactacttcagatgatactccttgtatggataagactgatgatagtcttacttcagaaaaggttgaggatgacattcccttcgattataatcttgttgataatctccaagacaatgataaggacttggaggatagaaatgctccctcaggtcaaaagctatctggtgttgattacttgagatgcaaaatgaaactcttgaattctgttcctgttgagcctgaatgggaggatgatgatatttacattagcaatcgaaaggatgcattgaggacaatgaggttagcatcacgccattctaaggcagcttctagtgcttttctaagaggtgatcatttttctgctcaacatcattcaatgaaagctcgggcggaatggcatactgctgaagaacttaattctgatgcagccaaaaaaattttaagtatcaggaataatgaaaatgatatctggagacttgatttgcatggtcttcatgcaaccgaagctattcaagcattgcaagaacatctctacagaattgaatgccaaggcttctcaaagagttcagccacttcaaatggagtgaaggaaaatgggcttggacattctactcttggatctttcaatttcatggacagggaaaaattggatacacaagcaccattacggcttagaccgttagctttacatgtcataacaggcatcggtaatcacagtcgaggactggcggctcttcctgcagctgtcagaagtttcctcaatgaaaacagtttctgtggggcatatgcaacaaacttctctaatttgtggttcaatagaagaggtacctcaattgagccattctctgatcctccaaattccacttcaaatcttatggcaaactttggaactacacaaagaacacccaacactaccaccacaccttcaccaccctccttagacccttacgaaccaaaagggcctcatgaaaagttgtacactgatttcaaaatctactggcccttcaccatgcccctgacttcagaagctgcagcaattcgtgtcatcagaaacttggagcatcttggcttgtactacacactctttgtgtggatcatactcttcatagtcctcattcctcatctgtttgcaacatttgtgcagctgattttgactgaggcagggattcaacttgctgtgactttggcttgtgctgtgccttttgttttggtgcatgcagttttgtgggttagtcatcatgcctttgagattgaggatgattctggcaccaaagaactgactcctcttgttggccataatggatgtgcatgtcgagccaaggctctagagaatgtttga

SEQ ID NO: 18898 - DNA, 1107 bp, Glycine max
  Peptide Sequence Number=SeqID_135676
atgagggcattgggggttgagttgaatgtgtatagtttctctaatgtgattaagagctttgccggtgcaacagcatttttgcaaggattgaagactcatgggcttctgatcaagaatggattggtggataactacattcttagaaccagttttattgataagtacttcaagtgtgggaaagttatgcttgcgtgccgggtgtttgaggagattcccgagagggatattgttgtgtggggtgcgatgcttgctgggtttgcgcacaataggttgcagagggaggtgttggagtatgtgaggtggatggtggaggagggagtgaagctgagttcggttgtgatgactattgttattcctgtgatctgggaggtttgtctgaggaggttgggtcaggagtttcatgcttatgttgtgaaaacgaagtcatactctaagctggtgccagttcagtctgctttgattgatatgtattgcaagtgtggggatatgatttcggcaagacaggttttttatggttcgaaggagaggaatgtggtttgttggacggctctgatggcagggtatgctgtgaatgggaaactaaagcaggcactgaggtccacgatttggatgcagcaagaagggttcaggcctgatgtggtgacacttgccactgttcttccagtttgtgcacagttgagggctttggaacaagcgaagcagattcatgcttacgctttgaaacattggtttctgcctagtgtgtctgtaacttcttcattgatgacaatgtactctaagtgtggtgtttttgagtattctagaagattatttgataatatggaacaaaggaatgtgatttcatggaccgccatgattgattcttatattgaaaatggatatctgtgtgaagcacttggtgtgattaggtcaatgcaattgtcaaagcataggcctgactctgttgttccagttaaaggttctatgacatggactgctcttataagggcatatggagatcttgaattgtatcaagatgcagttaacctttttgatcagatgagatattctccaaaccacttcacttttgaagccattctatctatatgtgacagctggatttgttga

SEQ ID NO: 18899 - DNA, 378 bp, Glycine max
  Peptide Sequence Number=SeqID_135677
atgaactcagttgcaaggcgtttatcaagcttagtcagacattcaggtttcacacctgaacccttcaataatgggcatcatcaaatgcagcagctccagcaatgcagaggcataagagtgaaggtcatgggtgggaacttggaagcagcattgggattgatgcagcgtaagatgcaatcaagtgggattgagaggatgataaagcaagaacaaagattccatatcaaaaactctgagaagcgtgttttagcccaaaagaacttggagcggaagattcgatctgaagatcttgctaagaaacttaaggccattatgatcaagaaagtcagcatagattttgacacagacactccagtatggccaatgtcccaaatatag

SEQ ID NO: 18900 - DNA, 852 bp, Glycine max
  Peptide Sequence Number=SeqID_135678
atgccgaaacactactttagactgtatatgacttttgtctccacatgcactttgcagcctgacaaaatattgccttacaataaagcctatattgatgaggaagatgaagaagagtggagcacacaaagcgacgaggaaaaaggtcagaaggaacttaaaaaaactatcaacaactctaacgacatactcaccaagaaacggaaaaagaaaagcagccacattgacaaggcaaacaaggaaccttctatatcttcttcctcttcccatgtgataaacatcaaagaaatgagaaaaactttagaacgcagaggccaaggattaacaaaaaatgattctgtaagtgtttccattcgtgagacattcatacagttctgttcaacaaagataatttgtccacaggaacatcgtgctgcattagcagttaagttatatggagttcaagcagcacttttatctgctttaggcaacccttttgagaacctatcccaatccataagctcaagaaacagctcacagatactaagtttgtcgaaagcctctaccgggttcttgccagcaattttatggactggaatgttcatagtgagttttgtgtacacattaattgtggtttggtctttggcttttagagtgcctatcatctcaatgctgtgcctttctcttctgtactgtttatctgtgttggttgctgcagcatcagggtttgatgtcatgtgtggcacgtttagaatgagtggcatcttgtttgcatctttaggggttcttggctttgttatgctgcttcttgttgtggtcttgctggtgctttttgcttcctggagatgcccaaaacaagatggaggagccaagtga

SEQ ID NO: 18901 - DNA, 318 bp, Glycine max
  Peptide Sequence Number=SeqID_135679
atgtcagttatcccaacacaagtgcaacacaaaattcctgtggaattcaacactcagacttccgaggacggtggagagggaggtgaaaccgacatagattgggagggtgcgaatgacatggtcgttttgggagacccaatccgcgaggaagtcgcattttggtgtgggacctctgtaactgtaagcgaaaatgaacctgaaaccgacaacaacgacgatgagaggcgagggcttgagagtgatttgggcatgacgacagtggcgatgacaagcatgacgacgaaggtgacaatgacgacgatggcgacgagagactag

SEQ ID NO: 18902 - DNA, 882 bp, Glycine max
  Peptide Sequence Number=SeqID_135680
atgggttggtttaccaagttgcttaagggctctgattataaaattttacgagggcaataccatggcaaatatggagaggacagaatttgggataatcatcatagttcgatggatgatttgacagatattgagaaagaagacattgaccgtgcaattgcactttctctgtcagaggaggatcataaagggaaaaaagttgttgaaagtgaatgtgttaagcaattaattatttccacaccaaacatagccaaaaggtctcatgtttttttgtctcataataccctagattacgactctcaatctgaagatgaggaactttgtaaaattgatgatgaggaagatgaacatcttgttaaagttcatctagaagaagaagaacgtcttgctaaaattcaacaagaagaagaagaacgtcttgctaaaattcaacaagatgaacgtcttgctaaaatccaacaagaggatgaacgtcttgctaaagctcaacttgaggaagacgagcaacttgctagggcaattcaagaaagcttgaaaattggttctcctcctcgatatgacaacgattcttcaattctatcttttcctcacctctttccccccggatacagaatctgtgctggatgcaagactgagattggccaaggaagatttttaagttgcatgggaggtgtctggcatccagaatgcttctgctgccatgcatgtcatcttccaatcactgattatgagttttccatgtctagcaatcgcccttaccataaagcatgctatagggagaagcatcacccaagatgtgatgtttgtaagaactttcagcccagtagggttggccacggtaaacatataattaggaaggctttagtattgggaggtagcttttag

SEQ ID NO: 18903 - DNA, 569 bp, Glycine max
  Peptide Sequence Number=SeqID_135681
gttacactatcccaaagggatggagggtcgttgcttcatttcgtgcggtacatctaaaccctgaccattacaaagatgcccgcaccttcaatccatggcgatggcagagtaactcagaagcaagtagcccttcgaatgtatataccccttttggaggaggtccacgtctatgccctgggtatgagctagccagagtggtgctctctgtcttccttcaccgcattgtcacccgttatagttggtttccagcagaagaagataagttggtgtttttcccaaccactaggactcagaagaggtatcctatcatagtgaagcgtagagaggagtccagactaaggggttataggaaggaatgtcttattagtagaccttgggaagggattggaaatgaggatgtgaaagatcgaaccccctatcaccctaataaatcagttgagctaaatccacctgtgtatatgatcttaatcaattcctacaaatcctttcacgtatatcataataaatcaatggcgaaagtttgtattaaaataaatgagattggacatgaagcccttgttgacccttga

SEQ ID NO: 18904 - DNA, 579 bp, Glycine max
  Peptide Sequence Number=SeqID_135682
atggggttttcaaaggaagagaaatccaaaagggtgtggagaggtgtgaaggttgtgttcttcttgatcaccatggttatatcactgcttcttttctctgccccggttctcttggttattgccgatgcacttgttccttcagctctactctcagctttttcaccatcttctctcttctcccattttgacaactacgattttggatactctctcattgacatacctctattatctatggcacgatcacttgtcatcttatgtgtgtatagtttttgcgatgggcaaaggctttcacatggaccttatttgggggtcaccatgttgtgctcagtgatgtctttgatgtttgtttgcttgaaagctgtttacgtgtttagcttaaacacaagtgttgatgaaagaagagggtcagggtatgatagaagttcccaaatagctctgttcgtgtggtcgtgtgctttggcagtggggcatgtcgttgttgcctacagaacaagttgcagagaaagaaggaagcttctcgtctacaagattgacattgaagctgtaagagtcttttcttcccactttacttcataa

SEQ ID NO: 18905 - DNA, 1219 bp, Glycine max
  Peptide Sequence Number=SeqID_135683
atgggttacaacattgcaacatacaacaaatacaaaagtttattgttctttatcagaaattgcaagttcaccaagctgcttacacctgtcaccgagctgcttccacctcaggacctcatggaggcatattcaaagttcactggaggagggtcctacatgtccgcgaagcagctccaccgtttcctggtggagcatcagggcgcgaaggaccacaccttaacggatttggaaaaagttgttgagaaggttttgcaagtgagaaagacatgtcaagaaattattaatgttgatcaaaatagagaacaacaaatcacccatgacgagctcttccattttttgcttcatgatgatttcaatggtcccttgatagctaaggacaacaaggactgtagtacgctaaatgaaagtgaatcatctgaagaagaatcaaagggcaaggaatctctaaactctagtaggaaaaaagtggagactgaggacacgctgaatgacagtgatcgtgatgagggaaacgataaattgaaaacagacggtgaacttcgacgccaaagttggagtgagacaacccatgaaaaggcttcagaatctcatggaacagatattgttaggtacttgccaagcttaactttcaagtcatcactcaacacttacactaggcctaggtatttattccatgacttatctgattcaagttcttactcttcccaggttcacacagaaaaatatcctcagggtgtatccaagggcaatgcgggtcaaatcctcaaatttgaagccacatattgggtggatgtatggggttcagatggttgcattcaatatgcagacaagcccattaagttcacttgcaacttgcaagggatgttcagggcaaatggaggatgtggttatgtaaagaagccgcaaattctaatgcagaagcatcaatgtggcaatgagtttgatcctacatggatactgacagtgaagaagacattaaaggtaaaagtatacacggggcatgggtggagcttagatttcagtctcagttctacacactttgataactgctctccgccagacttctacactgagaagaaaacaaaggttatgatgaacgactcgtttcctgtttgggatgaagaatttgaattctctttaactgttccagagcttgcattgcttctgatacaagtaaaggacaaagatcctggaaaggatgatttttctggacagacat

SEQ ID NO: 18906 - DNA, 120 bp, Glycine max
  Peptide Sequence Number=SeqID_135684
atggcagtagttgaatttgaatgtggctgcatttatgttgccattgactttgttaagcaagatacaagccttcgtgcatctttacgaaaaactcatattttcaataaggataaaacttga

SEQ ID NO: 18907 - DNA, 366 bp, Glycine max
  Peptide Sequence Number=SeqID_135685
atggacggagactcctcccgccgctcttccaccgccgaagacgacggcgaccctgcggtgtgggaagcgttcaacgaaagcctcagtgaagtgccgtcggtgttggaccgtaaccgacttctgatcgagcaggtgaacgagaaccaacactccaggctccgcgacaacatggtaacaaacgtgtccctcatcaggagctcagcggcaacatctccaaggttgtcgctctcaactccaatttctccgccgccttggaacaacaacaacactccaagaactccgccgccaacgccacatgtggcgaatcatgacacgtcacgtgactttaatggctctgcttcctctgtgtccattcataacatttaa

SEQ ID NO: 18908 - DNA, 1548 bp, Glycine max
  Peptide Sequence Number=SeqID_135686
atggaatattctccactgtccattgttattaccttctttgtgttcttgcttttgcattggctagttaaaatttacaagcaaaaatcgagatacaaattgccccctagcccatggaggttacctatcattggtaacctccatcagctagcattagcagcttcacttcctgatcaagctctccaaaaacttgttcgcaaatatgggcctctcatgcacctccaacttggtgaaatttcagccctggttgtgtcctcccccaagatggccatggaggtgatgaaaacccatgatgttcattttgtgcagaggccccaacttctggctcctcaatttatggtatatggagcaacagatattgtttttgctccatacggtgattattggaggcagatcaggaaaatatgtaccttagagcttctaagtgccaagagggtccaatctttctctcatatcagacaagatgagaacagaaaactcatacaatcaattcactcatccgcaggctcatcaatcgatcttagtggcaaacttttctctttgttgggcaccactgtttctagggcagcgtttggaaaagaaaatgatgaccaagatgaattaatgtctttggtcagaaaagctataacaatgacaggaggatttgaattggatgacatgtttccttcattgaaaccattgcatttactgacccgacagaaagccaaagtggagcatgttcaccagcgggcagacaaaatcttagaagacattctcagaaagcatatggaaaaacgaacaataggaaaagaaggcagtaatgaagcagagcaagaagatcttgttgatgttcttttgagactcaaagaaagtggcagtctcgaggttccaatgactatggagaatatcaaagctgtgatatggaacatatttgcttctggaactgataccccggcatcaacattggagtgggcaatgtcagaaatgatgaaaaatccaagagtgagggagaaggcacaagctgaattaagacaaacattcaaaggaaaggaaataatacgtgaaactgatctagaagaacttagttacctgaagtcagtgatcaaagaaacgttgaggttacaccctccttctcagttgatccctagagagtgcatcaaatcaaccaacattgatgggtacgatataccaataaagactaaagtcatgataaacacatgggcaattggaagagatcctcaatattggagtgatgctgaaaggtttatcccagagagatttgatgatagttctatcgatttcaaagggaatagctttgagtatataccctttggggcaggaaggagaatgtgtccaggcattacatttggtttggctagcattacgcttccattggctttattactctatcactttaattgggaactcccaaataagatgaaacctgcggatttggatatggatgaactcttcggactgacagttgccaaaggagattcaataagagtaccaatgatattcagaataaaaaagttacagagaataaaggaacccaaggcgcaaagaaactaa

SEQ ID NO: 18909 - DNA, 5202 bp, Glycine max
  Peptide Sequence Number=SeqID_135687
atgccaatgcagcctctccggcgccctatcaccgccgattccgcgctcatgaaccctaacaccagaattctcgcgcttaaagctcatgttccaggcagtactcaggatcatttgcaagtttttaacattgaatccaaagcgaagatgaaatcgtatcaaatgggccaacaggttgtgttttggaagtggataaccccaaagacactaggcatagtgactcagtcatctgtgtatcattggtcaattgaaggtgatggtgagccagtgaaggtgtttgaccgaacagctaatttggcgaataatcagattatcaactatcgttgtgatcctactgaaaagtggttggttttgattggaattgcccccggttcttctgatagaccacaacttgtaaaaggaaatatgcaactcttctctgtggatcagcagaggagccaggctcttgaagcacatgctgcctcatttgccacatttagggttgctggtaatgataaggattcaactcttatttgttttgcatcaaagagcatcaatgctggacaggttacgtcaaagatgcatgccattgaacttggtgcccagccaggcaagccatcattttcaaaaaagcaagcagatctcttcttccctccagactttgctgatgactttcctgtatcaatgcagatttcaaataagtatggcttgatatatgttatcacaaaacttgggcttttatttgtctatgatctagagactgccactgcagtttacagaaatcgaatcagtcccgatcctatatttttgaccacagaagcatcttcagaagggggcttttatgctataaatagacgtggccaggtgttgctcgctactgtgaatgaagcaaccattgtaccttttgttagtggccagttaaataatttggaacttgctgttagtcttgctaaaagaggaaacctccctggtgcagaagaattggttgttaagcgttttcaagaattatttgctcagaccaagtataaggaagctgcagagcttgctgcacaatcgccacaaggagtacttcgtactcctgacactgttgctaaatttcagagtgtacctgtgcaagctgggcaaacaccaccgctgttgcaatactttggaactctgttaaccatgggaaaactgaatgcttttgagtcactggaactttcacggcttgttgtaaatcagaacaaaaagaatctcttagaaaattggctagcagaggataaacttgaatgcagtgaggagctaggtgaccttgtgaagacagtggataatgaccttgcattgaaaatttatatcaaagctagagccacaccgaaagttgttgcagcttttgcagagaggagggaatttgataagatcctgatatattctaagcagtctgatgcattcttttcttttcctttgatgaaggttggatacacacctgattatatgttccttcttcaaacaattttacgaactgacccccagggtgctgtaaattttgctctgatgatgtctcaaatggaaggaggatgccccattgactacaacaccataacagatctctttcttcagaggaatttgatccgtgaggcaacagcctttttgttggatgtactgaagccaaatcttcctgaacatggatatcttcaaacaaaggttctggaaattaatcttgtgacctttccaaatgttgctgatgctatattggccaatggcatgttcagtcattatgatcgcccacgtattggacaactatgtgaaaaggctggcctgttcatacgggctcttcagcattatactgagttgcctgacatcaaacgtgtcattgtgaatacacatgccattgagccacagggtttagttgagttctttggaaccctttctcgagaatgggcacttgagtgtatgaaagatcttttacttgtcaatcttaggggcaatcttcaaataattgtgcagactgctaaggaatattctgagcagttgggtgttgatgcatgcattaaactctttgaacaattcaaatcctatgaaggattatactttttcttgggtgcatacttgagctccagtgaggatcctgatattcacttcaagtacattgaggccgctgctaaaactgggcaaattaaggaggtagagcgcgttactagagaatcaaacttttatgatgcggagaagacaaagaattttcttatggaggccaagcttccagatgcacgtccattgattaatgtgtgtgatcgttttggctttgttccggatctcacccattatctttatactagcaacatgcttcgctatattgaaggttatgttcaaaaggtcaatcctggaaacgctcctctagtagtagggcagttgttagatgatgaatgccctgaagattttattaaaggtcttatactttcagttcgttctctcctgccagttgagcctttagttgaagaatgtgagaagaggaatcgtctccgcttgctcactcaattcttggagcatcttgtaagtgaaggaagccaggatgtacatgtacataatgccctgggtaaaatcattattgacagcaacaacaatcctgagcattttctcacaaccaacccatactacgattctcgcgttgtcggtaaatattgtgaaaagcgggatccgacccttgctgttgttgcttaccgaagagggcaatgtgatgatgagcttgttaatgttactaataaaaattccttgttcaaacttcaagcaagatatgttgtcgaaaggatggactccgacctctgggagaaagttcttaatcctgagaatgagtttagacgactgttgattgatcaagtggtgtctactgctttgcctgaaagcaagagtcctgatcaagtttcagctgcggtgaaagcttttatgactgctgatcttcctcacgagttgattgagcttcttgaaaagattgtactacaaaattctgcttttagtggaaacttcaatctgcaaaatttgctgatccttactgcagtcaaggcagatccttctagagttatggattacataaataggttggacaactttgacgggcctgcagtaggggaggtggctgtggaagcacaactatatgaagaggcattttctattttcaagaaatttaatttgaatgttcaggctgttaatgtcctactggataaccttcagactattgatcgtgctgtggagtttgctttccgggttgaagaagatgctgtttggagccaggtggctaaagcacaacttagagaaggcttagtgagtgatgcaattgagtcattcattcgtgcagatgattcaactcatttcttagaggttataaaggctgctgaagatgcagatgtataccatgacctggtaaagtatcttctcatggttaggcagaataccaaagagcccaaggtggacagtgagctcatctatgcttatgctaagattgaacaccttggagaaattgaagaatttatactgatgccaaatgttgccaatttaccaaatgttggagaccgcttgtatgatgaggctttgtatgaggctgccaaaattatatttgcttttatttctaactgggctaagttggcagtcacattggtgaagcttaaacagttccaaggtgctgttgatgctgccaggaaagcaaatagttcaaaaacatggaaggaagtttgtttcgcctgtgtcgatgctgaggaattccgcttagctcagatttgtggtctcaatgtcatcattcaggtggatgatttggaggaggttagcgagtactatcagaacagaggatgcttcaatgaactcatatctctaatggagagtgggttaggattggagcgtgcacatatgggtatctttactgagttgggagttctgtatgcaagatatcgtcctgagaagctaatggaacacattaagttgttctcaactcggcttaatattccaaagcttattcgagcatgtgatgaacaacagcattggaaagaacttacatacctatacatccaatatgatgagtttgataatgctgcaaccactgtaatgaatcactctccagaagcatgggaccacatgcaattcaaagatgtgatagttaaagttgcaagtgtggagctgtactataaggctgttcacttctacttcaaagagcatccagatgtaataaatgatatgctaaatgtgattgctcttcgtgtggaccatactcgtgtagtagatataatgcggaaggctggccaccttagattagttaagccgtacatggttgcagttcaaagcaacaatgtgtccgctgtcaatgaagctttgaatgaaatttatgttgaggaagaagactacgacagactccgagaatcaatagatttgcatgacaactttgatcagataggtcttgcacagaagattgagaagcatgaacttcttgagatgaggcgtgtagctgcctacatttacaagaaagcaggaagatggaagcaatccattgctttgtcaaagaaagacaatctttacaaggactgtatggaaacatgctctcaatctggtgaccgtgaactttcagaagatttgcttatctactttattgagcagggaaagaaagagtgttttgcatcatgcctctttgtctgttatgatattatacggccagatgttgctcttgagctatcttggatgaacaatatgattgattttgcttttccatatctcttacagtttattcgagagtatacaggcaaggtagatgagcttatcaaggacaaaattgaagcacaaaatgaggagaaagctaaggaaaaggaggagaaggaagtacttgctcagcagaatatgtatgcccagttgctaccgcttgctttgccagcacctcctatgcaaggaatggggggaggctatgccccttccccaccactacctatgggtggaatggggatgccaccaatgcctccttttggtgactatcttagggttaaagagtttgacgtggtggcaccaagcatcagtcttctagtctgttactactttccaatgattgcggtttttttcaatgaaagttttccgagtcatgtggatccttttcttgtcgattacatgacaattcaaactggagtaacgacgatagccacatccttggcttttggcgatgtttggatgaagaaaaactgggaaggaaaaaacaagagaagtagaagtagaagagaaatataa

SEQ ID NO: 18910 - DNA, 1122 bp, Glycine max
  Peptide Sequence Number=SeqID_135688
atgaagaaaatatgtgtgtcggagcttctaagtgccaagagagttcagtctttctctgatattagagaagacgagacagccaaatttatagaatcagttcgaacatcagaaggttcaccagtcaatcttaccaataaaatttactccttggtaagttctgctatttccagggtagcatttggtaacaaatgtaaggaccaagaagagttcgtgtctttggttaaagaattggtagtagtgggggcaggatttgaacttgacgatttgtttccttcgatgaaacttcatctcataaatggaaggaaggccaaattggagaagatgcaagagcaggttgacaagatcgtggataacattctcaaagagcatcaagaaaagcgtgaaagggcacgacgagaaggcagggttgacctagaggaggaggatcttgttgatgttcttttgagaatccaacaaagtgacaatctcgagatcaaaattacgaccacaaacatcaaagctataatattagacgtatttactgctggaacggatacttcagcatcaacacttgaatgggctatggcagaaatgatgagaaacccaagagtgagggagaaagcacaggctgaagtaagacaagcatttagggaattgaaaataatcaatgaaacagatgtagaggaacttatatacttaaagttggtgatcaaagagacattaaggctacacactccttctcctttattgctccctagagaatgctctaagcgaaccatcattgatggatatgaaatacctgtcaagactaaagtcatgataaatgcgtgggcgattgcaagagatccccaatattggactgatgctgagaggtttgtcccagagaggtttgatggtagctctatcgatttcaaaggaaataactttgagtatcttccttttggagcaggaaggagaatgtgcccaggaatgacacttggtttagccaacattatgcttccactcgctctattactctatcacttcaattgggaactcccaaatgagatgaaacctgagtatatggatatggttgaaaacttcggattgacagttggaaggaaaaatgagttgtgtttgattcccgttgttaatgatctttga

SEQ ID NO: 18911 - DNA, 1896 bp, Glycine max
  Peptide Sequence Number=SeqID_135689
atgaattgcgggttgattccgacacttgccaactgcaaaaacgaagagcgtatcggagagtcagaaaacgacgagagaatgggcaatgcggcaaggcattgcggggaaaacgacgagagagtggcgaaatgcggaccgcagttctttcgcgaggctaacctgttaaacgggttaaccttgcaagtgcaagctcgttcctatgctcgtcgccgcgaacaatttcccaccaaagtttctcactgcctccaccgtgcaaagctcattgactacattagactcactctacgctccaacacccccaactcctcccttccctctctcataaaccaccgtcttttggactctttcgtggtcagtcatgcacttcgctctgctccttctgctgattccgctctctcccttgtccatgcccttgaaaaaagttcccatttttcccacacccaccatacgctccatgcacttgccactgttcttgttcttgccaagtctggtcgaagctctgagctcaaatctctcgttgatgatatccgagctaaccggttcggctctgttcagatcagtttcatgaatctcatgcagtggcatgctgcagctagggaccttgatactgttcttcaggtgtgggaacagtatgcactcgagaatgaccatctgtgtactgaatcttatagcattgttatgactctttatgctcaaatgggaaaggactttgaggctgttcgagtttttcacagaatgattgatgaagggtctcttccgaattgcagaagctatacagtgataatcgagcaccttgtgaagtcgcggaagttatcagaggcattggaggcttttaacctgttgccttcaatgaggatcaaacgcaccttgaagcagtactccgttctgcttgagggttttgtaggtagcaaacagtttgatgaacagatgaaggaggaaggagttcttgaaggcaaggagcgattattgagaggaattttgccggatgcgagagtcaggagtgtaagttattctattgataatggtgatgaggatgaggatgaaaatgagaaggagggcaaagatgagaatataagtgatgcttgtcaatgtgatcatgttgatggaattcatttaaaaccgtggatggacccacgggctttggccagtgccttgcggaattggagtcctgatgagaagctgcatggagtttcttctgttgggttggcaatcaaggaggatttactcatgacatatacacgaatggagggaatgagactgccattcagcaccatcaggctgatcattgacttttatgggatttctaaaaatgctgatgctgctctgaaggtttttaatgatgatagaatactttgcggtcctatatcaaatgttaacttgatgcttctgtattcctctcttctaagaacattgacaaagtgtggaagaaattctgatgccctggatatgcttgatgacatgattttaaatggtatttgcccagatatccagacattttcaggcctaatgcaatatttttcacagcttggagatataaaaacagtgcagaagctctttgcaatggttaggcagagcggtttagagccagatgcttatttgtttaaggtattaatccaaggttattgcaagtcagaaagagctgcactagcatgtagactatttgaagacatgaagaattcaggtttggtgcctgactctgccaccaaagagttgctagtaaagagcctatggaaagagggaagacgaagagaggctgctgcagtggaagaaagttatgaggaaataaatactgtccttccacttgcattgcagggtcatgaccacaacagtggtcgcgttagtctgcatttttctgcactatcaaggattgtgatgactgcaatcaccgtaacttaa

SEQ ID NO: 18912 - DNA, 813 bp, Glycine max
  Peptide Sequence Number=SeqID_135690
atgctcctcagttactctctgcacctcccaattacatcttcttactcacacacctccaaccgcagtcccaactcgagcggttacataaagttccgaacaaggtaccgcgaaaacctgcgatacctgcgagccttaaccataatcgacccaaaaaccaaaccagaggaccttcctctccccaacgacgtcgaccacatcatcgacactctcacattcctcaagtcgcactctttctccgacgccgacatccctcgcctcaagttcctgacccctgagctcttcaccaccgccgtcgtcccctccgacgtctccgccgtgttccgcttcctcgccgacgacctcgccgccacgaaatccgagtcccgcgacctcatcctccgatgccccaaactcctcttctcacacgtcgacctctgcctccgacccacgctccaatttctccggcaggggctgaaccggccaacgacaaggaacgcgcacctgctgaacacgcgcgtagacaagctgcatgcgaaagttgagttcttgcaagagttggggttttcgtacgaggaggctgtcagggcttgtgctaggttacccgcaatttttgggtatgacgtggagaacaatttatggccaaagtttgtgtatcttgtcaaggaaatggagagggatttggaggacttgaagaggttccctcagtactttgggttcagtttgaaggagaggattgtgccaaggcacttgcatttgaaaaaaaggggtgttaggattcccttgaatagaatgttgatgtgggctgatcaaaagttctacgccaagtggaagtga

SEQ ID NO: 18913 - DNA, 396 bp, Glycine max
  Peptide Sequence Number=SeqID_135691
atggaagcagagagaggtggtgcacccaattatgagcttcaagtttcgttcaccaacaccccacaagccttacacgaaatgggttttgttcaatatgaagaaaaccaggtccttggcttcttgtcaccctcttcacaatctcaatcttctcacctctctcaatccttaaatagtgatactggcgttgttgctgtcactgccacgacccccaccgcaaccatcggattcatgagtcatagcggacttgtcacgaaaacttggaataacgaccaggtaggaactctggatccaaagcctgtcgaagatgaaaattgcactggaaatggtagtgatcaaggcaacaacaacacttggtatatccctcttccaacttcaatttcattccactacttgtaa

SEQ ID NO: 18914 - DNA, 159 bp, Glycine max
  Peptide Sequence Number=SeqID_135692
atgtctatttggccacgaatcacaccggccatcttgagcgggcatgagttccacggtgggacgataaatgattacgtgcacatgacagcacagcataatgacgctcttcacggagtttacgccttttttttaattgacagaacagggagtttacgctaa

SEQ ID NO: 18915 - DNA, 125 bp, Glycine max
  Peptide Sequence Number=SeqID_135693
atgaaggttttaatctcttctcattcttctaacgcttggaaatcctatcagagcaaatcagagaaaacacttgaggaatctcaagaaattgctagagatgccgctatcgttgtcagaatacacac

SEQ ID NO: 18916 - DNA, 265 bp, Glycine max
  Peptide Sequence Number=SeqID_135694
gtggaggagcgcagctacagagaagaacaaggtgaaaataaggaggaagcttagagaaccaaggttttgttttcaaacaagaagtgatgtagatgtgcttgatgatggttacaaatggaggaaatatggccagaaagttgtcaagaatagccttcatccaagaaaatgtgtggttgagtacactggcaatatcacaggcattatacccggggggaatgaaggtaaaatgtcttttctgggaaaaagttatgtcggtagtgaataa

SEQ ID NO: 18917 - DNA, 762 bp, Glycine max
  Peptide Sequence Number=SeqID_135695
atgaagtttgagaagatcctgaagaggctgattgagcagacgctgcctgattggcgcgacaaattcttgtgctacaaaatcttgaagaaacaattgaacgttatgtgtcccgaagatggccaagctccaccccaattggatgccaacgaactcaaccacttccttactctcttgcagctcgagattgacaagttcaacaatttctttatagacaaggaagaagaatatgtcatcaaatggagggagttgcaagacagagttgtagaagctgtgaattcaaatgtagacctgatgtcattggggacggaaacagtagattttcatggggagatggttttgttagagaactacagtgctctcaactacacaggcatgttatgtttagtgaagataataaaaaaacacgataagaaaactggtgctctacttcgctcaccttttatccaagctgtggtgaagcagcccttctatgaaattgatgcgcttaacaagcttgtaaaggagtgtgaggtgatactaagcattcttttcaacaatggcccgagctcatcaataagccaggattttatgcaaaatggttttggctccatgagtgataaagaaaataaagagactgtaatgcaggttcccgaagaactatctgaaataaaaaatatgaagaacatgtatatcgaactaactctaacagcactgcataccttggagcaaatcaggggtagaagctcaactctaagcatgttcccatcttctccacacaactag

SEQ ID NO: 18918 - DNA, 288 bp, Glycine max
  Peptide Sequence Number=SeqID_135696
atgttacccacagcttccaaaggacgttcttcttcctcctcctcttcctctcgacctaacaatcccatgctgcttccctacctccgcagaatcatcaagatttacttctcgcaccactctaagatccaattcgtgcttttatctctccctttcattctgtatcttttttctctgatgaatttttttggtgttcttgatatggaactgtacaacggatgcagctatcagcatactaaatatcacaaactgattggttcagcaatgtttactgagcttctgtcttactag

SEQ ID NO: 18919 - DNA, 459 bp, Glycine max
  Peptide Sequence Number=SeqID_135697
atggctcatcctgtgtcgctgtgggctcatccagaggtgaggagggagcatcctgggctggctgaggaatatcctgagttgcataagccacggtgtaggctctgcagcatcggctctgtgacctcagaacttcgacactatgctggaactgatgatggtggagcagagggagatggagtagaagtagaagtagagggagtaggagcagaagtagaagcagggggagtaggagcagaagaagatgggccctcagatcctcgagcccgagccttgcgagtccctggaaatacaatcgtgggatcttctaggttccagcagttcttctttatgtacgccaaattaatgacagggctaaaggactcgaaagtgagggagtctgagataactcatcgggccacgcagagtgcaggaatgagggttggaaagccgagcctcgaggagttggactgggccatttga

SEQ ID NO: 18920 - DNA, 342 bp, Glycine max
  Peptide Sequence Number=SeqID_135698
atgataaattgtgaaggttgtaggaaagcattgtggttcaaagaaaatttgccccaactttgggggagattatggggtgacaacaagtgtggtgaaaagatgaagaataagaaggttgttatggctggtgtctcgctaagcgaggcttgtgcgcttagcgagaatcatccgctaagcgaggcactcagcctgcttagcgagtcaggagaatatgtcaagcatctgcgtgctcaacgcgttatcaactcactcagcgagtcgtttgtcttctctcgcgctaagcgcgcccagctcactcaacggaaaatcactaactcgctcttagtacaaaaatgccgctaa

SEQ ID NO: 18921 - DNA, 364 bp, Glycine max
  Peptide Sequence Number=SeqID_135699
atgcctccaaattcttcaagcttatatgagcagtcatcttcagctttaaaatcccaaaacaaggaacctaccaaccttactaaaattttgaattccctcgaggatgatccgcatagcaatgaaggattcaatctacaaattggagataaaaatattaaaaaacagatgccaaagggcaagaatttacatacacaaagccagagtttaaggtatacttatggtcagattgagaaggagaaagttcaacaagagaaaaacaagaacttgactttctcaggagttatttcaatggctactaaaggcgatgttcgaacaaggcctatgattgaggtagcttttaaggatttaactcctactttcaaag

SEQ ID NO: 18922 - DNA, 108 bp, Glycine max
  Peptide Sequence Number=SeqID_135700
atggaatattacaggatcaagtttgctaagtctgtctcctactacccgacagaatcaagcaaggctgatatgctaattcctaattcaccctcaaatgtaatccttgag

SEQ ID NO: 18923 - DNA, 399 bp, Glycine max
  Peptide Sequence Number=SeqID_135701
atgggagctcataccttttttcttaacacaagaatccacgaaatcaaaccttcctttaaaatcaaatgcttcctcccagtgtttggggcaatccctggcgcgggtgctactcttgacgaactggacgtccttgattcgggaatcaccgacgtagggtccgacggtgatgttggagccgggaagggccgtggagtcatcgaactcgtcgggcgttgcttgaatgggaaagagggtggcgaaaggagaagagagaggcgggacactgcaggttttggagaagagataagtggcggaaggagaagagagaggtgggggttttggaggcattgcttgaataagctgcgcgcgacactacaggtatatctctttcaggaatttctcccgattgcttacgcgtaa

SEQ ID NO: 18924 - DNA, 180 bp, Glycine max
  Peptide Sequence Number=SeqID_135702
atgtcatatattatctggaggtggaaagggccccaacgcattggtgtcttcttttggaaagctgttaagagaggctctgatgagaaattttcagcggtgtggttctggttcagaaacaactatacaccttctacgggattgtgccatttctactcaagtttggatgcgttagattggtag

SEQ ID NO: 18925 - DNA, 504 bp, Glycine max
  Peptide Sequence Number=SeqID_135703
atggttctcatttcatggaaattttccttcatgtcactgactagtatgtgccagaaaatagaagggaggcccaccactgtagaggaaattctaaccattgagatcaagccgggctggaagaaaggaacaaaaataacttttcctgagaagggaaatgaacaaagaggagttataccatctgatcttgtttttatcattgatgagaaacctcatggtgtcttcaaaagggatggcaatgatcttgttatcacacagaagatatctctagttgaagctctgaccggttacacagcacaactgacgacacttgatgggaggaatcttacagtctccaccaattccatcatcagtccgacgtacgaagaagttattaaaggagagggtatgccaattcccaaggaaccttccaaaaagggaaacttgaggatcaagttcaatatcaagttcccctctagactcacatcagagcagaaaaccggcattaaacgattattgacatcataa

SEQ ID NO: 18926 - DNA, 432 bp, Glycine max
  Peptide Sequence Number=SeqID_135704
atggcagtagcagcagacgttgcagaaatagcggagtgtgaagaagatgaaaaaagagaggcagctggaaatcggtcgacagcgatcactggagacaacaatctctggcatctgcccttttccaacaacctcgacttcactatttctcctggtttctttactcaatctctgttcagtctcttttctcatgaccttgctcttgtttcattctacctcaacctcgctcttaattctctcaaaatggcggaacatggcaaaagaccgaaattctgccatataaagcagccattacaccttatggtgccgccatggcaagcctcccttcacaaattgcctatgacagttggcaacaaatccaccacgccattccgccatggcggctattcaacaacacttctaaagacaatcatatctcctcaaattttgcattaa

SEQ ID NO: 18927 - DNA, 1536 bp, Glycine max
  Peptide Sequence Number=SeqID_135705
aacttaacaccagaatctgggagttgtgatcccctatgttcactcgatgaaacaagctcacaagagtttgaagacagctaccagcccaagactgatttcctcaaagctgttgcaatattagcaacagctgcaactggggcagtggcaattaatcattcttgggtagccactaatcaggatcttgctatggcattgctatttgtaataggatatgcaggcatcatatttgaagaatctctagccttcaataaaagtggagtgggactgttgatggctgtaagcttatgggtgatacggagtattggggctccatcaactgatatagctgtttcagagcttacacatgcatctgcagaagtcagtgaaatagtgtttttcttgcttggtgcaatgaccattgttgagatcgttgatgctcatcaaggatttaagctggttactgacaatataacaacccgaaacccacgccttctcctctgggtgttcagttctagacaacctgacatccaccatagttatggtttctctgttgcggaaattggtgcctccatcagagtaccgaaatattctccaactattttgaggtttggatacaccttatcaaatcctcaggtggttgatttggattctgttgacaggattcttggagctgttgttgtaatagcagcaaatgcggggggtgcatggactcctattggtgatgttacaactactatgctgtggatacatgggcaaatatctacagttcaaacagtgaaggatttgtttgtaccttcagccgtttctctagctgttccactggctctaatgtccctgacaagtgaagttaatgggaagggacaaaattctcccaatgtcttggcatcggaacagattgctcctcgaggacagcttgttttctctgtgggtttaggagctttgatttttgtcccagtattcaaggctcttacaggtttgcctccatacatggggatgctgcttggactcggtgtgctttggatcctcacagatgctatccattacggtgaatctgaaaggcagaagctaaaagtaccccaggctctctcaaggatagacacccaaggagtactattctttctgggaattctattatccgttagcagcctggaggcagctgggattcttcgggaaatagcaaactaccttgatgcacatgtgccaagtagtgaactgattgccagtactattggactcatatctgcagtaatagacaatgttccattggttgctgccacaatgggaatgtatgatgtcacttctttccctcaggattctgagttctggcaattgattgcattttgtgctggtactggtggatccatgttaattattggctcagctgctggagttgcgttcatggggatggaaaaggtggacttcttttggtacttacgaaagattagtggctttgcttttgcaggttatgctgctggtatcgttgcctatttagctctccataaactcaacatctccctaccaactctagcagaggttcctttcctttctggttcataa

SEQ ID NO: 18928 - DNA, 918 bp, Glycine max
  Peptide Sequence Number=SeqID_135706
atgggtgaagatggagaagctggattaacaggtctaattcttccttcactgccctcaagtgcgcgttttcaaaaaaattcatcactggggatgatgatgatgatgatgatcgccataactgtctccatactcttgggaaatgttcagagcttcgacggcggtagtttgtgtgaagagctcattatcccctccggttacccctgctccgagtatacgattcaaaccaaggatggtttcttgttaggtcttcagcgtgtgtcttcttcttcttcccttcggcttcggaaccatggagatggaggccctccggggagtgagagttctttaattcctgcaggtgatgcatggtttctaaatactccggaacaatcacttggcttcatacttgcagatcatggttttgatgtttgggtaggaaacgtgcgtggaacacgctggagccatggacatatatctttattagagaagaaaaagcaattttgggattggagttggcaggaattagccctgtatgatgttgcggaaatgatcaattacattaattcagtaacaaactcaaagatatttgtagttgggcattcacaggggacaattatatctttggctgccttcactcaaccagagatagtagaaaaggttgaggctgcagctcttctatctccaatatcatacttggatcatgtcagtgcacctcttgtacttagaatggttaagatgcacattgatgagatgattcttaccatgggcattcatcaactaaacttcaaaagcgaatggggggccagtctcttggtttccttatgtgatacccgcctaagttgcaatgacatgctttcatccataacagcaaccacaaaacttcctgttatgtgcgcaaatgccaggaacttaggatttaaaacatgtctgagtttgtaa

SEQ ID NO: 18929 - DNA, 216 bp, Glycine max
  Peptide Sequence Number=SeqID_135707
atggaggaggagagaatgactaaagaaagaagcgggtatggcggtgatgacgcgcttagcaccgaagcttctgggtttagcgagtatggcggtgctcacacgcttagtgcgggactcacgctaagcgcacctttaggctttttcgtgggccttttcacgctaagcttgagctggtcgctaagcgaggcaatgcgttgtgcctgtcttgtgcgctaa

SEQ ID NO: 18930 - DNA, 1902 bp, Glycine max
  Peptide Sequence Number=SeqID_135708
atggatctctttcccttcatccccatcatcattttcacactattgatccacaacttctctctgattctggggcagcaaccttacattggtttaggcacagtagcgtgcccaagaaggggtaacaaaaattctatccgtggttacacttgcaatggtgcaaaccatagctgccaaagttacctcaccttcagatctcaacccatctacaactctgtcaagacaatatcaactttgttgggttctgacccatcccagcttgctaaaataaactcagtttccatgaatgacacctttgaaacaaacaagttggttattgttccggtcaactgttcctgtgcaggtgagtattatcaaacaaacacatcctatgagttccataattcagaaacttacttcttgattgccaacaatacttttgagggcctcacaacatgccaagctttggagaaccaaaaccacaaccctgcaaacatataccctggtagaaggcttttagtgcctcttagatgtgcttgtcccacaaagaatcaaactgagaaaggcatcaggtacctcctaagttacttggtaaactggggtgattctgtttcattcattagtgagaaatttggtgtcaactttatgaccactcttgaagctaatacacttactctcacccaagccacgatctatccctttaccacaattctagttccccttcatgacaagccctcaagttctcaaactgtttcgccaactcggcgcactccaccaccctctcctccctcttctgatcatagctcaaacaaaacatgggtgtatgtagttgttggggttgttgtgggagctattgccttaatatcggttctctgtgctgtcattttcttcacacgctatcgcaaaaatagaaagaaagatgactcagtggtagtagggtccaagagttttgaggcaattgaggaaaaaccagaagtgaaagtgaatgaaaaattgtcagagatcatatctggcatagctcagtctttcaaagtgtataattttgaggaactacagcgtgcaacagataactttagtcctagcagctggatcaaagggtctgtttatcgcggtgtgattaacggtgatttggctgcaattaaaaggatagaaggagatgtgtcaaaagagatagagatactgaacaaaatcaaccattccaatgttatacgcctttccggggttagcttccacgaggggggttggtaccttgtttatgagtatgccgctaatggggacttgagtgaatggatctacttccacaacgtgaatgggaaatttctgagttggacgcagagaatgcagattgcattggatgtggccacaggacttgactatcttcacagtttcacttctcctcctcatatccacaaggatataaacagcagtaacattcttctggatggtgatttcaggggaaaggtcacgaatttaagccttgctaggtgtttggaaggaggggacgatcaacttcccgcgacgaggcacattgttgggacaagaggctacatggctccagagtatttggaaaatggtcttgtgtctacaaagcttgatgtgtatgcatttggggtacttatgctggaaatggtcactggaaaagaggttgctgctattttaactgaagatgagacaaaattgtcacatgttttaagtggcatacttggtgaggaaagtggcaaggagatgttgaaggagtttgtggatccctctttgggagaaaattgtccattggaacttgctatgtttgtgattgaaatgattgataattgcataaagacagatccggcaagtcgccctagtgtgcatgagattgtgcaatctatgtcaagaaccctgaagtcttcactgagttgggaaaggtcaatgaatgtcccacgaaattaa

SEQ ID NO: 18931 - DNA, 1230 bp, Glycine max
  Peptide Sequence Number=SeqID_135709
atgccagaatcgtactgcgtgaaggagagtaaaccctgtgtgggttgggttgagaaatacttggatgattgtctctgcaatttgaaagataaaatctcctttggctttggcttcataagtctcgtatgttggggagtagcagaaattcctcagataataaccaactttcgcgctaagtccagccatggtgtctccttagcctttctcctcacttgggtcgctggcgacatattcaacctccttggttgccatctggagccagccacgctttacacaatcactacgatcgtgttagtacttcaaagtttctattatgactacatctataaatggggcaagcctcttcggaagattaacatcgatgaggctcatgaagaagaagagaaaaaacctttgagacagaaaccaggccgcgactctgggattccaatacaaaatgacggacccaaagaaacgcctcgacgggattactactataggtcagcgagatctttggctgctaatgatactccaccatttggtacctacttgagagctgctaaaagtgtcccttcagccatggaaatgaacaatgattcatcctcagatgatgaggcacctccactctcttctacgaagcctgtaacacagcctagaccaatcccccgttctgtccctgcaagctatggaacttttctagcagcatctatgaacttgccccggcagggtaatgctttgatggagggatacaaaagattcaatggaagaaagctactctcgcaggagcacaacatgcacagtgctttgggtcaatggttaggatggctcatggctgttatctatatgggtggccggcttcctcaaatatggttgaatttgtgtattctatttttctgtgcgttaattactgataaagttgttgattacgttatcattggccagattaaaagagggagcgtggagggcttaaatccactcatgttcatctttgcattgatcgccaatgccacttacgtgggaagtattcttgtacgaactatcgaatgggaaagtatcagagctaatatgccatggcttttggatgccattgtttgcgtggcattggacctattcgactataaagttggtaaacctcaacagtggcagataattttgcagtatgccaactacagatacgttcggaagaaaacaggaagtgatgatgctgattatggagactacaaagaagccagcaaaacttttgtgtcttga

SEQ ID NO: 18932 - DNA, 822 bp, Glycine max
  Peptide Sequence Number=SeqID_135710
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgtagcaaaagccatccaaggtcttctccctgtaccaggagccaaggcgcacgagtcggtaagaagagaattcgaagtaatggagaaaaagaagtcagccattgacaagaaagcagacaccatggttcggcgtgagctctggggagggttaggttttatgatggtgcaaacaatggcattcatgaggcttacgttttgggaactctcctgggatgtgatggaacccatatgcttctatttgacctcaatgtactgcatggcaggctacaccttcttcctaaggacctcaaaagaaccttcctttgaaggcttctaccaagtccgtttcagctccaagcagaagcacctcatgaagcttcacaattttgacattgaaaagtataatcaactcagggctgcttgctctcccaccaccatgcctccaaagtttgatccctccattgctctcccatttgacaattcttccattcatcaatga

SEQ ID NO: 18933 - DNA, 1002 bp, Glycine max
  Peptide Sequence Number=SeqID_135711
atgaatgtaattgatcgatgttggagactgaatcctgaatggaggaggcatcgacctcaactagcaacatgttccgttggttacactggcaagatgacaaacaacattggagatgacctcatccattataaagttattgatcctagtgatgatcctataaaccctaaatttggaactttgaggtatggagcttcagtaattcaaggtaaagtgtggatcacattccaaagagacatgcacattaagcttgagagaccccttcttattagtagtttcaccaccattgatggtcgaggtgttaacgttcacattgctgacaatgcatgcataatgatctttaaggccaccaacataatcatccatggcattcgggttcatcattgcaaacctcaagccccagggatcgtgatgggacctgaaggaaagatttggattgaccataatacactttataattgtcaagatggtctactagatgtaacacgaggttccactgatgtgactatatccaataactggtttagagaccaagacaaggttatgcttcttgggcacgacgatggatatgtgagagaccaaaacatgaagatcactgttgtgtacaatcactttgggcctaattgtaatcagcgtatgccaaggattcgtcatggatatgcacatgtagccaacaatttgtacttaggatgggtgcaatatgccattggtggaagcatgggacctagcctcaaaagtgaagctaacctctttatagcaccaacaacagggagtaaagaggtgacatggagaaaaaatagtcataaaaatggagatatatgggaatttcattcagtgagagatgcttttgaaaatggagcctcctttgcagtaacaaaaggaggacgtgtgccaaagccaaattatagtaaggaacaatgctttaaagttgttaatgtcaactccgttagatcattgacgagctcatcaggtgttttacaatgcactaaaacttctatatgttga

SEQ ID NO: 18934 - DNA, 813 bp, Glycine max
  Peptide Sequence Number=SeqID_135712
atgcaggaggctgaccgggcccggatgcaagtctctgcaaagcccgcggaagttatccccgccgaggccgtgttggttccacctgtgatccacggggactatgtttcccgcgaaaacgagcaaaaacggaggcaacgatccgagttcgtagatccgcattctcttctggagctccatccactcctggatcttggtggtatagtccccggcacgccagcgttgcaagtgaatgaccatgacgccggtgttgaagtagcagggggtgcggccggcgaaggtgagggagagggaggggttggaccagaaggatggggtgaagtaggcgctgaagttggcgttgcagtattcgggggcggcgaggacggtgttgttgttgtctccgaggggggtggcggcgagttttgcgatgtcgtcgacgagaacgaggtcggagtccaggtagacgattttgaggacgcaggaggggaggaggttggcgaggtagttgcgggcgtagttgagggggcagtccagggcggagcggatggaggtggagatgaggccggagacggcggcggcgtcgtcgaaggggtagatttggaatttgaggtaggggaaggaggtggagagggtgcggttgaggagggaggaggaggcggcggtgacgaagtggaagatgatgttttcggggcaggaggaatgttggaggacggagaggatggcggccatggagccgcggaggtaggttacgtccagggtcatggccacgtggactgcctcgtcggaacacgtgtcgcactagtggccatggcaaaaggagcttccaagttttga

SEQ ID NO: 18935 - DNA, 522 bp, Glycine max
  Peptide Sequence Number=SeqID_135713
atgaatgattatgatttggtccttattgacttgttcttgcatatagatctttcattgagttacaagattcaagaaggagcaaatattctgcgggctgtgtggaaaataccagcaccatcaaagtctttggggttctcatggagtgttattagaccaaagaaacaatttctcacttgttcttctcttgtgccttctctcattcagtttgaacaaggatacataggtggccgggtttcgagcgacatcttggtctatatggctacacaggaatgcagtcatacatttaaggaagtggagctatgtcaggcgagttttaaagcatctttttatgactggttgaaccaacccgttttgtgtctcaatgctggaagggacgaggaggtgagcaatggttatgtgggtttgggtggaggtggggcattgtggttattgggtttagaggtgggatgcagtgatgttgggtttatggccagggttgtgaaagtgagggaaggggtgctgagtgctgactatcacgcatag

SEQ ID NO: 18936 - DNA, 162 bp, Glycine max
  Peptide Sequence Number=SeqID_135714
gattatcctttaacactacacagcagcagctcaagaagttgttctctccattcagactagttacccaagcgttggatcctataaccaaaaggccgaaaggtttcagctttgtctccttcaaatctgaaattgaagcggaaaaggctttcaaagccattaatg

SEQ ID NO: 18937 - DNA, 1146 bp, Glycine max
  Peptide Sequence Number=SeqID_135715
atgggagggcaatccagcaagatacctagcaatagtggtgttccaacaccaatcaaaatgggtacccattctctgtatgcggctgatttgaactcttatgaggctgcgtgtgttgaagatccaaacttgcaatccttagatgctaccattcaggagcgcaccaacagggtgatcacctctcttgctaatgggattgaggttcgttccatatccatcgagtcactaggggaaatgactggtagtttgcttgaaatgaatcaggatgttgccaaagtcattctagagtgccagcaagatatatggaacaagaaggacagagagctgttctccctggtggaggacttctttgaaaatagcctccagacattgaacttctgcaacgctcttgataaatgcttgaatcgagctcgcggaaggcatgttatagttaagtctgcgattacctgttttgaggaagaggtgcaaaatggggttgaagggtccacttatttgaagactttgcaagagcttaagggtttcaaggaagccggggacccctttactgaggagttttattccttgtttcagtcagtttatcaacagcaggcatcaatgctgaagaaattgaaaattaggaagcaaaagcttgataagaaactgaagtccttcaagacattgaagagggtgtcaaatgccatttttgtggctgctttcgtgtctgttttgatattctcagtggtcgcagctgccattgctgcaccgcctgttgtaactgctttggctggtgcattggctgttccaataggctcagtggggaaatggtgtaactctctgtttaagcgatatgagacagctttaaagggccaaagagaactaatcagttctatgcaagttggtagttacattacattggtggacttgaaaaacattcgtttgcgcatcgaccaattggaaataaagatagagtccatgttgcagagttctgattttgctcttagaaatgaggatgctgtaaagtttgccatagatgagattaagaagaatatagacatttttgcagagaccattgaggcgttgagtaagcaagctgatgaatgtagtcggcagataaggatggcaaggacagtggttgtgaaaaagattattaattacacaaacactagctga

SEQ ID NO: 18938 - DNA, 165 bp, Glycine max
  Peptide Sequence Number=SeqID_135716
atgaaacgaagcaagagagcaagagaaggtgttgagcttgataatcctaaacaaaactgctcacgcgatcgagcctttgtcttcagcgagagaacaagagaaggtggcgacatgcagtggccaaaatcccttttgtgggctgagttgcacaagctgaaagcttga

SEQ ID NO: 18939 - DNA, 381 bp, Glycine max
  Peptide Sequence Number=SeqID_135717
atgggaagtagtgaaaacactattgtgcagtatggacaaagaaatcttcacaaatcctcagaaggagaagccattaatcaaactcttgatgctctcatgaacatgaagctagaactttcagcctataagtatatgaaatgtatcatacaaattgatcacaaagaaattagcacaaacactcctgtcaattatggaggagttgagaggaaagaaattgattcagagaaggttatgacaaaaatgaaatgcatattcattaagaagactacagaggagtgttgctttgcttttagcttcaccgaactaatttggcattgcatgtctgagaattctcttaacatggaagcgaaggaggatttcttttcgtcaaaaggtctttag

SEQ ID NO: 18940 - DNA, 525 bp, Glycine max
  Peptide Sequence Number=SeqID_135718
atggacagggatgtggaagaattggctgaagttgaagctaaattggataaagattggaaggctagcaatggagctacaaaaaatagcaataaggcattttctatcacctgttttggtgaatggggtgacaagagccagttggctaccataggtttggctgcagataagaacccatttggtgtggttcttggaaactttgaaacatcaaatgcgcaattcaaacatatattagtattaagtattaactatcaaaggcttgatgttgtggatgatctaatggccaacctagagattatgccacatattgctcaacatcttcacaggcttctatttgaagtagcagtagacaatgacttcccaaattaccagagtacgtgtctggtgcacatggacgctgaagaagtgcttggcgaagacgagcttctcttagatttggatctattgactatgctagatttgaatctggagcttgtggaagaggacgacaacattgttgtcataacaaagagtggatttctgagttag

SEQ ID NO: 18941 - DNA, 216 bp, Glycine max
  Peptide Sequence Number=SeqID_135719
atgttgctcgccatttaccaacaatattggcaccttctgatactcagaccatttgatttctttcttactgagaggattaacctccacaactttgtaagaaatagcaagcctcaaattggtagagaacgacatcgttcggaagagcctctggcggtgggggctccttggggaggacttcctgacagaccagagccccaacgatgccaagggacgtga

SEQ ID NO: 18942 - DNA, 492 bp, Glycine max
  Peptide Sequence Number=SeqID_135720
atgcaaaacagtggggttaccctaagggctgaatctcaacacttcgctagtgtacatgaggacaatcctcgtgtagcttccatcccttactttggtttcattgaagaaatttgggagcttaactatgatttacattggtggatcttaagaaactcgcttactagaatgatcctttcattagggcagaacaagcaaagcaggtggtcagtggttctacatgggaaaacaataggtgtcaatgttgaggatgctgattcatacattgatacttatgttagtcctctgtccacacaaatttcgcctaatgtcgtcggagaagaagaagttgacgatcaaatggctacaccgcccaactctcctcctcctcctcctcttcctcctactagtgcaacatcgcattcgccgtctacattgaagtggacaagaaaggcaacatgcctaagatcattggcgaatagaccagttggggcagagagacccttgcaccactaa

SEQ ID NO: 18943 - DNA, 750 bp, Glycine max
  Peptide Sequence Number=SeqID_135721
atgattaagctttttaaagtaaaggaaaagcagagagaacttgcagaaaatgcaagtggcggaccacctgttaagaagcaaagtgctggagagttgcgtcttcacaaagatataagtgagctgaatctaccaaaatcatgtaccatgcaattccccaatggcaaagatgatctgatgaactttgaagtttcaattcgacctgatgatggatattacttaggtggcacatttttgttttcctttcaagtgtctcccatctatccacacgaagcaccaaaggttaagtgtaagacaaaggtctatcatccaaatattgacttggaaggaaatgtttgtctcaacatcttacgagaagattggaaacctgtccttaatataaacactgtcatctatggcttgtatcatcttttcacggaaccaaattacgaggatccactgaatcacgatgccgctgctgtgttgagagagaacccaaagatgtttgaatctaacgtgaggagggcaatggctggaggttatgttatttttcttggtggagaaacaggccaagttcttaagaccaccaagcttcaaaaagccaaacaagtggaatatgatctcgccacaaaacagtatgagcctgggttaaatatcctgatatttctgatccattcagctacagatgccatctcaagaaatggctcagaagccagagtgagttcaatcctcggtaataagcaacctagccatgacggaaccatgaatgtatga

SEQ ID NO: 18944 - DNA, 246 bp, Glycine max
  Peptide Sequence Number=SeqID_135722
atggggcatgctcagtttaggtactccaatgctcaagtgaaaaagaggctaagtcatgaagtgctaaaacgcacattcaccgctaagtgcagcttcagcacacttagcgcaacagaagaatctggcagagcatcaatatcaaggttgcacgctaagtgcaagattagtgcactaagtgcagcagttatcttcagccaagctcagcacacgattggcgctaagctcgaatccacttactcgcgctaa

SEQ ID NO: 18945 - DNA, 1044 bp, Glycine max
  Peptide Sequence Number=SeqID_135723
atgacagctgatgaagagtattgcagtgactgcaaaagctacactccattagtgtatgatcacaaggctggggactcaatctgctcagaatgtggcttggttctcgagtcccgttccatagaagaagaaataccaaaattgagactctatggggataaacttgaggatgatgatgatggtggtggtgaccatgaagatgaagatgagcatcaagaacaagtattcagtgtgagtgaccctttcaaccctttactacttactagtggagctgaccttaccacacttgttacacacccctccttgtatgacaataacaatagtgatatggtaaaaacttgtaagaatcaacggggaatcaagaattccaacagggctgccaagagaaaactgaagagagattgcgatctcgtagccgcgctcttgaccatggaacaaatggctaataacttaggcttggctaggagcatacaaaatcatgccaaggaactctacaagaaggcagaagatagaagggtatttaggggacggagaagacattcaagggcctctatggtggcatgcttgtacttggtatgtcaagaagagggatttccaatgactttaaaggaaattcaaagtgtttctggagaagccaaagagaagaataagcatattaacaaggccataggagtgttcaaaaagcattttcaggtgggcagaaattatgacaagacacaggccttggacttaggtgaacgcctgtgcaccgatcttggccttggcaaccatgtcatcaaagctgtgagagaagtgctgcaaaaagctctggagttaattgaaaggagcagaccttcttccgttatggcagcaactatatatatggttgatcaactttcttcagataatatgatgcatttccgagacatcaaagaagttgcaaaagcttgtagactgaaggaatatacaataaagaaggcatatagagatcttcatgcacttgcctttgttctgattccaagctggtatgccaatgctgaggacataaagcgactctgcaatatttga

SEQ ID NO: 18946 - DNA, 453 bp, Glycine max
  Peptide Sequence Number=SeqID_135724
atggatatggctgacatctgcattgtgcttccactggcctccatcaataattggcaccttcaccaatttgatgtgagcaatgtttatcttcatggagaactttcaaaggaagtatacatggttattccccctgacactcatgattacaagccttatcaatgttgcaagttacttaaatccttatacgaccttaagcaagctagtctatcgataaagattgaggttctaactttactgctctcatcgtcagaatatcgtgcccttgcatctactacctatgagttacaatggctcatttatcttcttgctgatctccaagtatcatggcattgtcttgtagttctttactgtggcaatcaaagtgcactccatattgctgtgaacccattttttcgtgaaagcaccaaacatctggatattagttatcacattgttcgtgagaaagctcagtaa

SEQ ID NO: 18947 - DNA, 2630 bp, Glycine max
  Peptide Sequence Number=SeqID_135725
gcgatcgttgtgactcaaaactgagtgaggagactgagaaaacagaagaaaacaaaatggaagacacagtttctgcgttgaggtctttgatggtttctcactctccgccgctggatgccttagtggtgccctctgaagattatcacctgagcgaatatgtgtctgcacgagacaagcgccgcgaattcgtttccggcttcactggaagtgccgcattcatcagtttagggtttaagttgcctcctgtttcggcgttttcctgcaattgtttcaacatttcgcgtgctgagaaagaacttagtgctgggtggaagctaatgcgaattggtgaagatcctgctgtagatatctggatggccgatgtgagtaacctgcttaatttgccaaaagaagcatccgttggggttgatccctggtgcatttcaattgatactgctcaaagatgggagcgtgcttttgccgaaaaacagcagaagctggttccaacctcaaaaaatttggtggatgaagtttggataaatcgcccaccggcagagataaatgctgttattgtacatcctgtgaaatttgcaggtcgctctgttgcagataagttgaaagatttgagaaaaaagcttgtacatgagcaaacccgtgggattattttcacagcacttgatgaagttgcatggttgtataatattcgtggaagtgatgtggcctactgtcctgttgttcatgcatttgctattgtgacatccaattctgctttcatttatgtggacaaacaaaaggtttctgttgaggtacaaactcatttagtggagaatggaattgaaattcaagagtatacagccgtaagctctgatgcgacattgcttgcaactgatgagctagatgctgtatctactgccaaggctgctttagccgaaacagaggccagaaaaattcccagtgaaattgataagagtgtaaatggtgaacatcaagcagaagaaaatagtaatgacctcatatgggctgatccagtttcatgctgttatgcactgtatgcaaagttgaaccccgatacagttctcttgcagcaatcacctttagcccttgcaaaagctttaaagaactcggtggagttggatgggttaaaaaaggcacatattcgggatggtgcagcagttgtgcaatatcttgtctggctggataagaaggatatttatggagcttctggttactttttggagaaggattctgtgaaaaaggagaaacatttgcaatctttgaaattgactgaggtgactgtaagtgaccagcttgaaggttttcgagcatcaaaagagcatttcaaaggattgagtttccccactatttcttcagttggctcaaatgcagctataattcactattttccaaaggcagaaacatgtgctgaacttgatccagacaaaatttatctttttgattctggagcccagtatctagatggaacaacagatattacacgaacagttcattttggtaaaccttcgactcacgaaaaagcgtgttatacagcaggatttatattaagtttgcttgatttgctaaactttgtgcaggtcctaaagggtcacattgctcttggaaatgctagatttcccaatgggacaaatgggcattctcttgatattcttgcccgaattcctttgtggaaggatggtcttgattatcgacatggtactggtcatggaattgggtcctatctgaatgttcatgaaggacctcacttaatcagtttcagacctcaggctcgaaatgtaccattgcaatcttcaatgactgttacagatgaacctggttactatgaggatggagagtttgggataagattggagaatgtgcttattgtcaaggaggctgatacaactttcaattttggtgatagaggttacttatcttttgaacacattacctgggcaccatatcagacgaagttgattgacctgaaccttctaagtcccgaggagataaattggctgaactcctatcacgccacatgtaggaatattctggcgccatatttggatgaagttgaaaatgcatggctgaagaaagccactgaacctgtagcttggttcagcaccaacagcgttccctacacttctacaccattgaagcagaagtaccacgccactggggtctgcaacggattgatctatttgaaccctattaagactcgtgaagactcaacgacttgctcggtccgattttacaatccggctacaagtgacacttacaaagtggtggcaattcggaacttgaaatcaaaaagagaattaagggttcgttgcttgggggacaattgttggaaaaatgttgcaagctggagtggttttccccgtatacttggaaataagggacgttttgtgagtaacactcttaactggattgcggaacttagcactaccaatcagtatgcagttttttcctttgatttaaggaaggagacatacagatatttgtcgttgccggttgatgttgatgttgatgttgcgtttgatgtcccaaatattggagattacatgggatgtttgtgtctttctcacaatttcaagggagcccatcttgctgtttggcagatgaaagaatttggattcaaaaatcttggactctgttga

SEQ ID NO: 18948 - DNA, 1479 bp, Glycine max
  Peptide Sequence Number=SeqID_135726
atggtaacatcaaagcctcatgcagcacttatagcaagccccggcatggggcacctaattcccatggtggagctaggcaaacgcctcctcactcaccactccttccacgtcaccatcttcgtcgtcaccaccgactccgcaatcacaacctctcacatactccaacaaacatcaaacctcaacatcgtccttgtccctcccatcgatgtctcccacaaactaccacccaacccgcccttagcagcacgaattctgttaaccatgctcgactccataccctttgtgcactcttccattctgtccaccaagcttcctcctccttcggcactcatcgttgacatgttcggatttgcagcttttcccatggcacgtgacctcggcatgcttatctacgtttacttcgccaccagcgcctggttctctgcggttaccgtatacgttcccgccatggacaagaaaatgattgaaagccacgcggaaaaccacgagccgctcgtgattctcggttgcgaagcggttcggttcgatgacacgctcgaaccgtttttatcgcctataggggagatgtaccagggttaccttacagcagcaaaggagatagtgaccgctgatggaattttgatgaacacgtggcaagatctggagcccgctgcgacgaaggcggtgagagaggacgggatattgggccggtttacgaaggcggaggtgtattcggttggaccgctggtgagaaccgtggagaaaaaaccggaggctgcggttttaagttggctggacggtcaaccggctgagtcggtggtctatgtgtccttcgggagcggtgggacaatgtcagaggttcaaatgagggaagtggcgttgggcttggagctgagtcaacagaggtttgtttgggtggtgcggccaccgtgcgagggcgacgcgagtggctcgttttttgaagtatcgaatggtggtgacgtggcgctgaattacttgccggaggggttcgtgaaaagaacggaagcggtgggggttgtggtccccatgtgggccccgcaggcggagattctgggacatccagcgacgggtggtttcgtgacgcactgtggttggaattctgttttggagagcgttctgaacggggttcccatggtggcgtggccgctttacgcggagcagaaaatgaacgcgtttatgctgtcggaggagcttggggtggcggtgcgggtggcggaggagggaggagttgtgagaagagaacaggtagcggagctggtgagaagagtgatggtggatgaagaaggttttggtatgaggaagaaggttaaggagctgaaagtgagtggagagaaagcgttgtctaaggttggatcctctcatcattggctttgtcaaatgagcaaggactgtgaagctcatgtgcagggttctgaggctaaagtttcttctgcttacactactaccactgctgtgctcagcgacgtcgttcgctcttga

SEQ ID NO: 18949 - DNA, 195 bp, Glycine max
  Peptide Sequence Number=SeqID_135727
atggcacttgttcaaccctttgcttctctttcaatctcttttcgcgatgctcgtgttttcactgcaccaaaatgctctcccaccactcactttcctcatcggaatttggttccaactcgagcatcattcatcgctggttccccactgtgtaagacttctagttcctgtgctgtggttactccttatcatatttga

SEQ ID NO: 18950 - DNA, 933 bp, Glycine max
  Peptide Sequence Number=SeqID_135728
atgccaactgttgttgtcttctcagttatacttcctcaaatagaagcacatgaattcgcaactgagcaaggagggttgtctgtggatgtgataaaaaaggcattcagtgccacagaggaggaattcttgcatttggtgaagctatccttgcccattagtccccagattgcttccgtcggatcctgttgcctttttggtgcaatttctaataatgtgttgtatgttgccaacctcggcgactcgagagctgttcttggcaggagggatacggtgagaaagaacagtccagtggtggcacagcgtttgtcaacagatcataatgtagctgatgaagaggtgagaaaagaagttgaagctctccatcctgatgactcgcacattgtggtttataaccgtggagtttggaggattaagggcattatacaggtgtcaagatctatcggtgacgtgtatttgaagaaacctgatttctaccgagacccggtttttcagcagtttggaaatcctattcctttgaagcgtcctgtaatgacagctgaaccatcaatcattattagggagcttgagtctcaggatttattcttgatatttgcatcagatggcctctgggaacaattaagtgacgaggcagcagttcagatcgttttcaaacatccaagagctggaattgccaagagactggtgagagctgctcttcatgaagctgcaaagaagagagagatgagatacgatgacataaagaaaattgacaaaggaataagacgacacttccatgatgatatcactgtagttgtaatctatcttgatcaccatgcaggctcctctaatggtagatttaagcaaactggtgttgactatacaactgcccctgttgatattttttcccttaatgcggatgaagcagaaaagcgtatgcttggtacagttgcctaa

SEQ ID NO: 18951 - DNA, 183 bp, Glycine max
  Peptide Sequence Number=SeqID_135729
atggcagttagaaatggtctcacttgtttgtatcgttctgaagattcctttttgttattcaacaagtgtagaatgtttttcgagagaaaaaaaatggcagttagaaatggtccgaatgcgaaggaagttttccaagatgggggagaagagaacgttaatccacagggtaaaggctttccttga

SEQ ID NO: 18952 - DNA, 297 bp, Glycine max
  Peptide Sequence Number=SeqID_135730
atggaggaagggattgtgcccgagaaggaattggatcggagggttaaggtttggaggttggagagtgaagagattgaagaggggattgggccgaacaagttgttttcagcgaggtctagtgtggtgaggccgcaaatgaaggaggtgcggcgagggagtgagcatgggtcggttgtaaagttccatgaggcgaggcatgaccattgtgtgatggaggagggtttgattgaggccttgaaggctttgagtgctgcaatgtctgagggtgaggtcagggcttggactaggatgctgtag

SEQ ID NO: 18953 - DNA, 513 bp, Glycine max
  Peptide Sequence Number=SeqID_135731
gaaattcatgctggtaagagctactccatggaaaattatcagtgggagcaagagttacaaccctacaatcaatatgaagaagaaagaagttctaatttggataatttgttgatgcaattcaaggaaacaattgaatctactcaaagagcatttaaaagtctagaaattcaagttggtaagctagcaaaagaagtgactaaatttgtggccacaagggaagaaaactttgtagaggttgaagcttatgaggaaagccttgtagaagagcatgattcaagagaaaaagatgaagaaaaaagtgaggagaaagcacaacaatgggatgagtgctcacaagaagaaaggcatggagaatatgagaaagccttaagtgtcattctttccttgatcgctatcacttctcttgcaatgatatggaaggtgtttttggaatatatgagtttcatggagtctctagctaagaggcaaaaatgcaaggaagatgtgttctatgtgaccttcatgccaccttga

SEQ ID NO: 18954 - DNA, 252 bp, Glycine max
  Peptide Sequence Number=SeqID_135732
atgtttaagaaagaatttgacacaagctatgtgggattcaaggaggatggtgcaaaatggctggcagagaacactgacatcaaacttgtaggagttgattacttatctgttgctgcttatgatcactccattccatctcatcttgtttttctggaaagcaaggatgaacctgccattagaagcaacgtagccccgaatacaattagtggtgtccataagaagcagtttgatgcaaattgcaagctaagctga

SEQ ID NO: 18955 - DNA, 483 bp, Glycine max
  Peptide Sequence Number=SeqID_135733
atgggtcaaaagcttgacccaagagaattggacaacacagctgcccaagtccatgtccatcttcatcaccaagccatatatcaaccttgccctatcaacattaagattaaaagtgtgagaggtaggcgtaaggttaaagtagtaaagtacactccatgtctgagcgagtgcagtgaggtatgtgttcacgtactgaaagcatgtcagatattcctctccttcagcaaggatgattggggtgttgaggaagtcattgatcgtctttgcatcaaacctgatgacctgcccccgcaccctataagcatcgtcaatctgcttctcctggagtttggtgagtacccggcagcactgcctccattagagctctccgtaaaattcaccgaacatccctgtggagaactctatgttcctctccgaagtgaagcaagaggaatcccaggtggattcccatccttgtgtaggaattgctcggcattttcgtga

SEQ ID NO: 18956 - DNA, 153 bp, Glycine max
  Peptide Sequence Number=SeqID_135734
atgtgggtcgagctacacgacctgcaggcgatagtgctaggggtcactcttgcctgtcacaagatacccaaatctttgtctgatgagccagacatgcttgcagcatggcagccaagtttcacagatttgggacacaagccatgctggggttaa

SEQ ID NO: 18957 - DNA, 825 bp, Glycine max
  Peptide Sequence Number=SeqID_135735
atgacttctgagccagcaaaggaaattgctaacaaaattgcctcacaggattcctttgtcgcccatggacgtcaggatgtactgactgttgtcattggacgacagaacaccctagtcgtggaccagctggaggagtcgatcacagaaaaagtgactcgacaactaatgttgtccttcaatcagatgcagtaccagtttcaatcgcgaatgcaatcacaggaactcgcactaccgtctgagcctaaggttggtccttcagctgctcgtgtcaacacaaaggagagttgtgttgatcccttagggaacgatccagacacgggtgactcaaagaaatgcaggttgtacgtcaaagaaaatcctccccacctggttgcactaggaagactgtataaggggtcgacaatcgttcacaacatgcctttgcgccaagatcaagtcaaggttggtgttgaggaagttagagatgaagatgtttttattcctatacccactaaacaggttatgtgggatgctaccatgtttggggtgtttaatgataacttccccttgtacataaagtatgaagatctatcagaaatagcacagatgggaaatgttgttatctggttttgttcgttgcataataggccagacaactacctcaaaggaattattaacagtgctttgaaagaactaaatcatactccacaaagtaaatccaaggctgctgctaggtggattattgttaaatgtaatagacaaaaaggaagcactgagtatgggtattacgtcatgcactggatgtcagctataatcttaggaagtttcaagaataattgggaaacg

SEQ ID NO: 18958 - DNA, 240 bp, Glycine max
  Peptide Sequence Number=SeqID_135736
atggctcctgacactgctgacgaattcctcacgcactttcttctagctttcaggacatgtaaaatctatcagattcatacatcaccagggacagaaatggacgcaaaaaaatgtaaatttggaataatgttgagtgtggccgttgtcaagtgtggcggctacagcttgtgtagggggaataacgaatcagaggatgagacagtgattgtgtcaggaagaagaggagttgacagggactaa

SEQ ID NO: 18959 - DNA, 264 bp, Glycine max
  Peptide Sequence Number=SeqID_135737
atggctctcctcggatcaaacataacaagcgaagttggactccgattgctcctttgtccacttggttccaacgttgtaattagaacagcatgctgtactgtcggagttgctatgcctgtgtacactacgttcaaggcaatagaaagtaaagatcaagatgctcaacataggtgtcttctctactgggcagtggtgtacccagctctcttttttggggagaagctacctggggtgactacattgccaatgagtggggaggtttaa

SEQ ID NO: 18960 - DNA, 297 bp, Glycine max
  Peptide Sequence Number=SeqID_135738
atgaaagtttctgaaatctcgtttttgaactcgcaactctcccctcacgccgatgattcccttcttcaagaaatatcgtctaagctcgcaaagtgtcgatcggttgcggacgtagggggacatgtagaattgcatccgccagttaggggaatagccgtcgctgcctatcacacggctgagggaagtcttttcacaattaatgatgttgtcattaagataaaaattgacttatgtatattttccaacaactttatagtgatattgacacattgtgaaatttttccaaacaacaactaa

SEQ ID NO: 18961 - DNA, 363 bp, Glycine max
  Peptide Sequence Number=SeqID_135739
atgcagcatctgaaggaaggtgatatgagcatggcaaagaagatcgagcatcttgaagattcaagaaggaagcttttgggagatgaattggataaatgcagtattgacgagttacaacagctagagaaccagctcgaacgcagcttggacaaaattagggcaagaaaggaaaagtgcttactcgaagtaaataaacgcttacgagagcagtatcggattgaccgacaacgttgtttgaccgacaacgttacagaaaaagaggcagaagaggtggagacggagttattcataggaagacctgagagaagaatgccgttgaagttgaaatctgcaacacatagtgctcataaatacatagcgtaa

SEQ ID NO: 18962 - DNA, 150 bp, Glycine max
  Peptide Sequence Number=SeqID_135740
atgtgtgcgaccaaggggtttgaggtagtgcctgactttgacagacaaaatgtgtgcgacctcgaggttcagcgtgcacgacctttagggaaagagagttcagggtgcgcgagctttagggaaagaggcggttgtttacaaccgccttag

SEQ ID NO: 18963 - DNA, 303 bp, Glycine max
  Peptide Sequence Number=SeqID_135741
atggccacactagctacagttttcctcccttctaagcttaagccatcgcattcggggaaccaggtctctccattcacgcacaaaacaccactctggaagaaagttaaccaaccactagtgcctgttgctaggttgttcgggccagccatatttgaagcttcgaagctgaaggttttattcttaggagtggaccaaaagaaacacccctcatatcttcctaggacttacactctaacccattgtgacattacctctaaaatcaccctctccatctcgcagaccataaacaactctcagatttaa

SEQ ID NO: 18964 - DNA, 1197 bp, Glycine max
  Peptide Sequence Number=SeqID_135742
atggaacaaccacccaccgaagccgtcgaatcgttgtccgtctccgaccctcagatcccccaatcatccaatcccagtccaactcatctagaaatttcacactctgtgagaagcgtcggagaagaatgcattcaggaagacgaactccttaacctcctcaccaaaaaacccgaaccagtttgctacgatggcttcgaaccctccggacgaatgcacattgctcagggtgttatgaagacaatcaatgtgaacaagctaacttctgccggttgcatcgtcaaaatatggattgctgattggtttgccaagctcaacaacaagatgggaggagatttgaagaaaattgagaccgtgggccgttacttgatcgagatttggaaggctgttgggatggatctggagagtgggaaagttgagtttctgtggtcctccaaagagattaacgccagagctgatgagtactggcctcttgtgttggatatagctcagaagaacaatcttaaaaggattatcaggtgtagccaaataatgggacgaagtgaacaggatgaattaactgctgctcagatattctatccatgcatgcagtgtgctgacatatttttcctcaaggccgacatttgccaattgggaatggatcagcggaaagtgaacgtacttgccagagagtattgtgatgacattaagaggaagaacaagcccattatcttgtcacaccacatgttacctggtcttcagcaagggcaagaaaagatgtcaaaaagtgacccatcatcttccattttcatggaagatgaggaggctgaagtgaatgtgaaaataaaaaaggcttattgccctcccaagactgtggaaggaaacccatgcttggagtacattaaatatcttgtcttaccttggtttaatgagttcacagtggagcgtagtgcagataatggtgggaataagactttcacaagctttgctgagctgactgcagcctatgaaagtggagagttacatcctggtgaccttaaaccagcattggcaaagtcattgaataaaattctggaggtgacgatttctgattatgttctatgtggcacaagctcaactattgtttcttggactctgcagcctgttagggaacactttaggaaggacagcaatgctaaagagctactgaaaagggtcaaggcttacagagtcaccaaataa

SEQ ID NO: 18965 - DNA, 1554 bp, Glycine max
  Peptide Sequence Number=SeqID_135743
atgccggttgacttggacaatgtttccacagcttcaggggaagctagcgtgtcttcctctggcaatctgacagtgcccccaaaacccacaacaaagaagaagcgaaaccttccaggaatgccagatccggatgcagaggtgattgctctgtctccgaagaccctgatggccacgaaccgtttcgtgtgtgaaatttgcaacaaggggtttcagagggaccagaaccttcagcttcatcggaggggtcacaaccttccgtggaagctgaggcagaggtcgagcaaggaggtgagaaagagggtgtacgtgtgtcccgaaccaacgtgcgttcaccacgatccttctagagcgttgggggatctcacggggattaagaagcacttctgcagaaaacacggcgagaagaagtggaaatgcgacaagtgctctaagaaatacgcggttcaatccgattggaaggctcactccaagatttgcggtacccgagagtataaatgcgattgtggcactttgttctcgaggagggatagcttcatcacgcatagggctttttgtgatgcgttagcagaggaaagtgcgagatctcagcctcagactgttgcaaaggctagttcagagtcagattcgaaggctgtgaccggtgattcgtcgcctccggtggcggtggaggctccgccgccacttgtaccgcctgttagttctcagtcaaacagtgttgttgtaccatcatctagcttgcagacacaaaaaccagagttgcctgaaaattccccacaaatcatagaagaaccaaaggtcaatactgctatgaatgggagctgtagcagtaccagtaccagcactaccagctcaacaagcaacagcaacagtggtgctagcagcagtgtatttgcaagcttgtttgcctcatcatcagcatccgcaactgcaagcctccactctcaaacaccagcattcactgacctaattagggccatggggcatccggatcatccagcagacctctcaaggccttcatcttcagagcccatttctctgtgcctagccaccaatcatggctcatccatttttggaacgggaaggcaggaacgccgtcagtatgccccaccgccacagccagccatgtctgccactgcattgctgcagaaagccgcccaaatgggtgcagctgcaacaaatgcctcttttcttcgtgggttaggcattgtatcatcttctgcatcaacgtcatcagttcagcaagataatttgcaatggggccatcagccagtggaaccagagagtgcctcagttcctgcaggtcttggacttgggcttccctgcgacagtagctctggactaaaggagttaatgatggggactccctccatgtttggtccaaagcaaaccaccctcgattttctcgggttggggatggctgctgggggcacccctggtggaggcttatcggcactcatcacctccattggtggtggtctggatgttactactgcggcggcatcctttgctagtggagaattccctggcaaagatattggaaggaggagcacttga

SEQ ID NO: 18966 - DNA, 1845 bp, Glycine max
  Peptide Sequence Number=SeqID_135744
atggagcctcgcaaagcttcaccattatcgtgggtcttgatcttcttccttagcatttccttgagtggagttaaggtattaagtgaagagcagcaccatgccaaatctcaagaaggacctgtggtggaaagggatcaaaggaggacattacttgtcactgaattcggagagatcactgccattgacatcaaggaaggacaaaaggaactgccctaccatcttcggttcatcacattggagccaaactcgctatttctccctgtgcttctccatgcagatatggtcttttatgttcatacagggagtggaaagctgacttgggcaaatgatgatggtactagtacgattcgtttacgcgaaggagatgtctgcagtctcaaggaaggatctgttttctatatacagagcaacctagaggctgagagaaggaaacttaggatttatgcaatgtttaccaatacggacgacaatacttacgatccatcaatcggtgcttactcaaggatcaatgaactggtcaaaggctttgatacgaaaatcatgcaagcagctttaaaggtgccggaagatttgattgaagcaatcattaacaagacggagactccagctatagtgcatgcagttccagagaagcggaatatcctccaggagctggaggcttcgtttcttaagaactttttaggcattgggtccaactccaagaaactcaaaacatacaacatctttgatcatgaccctgacttcaaaaatcccaatggttggagcacagcagtgaccaaaaagcaactaaagtcattgaagcggaccaacattggatttctgatggtgaatttggccatgggatcaatattggggcctcattggaacccgaaggcaacagagttggtagtgggagtagatgggggaggcatggtccgagtagtatgtggaagcagcaatgaagatgagacagaatgccaaaacatgaggtttaaggttaaggaaggtgatgcttttctggtgcctaggtttcatccaatggctcagatgtcattcaatgatggaccatttgtttttctcggcttcagcacttcagcaaagaaaaaccatcctcaatttttggcgggaaaggggtcagtgcttcatattctagacaaaaggatactggctacctctttcggtgtgagtaacagaaccattgaccagcttctgcgttctcccgaggattccatcatttttgggtgcagttcctgtgcagaggaagaggagaagataatgaaggatgaggaagagaatagaaagagagaggaggaagagaaggagaagaagaaggaagaggaggaagagaagagaaagagagaggaggaagaggagagaaagagagaggaggaagaggacgagaagaagagaaggagagaggaggaagaggaggagaagaagaaggaagaggaggaagagaagagaaagagagaggaggaagaggctaaaaggcaacaagaagagagggaaaagaagcgagaggaggaggaagctaggagagagaaagaaagggaaagagaagaggaggcagaaagggagcaagaacaagctaaaagagaagcagaagcagcagcacagagggaacaagaacaagctaaaagagagcaagaaaggagagaaaggagacggcaagaagaagaagatgaagaagaaccaacacggtgggagagaagaggaagaagagagaaggggaaaagtccagaaggagtagaatgggagcaagaagaagccaggagacagcaagcagagagtgatagacaagtggaagagcaaagccacaggaacagctttgaaggaaggagagctttgaaaataaggaacgtttga

SEQ ID NO: 18967 - DNA, 1422 bp, Glycine max
  Peptide Sequence Number=SeqID_135745
atgttaggcccaggcccagtagtccatcgacagggtcttccttctccttctcggtgtgttagggtattatgcagagttgcattttccaccttagacttcgtcacactcactcaccactcaccactcaccactcaccaatacacttcctcagaggttgtggattttgagagtggctttgatttaattctagcactagttgcagagagctgcatggtgaatacaaaacagatggttcacatggcagcatctcgaggaggggttcataaacttgtatcctcctctcgaattgaaaaactagtttcccttttatattccaaacaatatctgcctccgtggcttgagactgtgcgccattttagctttaccgatgatcgcagtggcagaagcaaacaacctgttggagaatctgatgactttttccgtgaacagtcagactcaagttttaaagacaatggtagcaaccgaacccaggagtcatacaatgttgaacagtctttgtcagaaccaattccaagtaggcctttgagaggtaagaagccaattaatcagcctcctccacgtttccgagaatatgatagaggttcccattccttccctccgagatttgatgacaaccatggtgggcctgatgaattggacaaaataaataaatcttcccaaattgatcttgcatttcagggcacaacaaatgtggcagaaacgaatagggatgttggcaaatcaggaggcagtttccttgataaatttaagcttggttttgatgataaaacagttaatctgtcagaggttgcagcaagcaagcaatctgaagaagcaaagaggtcaaatcccaatcaaccggctcaagagtctatgccccaagatgccaacgagatcttcaagaagatgaaggagactggccttatccccaatgctgttgctatgctcgatggtttatgtaaagatggtttggttcaagaagctttgaaactttttggtttgattcgggagaagggaaccattccagagattgtcatatacacagcggtagtggagggatacacaaaggcccacaaggctgatgacgccaaaaggattttcaggaaaatgcagagtagtggtatttcacccaatgctttcagttacacagtccttatacaaggactctacaagtgtaatagattacatgatgcttttgaattttgtgtggagatgttagaagcaggtcattctccaaatgtgacagcttttgttggcctagtggatggtttctgcaatgaaaaaggtgtcgaagaagctaagagtgctatcaaaacattaacagaaaagggttttgttgttaatgagaaagctgttggacagtttttggacaagaaagcaccattttcaccctctgtttgggaggccatctttgggaagaaagccccacagagaccattttaa

SEQ ID NO: 18968 - DNA, 2085 bp, Glycine max
  Peptide Sequence Number=SeqID_135746
atgaagaaaggcatgatgtttgcgaccactgcagcacagtgtgaatcgctattgggaaaattttcagcttctcaatctcattctgaaaccaaaaggctgcacgccctcatcctcaccctaggtattttctcctcctccaacctttgctctaagcttgccacaacatacgcgcaatgccaccacgcgtcctatgcatcccacctgtttgataagttgtctcagccatgtttgttctcatggaacgctatgatgaggatgtatgtccaaattgggcgcccctttgatgccctcaacttgtttgtggaaatgctcggctctggtcgtaccctgcctgacaaattcacatacccggttgttatcaaggcttgtggtgacttgtctctgatcgatgtgggtgttggaattcatgggcagacctttaagtttggctacgattccgacacatttgttcagaacactttgttggcaatgtatatgaatgctggggagaaagaagcagcacaacttgtttttgacccgatgcaggaacggaccgtgatttcttggaataccatgattaatgggtactttcggaataactgtgccgaagatgcagtgaatgtttatggtagaatgatggatgtgggtgtggagcctgattgtgcaactgtggtttcagtgttgcctgcttgtggccttttgaagaatgtggagcttgggagagaggttcacacgttagttcaagagaaagggttttggggaaatattgtagttaggaatgcgttggtggacatgtatgttaagtgtggtcagatgaaagaagcatggttactagcgaaggggatggatgataaagatgtggtgacatggacaactttgatcaatggatacattctgaatggggatgctagaagtgctttgatgctttgtgggatgatgcagtgtgaaggagtgaaaccaaattcagtaagtatagcttctttactatcagcatgtggcagtttggtttatttgaaccatggcaagtgcctgcacgcatgggcaataaggcaaaagattgagtctgaggtcattgtggaaactgccttgattaatatgtatgccaaatgtaattgtggcaacctcagttataaagtgtttatgggaacctctaaaaagagaacggccccatggaatgctcttctatctgggttcatacaaaataggcttgcaagagaagcaatagaactctttaagcaaatgctagtgaaagatgtacagcccgaccatgcaacctttaatagtcttctccctgcgtatgctattcttgctgatctccaacaggcaatgaacatacattgttaccttataagatctggttttctttacagacttgaagtagcaagtattctagttgatatatactcaaagtgtggaagtttaggatatgctcaccagattttcaatataatttctctgaaggacaaggatattattatttggagtgcaataattgctgcttatggaaagcatggacatggcaaaatggctgtgaaacttttcaatcagatggttcaatctggagtaaaaccaaatcatgtcaccttcacctctgttctgcatgcttgcagccatgcaggtttggttaacgagggtttttctttgttcaactttatgctcaagcaacatcaaattatttcccatgttgatcattatacttgcatgattgatcttcttggacgtgctggtagactgaatgatgcttataaccttattcgaacaatgcctataacacctaaccatgccgtatggggtgcactactcggtgcttgtgtgattcatgaaaatgttgaactgggagaggtggctgctaggtggacttttaagcttgagcctgaaaatactggaaattatgttttgttggcaaaactttatgctgctgtaggaaggtggggagatgcagagagggttagagatatggtaaatgagcaagatgacaatgatgacatattgactatgagggaaaggcagagcagaactaggtcggtaccacctattcttatagacttatactttatgcagtcgcttgttagctatgtcgagcataatgacttcacttactggtga

SEQ ID NO: 18969 - DNA, 1104 bp, Glycine max
  Peptide Sequence Number=SeqID_135747
atggattcagtgcctgctgatgtgtctaattcacatactattaatgacccgtcgaagtcacctccggctaaagagactgacagacaagcttctgcttctgtagcctccgggcaagataattctccacatgaggcatcacctaggctatctcccacgggcatatcatcctgggccaaaaacttgaaaatttctcagccattttctggctcccaagacgactcatcaagtggaaatgttgggaaatcaacttttgcacgcatcacaagtaatttcggattgaggttgtctccaaagtctcctgtagaagatgacagttccagtgaaacagctggacaatctaatttgtttggaactattacgaaaggcctggtcgactcttctaagaatgcagtgaaagctgtgcaggaaggaggttttgatttagatatgacatatatcactgaaaacattattgcaatgggattccctgctggcgacatgagctctgggtttttcggctatgttgaaggattttacagaaatcacatggaagaagtgattaagttttttgaaactcaccataagaaggccactagaagcgccagtgaggataaatacaaagtttataatctttgttctgagcggttgtatgatgcatcattgtttgaggggaaggtggctagcttcccatttgatgaccacaattgcccaccaattcaactgattatatcattctgtcaaagtgcttactcatggttgaaagaagacattgagaatgttgtggttgtccactgtaaggctggaatggcaaggactgggttgatgatttctagtcttctagtgttcttaaagttcttcccaactgctgaggaatcaatggattactataatcagaaaagatgtgttgatggaaagggacttgttctgcctagtcagattaggtatgtcaaatattttgaacgagtcttgacttactttaatggtgaaaacccacctgcccgcaggtgcatgcttaggggattccggcttcacagatgcccttactggattaggccctctataaccgtctcagatcacagtggtatgtttgccattaaaatttcccttactgcttatactacatga

SEQ ID NO: 18970 - DNA, 819 bp, Glycine max
  Peptide Sequence Number=SeqID_135748
atggctcaattcataatgtgggattcaggttccactgttggagattttgatggccattcacaccgagttttaagttgtgcatttaaaacaactaggccattccgcattgttacatgtggagaagattttttggcgaatttttatgatggtccaccgttcaagttcaatatgtccatcagggaccatacgaattttgtcaactgtgttagattttctccagatgggagcaaattcattactgttagctcaggtagaaagggtactatatatgatggaaagacagggaacaaacttggtgagttgtccatggaggatggtcacaaaggcagcatatatgctgttagttggagtcctgacagcaaacaggttcttactgtttccgctgacaaatctgcaaaagtatgggatattgttgaggatggtagtagtggaactgtaaataagactttgacatgtactgaatctggcggggtggaggacatgcttgttggtcgtctttggcagaatgattatctgcttactatctgtctcggtggcacgacctatttatattctgccaaggatttagataaaagcccattgtcattatctggtcacatgaaaaatatcactgttttgactatgctcaacagaagtgaaaagatgcttttgtccagcagctatgatggagtgggtaaacaatttgggttaatcaaattgttagtagctggccaagatgaagttattgctgctggatttgacaacaagatacatcttatgttcatccattccttcatagcaaacactgaagctccacgtttattgcggaattattcatag

SEQ ID NO: 18971 - DNA, 1728 bp, Glycine max
  Peptide Sequence Number=SeqID_135749
atgggcaaaagaacattgctcctgaaactactcactctggtgtctcttttaggatgctcatcagcttcagatcatttggttaatgtatccaagttggagatgttcgtggatgagcttcctcacatgcccagaatccttggctatcatctttcagatggcgtcccaagatctaagtctttcaagattggcatgttcaagaagaaatggaaattccacaaggatctgcctccaacaacagtgtacgcttttggaacaagcaagcacacagcaacagttcctggtccaacgatcgaggccctctatggcgttgacacccacgtgaggtggcaaaatcacctccctccaaaacacatacttccctgggacccaacaatccccaccgcaatgaccaactcgacacgtggaatccccacagtggtccacctccacggtgggatccatgcgccagagagcgacggaaacgccaacgcatggttcacatcaaaattcaaccaaagaggacccacatggaccaaaaaaacatatcactacccgaacaatcaacagccggggaacctatggtaccatgaccatgccatggggttgacccgagtcaaccttctagctggcttacttggtgcctacatcattcgccaccctgagatcgaggacccgctaggcttacccagcggtgacgaattcgatcgaactctgatcgtgttcgatcgtagcttccgcacggacggttcgatcttcatgagttccattgggaacaaccctaaaatacaccctcagtggcagccagagtacttcggggacgcaattatcgtcaacggcaaagcgtggccgcgtctcactgtacgacgtcgtaagtatcgattccgcataatcaacgccagtaacgcaaggttctttagattcttcttcagcaacggcttgagattcacgcacgtggcatccgattcggcttatatcgagaagcccgtaaccgccaatgagacgctggtggggccatctgagatcacagacatagttgttgacttttctcggtccaagagtgacgtggctattctagctaacgatgcaaaatatccttacccttctggtgaccctgttaacgaggctaacggcaaggttatcaagtttatcatcatacctgatcatgatcaacaactccacacgtctcggctccctaaacgcttcttggaataccctcttctggatttatccagtgtgacgcacacacggtatgttgctatgtacgagtatgccagcgacatcgatgagccaacccacttgtaccttaatgcgaaaccgtacgaagctccggctacggaaaatcccaaggtggggtccacagagctgtggtatgtgatcaacttgacggaggataatcacccgcttcacattcatttgggtttgttcaaggtgttggatcagacggagctggtgaaaccgcatgatgagtttacggaatgcatgacgaaaatcaacgatgcggtgaagtgccacgtggacaagtacgcgcgtggcaagaaaatagaggtgccagctcatgagaaagggtggaagaatgtgttcaagatgatgcccgggcatgtgaccaaggttgctgtgaggttttcttacatacacaccaatgcttcctatgcgtttgatgcaaccacagagcctggctacgtctatcattgtcatgtattggaccatgaagacaatgctatgatgagacccttgaaaatcatcaagtga

SEQ ID NO: 18972 - DNA, 303 bp, Glycine max
  Peptide Sequence Number=SeqID_135750
atgggaagaggcagcgagaacgaggaagggggaacggggtttagtgcgagagaaagagagagaaagggaggggcgaaagagcgaagggttagggttagggtagcgatggaaaagaggaagagaggaggagaggatggaggaaagggttgccataccaatgaggaggacaaccaccaacaccacttttccttcccttctctctctgtgacgttgtctcgcagccacaataaagcagtaattagtttgtgggtgataaaaataaggggaaacgaaacatgtcaaaacaacacacgattacgatag

SEQ ID NO: 18973 - DNA, 1407 bp, Glycine max
  Peptide Sequence Number=SeqID_135751
atggatcacaaaccaaacccttgggctccaatctgtttttggaagtctcccttgggggttctttgctctgctttaatggcactagatgaggactttaatcccttccccttcatgcagcagaagaagcctcaaaatcctactcaggaaacaacttcttcgtttcctttaccttcaagaaatccgcaattctctgggtttgatttgttgaatatccatgatatgaacatgtcacatccttatggttttaatgatcatgggttacatggcatgaggcttattggggctcaaaatcccactgtgaatgaaacttttctccccttaccttcaagaaatatgcaacactctgggttgggttggttcaatcatattggtgaaactggtacttcttctggagtgcaaggatttgatatgaacttgtcaaatccttatgatttctatgattatgggaccaacaataagcatgaagcttcgttacataacatgggtattattggagccactggtcaggatcttcaaaaccccacttttgtgggtacttcggttccttcatattcaagaaatctgcaaggttccgggtttggctgcttgaattacggtcagagaagtgcttatggagtccaaagcctcttgcctcgcatggaagcgcttaacttatcgaatccttatggttttaatgattatgacactgaccttatgtatgaagctgcgttgcaccacataagggttaatggggctgctgattatgcaacactgccacatcacaatcttgaaactcattctggacacagtgtttctgtggcaaaggatccacgtggatctcgtttgcttcagaagaagatcaatgagggaacaccccaagaaatctgcaagatcttgaaagaactgaagtaccatttgcatgagttaatcaaccacccttttggacactttgtgattcagaagctttttcaatcaagcaatattagcgtggctcaaaagaacgctcttgtctacttgatcatcgtcgacttgcaaaagcttaaaaatgtgtgcatggatgatcaaggaaatcgggttattcagcagattcttgcgaacgtcaaagaaccatccatgatacataaaattgcagttattatgcggagtatcagtctcgcattgatgaaaaattttaatggtggctatgtcattcaacagtgcctgaagcttttcccacccaacaagtatgctagcaatgtagtggaagagctcttaagatattctggagctgataatgttgctgttatagctcgggagctaatgaaaagtcccgagtttttgaatcttgttcagcatccttacgggaattatgttgttcagagagcagtgaagtacactgaggatgcaatcaatgatcacaagcgtctgaacgaagcagatataacttga

SEQ ID NO: 18974 - DNA, 2025 bp, Glycine max
  Peptide Sequence Number=SeqID_135752
atgggggagtttatgcatatacacaccctaaatcttgatttcagttcttctcttaccagtttccaggaagactgttttaattgtatgcccaacctaatgcgcctctcaatgtgtgatacacggattacaaatctttggacaactgttgcagctctctctaagcttccttcgttgattgaattaaggtttcaatattggcagtattgcaatgatgctgtgacatcttttatctcatccagtggtaagtctgatgacactgctgattttagcctgcttgatagtgttccttttattggtgagccctacacttatacaacagaactgacagatcctaactttaatgctgaagatcctctaagaaatttttattcctttgatgaagaagttataaatcatgatgttcaaagcatggttgaggattcttcagatgatagtgaagttgactttactagtcgtcatcataaatactggttgtcagatgtttttcctgggtggagttcagaagtgcctcttcagaatgagaatgaagatggagaagagtccttgcaagctgcttttacagactctaatgctgatgtttctatgaagtatatgtctcgtcatgcatcaccaatatgctatgagaagcattacagagagttcatgatagcttcattgccaaatctaaaaaatttagataatatgccaatcagaaagattgacaaggaaagggctaccggaatattttctcaatattttgaatatcttccatataaatggaagcacaaagagagtgttgtaagtatcttacagaagagagaaataaaatcagtccacaataaggtgcaatcttctaagcataggctatcatatccttctggaaagtcccaatatttttattctaggtctctttctgctgctaaattgggttcttcaacttggcctattttgcatcccctttctttcgtaggatgtgaattggacaagggctttcatccaaggcagtttgagtaccatccatctgactccagtttgatggtctttggaactttagatggtgaagtagttgtcatcaaccatgagactgaacatattttgagttatatcccgtcacttggagcaatgaatagtgttttgggtctctgttggctcaaaaaatatccctctaagcttatagcaggatcagacaatggttccttgaaattgtatgacatctaccacataccaagaaaagttactggcttacatgggaattttggttgtgttacctttgatgaattcgaccagttgacatctgttcatgttaactctatggatgaactatttcttgcaagtggttactcaagaaatgttgctttatatgacatcaacagcgggaagcgcttacaagtgttcacagatatgcatcgtgggcatattaatgtagtcaagtttgctaatcattccccgtcaatttttgccacttcatcatttgatcacgatgtcaagatgtgggacttgagacaaaaaccaatacacccttgcttcactgtttcaagttccagaggaaatgtgatggtttgtttttctccagatgatcaatatattcttgcttcggcggtagataatgaggtggcctgtctttctctttgtaaaattttatctcaagaccacattgttgttgtccagactgacatgcttcacttagtttttgatatagctcccactgatagttctcaaaattacacccgttcttattacatgaatgggagggactacatcataagtggtagttgtgatgaacatatccgtatttgctgtgctcaaacagggaggcgcttgagagatatatcccttgagggaagaaacttaggaagttccgtgtttgttcaatctttgaggggggatcctttccgagatttcaatatgagcgtgttagcagcttacatgcggccaggctccaagtctaaaattgtcaagatcaacttactagcatctagtgaccatgccaacaaggatgattctgatgatttgcgcccttgcccgttccacagtatgggaggttga

SEQ ID NO: 18975 - DNA, 1905 bp, Glycine max
  Peptide Sequence Number=SeqID_135753
atgctttcactgtctcatcagattgtctttcccaccacccaaaggttaaagttcaaacccattgttgctcttcttcactctccctcttcgtgttccattgcagaccccaccaaccttgccaccctcctacaaggcaacattccacgttctcaccttctccaaatccatgcacgcattttctatcttggcgcacaccaagacaacctcatagccacgcgcctcattgggcactacccatcacgcgctgctcttcgcgtctttcaccatctccaaaacccaaacatcttccctttcaacgccatcatcagagtcctcgcccaagatggtcacttttttcacgctctttccgtgttcaactatttgaaacgacgttcactttcgcccaacgacttaaccttctctttcctctttaagccgtgctttcggaccaaagatgtccgttacgtcgaacagattcatgcccacattcagaagataggtttcctctctgacccttttgtctgtaatggcttggtctctgtgtatgccaaaggctttaacagtttggtatctgcccgtaaagtgtttgatgaaattcctgacaaaatgctagtcagctgctggactaacttgatcactggttttgctcagtctggtcacagtgaggaggttttgcagcttttccaagtgatggttaggcagaacttgcttccccagagtgatactatggtcagtgttttatccgcttgttctagccttgagatgccaaaaattgagaaatgggttaacgtttttttagaattggttggtgatggagtgagtactagagaaacttgccatgattcggttaacacggtgctggtttatttgtttggtaaatgggggagaattgagaagagtagagaaaattttgaccgaatttctacgtccggaaaaagtagtgtggttccttggaatgctatgattaatgcatacgttcaaaatggttgtcctgtggagggattaaatcttttccgcatgatggtagaagaagaaaccactagacctaaccatatcacaatggttagtgtgctttcagcctgtgctcaaattggtgatttgagttttggtagttgggttcacgggtatctaatatctctaggacacagacacactattggatcaaaccaaattcttgccacatctttaattgacatgtattctaaatgtggcaatttggataaggcaaagaaagtttttgagcatacagtctccaaagatgttgtcttattcaatgcaatgatcatgggtcttgcagtatacggtaaaggagaggatgcattgagactcttctacaaaataccagaatttggcttacaacccaatgccggaacatttcttggtgctttaagtgcatgcagtcactctgggttgttggtgagaggacgccagatattcagagaactgaccctttccactactcttacattggaacattgtgcttgttatattgatctccttgcaagagtaggatgcatagaagaagctattgaggttgtgacttctatgcctttcaagcctaacaattttgtctggggtgctttgcttggaggctgcttgctccattctagagttgagttggcccaagaggtttccaggaggcttgttgaagtagacccagataattctgcaggctatgttatgttggctaatgcacttgcatctgataatcaatggagtgatgtctcggggctgcggctggaaatgaaagagaagggggtcaagaagcaaccaggaagtagttggattattgtggatggagctgtacatgaatttcttgttggttgtttgtcacatcctgaaattgagggcatatatcatacattggctggattggtgaagaatatgaaagtagcaagccattttaaccttgtgtgctgttgttag

SEQ ID NO: 18976 - DNA, 1224 bp, Glycine max
  Peptide Sequence Number=SeqID_135754
atgactaaagaagaagactttaagctccttaaaatccagacttgtgttctcaaagtgaacattcactgtgatgggtgtaagcagaaagtgaagaaactccttcagagaattgaaggtgtttaccaagttcaaatagatgcagaacagcagaaagtaacggtttcaggttgcgtggattccgcaactttgatcaagaaactggtcagagctggtaaacatgctgaactttggtctcagaaaacaaatcagaaccaaaagcagaagaacaacaatgccaaggatgacaagaacaaagggcaaaagcaagcactggtcaggggacttgaggccttcaaaaaccagcagaaatttcctgcttttagttctgaagaagatgaatactactccgaatatgatgatgacgatgacgaggacgaagatgaagagatgcggtttctgagggagaaagccaatcaactccaaatgctgaagcagcaagcagctaatgcaaataatgccagaaaaggcatgggagccattgcagcaggttctaacaatggtaagatgaacaatggttgcaatgccaatagtggcaaaaagggaggcccaaatcatcagaacatgggaatgaaggacagtcctaatgggaggcttgatcagaaaaccatgtcagctcttaaattgaacaatggccacctgggtggtgaaggcctcaacctcggtgaagccaaaagagccaatgacattggtgccatgatgaatttggctggttttaatggtaataatggtgctaatgttggaagtgccactgttttggggggtaataataattccaatggtttgggaggttttcctgttcagtccaataataacatgattccagggtcttctgcatctttttcaaatggtggtggtctttctggtggccaatatccatcttctctgctaatgaatatgaatggcttcaataaccatccatcaccatctccattaatgatgaacatgcagcagcaggcaaggcaagccatgatgcagcaacaaccccagatgatgtatcacaggtccccttttgttccccctaacactggctattactacaaccacagtagtagctacagccctgcacattactcctactcctcgtatggcttgcctggttaccctgcagcaggaggtgatgatcatcactctgcagctcacatgttcagtgatgacaatactagcagcagttgttcaataatgtaa

SEQ ID NO: 18977 - DNA, 372 bp, Glycine max
  Peptide Sequence Number=SeqID_135755
atgacatggggagtgtatgataaaaatcaaaggtgccacaatagtaatgacacttttgaagttttggatgaggtggctccaaccatgcgaaaagctgcgaagttcacaccggaaaacccctatttcaaaatcactataaagggaaatcgtcagggagataccaggccgcgtttaccactcaatttcatgagaaagtatttgcataacaaacagaccgtggagttacgtgttggacagaagccatggcgtgtaaacgtgatcggtgacgttcgaacaaagttgtccagcggttgggctcaatttgagaaggaaactaagctgcgaattggagatgcattgttcgatgttcacatttttcgtgcccgcccttaa

SEQ ID NO: 18978 - DNA, 3009 bp, Glycine max
  Peptide Sequence Number=SeqID_135756
atggctagtccaactggagaattgacaagccataacgacggtaccaccgaccggatgggaactgaacaatgtgaattgtcagaaaaaacgcctcagataggctctgaaggtttagagaatgaacaaaaggagcttggtactgagttaaccagttcggttattgaagaaaaatcaaatcaagtttctgccattgtaacagagaatgccgttattcaactgcctgaaccgcttcaacatgacttacaaaagaattgccagactgtagaaggttcatgccttgaacaaagtactgtcgaacaagtcactgttgatttatctaatgataaacctgaaaacaaatgcaaaccattgtctgaaaatgttcaaagtgaacccgtagaatccattcctgccgttgttgttgaaggccaaatgcaatccaatccatctcaagcgaatatgagttctgtgaatgaattattggatcaaccttctggagatgctgtgaacaatattagttccaattgttcagaaaaaatgtctaatagcccaactcattcacagtctaggcgcaagggtaaaaagaactctaaattattgaaaaagtatatgctaaggtcgttaggaagcagtgacagagctttgcggtcaagaacaaaagaaaaacccaaggaacctgaaccaactagtaatttggttgatggtaacaataatggagttaagaggaaaagtgggaggaagaagaaaaagagaaaagaggagggaattactaatcagttttctagaatcagatctcacttaagatatttattaaaccgaataagctatgaaaacagcttgattgatgcttattctggcgagggctggaaaggatacagtatcgaaaagttaaagcctgagaaggagcttcagcgggctaagtcggaaattcttcgacgcaaattgaaaattagggatctatttcaaaatttggattcattgtgtgccgaaggaaagtttccagaatctttgtttgattctgcaggagagattgacagtgaggatatattttgtgcaaaatgccagtccaaagagttgagcactaataatgatataattctttgtgatggtgtttgtgaccgtggatttcaccagctctgtttggatcctccgatgttaactgaagacattccacctggcgatgagggttggttatgcccaggatgtgattgcaaagatgactgcatggaccttgttaacgactccttcggaacaagtctctctattagtgacacctgggagagagtctttcctgaagcagcatcatttgctggaaataatatggataacaactcgggagttccttctgatgattctgatgatgatgattataatcctaatggtccagatgatgtgaaagttgaaggggatgagtcaagttctgatgaatctgagtatgcttctgcttctgagaaattggagggtggttcacatgaggatcaatacttgggccttccatctgaagattctgatgatggtgattatgatcctgatgctccagatgttgaatgtaaagtcaatgaagaaagttcaagctctgatttcacttctgactccgaggatcttgctgctgcaattgaggataacacatcccctggacaggatggaggcatcagttccagcaaaaaaaagggtaaagttggtaagaagctatctctgcccgatgaactgtcatctttactagagccagattctggccaagaggctcccactcctgtttctgggaaaagacatgtggaaaggttggactacaaaaagctgtatgaggagacgtatcacagtgatacgagtgatgatgaagattggaatgacactgctgctccaagtggaaaaaagaaactcactggcaatgtaactcctgtgtcaccaaatggaaatgcttcaaataattctatacatactcctaagaggaatgctcatcagaataatgttgaaaatacaaataattcacccactaaatcacttgagggctgttcgaaatctggttccagggataaaaagtctggatcttcagcacacaaaagactaggagaagccgtagttcagaacatttactgcaacaaaaagaaagggcagaacaatctcaaagagagagcagggaacagtgagagtgagctgaacagaatgtctgagatagtgccagagaacagagcaggtctggaaacactaggaagagacttcacaaatcttttaaagaaaatcagtatccagatagaaccacaaaagaaagcttggcacaagaacttggacttacttatcagcaggttgccaaatggtttggcaatacacgttggagcttccggcattcatcacaaatggaaaccaattcagaaaggaaaaggcccaggtccaaactttgttaatttcgaaaaatcggcccgacccgtatatcccggcgtagcgactgtgtcggtgaaggtgaaggtgatgatggaattggaagtcgacgagaacgacttgaaagccgccggtgctgagctcttcgtcgacggtggtcggcgcggcattcgcatcaatggctgggtgatcgagactcggaggcactccatactcaactcttccacactccaagagtgggaacagaatctcgatacgtctcatttaccagaaatggtttttggggaaaacactttgattctaaaacacttgagcagtggcaccaacattcattttaatgcatttgatgctctacgtggctggaaacaggaagcattgccgccagttgaagttcctgcggcggctaaatggaaatttagaagcaagccctctcagcaagtaatacttgattacgactatacatttacaacaccttattgtggaagtggcactatggagattgataaagatccgaatgagggagagagagagacttctaaggaaaccagtgatatccattgggaagactgcaaggatcaaattgatgtagttgcactagcatccaaggagccaatacttttctatgatgaggtgggtagtgagtaccttgaatga

SEQ ID NO: 18979 - DNA, 942 bp, Glycine max
  Peptide Sequence Number=SeqID_135757
atgcagagatgccaacagctaacaagcacagttatgagcttctcctactccaccgacttcttctttactttgtcgtctcatgctcattatcgtttatcttgggcagtgcaagattgtgaacgggttatggtgcgccacaccccacagaagaactggtggaaaccaagtttaacaaatgcagaagatgatgatcctcctccaaggcccttgaaggttacttttgctgaacctgcaactcactggaccgatgccatccccattggcaatggccgtcttggtgccatggtttggggtgccgtaccctcagaagctctccagctcaatgaggacacactttggactgggattcctggagactacagcaacaaaagtgctccacaagcactggctgaagtcagaaagctggttgatgatggaaaattctctgaagctacggcagcagctgccaagttgtcagtagatccttctgatgtataccaacttctcggtgatatcaagttagagtttcctgattcccccatcttaattattcaagagtcatattatagggagctggatttggatactgcaacagcaaaaataaaatactctgtgggcgatgacacacaattagtgtcgagaaaactccagacctctaaagctgtggaagttagtctaattaaaagaggagatgatggtccaggtggtcaacaacttgaaaagcttcactgtgggcacaagttcacaatagtgagcacgcatcgcatgataaaacacctgactgtcttgatggagcctgatcgtggatttggtttcgaaggaggactttacaacaacctgttcacagcacattcccctttccagttttgcttttgcagaaacaagttaagctatcatgaaaatcttggtagaatttcaatttctatatacgtcatgttaaggcttcaacttttgtttccttga

SEQ ID NO: 18980 - DNA, 2178 bp, Glycine max
  Peptide Sequence Number=SeqID_135758
atgaaggtatttcaacttctcggtgatatcaagttagagtttcatgattcccatcttaattattcaaaagagtcatattatagggagctggatttggatactgcaacagcaaaaataaaatactctgtgggtgatgtggaatttaccagagaacattttgcttctaatccggaccaagtgatagtgacaaggttatctgcaagcaagcctgggtcattatcatttacagtgtattttgatagcaaaatgcatcacgattcaagggtaagtggccaaaatcagataaaaattgaagggagatgtcctggcagtaggatccgaccaagagtgaattcaattgacaatccacagggaattcagttttctgcagttcttgatatgcagattagcaaagataaaggggttatacatgttttggatgataagaagctaagagttgaaggttcagattcggctattttgcttttgacagcttcttcttcctttgatggcccatttactaagcctgaagactctaagaaggatcctgcttctgagtccctcagtagaatggtgtctgtgaaaaaattttcatatgatgatctttatgcacgccacttggctgactatcaaaatctatttcaccgtgtctcattgcaactctctaaaagctccaagactggttcaggaaaatctgttttggagggaagaaaattggtttcctcccaaactaacatctctcagaagagaggtgatgataccattccaacttcagcaagagtcaaatcttttcaaactgatgaagatccttcctttgtggagcttttgtttcaatatggtcgatatcttctaatctcttgttcgcgtcctggaacccaggtggcaaacctacaaggtatctggaacaaagatgttgagcctgcatgggatggtgctcctcacttgaacattaatcttcaaatgaattattggccatcccttgcttgcaacctacacgagtgtcaagagcccttatttgatttcatttcctctttgtcagtcattggtaaaaaaactgcaaaggtgaactatgaagcaaatggttgggttgcacatcaagtttctgacatatggggtaaaacatcaccagatcgaggtgaggctgtttgggctttatggccaatgggtggagcttggctttgtacacatttatgggagcattatatttatacaatggacaaagattttcttaagaataaagcttatcctttgttggaaggatgtacaacatttttgttggattggttgattgaaggccgtggtggattattggaaaccaacccatccacttcaccagagcacatgttcactgcaccagacggaaaaactgctagtgtgagctactcatcaaccatggacatttcaatcataaaagaagttttctctatgatcatttctgctgctgaggttttgggaaggcataatgatactattatcaaaagagtcaccaagtatcagtctaaacttcctccgacaaaagttgctagagatggttccattatggaatgggcagaagattttgtggacccagatgtacatcatcgacatgtttcacacctttttggactgtttccaggacatacaattagtgttgagaaaactccagacctctgtaaagctgtggaagttagtctaattaaaagaggagatgatggtccagggtggtcaacaacttggaaagcttcactgtgggcacatcttcacaatagtgagcacgcatatcgcatgataaaacacttgattgtcttggtggagcctgatcatgaaagggattttgaaggtggactttacagcaacctgttcacagcacatcccccttttcagattgatgcaaactttggtttttctggagcaattgcagaaatgcttgttcaaagcacaacgaaggacctctacttgcttcctgcattgccacgcgacaaatgggcgaatggttgtgtgaaaggattaaaagctcgtggtggggtgacagtcaatatttgctggaaagaaggagatctgcttgaatttggcctttggacagaaaaccagaattcccaacttagactacattatagaggaaatgtggtcttaacaagtttatcgcccggcagagtttactcatataataaccttctgaagtgtgtgaaggcatactcccttaacgaagtgaatccttga

SEQ ID NO: 18981 - DNA, 906 bp, Glycine max
  Peptide Sequence Number=SeqID_135759
atggaggcgaagaaggaatatgaagtggaccatctgagcacacccacagggaccagtttctctcagttactattcggagatgacgacgacgacgttgatgaaagtgcattgggtctcgctgtggaccagtcttactcttacaattacaacaaccttacccgttcacctcttttctccattcacaaggcaccccaaatgctttgttttggcaaccatcaaaacgaagaaggtggcgttttgcttcctgaaaccaacgtaacccctcagaaatctgtcatcacttctagtgactcctcttctgctagcgcttcctcctgcaaccacaccaacaccgccttcaattccttacctaagtctaataatagtttgcagaaaaagcgacaagaaggagttgccaaggttggtgttggaagccagagacaaactaaaaagaacaaagcagagaaccccacctcaaccggacatgcaaagaggaaggagaagctcggagaacgaattgcaacgttacaacaacttgtttctccctttggaaagacagatacagcatcagtgcttcacgaggccatgggttatataagatttcttcatgaccaagttcaggtcctgtgctctccttacttgcaaagtttgccttcctcataccatcaaaatcagcacctgatgtgggcacaattgcaattctgttgcaaagaccctgatgttgatgctgaaatcacggggggcggaggtaacaatgaagaggaagtgaacaaggacttgaggagtaagggtctttgcttgatccctgtgggatgcaccgtacacgtggcaggtagcaatggtgctgatttttggtcatctgctgcaatagggaacaatgttagtttcaccatcagccaagcagtgaaacgaaaccaagatcaatga

SEQ ID NO: 18982 - DNA, 261 bp, Glycine max
  Peptide Sequence Number=SeqID_135760
atggctgtagaatcgagtagaaattcttgtcgtatgcaagtcataactgcatacgtagactcaggttttgtcatggttagtttctggggcctggcgccttacacgtgtgacccagtgaagttggcaactaggcatgcttgctgggagacttatgacccacagaagaaaactacaaatggagttcgacaaagcatcgcaatctggcatgcaagcaagatgaagaccgtcgagagtgtttctgatgcagtaagtccagcataa

SEQ ID NO: 18983 - DNA, 231 bp, Glycine max
  Peptide Sequence Number=SeqID_135761
atgggcctgcgggatactaattgtgaaaaggaaagtcgtggtttaacaaggtggttggaggcagtggtggagagactagcggcgatgatggggtggctggcgacagtaattagggtgatgacaacggtggtggggtggctagcgagtagcgacaacgacggggtgactagggaccgtaacggggtggctgttgtggtggtggggtggccggcgacggagttgagctgttag

SEQ ID NO: 18984 - DNA, 564 bp, Glycine max
  Peptide Sequence Number=SeqID_135762
atggcaacagctaacaggcacagctatgagcttctcctactccaccgacttctgctttactttgtcgtctcatgctcattatcgttatcttgggcagtgcaagatggtgaacgggttatggtgcgcaacaccccacagaagaactggtggaaaccaagtttaacaaatgcagaagatgatgatcctcctccaaggcccttgaaggttacttttgctgaacctgcaactcactggaccgatgccatccccattggtaatggccgtctcggtgccatggtttggggtgccgtaccctcagaagctctccagctcaatggatccaatatggtttgggacttgagtcccaatttgaagtatgggattctagttgaggtttatgaggccttagactctgcatctagaatggctagtttttgtgaggacacactttggactgggattcctggagactacaccaacaaaagtgctccgcaagcactggctgaagtcagaaagctggttaatgatagaaaattcgctgaagctacggcagcagctgtcaagttgtctggagaaccttctgat

SEQ ID NO: 18985 - DNA, 159 bp, Glycine max
  Peptide Sequence Number=SeqID_135763
atgtcaaagttggccactcttacaggccatacctatagagttctttatctagccatttctcccgatggacagactattgtaactggagctggagatgaaacacttaggttctggaacgtattcccttcccctaaatcacagtgccatgaaagaggctga

SEQ ID NO: 18986 - DNA, 150 bp, Glycine max
  Peptide Sequence Number=SeqID_135764
atgtctttggaagataaaaacgcaggcggccaacagttcatggaaaacggggacaaccataaagggctcaacaagtatgcctgtgcctctgtgttagctgccaatattgtctctgctatatttggttacgtacaaaaaattactatataa

SEQ ID NO: 18987 - DNA, 318 bp, Glycine max
  Peptide Sequence Number=SeqID_135765
atgagttttacaagtggagatgctactccatcatctccaaaaaccgcaagaagcgaggggcatgaaaaggatgggggagaaaagaggaatgagaggtataaggagagaataaatcatagaagatatggaggtaggcaaagaaaggaagggattgaaggagtgaaggtgaagatccctacttttaaagagacttatgatccagatttatatcatgagtgggagatgaaggtcgaacaagtttttaattgctacaattacaatgaagagaatatcaaattgacctctctggagtttgagggatatgccttagtttggtga

SEQ ID NO: 18988 - DNA, 171 bp, Glycine max
  Peptide Sequence Number=SeqID_135766
atggacaacaacaccacgattacgatggtggtcactggtgatgcgaatgacaacattaacgacagcgacaggggcatgacgaagaagacgcatgatgtaataattggactacaagatgcaatagccgctacttatagacttcccatgcaaagcgaagtgctgaagcagtaa

SEQ ID NO: 18989 - DNA, 1349 bp, Glycine max
  Peptide Sequence Number=SeqID_135767
agtcgaagaagagagttattcggtctggtggtggagccacagtgagaggaaagaaacagagcactatccacgatcgcgccaccggaaccgccatggaggacttgtccggccacctgaatattcctccggccgcctccgcggcgactctccgccacgtggaccgcatgatcaactccaaccactacacctcgccttccaggacaatctactccgaccgcttcattcccagcagatctgcctcgaaattcgcactcttcaacatcgcttcgccgcccgagggccgcgacgacagctccagtgcctacaccacgctcctccgcaccgcgctcttcggccccgacttcgcgccgccgcccacgccggagaaaacggcctcgccggcgatgacgctccccagccgaaatattttccggtacaagacagagacgcgccagtccatgcactcgctctcgccattcatgtgcgaggattcggtgcccggcgttgttcacggtccggtcaaggctccgaggaaggttccgaggtcgccttttaaggttctggatgcgcctgcgctgcaagacgatttctacctgaatcttgtggattggtcttcgcataatgtgttggctgttggtctgggaaactgtgtttatctttggaatgcttgtagcagcaaggttactaaattatgtgacttggggattgatgaccttgtttgttcggttggctgggctcagcgtggtacacaccttgctgttggaacaagcaatggtaaagttcagattcagattcatcactgtgcagacaagctggctgattatgcttgttcattggggtgtgattacttgttctttgagcaacaaccttcattcttgaaggatttgctttttagtgatgcgatgggtgttagctttccttgtgttattcctatttgggatgcatctcgatgcaagaagataagatctctggagggtcatcggttacgtgttggggccttggcttggagttcatctcttttgtcttctggtggcagggataagaatatttatcaaagagatatccgtgcacaagaagattttgtcagtaaattatcagggcacaaatcagaggtttgtggactgaagtggtcttatgataaccgtgagttggcatctggaggaaatgacaacagattgtttgtttggaatcaacactcaactcagcctgtcctaaagtactgtgagcatacagcagctgttaaagctattgcatggtctcctcatcttcatggacttcttgcatctgggggaggaactgcagaccgatgcatacgtttctggaatacaaccacaaactcacacttaagctgcatggacactggaagccag

SEQ ID NO: 18990 - DNA, 219 bp, Glycine max
  Peptide Sequence Number=SeqID_135768
atggtgtaccagggcggtggtggcatggtggttgcactgggtggtggtggcaccaccagagtgggagcaaagcgagaaccaggggcgttccacttaggcaatgcattggttgatgcaaagctgaccattaagtctattcaagaaccttgtctaatttccgtgctcaattacctttgtagggcatttgttcggggagccaatactagggttatgatataa

SEQ ID NO: 18991 - DNA, 798 bp, Glycine max
  Peptide Sequence Number=SeqID_135769
atggctgcaacgcttcaacattgtagcttcttgttgataacaacatttacatggatgttcatattaatcatcggaaagccaccaatagtagcgggtacatttcagcctagtcaatggacccttgcccatgccacattttatggtgatgagtctgcttctgccactatgggaggagcatgtgggtacggaaatttgctcataaacggttacgggaaagacacagcagctttgagttcgacattgttcaacaacgggtatgcatgtgggacttgttatcagatacgttgtgttcaatcgagtgcatgctattccaatgtgccttacactacagtgactgccacaaatctttgccctcctaattgggcccaggcctctgataacggaggctggtgcaacccaccacgtacacattttgacatgtccaagcccgctttcatgaaaattgcacagtggcaagctggaatcattcctgttatgtaccgcagagtaccttgcgtaagaagtggggggatacgattctctttccaaggaaacgggtattggttattggtgtacgtgatgaatgttggaggtggaggagatattgctaacatgtgggtgaagggaagtggaacagggtggattagtatgagccacaattggggggcttcataccaggcatttgcaacattgggtggccaagctctttcctttaaggttacttcctacacaaccaaagagactataatagcatggaatgttgctcctaccaactggggcgtaggactaacttattcctccaatgtcaacttcatttaa

SEQ ID NO: 18992 - DNA, 668 bp, Glycine max
  Peptide Sequence Number=SeqID_135770
ccaaaccagctccttctccgtgctcttctccatgcccaaccacaaaccaccctacgaccattccgacaacatctatgactattcttccttcactccctcttcctcttccgttgactgcaccctctccctcggtaccccttccacccgcttctccgaagacgaagaaaagcgaagctgccacgaaccccgctccgtctcgaacttctgctgggacttactacaatctaaacacaaccaccctcaatcccattccaaatcctcccgaaccaccaacaccaccgaccctctcctcgctcgccgctgcgccaattgtgacaccacttctactcccctctggagaaatggcccccgtggccccaagaggctcactatgcaatgcgtgtgggattagatacaagaaggaagagcgaagagcgagtgcggccgccgccacgccgccggctgcggcggcttccggcggcatgatggattcggcgcaggtgtacaataactcatggtacgcacaccagcagagtcagaagatgcagtgtttctcgccggggatggggagcgagttccgtttcgtggatgacggcgatcgagacgccgctgataacggcattcagtttctctcgtggagactcgacgtcacagacaggacgagcctcgttcacgacttcacgagatga

SEQ ID NO: 18993 - DNA, 474 bp, Glycine max
  Peptide Sequence Number=SeqID_135771
atgacacatgatctgacattgtttgtgttctctcaattctctccaagggggagggtgcaagaagggaagattggtggaggaggggagaagggggaaagtagtggtgggcggagggtaggaaggggagggttgaaggctagagaaaaaaagggagggtgcaatgagaagaggaaagggaggatgacggtggaaatagtttggatatttcaaaaaactatcatcgtaaccaccaccaacaccttcatgaccaccgttgtcgttaccaacatgactgatgttgttgccaccactggtcgcgacgacgatgatcacgatgttggtggttgtggtgatggtggcaacagtaacaacgacaacattcatgttggtggtagcgtggttgacgatcatggtggttgttgcagtgatagtcattacagatatggtggaaacaatcatgacaatgatgttgatgataggtttgagatattttag

SEQ ID NO: 18994 - DNA, 1173 bp, Glycine max
  Peptide Sequence Number=SeqID_135772
atggaggccgacgctattgctgtggactcaacggagttaaagttgacggagctattgaaggaggtcaacgtagaccactcacatcagttctctaagctcgtcgacgacaccgtttccgccattaaaacctccattgacaaaatccccaacgatttcaaggtaactgctgatttagcttcgcgctttgttacggacattggtgctgataaggtcgagttcaagtttaagaaaccagcgtctgttaagattggtggaagttactccatacaaagtattgcgaaacctgaagttaatgtggatcttattatcaggttgccaaaggaatgcttccatgagaaggactatttgaattacagatattatgctaagaggtgtctctatctctgtttgatgaaaaattatttggagaagtctccatctattgatagggttgaatggtccactctacagaatgaagccagaaaacccttgctcgttgtgtatccagctgctaagcttgttgaagttcctggtttttttgtaagaattattccgtcagctaaggctatatttagcatagcgaagttaaacttgaagcgcagcaacattcataatttgagtgatgggactgctcttctggctacaccgaagtacaattctagtattttggaagacatgtttatagaagatgtggaatttatcaacaactattttcttggatggaaggaactaagagaggctttaatcctgcttaaggtttgggctcgacagagaagttcgatacatgttcacgactgcctgaatgggtttttgatttccgtcattttggcatatcttgcttctaagcaacatattacaaattcaatgaaatcaactgaaataattcgtatcacgttgaacttcattgccacctcagagttgtggagtcgaggtctctactttccaaaggaaggccatagcaatattacaaaagagcaaaggatgcaacttaaagagtcatttccagttgtcatatctcatccgtttggaggattcaatttggcttttcgaatgtctaggattggttttactcagcttcaaaatgaggctactttgacacttaggtgcatggaaaagtgtagagatggtggatttgaggaagtttttatgaccaagattgactatgctggtaaatatgactattgtatgaggtaa

SEQ ID NO: 18995 - DNA, 471 bp, Glycine max
  Peptide Sequence Number=SeqID_135773
atgggctattgtaaattaagaagggccgtcctaagcttgaatgccgtgtgcggcttgcctgtagtaaaatcagaagccgcggaaatctggtatagaacgctgttggtatctttgccccaaatgatttctattgttgcagttgcattgcagccaaagccaagtgatccctcattgatcttccctttcctcaaagtgctcgctagaatggattccaacaacaagcagactgatgagaaacgaccagcatcaagagactcattctgccaaagaaagaagtctgagaatgggagttttgtgtctaatttaagaaatcactttcatgaatttatacatgcttctgcggatgaacacaagacatgcttgagaaacacaattcaaaagatattgaatgcatcaaagatttttgggaaagaccgtgacagcacaaatgaaggtgactctgtaccccttcagtcatctacaaagaactag

SEQ ID NO: 18996 - DNA, 213 bp, Glycine max
  Peptide Sequence Number=SeqID_135774
atggacaaaacattgtcacttccaactgtcatatttcagaaatccatgcatcgcgtacaagaggagtacatggatgtgcacgtgtcggatgcagagagggccacgctgcgctgccaccatcacttggtagcaccgtaccgtgcccccagaccacaaaatctcgtcgccagtttctgctgccccttttacattgtatcggatgttttgctttga

SEQ ID NO: 18997 - DNA, 879 bp, Glycine max
  Peptide Sequence Number=SeqID_135775
atgacgctgggtctgatcaatgcgaatcctgtggttcacgccaagaaagagcgaatcgctcgttctgatgatcctcacgccgatgacgccgttgatcctctcgacatctatgatatccttttttttttttcattttctcttctcccactcccaactcaactaactgttgagatccttgacttggctttgacaaatttcgtgagggatattcgggatcccgaacatccttattccctggaacagctcagtgttctctccgaggaatctatctccgttgacgacaaattaggccgaattcttctcagcaaatttcctcccctcacggattcatgggtctctatactagttcttatttgtagtgttcaatggattatggatctagattcctcccaggcagggatttggcgcattcatgcagtcagtcaatcggaattgttggatgaagattggactactcatattttattttgtggtctgacagctgcgatagcgaacaaaatcagagaaaattacggctggagtgggttgcaaaaaacctattttaaccaacggagtgaagcggtccctagccacaatagaggccgctgtagaagggtggctgttgctgaccaaacaacggtcataggtgacaagatagtgttggttagaagtcatcccactatccgcaatagcattttcttggttggccaccctgccccactatttgggattgacaactatggttggtggtgtgtggacatcaaggtttctcctggatctcatgccaacgaagaatcagtcaataagcagttgaatgataaagaaagagtcgctgctgccttggagaatcctaacctccgccagcttgtggacgagtgcctctactccaatgaactgtga

SEQ ID NO: 18998 - DNA, 306 bp, Glycine max
  Peptide Sequence Number=SeqID_135776
atgacatcctacacactttcttctcctaacaccagtctaagatggacaactgagaagaacaaactgtttgagaatgccttggcaatatatgacaaggatacccctgagcgttggaacaacatagccatgtttgttggaggcacaactgaagttgaagtcaagagacaatatgagatactcctagaggacatcaaaaacattgaatcgggcaaggttccactccctgattacacgagaaatgctggatgtggcaaactaaacatcagcagtgcagaacaaaggctgagggatttaaaactcagatga

SEQ ID NO: 18999 - DNA, 2619 bp, Glycine max
  Peptide Sequence Number=SeqID_135777
ggaaagaaggaggtatttgcatctggattttgtttggacgatgagtgctggagatcatatgaggataaaatacatggtattttgtctaaagggttgaatgatagagccaaattcattcaagttacatggagaaatacacattgccagtggagtgtcgatgatggcttgtcggtacttgataaagtgcccttgttcataggaatttcggtgagtactttggagaaagcatttaggatggttgatattggcccaaatgctgaaagtaaagaagaggctcttgaatttcgaaagttttggggagaaaaagcagagcttagaagatttaaagatggtagaattgcagaaagcacagtatgggaaattgagcaatgggcgaagcatcttattttaaaaagaatagttgagcatgtacttagtaggcatctttctctgtccaaggaaaatattgtggttgtcgtggatcaacttgatttctctttgcttcatggttctggagatcctatatcatactctggaaatttgcttggggcatttgatgttttatcaaagcgtttgcgtcttattgaagacctccctttgaaggtgtctagtgtacagcctttagactctgctttcaggtttacatcagtcttccctcctgaacctcatcatctagcaaatgaaaaacatgaatctctcagactgaataagttagttccatcatgcattcaaccactggaagttatgattcagctggaaggttctgggaactggccaatggatgaaatcgcaattgaaaaaacaaaatctagtttccttgtccaaattggagtgagtcttcaaaagatgtgggggatgacatgtactgccactgaggataatgtggatgtgttggtgtctggatatgcatttcgtctaaaaattttgcatgagaggggtcttagtttgctcaacaaggaaattgggaatgatcaagctaagcggattccttctgctgacaagaaactttttatccgaagtcagcatgctaacatgatcaatgggttacaaagtcgttatgcaatatttggaccagtagttagacttgcaaaacgatgggctgcttcacatctattttcatcctgcttggtagaggaggctgttgagctattggttgcatatctttttcttaatcctttgccatatgatgttccctgctcacggatcactgggtttttgagaacaaggaaacagcctctttgcatatgcaagggtaaggctgcgtacaatatccctcccccataccttcgcatagcgaagagcctctgggcaatggggttcctgcggttactctcgcactatgattggactttctctccgctgatcgttgacataaatcatgacttgagccaaagtgatgggaaagaaataaatgacaactttttgctaagaagaaaaggtcagggagaaaatggacaaagtgtaggatcagcaatgttcttagctacagtttatgataaagaatccgaggcttggactggattatcacctagtggaatggaacttaaaaggttagttgcatatgcccgaagcagtgccaatttgttggcaaaactcacatttctggaagagattggtccatttagatgggagtgcctttttagaactcctttaaacaattatgatgcagtaatttttctccacaaggacaaactcccgtatccccaaaggcttctctttccatcagaagttaatcacggaacacatgttgctgaaggacaggccagcaagtgtttccaaccctttttgttgcctaaagatttgaagggcaggccagaggaacttagaaataagttgctgcaagagttctcaaccacattccaagtatggcatgattatctgggaggtgatgttattggcctaacatggggggagtcatatccttccaagaagcggaagcacgaggaagtagtagttgaggaagaatataacccttgcaaggtgttaaaagcggtgggggaagttgggaaaggatttgtgaagatacaactcagtaaccaccttccgttggacattattaacgatttatcgctgtggaattacgttcgaagtcgagtcgaagagttttgggagccaaatgggtcttctgagtatcataaggaaaatcaagcggaaagagaaggaaatgcgaattctaatggtcggattggacaattctgggaaaaccacaatcgttttaaagataaacggagaggacaccagcgtcatcagtcccacgctcggcttcaacatcaaaaccataacttaccaaaaaaaacaataagatcttactggagaaactactttgagcaaacagatggtttggtttgggtggttgacagttcagatctgagaaggttggatgattgcaaattcgagctcgataaccttctcaaggaagagaggctatctggagcatctttactgatattagcaaataaacaggacataaaaggtgcccttacacctgaagaaatagctaaggtgctgaacttggaagccatggataaatctcggcattggcagatagttggctgtagcgcatacactggtgagggtctgcttgagggatttgattggttggtccaggacatagcctccagaatctacatgcttgactga

SEQ ID NO: 19000 - DNA, 123 bp, Glycine max
  Peptide Sequence Number=SeqID_135778
atgaaggcaggaacagcagtacttgtaatcctcattgaactgatcaacaagaactcaaattctatgctgcagcaaaaccatcagaaacaaaaggatcacggatccgcaaaacccattagctaa

SEQ ID NO: 19001 - DNA, 564 bp, Glycine max
  Peptide Sequence Number=SeqID_135779
atgcctatctcaaggactagcaagaagagcaaagaaatggatgatctgccttttaagtcagagtgtcaagtggaaaccatccagtccgcacttctaaatccaaacagccccaaacacattgctgcacttaaattgcagaaagtatacaagagctttcgcacgagaagaaagctagcagattgtgcaattcttgttgaacaaagctggtggaaactcttggattttgctgaactcaagcgcagctccatatctttctttgagattgagaaacatgaaactgctgtttctcgttggtccagagctagaactagagctgctaaggttggaaaaggtttattaaaagacgataaagctcaaaaacttgctttacagcactggcttgaagcgattgacccacgccatcgctatggacataatctacacttctattacgataggtggcttcagtgtcagagcagagaacccttcttctactggctagatataggagaaggaaaggaagtaaatcttgagaaatgccctcgttccaaacttcaacagcaatatggaaaggctggcttatga

SEQ ID NO: 19002 - DNA, 1017 bp, Glycine max
  Peptide Sequence Number=SeqID_135780
cattctagcttcttggctggaggagctacatcttctgctgggagactagtggttcaaaatggtgtcttgaagaaaaatgactttgttgtttcttttcaacaggctgtttggcctcacagtggtcattatcgtccgacagaagaaaattttaaggaatttatttcattccttcaggagaacaatgtgagccttttagacgtcaagatggatccagttgatgaggttgatgacttactttctctgagaagtagtggtcatcttagaagccactcatctgaagaggacttcactgagaacatgaatggcctggagattgaagagaccactactgaagactcagttgcagtagagaaggccaatttgatcgaaaccgagaggccttctgcattgatggcacctagcccaaggcaatttcaaattcttggaagagaactgggcaatcttgaaataccaaaaaggggtaatgtgtttgaaggactagaaaatgagatagaaggtgttgaacaaagttgtgtgagtttccctatggaatcacacacaggtagtcaagaaacaacactagcatttgtaccagaactagaccataccatttcagagaaaaaaaacttatctgatgacaatgatgtagaaaccattccacaagagtccatactcaaaagaatcaactcacataaagaaatgaaatcatatcaactggggaagcagttgtcttgcaaatggacaaccggagcgggaccgcgcattggctgtgtgagggactacccttgtgagcttcagttccgagcattggagcaagttaatctgtctccaaaaagtggatcccgctctaaatcatcttttgctcttagaagcaccattttgttgagctctagtctttcaaatgtggcaagtttatgtggggacttaacaatagaaccacttcacatgccccaaagaggtgagtcctatagttcaagatcagaatgctcccctttgatcagaggaacatcagtgataccagttattcatagttcatga

SEQ ID NO: 19003 - DNA, 183 bp, Glycine max
  Peptide Sequence Number=SeqID_135781
atggtggttttggccgggtctttcatagatctggtgcgtagaggctcagatctacgaaagtcgtttggtcttgcatatggcatggctcttgagctatggagtggaaaatatgtggatgtaggagatttcgggatgaatggcctcaaaacgctttgtcgtttgtggttattgagtcctgagtga

SEQ ID NO: 19004 - DNA, 636 bp, Glycine max
  Peptide Sequence Number=SeqID_135782
gtggttaccattaaaggtgacaatccagatgcagtggtttctggattgatggctgctggggaaacggcctgtgcatcagtccatggtgccaataggcttggtgcaaattcacttctcgatattgttgtttttggagagaaacaaaagcctctagagaaggatgctggtcagagaacaattgcatggctggacaaattgagaaattcaaatggctcattgccaacttcacaaattcggttgaatatgcaacgagtaatgcaaaacaatgctgctgtgtttcgtacacaagaaacattagaagaaggttgtcaattaattgataaaacatgggagagcttccatgatgtccaggtgaaggaccgcagtttaatctggaactccgacttgattgagactattgaattggaaaatcttttgataaatgcatgcatcacaatgtactctgctgaagctaggaaagagagtagaggagctcatgcccgtgaagacttcaaggttagagatgatgggaactggatgaaacacactgtgggattctgggagaacgagaaggtccggttggactacaggccggtgcatttgaatgtattggatgatgaggttgaatcattccctcccaaggctcgggtgtattaa

SEQ ID NO: 19005 - DNA, 520 bp, Glycine max
  Peptide Sequence Number=SeqID_135783
gagcaagagcctcgcttttgtcgaccacaccgccttttgtcgccatgactcaagagctggtagcccgcggagataccttacggttattcgcacccttttgtcatccagaggcggcgggcccgatgacaagcagagaccaagttttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaaagaccaagtttggtcattctgcacccttgtatcatccagaggcggcgggcccgatgatacgcggagatacccgagtggttatccgtataaacattcttttgctatctgtaagacagaacgcttga

SEQ ID NO: 19006 - DNA, 237 bp, Glycine max
  Peptide Sequence Number=SeqID_135784
atgtcatcttctacacttctgttaatcctgacccgtgagtcaggtgacgtgcagagatacccaagcggttatccgtacaaacgatttttgttaaccctgacccgggaagtcaggtggcaggcggggggacaacgggtcaggtggcaggcggagataccttacggtcgtccgcacctttcgtcaaccaaggcgaacgagttcgacggtatccagatgatgttggtcgtccgattctga

SEQ ID NO: 19007 - DNA, 306 bp, Glycine max
  Peptide Sequence Number=SeqID_135785
atggaggcaccagcttttgtggaggacattcctgcggacgcaggcatagaggcggctgaggatcagcatcagggatttccgggtagtccgagcggcccatccgtgttgatagcgtatgcggatcatgttgcttgcagcgagcgttatgaattgaagctatcctctcatgggaggaaggtccacagtttaggcaggcctgtccctgccattgagggacttattgctggtacaggactaagtcctctgatcgcgtgttcggtagacaccagcgatcggggacttttgtccacgtttgtggagcggtga

SEQ ID NO: 19008 - DNA, 216 bp, Glycine max
  Peptide Sequence Number=SeqID_135786
atgttgattgcaatgatgctacgcatgctgaatgttttatgctttatgcaacaatctctgtctgtcacagttgaccatgatccggttgcgggattgcctttaacacccaaaaagcggatgtcatctgatgaagccgatgaagagttagggagctctcaaatttcgccagcccaactatcgtctaacaaattaacaagacattctcataagagctaa

SEQ ID NO: 19009 - DNA, 1288 bp, Glycine max
  Peptide Sequence Number=SeqID_135787
gcacgacttaaattttgagatgaatgtcgctagtgttcccaaggaagaaacggggatcattgtccacttgacaacatgggaagtttttattgcaccaagaggtgttgactattacacaaagaaggaagctgaatcgtttttctgtgttgtgcagagtggggcgaactcttcgtacaccgtggtggatcatacttatgatgctgttgtcgttggtgctggtggcgcgggattgagagctgctattggactttcagaacatgggttcaatactgcttgtattaccaagctcttcccaactcgttcacacactgttgcagctcagggcggtataaatgctgctttgggaaatatgactgaagatgactggaggtggcacatgtatgacactgtcaagggaagtgattggctagctctatggcctacaggagaccaggatgccatccaatatatgtgtagggaagcacctaaagcagtcattgagctagagaattacggattaccattttcccgaacagaggatggaaaaatatatcaacgtgcatttggtggtcaaagcttaaactatggaaaaggtggtcaagcttaccgctgtgcatgtgctgctgatcgaactggacatgctttattgcacactctctatggccaagctatgagacataatacccagttttttgtggaatattttgcattggatcttttaattaatagtgatggcacttgccaaggagtgattgccttgaatatggaggatggaacactacatcgtttccaagctgcttcaacaattttggccacagggggttatggtagagcatacttctctgcaacctcagcacatacttgtactggagatgggaatgccatggttgcacgtgctgggatccctcttgaggatttggagtttgtacaatttcacccaaccggtatatatggagcaggttgccttatcacagaaggatctcgtggtgaaggtggaattcttaggaatagtgagggtgagcgatttatggaacgatatgcccctactgcaaaggatcttgcatcaagagatgtagtttcaagagcaatgacgatggagattcgggaaggtcgtggtgtaggacccctgaaagatcacatctatctccacttgaatcacttgcccccagatgtgctcaaagagagacttcctggcatctctgaaactgctgctatttttgctggtgtggatgttacaaaggaacccattcctgttttgccaactgtacattataacatgggcggtattcccacaaaccattatggagag

SEQ ID NO: 19010 - DNA, 204 bp, Glycine max
  Peptide Sequence Number=SeqID_135788
atggcttctaacaatgctctgcaattaaaacgatacaaaaacaattggcacaaagcctgttttgtgccaatacagtcagatgcccttgttattggttatagaacttggttaaagaagtatgcaggtggtcaggttgattggagaggaaaatatagtggggctctccctccaacacctccaagagaacagcttatggacaggtag

SEQ ID NO: 19011 - DNA, 1170 bp, Glycine max
  Peptide Sequence Number=SeqID_135789
atgtacatggttcagttttgtgctttgaaaggtccaattgggttaagtcagtacatgactcctacacctaatttttttaccctcttaaaaactcaggtacatacgtccaaaaaagcatgtgtagctgcttacccaagtactgtacagaatgatatcttgtggttctggcccaatactgatcctcaatacaaagatattattacaagaaaaagacccccatacataccagaattagatgatccatcgtatactaaattaatgggaaacagagacatttcttatgggtatgaagtactgatagaaaatcttatggaccctgcacatgttccatatgcacactatggactaatgcgtactccgaaaccaaaagtgaaagttgatagagaagggggcaggccacttgaattgtctattgaaacgttagatatcaatggttttactgcaaatcagggttggagtaaaagtaaatttatgccaccatgcattttttatgtatatactgattcagatcaacctgcctcatctgctgaaactcagaaatcatcagctcagaagaagtttgctttaatctttgtttgtgttccggttagtcctggtaaaagcagattgatatggtgcttcccaagaaactttggagtgtggattgacaaaattgtgccacgatggatatttcatgttggacaaaaccggattctagattcagatttatatcttctccatgttgaggaacaaaaaatagttgatattggtccaaagaattggcacaaagcctgttttgtgccaacaaagtcagatgcccttgttattggttatagaaattggttaaagaagtatgcaggtggtcaggttgattggagaggaaaatatagtggggctctccctccaacacctccaagagaacagcttatggacaggtactggtcccatgtggtgaattgcaagagttgcaattctgcttataagagcctcaatgtgattgaagtaatgttgcagatcatatctgttgcttcaattgggattgttgccatcatgaagcatggtacaatgtcagtggcaaaaagaaattcaatggttgcgttagcagtgctatcattagcactgtctcggtggttggctcacttcatatacaaaaacttccgttatcatgactacgagcatgccttccgctaa

SEQ ID NO: 19012 - DNA, 881 bp, Glycine max
  Peptide Sequence Number=SeqID_135790
atggagggtgatcttcaaagggctctatctttgcgcctaaatcgtagaggagaccgaagtaatcaaagtcctgctaaagatgatatgacagtgaaggacatagttactttggccctggcaaataaacttagtttgtttgttggtgatgcagattttgagagggcaagctctggcgcaatggaaaagttgcgccttggtgaccggttggtcatggattcaaatccagaaatagcctctttgcacatggaagggggtacattagttactatgtgtaacaaagatagcaaggttttcaacatgttagacaatatgggacttgtatcaaaacctcacagatgtccaattcctctttccaatgaccctgataaaatagttatcccaactggaagaactcccaacgaaactgtcaaaaatctgtcatatgttatggaagatgaggttccacatagtgaagctcagtcatctcctctatttggaggccatccaagtggtggtgctgaaatgaatcgtgtagacatcaaatatgtcaagaaatgcaaatttgttgttgcatctggaatttttgatggctatgatttacctcatcaaccatcaaatataagccttcgctcaaaggagcttttttgcttccttatggttgtggatgaggtatctctaaaattcatgagggaaaatggtacggtcaaagaagacagagctggtggaaaatgggtgggaatatggagacttgttcttcttaagcatcctccttatgatgaaccaagaaggaatgggaaggttcccaaaattttaacccacaggttgttccctcaagcacagtatagcatttggattgatggtaaaatggagctgatagtagatccattgctaatccttgagag

SEQ ID NO: 19013 - DNA, 1356 bp, Glycine max
  Peptide Sequence Number=SeqID_135791
atgtctgactcactcttaactttctattctctttcagccattcttgctcttctcccaatcttcatcttcattctcatcaaaagaaagcaaagcaaacccaggctcaaccttcccccaggtaacatgggttggccatttcttggtgaaaccattggctatttgaagccttattctgccaccacaataggggaattcatggagcaacacatagcaaggtatggtacaatttacaagtcaaaactgtttggggagccagcaatagtgtcagcagatgcaggactcaacaggttcattctacaaaacgaagggaaattgttcgagtgcagctatcctagaagcatcggtggaatactaggaaaatggtccatgttggtcttagttggtgacatgcatagagacatgcgggttatatcactcaactttctaagccacgccaggctcagaacacacctcttgaaagaggtggagaagcaatccctcttggttctgaactcttggagccaaaattccatattctcagcccaagatgaagctaagaagttcaccttcaatttaatggctaagcatatcatgagcatggatcctggggatatcgagacagagcaactaaagaaagagtacgtcactttcatgaaaggggtggtttccgcgccattgaatttacctggaactgcataccgaaaggcattgaagtctcggtccattatactaaagttcatagaggggaaaatggaagagagagttagaagaatccaagaggggaatgagagtttggaggaagatgatcttctaaactgggttttgaagcattcgaatctttcaacggagcaaattcttgacttgattctcagcttgctcttcgctggccatgaaacttcgtcggtagccatagctctagccatttatttcttacccggttctcctcaagctatacaacagttaagggaagaacacagagaaattgccagagccaaaaagcaaacaggggaagttgaactcacttgggatgactacaaacgaatggaatttactcattgtgttgtgaacgagacacttaggttgggaaatgttgtgaggtttctccacaggaaggctgtgaaagatgttagctataaaggttatgacattccatgtgggtggaaagtccttccggtgattgcagccgtgcatctggatccttcactttttgaccaacctcaacacttcaatccatggagatggcaggaaaagggaaaaagaataataagcagagaggtccccaagcacttgaattggtccttgcggtggatccccacatgcaatcactgcctcattggcttcctttccttgaaggtgtgtggtgtgaacaaaatttag

SEQ ID NO: 19014 - DNA, 489 bp, Glycine max
  Peptide Sequence Number=SeqID_135792
atggttctcatcttgagaagtttacattcagactttgatcacgttcgtgatcaagtcttagctggagatcaggttccgtcgatggattctctcatcactaggctgcttcgtgttccccatgcattgaaagaagaaaatccggctgatgtagtggagacgtcagccatggctgcacctcgtgggagagggggaggacgtaacagtagaggaggccgtggtgggagaggtggacgtcctcaatgcacatattgcaagaggatgggccacacacaagagacttgctactccttgcatggcttccctgacaaagtagctcagctgaaatctgagaaatccagcagccagacttcatcttcctctgtaccatgttattcaacagcatgtatttctcaatctattgatggtcccagtccttggatacttgattcaggtgcctctgatcatatttctggaacatggcacgggtcgattgattggagaaggacgtga

SEQ ID NO: 19015 - DNA, 213 bp, Glycine max
  Peptide Sequence Number=SeqID_135793
atggtggaaagacccggtggatcgttcggtcctgccgaccaacacctttttcggagccccaccgttttcattcatgtgtcctccaccttcgagtttggagctatgcgtagtgattgcttagtgcaactctccattctcaaccctttttcggagccccatgaattgtgttttcgttcatgtgtcctctaccttcgagtttggagctatgcgtag

SEQ ID NO: 19016 - DNA, 556 bp, Glycine max
  Peptide Sequence Number=SeqID_135794
atgacgctgggtgatgaccgtaacatcgcgcaaacctgggtcaacggagcgataatgacttcacgtgccaatccgttttttaacgtcagcccgttgccgtaccagacaccgccgtttgatctgatcgacgaagcgcatttcctgccggcgctggaagccggaattgccgaaaagcgccaggaagtggcggccatcgccagcaaccccgagccggcaacctttgccaatacctatgaagcgctggagcgcagcggtagcctgctaaaccgggtgtaccccgtttttgccgcgatgacctcagccaataccagcgagcggctccagcaggttgacgagctgatcaccccgcagctgacggcgctcaatgacgaaatctaccttaacccggcgctgtttgcgcggctcgacagcgtgtatcagcagcgcggttcgcagtgcccggatgccgaagcgatgcgtctggtggaagtcacctggcagcgctttcagctggccggcgccagtctgagtgagcgcgataaagcgcaactgcgcgcctgtaatcaggagctggcca

SEQ ID NO: 19017 - DNA, 243 bp, Glycine max
  Peptide Sequence Number=SeqID_135795
atgctgattgaaagagttagggttaggattgacattataattcaagggctgaccattcttgctccagttgactctccaaacactgatggaatagatccagatgctatatgtgagctaaatctctgttcaaatattaggcgactcatgtttaagaaagaatttgacacaagctatgtgggattcaattctggatcagagcttctctctcgtcagaatttatgtaatgcgtaccttgacttctaa

SEQ ID NO: 19018 - DNA, 201 bp, Glycine max
  Peptide Sequence Number=SeqID_135796
atgtcgacactccaaacgaataatgcagaacttaaccaaaagcagtctttagttgaactagaacggatagatcaaaaaactactgattcggcagttagtctactttctggtttacatcgtaaggatgttaatgcttttaaaaaagcgacacaggctgcgcagcctttaactgaagcaaaagtagcagagccaagggcttag

SEQ ID NO: 19019 - DNA, 276 bp, Glycine max
  Peptide Sequence Number=SeqID_135797
atgttagccatgatcagaaagtaccaagaagaattaaatctagccacagcccacgagcacaaagtggaggatgaatatgcccgagtgtacgcggaaaaggaggctagaggaagggtgattgactcgttacatcaagaggcaacgatgtggatggaccgatttggtcttactttaaatgggagtcaagaacttccccgattgctggccaaggccaaagcaatggcggatgcctactccgcccccgaggagatccacggactcctcagctattgttag

SEQ ID NO: 19020 - DNA, 318 bp, Glycine max
  Peptide Sequence Number=SeqID_135798
cttctcgaaacatccttcatcctttcactattctctctcttggcttctcccgaaaacctctgcactcagctgccgacggtggtttccggtgactgcatcggaaagtttgtgctggtcacaggtcagttcttgcctcttctcccactctcactcttgactgcatcaaaaacctccttcattcttgactgcaacggaaagtttgacggcatcggaaacctccttcattcttgcaaagtttctcactcttgtctctctctcttgcagcagtttttccctctgcattattctgaaaaaggtgccgatcacaagcaaggttag

SEQ ID NO: 19021 - DNA, 360 bp, Glycine max
  Peptide Sequence Number=SeqID_135799
atgtttcaaaatataaattcttcttcctccatgctttctttcaaagggagtccatactggatggcacccgaggttgtaatgaatacaaatggcaatagtcttcctgttgatatatggagtttgggatgcacaattcttgaaatggcaacatcaaagcctccttggaatcagtatgaaggggtagctgcaatatttaaaattggtaacagcagagatatgcctgaaattcctgagatatgccttggatcttgggttcttgagctctcgtctgaacggcctcagaatctgcttccccaaattgccacccacacccctcactgcttctcccttccccacacccctccctatcgttgccaataa

SEQ ID NO: 19022 - DNA, 468 bp, Glycine max
  Peptide Sequence Number=SeqID_135800
atgaagatcttaaaatggtataccaagaatctacaccatctagaagcatctattgttgaaaggtacattgcagaagaagcaattgaattttgttcaaagtacattgaaaaagctaaacctgctaggcttcccgagtctcggcatgatgaaagagtgggaggtaagggttcaagaggactgcatgttatcactctaattctagaagatttgcaacaagctcatttgtatgtgttgaataacagtgatgaagttttgccatacatacttcgccacaaaggtttagtaaaggaaagtaatccaaaaatttcgaagaacaagctttccaagtttattttgatgatgccaaagactcaagtcaagaatcaagagtcaaacaagtttcaagaatcaaagaatcgttcaatcgagaaccaagattcaagagaagactcaagatatgcaagaacttcaagaaaagcttcaagataa

SEQ ID NO: 19023 - DNA, 303 bp, Glycine max
  Peptide Sequence Number=SeqID_135801
atggaattaaaccaacctcatcttattagagaacaaaaggttttaactagccaaaatcagagtgatagtacaattgccttaacggctcctaattatgttaaaaagaggctaagtcatgaagtgctaaaagtgacagttgagctcagctcatcatgcgttaagcaacgtaattgtcttcagccagactcagcgcatgactggcgtaaagctcaaatccacttactcgcactaagcgctagggtggcgctaagcgcaacgtcacggattcagagcctatttaaagtctgtcttgtgcaaaattag

SEQ ID NO: 19024 - DNA, 501 bp, Glycine max
  misc_feature (5)..(5): n is a, c, g, or t
  Peptide Sequence Number=SeqID_135802
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtactgccaagcactactgaaatccttgaaaactggccgtgctccagaagtagaatcgtggaagcaattagcactatctcttgaggagaggattagaattcaccaacagggtggatatgctgcaaatttagctcctgcaaaattagttggcaaattgctcaacttttttgatagtactgcacatcgagttgttggtggtttaccaccacctgctcctttgccatcacaaggaactattcatggaagtgaacaacaataccaaaatatggcacccagagtatcctctagccaatcaacaatgtcattggggatcctctag

SEQ ID NO: 19025 - DNA, 442 bp, Glycine max
  Peptide Sequence Number=SeqID_135803
gactaaccgcctgagaatcctttgtcttaacacattggaggatacatcctttgtggtacaagtagagggtacatctacttgggttgttgtactgagaacaagagagggtacatctcttgtggatccgttcaagtggaggtacatccacttggttgttcaaagagaacaagggaggggtacatcccttgtggatctttggcttgtacaggattttacaaggttgaaagaaatctcaagaaccgttggttgcttgaggactggatgtaggcacggaacaagattagtctctaagttgagccttgctatcactccccatccaaagccttacaaacttcaatggctcaatgagcaaggggagatgatagtcaatcaacaagtgaaagtgcccttctctattggaacatataaggatgaagtgatttgtgatgtagttcctatggag

SEQ ID NO: 19026 - DNA, 294 bp, Glycine max
  Peptide Sequence Number=SeqID_135804
atgaaaactaaaatacctgaatatcctgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatccttgtttcaagattcactaaagaccaagccttgccttaaaacaatgtgctttcaagacatgcaaggctctggtaatcgattaccaggaagtgtaatcgattaccagaagacagggttgagaaatagctgttga

SEQ ID NO: 19027 - DNA, 291 bp, Glycine max
  Peptide Sequence Number=SeqID_135805
atggcatttgtaggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactaccggaagccattcaccgatacagttgacggaaccggggaacaagactattttttttgggttttttga

SEQ ID NO: 19028 - DNA, 588 bp, Glycine max
  Peptide Sequence Number=SeqID_135806
atgtgtctcccccacggtttaagagacacgtgcatgatcagtttggggttgttggctctcaatgggtataggagtggagttattgacattctcattgggagtgtacgccatattggggggcgtatagttgagaggcaagccatatggtgggaaggcgtgctcgttttgaatttgcacatcatgggggcgttcgtacttcccaaatctttgcccaccatatctgaggttggatggttcatttcgttgagatcagatgggggcatcgggttcaccttagcaacagcgctggtagcggaaactgcaaccgcattggcttccattatcttcttcatgctcatcatggcctccatgattgtggccatttgctctttcatggccttcatgtcggccttcatctactcttgtacctcctctgctttacccattactctagctctagcacgggttcggacatgtgatgcaagctccatgggagcttgtaggcctaggatcttcttcatcaatggattcctttgcttcttggaagataaatggcagcggaatggggaaggaagagagagaggagacgccacttcaaggagaagatga

SEQ ID NO: 19029 - DNA, 114 bp, Glycine max
  Peptide Sequence Number=SeqID_135807
atgggaaacgctatggggagtaaaaaagccaagataatgaaaatagacggtgaaacgttcaagctcaagactccagctagagcaaacgacgtcgttaaggactaccccggacac

SEQ ID NO: 19030 - DNA, 387 bp, Glycine max
  Peptide Sequence Number=SeqID_135808
gtagttgtatctctgccaaaaccacctctgaagcccgatccggaggtcgatgatccgctttatcaggttagatgggatgccaccatgttcggggtcattaatccaaatttccccctgcatctcactgaaacatgtatgcgagtagggaattctgatatctatggattcctcgagccacagtccattcagaggtctgggcaatcgcagtttgaatctgaaagttacataaagagttggatgcagagttcacaacgcgatgtctatcttggagcctacctaaatgggccagacaactaccttaaggggattattaatagtgctatcaagggtcgtgatgatgctccacagcctaaatcaaaggcttatgctaggtggattgtcgtcaag

SEQ ID NO: 19031 - DNA, 172 bp, Glycine max
  Peptide Sequence Number=SeqID_135809
atgaatatcttgatggcacacaatcaagagtgggaacaggagttaagtccttacaatcaatatgaagaagaaagaactcctaatcttgaaagtgtgtttgaggaattcatggcataccataccagctcaaaagctaatcaaaactcaatgaaaaatcatgaaattcattttg

SEQ ID NO: 19032 - DNA, 168 bp, Glycine max
  Peptide Sequence Number=SeqID_135810
atggctcaacctccaatcttgaggactgatccgatgaatacgagacttgttgggtcaaaaaccatgatagtgatactgactcctcttccggacctgatggaagtaacatgtctccatcccacgaaacaatattcaaacgggattgtgtgttatgtccatgttcaatga

SEQ ID NO: 19033 - DNA, 378 bp, Glycine max
  Peptide Sequence Number=SeqID_135811
atggccggtcgtggcggggctatcagggacgccaacaaccgtagtaagcggtcggacggggtggttccggcggtgctgtggttccaaggtgaaagccacgcaatccacgaggaagacgctgcggcttacaagttcaacatggagactctcatccacaatcttcgtcaagacctcaattccccatcttcttttacggaggcatcttcttttgcattattagtttggtacaaagttgcattagcctcagggtctgaccacacagagaaagtgagagaagcacaaaaagtaattgatcttccaaacgtgatttgcgtggacgcaaagggattgcaattgaaggaagataatcttcacttaattgggtcacaagctggctga

SEQ ID NO: 19034 - DNA, 264 bp, Glycine max
  Peptide Sequence Number=SeqID_135812
atggatggccacttcattgtctctgcagtgattttttttatcaatgaagttatccctaacgatccaaagggatccctaacgacttcttcgtggtacaaatttgaatatgaaaacaagaaaagcaaaatcgattttgtttggtgggcttcgctggctttcacggctgggttcgcagttggatttcatgggaatttcacgaaagaaagaatactaaaaaacaaaagggctaacattattcatagaattggatcagcaaatccatag

SEQ ID NO: 19035 - DNA, 663 bp, Glycine max
  Peptide Sequence Number=SeqID_135813
ggttcaggtctcactggtttacctccatacatcggaatgctgctcggacttggcatgctttggatcctcactgatgctatccattatgatgaatctgaaaggcagaagctaaaagtgccacatgctctgtcaaggatagacactcaaggagcactatttttcttgggaattgtattatctgttagcagcccggaggcagcaggtattcttcgggaaatagcaaattactttgatgcacatgtcccaagtagtgaactgattgcaagtgctattggactcatatctgcattaatagacaatattccattggttgctgccacaataggaatgtatgatgtctcttctttccctcaagattctgagttctggcaactgattgcattatgtgctagtactggcggatccatattggttattggctcagctgctggagttgcgttcatggggatggaaaaggtggatttcatttggtacttacggaaggttagtggctttgccttagcaggttatacagctggtattgcttcctatttagtgcttcataatctcaacatcttgcaaccatctctagcggaggctcctttcctttcatgtttcataaatcaagaattcggacttcattccaatccattgtcatggtatcaaaagcagcatagtttgtaa

SEQ ID NO: 19036 - DNA, 255 bp, Glycine max
  Peptide Sequence Number=SeqID_135814
atggggcagagtagagacaaagaaagagagcaaggaagagggagcgggagtgatggtgtggtgtcggggggcttccggtcttggcggcacagagatgcaaagcttcaacagagcgggagaggagtatataccagagaaagtgggagagcagttgttgctcgtcagtggcttggtcctggagtatatggggtagttgcatcaagcaaattcagacattctcttgggaagaaaagtaggaagcaaaatagtgaatga

SEQ ID NO: 19037 - DNA, 192 bp, Glycine max
  Peptide Sequence Number=SeqID_135815
atggctggaagaaaaattgggggtgagggttttcgagagagaagcttgttgcaggtgcagggacgcattgtaatcgatgacacaaatatggtaatcgattaccagagagcaatgttgccagaaataactgcttgtaatcgattacactattatggtaatcgattaccagaggttattttagccagaaaataa

SEQ ID NO: 19038 - DNA, 383 bp, Glycine max
  Peptide Sequence Number=SeqID_135816
tcactctcttccttcaacactttaacatccctcttgattttgaaccttatgttccaatcaagagatccttcttaattggtgccgttgtgattgcatcttttggttaccgtaaagagcatgatggctcttgggtgaaaaaaggtgcacaacccattgatgaagaaggacacttaccagttggagaagattcctctcttcttcaaaggattttggacaggttcgatggtcttcaaacctttgttggtgaaaggtttgatgctctggaattacaagtggacatgttattcgatgaaatggatacaaggatcaccaaggttgaaggagatgtctctcacatccgcacatgctttgatctaccaccaccaccacgaccatcatcttag

SEQ ID NO: 19039 - DNA, 315 bp, Glycine max
  Peptide Sequence Number=SeqID_135817
atggtattttccttggttttcttggaccctagcttacccaaactagcctctggctcgcctgggccaccaaataacttcatggtgaagaaaccaactcgcctgggcgagctacaactgcctcaaagtaacccttttcctataaataggtgttctaggggtggttttaagggtgagaaggtccagaaggtgagggaattgagagaaaacagaaagaagaagaagaaagaagagaaaacgaggctgaagcgctaccgaatcacgatcatgatcattccctacattgttccttgtacagtgttcttcatgcaaccatcg

SEQ ID NO: 19040 - DNA, 156 bp, Glycine max
  Peptide Sequence Number=SeqID_135818
atggccctctacgggtcggcgttcgcttactcgaacccactcaaggatactaggctgccttgcagcggcgttttctgcttgtccagagctgggaagggacgacgatctgtcggtcgtgaccctagcttctatttgcgtccgtccctaagtacctga

SEQ ID NO: 19041 - DNA, 339 bp, Glycine max
  Peptide Sequence Number=SeqID_135819
atggcctttttggagaactcttgggattttactttcttcatctcctttttttccttcatgcacctcaaaaacaccaacagacaaaaatgccctcacacaagcaccccttattacaaaatggttattctggaagagtattctatcctgcttgcatacctcacagagcatcacgtggagcggaggtcggagagggtgaggacaatggtcatgcttcacaacaggttcaagatccttctctatccacgctaccatgggttcatagtagcggcacaaggaacagtaaggttgcaggaagtagaaatgggtgtaagaagtaattgcccaactcttaactactag

SEQ ID NO: 19042 - DNA, 336 bp, Glycine max
  Peptide Sequence Number=SeqID_135820
atgggtaaaaaaaaaaatctgtctcaaaaggtaccctgcaggagaaggggaggcataaggttcacaatcaatggccactcctacttcaacttggtcctcataacaaacgtaggaggtgctggggatgttcatggtgtggccatcaaggggtcaagaacagggtggatgccaatgtccagaaactggggtcaaaattggcaaagcaacaactatctcaatggccaaagcctctcattcaaggtcacaaccagtgatggccgtacagctgtgtcctacaatgttgcccctgctggttggtcctttggccaaacctacactggtgctcaattccgctag

SEQ ID NO: 19043 - DNA, 1008 bp, Glycine max
  Peptide Sequence Number=SeqID_135821
atgccgacactgaaactctccctcttcgtctccctcccaaaacccttaaacctcagaccccaattttcgcgccacccaataaacccaaacccgacaacctcggaccgtggcctcgtattccacgaaaaagtgctctaccttaaagccctcaaagtgaaccccgacaaggccttccgcttaaaccccaccctccgttcctctcctctctcaacccttaaatcggtgacgcgctccctttcttcattgggcattccacgcgcctccatgggtcgaatcctcgacatgctccccgtgctcctcacgtgcgacccctatttccaattctaccccctcctcgacttcctcctccacgaggtcccaatcccctaccacgacatccacctttcaatcctgcgctgccctagattactcgtttccagcgttaacaaccgattgcgaccaactttacactttctgaggaaattagggtttaatgggccccactcgctcacgtgtcagaccacattgcttctcgtttccagcgtggaggacacccttttgcccaagattgagtttttgaagggtttggggttcactcacgaagaggtggctaacatggtcgtgaggtcacctgggttgttgactcttagtgtggagaagaatttgaggcccaaggtggagtttttcttgagggagatgaatggggatgttgctgagctcaagaggtttccgcagtatttttcttttagcttggaacggaggattaagccgcggtacgggatgctgagacgggttggcgtgtcgatggatttggaagatatgttgaagcaactgcaattttggcggcaacctcgagatcttttgaggatgcaagcgactgcaattgcagctgcatttgttcgcaatttcctgcagtgtcaaggattgcggcatgactacgactgcaatgtacaaagggattcttgtgattcaaaggaaatgagattttggtttatggaaaacaaggagttggatttaggtgcactttag

SEQ ID NO: 19044 - DNA, 525 bp, Glycine max
  Peptide Sequence Number=SeqID_135822
atggagtatgcagctagtgaagtagagggaagttggtgcttcccttctttttgtaaaaaggataagctaacaactttgttagttactgagagatataggagtagcagtactctaggcctaggtcgactcaagacgggcggtgtgacaatggtcttattgaagtttttggacttcttggatgttggtagaagtgtgcatctcaagtatggatgtgcattaattggggttggattcaattgtgatcatgaaccccaggaacttgcctccaccgaccccaaaaatgcatttttccgggttgaggtgcatgctgtatttacggatttctccgaatacttcttccaggccaaagggcatgaccctgttgcaaaagttgacatctccagtgatgaatgtcgttttctcttcatttggggcatgtatccgaatttgatgatgccaaagaatcaagagttaagcaagttccaaagaattaggagtcaaaaagcttcaagaatcaagtttcaaagaatcaagattcaagaataa

SEQ ID NO: 19045 - DNA, 426 bp, Glycine max
  Peptide Sequence Number=SeqID_135823
atgggggagacacatgaaattccccaccagaatctagctgatttcgagccttgcctcgaatatgccactgaagggcaagcagttagtggtatacccctacaaaacactttggaggggcctcaattttgcccccaaccacaacccttatatgaaaaaatggtgggttacacaccttcaagctttgcggattttgtcttcactggggaaaggatcaaagtggatctggaaagaggcaaatctaatcatcctgctttgatgaatgcgaaaactggggcaaatgaagagggtgagaatgatggtgaaacccatgctgcgactgccattcctacatggaaaatcccccaccagctcaacaacatcattactcagccaatatcagcccttctcattacccaccacctagtcatccataaaggccatccctaa

SEQ ID NO: 19046 - DNA, 690 bp, Glycine max
  Peptide Sequence Number=SeqID_135824
ggcatcgacatcttaccccggtggggcaaagatggcgtggtactgccgccgggcgaatttctcccgcatattcactccgaatacgcctggctattactgaccgcctttgtcctgcaggaagcggtgcagaatatcaatcgctatcagggcgagttctatttttcggtcaatatccctccctgcatcgcctatcacgataatcttgcccgtatgatggaaaccgcctggcaacagctacagaacccgcagtgggccaaccggctggtgctggaatttgctgaaaccgtcgatttacagcagcaaggaaaagcggtggagaatatgagtaatattcagcagcagggctttcgcatctttctcgacgactgcttctcgcacagcagcgtgatgttcccggtacgcacggcgcgttttagcggctacaagctggatatgagcatcgtcaatgattttcagcgcgacccgcacgcgctggtgttgattaaaagcctggtctactactgccagctaacgcagaaccgctgcatcgccgagggggtagatagtctggagaaatttaatcagctaaaagcgctgggagtcgatcgtttccaggggtatctgttctcaccaccggtcactcgcgagcatctgggagagatcatttcgcgatttttaccagatcatgccacctgccggttggccgggtaa

SEQ ID NO: 19047 - DNA, 237 bp, Glycine max
  Peptide Sequence Number=SeqID_135825
atgacgccgagagaaaaccaggtggcggaaattgtctttgttccaaccggtgaacatctgagcattattgagcataccgatgtcgatcccagcctgaaaggccagggcgtgggtaaacagctggtcgcgaaagtggtcgaaaaaatgcgccaggaacagcgcaaaatcattccgctgtgcccgtttgccaaacacgaattcgataacacccgcgagtacgacgatattcgcgcctga

SEQ ID NO: 19048 - DNA, 240 bp, Glycine max
  Peptide Sequence Number=SeqID_135826
atgagaaaaattgaaaaagcaatttactttggaatcgatcatccagagcttctccttcaaagtacttcaagtgagcgaacctcaagatttcatgacggtgatttgaaggggatcgagactccagcaaagcctcgcgatgatgtaaagcaagagagagggagggagggagagattttgagggttttggcaaatcttaagaagaattctggtggtaaaagcttattaacgtgcatatactaa

SEQ ID NO: 19049 - DNA, 248 bp, Glycine max
  Peptide Sequence Number=SeqID_135827
gtaataaatacttagtacttgtcgcaacgtgccctttcgcgggcgagcgagggcgaggctcacgggtgcgctttccaaaggaggaaagatgcacggagtcgccaccaacgtttatttgtggaaaacgtcggaaaaaccgaaggaaaccggtcaaaatgaaaattctaagtttggaagttgtatttacgttcgaggaaggtattggcacctctcacgtttgtctcaaaggacaacatcctattttttag

SEQ ID NO: 19050 - DNA, 720 bp, Glycine max
  Peptide Sequence Number=SeqID_135828
atggcaagagtagccaaggtagttaaaatcttggtacaagagttggaccatgtgaagcaaaataggaacgggttagtcaaaataccaaggaagcgtttggaggaaaaggcgaagacattggcagatcaaggggaatgggcttcgtttattgacatcttggcactgttgatatttggagtcatcctctttccaaatgtggaggggttagtggacctagcagcgattaatgctttccttgcttatcaccatagcaaggaaagctcggtcattgctattttggccgatttttatgacaccacctttttcgccaagaaagtaggcccgcctatccactgcaaggaaggaagagccggggttttgtcctcatgtgaaggatttccaaatgttcccttgatgggaacaagggattgtattaattataatcccgtcctcgcgataagacagcttggctaccccatgagaggagcaccgtcgaaggaaagcatcaagcctttcatcgcgcggggtttcagtgaccccaatacgagggtacttcaaggggctgcaagagaggaagaggttgaaactccggaggaaagtgaggaagtgcaaaccctaaaggcggaacttgaaagagcccaagcaatcaaagagaagttcaagtcaacggccatcaaattccggaaagagtacgatgaactaagggatgtcaatatggccaccaccgaagccttggaatga

SEQ ID NO: 19051 - DNA, 234 bp, Glycine max
  Peptide Sequence Number=SeqID_135829
atgggggcccacttgggccttccagggggttccaacaaaaggtggtgccttctggtggaagcaacccagctcgcttgggattctcttgaaattagtgagaaaaattgtttccgtgaagaaaatccacgccgaagcactttcataacgtttccgagacgtttccgtgagcgatttcgagaagattcttcaccgttcttcatcgttcttcgtcgttcttcggtcttcaaccggtaa

SEQ ID NO: 19052 - DNA, 192 bp, Glycine max
  Peptide Sequence Number=SeqID_135830
atgtgcacgtatgcaatttttgatagccaaagtgctttgagtatgcatgtatgtaaatttagcaaaggaaatgcgtgtgatgtagcatttcttggtaaaactaactttccaaatgtttgccttcgcaggaatggccccgaggaagcttgcctcaaagaggtccaggaaggacaaggcgaccgaaggaactag

SEQ ID NO: 19053 - DNA, 459 bp, Glycine max
  Peptide Sequence Number=SeqID_135831
atggagagaagagaaaaaggtgtgtggggaggggataaaaggggtggtggattaatggtggaaaagttaagggaagggactttggtggggaaaaagggagggcctagtactccaccacccacatggagacttgagcaaaatggtggtgacaaggttcaagagtttcttaacttttccacttcaactctttctgctagaaagctctgtgccaacctctgggaagttcttccccaccaacaacagcaacagcaacaaaccccacttgtcaaaatgaacaagcttggcacaacccaccgccgccgtaaccgccgccgccggagccaacaccctagggacactggctctgaagtgaacaacaacaacaaccaattggctgatcctccagacaacccttctgattctgatcagaattatgctgttgaccttccctttgttccgtatataaaggatttttactaa

SEQ ID NO: 19054 - DNA, 1006 bp, Glycine max
  Peptide Sequence Number=SeqID_135832
atggagactacttgcttcaatcctaggatgcgatttagaagcatagtagttggcctccccttctcctacctgggcatcccaatttttgttggaaagcttctcttctttctacaatggggcgacatgattaaggagctagatggttggatcaaaaaatttgtgtgggtggggaatcctgatcagcgtaagattttcactgtcaagttgcattcggtctgtagccccctctctgaggggggccttgatgaatcaactggttatgcttattatcccacccttcggaaatggtatggcattgaacttcctttgattgaaacttctaattggttcattgcttcatcgtatggtttagtttgcttcatgaacaatgacaacaaaagcaaattacgcatgtgcaaccctattaccaaaagctacaggaacctcgatgagcctccagctttggaatcttctgattacaatgcattggcaatgccagtgaacaggaaatcccacagttacaatgtggcaattgtgaaatcaaagcaaatccctgaggattttgtccaatggggtatctcaattcatatatacgattcaaagaatgagacttggatgacaacttcaacagaggttttgatggggtggagaggagtcgggggtgtttcattagaaagtcatcatgcactgttagcatacaatatctcctactgctcttcgcaaactaccttgagaacgagctttattgatgtaccttattcactaacatgtggtcgtctgatgaatatgaacgagaagcttgtaatggtgggaggaattgataagcatgatcgaccttgcataataaagggagttggtatctgggttctcaatgataggaattgggaaaagattgttcggatgccccacaaatacttccaaggctttaatttgggaagcttgaaatttctccataggttgttctccatccaagcagttgctgctattgacacttatgtgtctgagtttttactcctttgttcttcaa

SEQ ID NO: 19055 - DNA, 4425 bp, Glycine max
  Peptide Sequence Number=SeqID_135833
atgatgcctgcatacagaagcatggactcgtacccatgtcagagaaaccaaatacctttccctcattattatcatccaggcattgaagctattccccctcaaatgaagcttgatccatccaaaccacccttttcttatgaccaacattggccctatgccggcaattttgggcaccctacttccccacatttctgctgtggccacaacaacttcccttgtcattatagctacatgccttcatatcctcatgccccttctccaatgtactattctggaacttgtccttcatatagtgaaccatattttgttccttattccccacaaccacattataccatggagctgcctaggtatgaaaatgacaaatgcatgccccgagagcttcattgttctggttctgctaatcatccatgcaaccaaaaggaaggtagaagtgtgaagattgaagagcatgaactggatggtggaaagaaagagaatgatgctttggtcccaattcagctcaagaattatccatatcccttagtttggattccacaggagtacacaagtaacaaacagctgaaaaatcctagtacaatggaagttcgtgaacaaaacaagccttctagtcttgagaattctaatgttgatgcgcagccaacacaggagcctatagtatggaatggatggcttcccttcaatataaagggtgcccggaacatgattcacgatggatatggaacaagaaaccagaaacaggagtctggcaataatagaggggaatctgaaaatggaaaaatagaccagaaacatcaaagtgaacagaagaggtcagaattcccattccctatcttctggttgccttattacaataagcaggaggagagtggagagactaagaaccaggagaaaaacatttcttcaccaaaaattgttgaggaggtaccccatacattcaaatttgttccagtgaagtctcatgttgatgaaggtggtaggaacagaaccggatcaaatcaagctgatcaatccacaaatacaaatgcttcttcggatgctgtagagaaagtgaataatgccagaagcatacctgtgaagcagatagaatcccacgaaggaaaaaatgtttctctcgatcaaatggaagagaatgtgacacaaaaggactcttgcactggggacaaaaagagacaatctacatcttcacctaaaggatccaagttacctccggtttgtctgagagttgatccactaccaaggaagaaaaatggccacgggagttcgagttcgaggtccccaagtccaccttcatcaaaagggaattcccaagctacaactggtgaaacattcaagactcctgtgagtggcacacatgacaaggctcagccaaatttgaatcatcagaatgctccaaacaccagtgagaaagttaaaccaaaggagaacaccattccggtgtcagaatgcatgactaatgaaaacaagggtgttgactgtagggatggatgtcagagccagatgaaagtaaacatacccagtaaaggtctgaaaggggcaagggaaacatgtccagatgatgatgactataagactgaagataaaaaggcagagaaaggagcagaaaatatgatggaggaaactactgaatcaagggaagagaaggattcaagcacacgaactgatgcgggtcgaaaagatggaagagttttgtcagatgcagatgctgctgttttgatacaagctgcatatcgcagttatctagttagaaaatgggaaccgttgaagaagttgaagcagatagatgaagtcaggaaggaggtgactcgtgttcaaggccgtgttcaagcttttgagagatctcccgaacttcaaaatgatgacaaacaaaaaattgcaattgaagagaccataatgaaactcctgctgaagttggatactatactgggtttgcatccaagtttcagggagatcagaaaatccttggctagggagctcataatcttgcaagaaaggcttgattctataatggccaagaaacctcagcagcagatgccggatgttcaggaacacgttgaaatcactccaatgaacatgcagagtgaagaacatgtgcaaaagcagcaagaagaaaaggttgctgtaccagaggattcagctgaaggcactagggatgatgtaaaaggtccttgtgctaatgatggtggaagtgaatctcagtcaccagttgatcctccatcaaatgagggagcagagtctgttgcacttccaaatggctcagataatgaggacaccagccaagtggttacatctgatgcattgaattcttcaagtgatctgtctgagagtgacaaaatggctgtggaatccgaagctaaatcagaagtgaaagacaatccgattgcggaagacattcccattgaggttgataaattggacaagactgtttgggaagaattgcctgtgggagttattgatgaagatatcaatgatgttagtattgagaaggaagaacatgatgatattagatcgggaagtctcccagccatggtgaatgattcggcacaagaaggattaaattcagagagctatgcaatgatggaactgccattgggattacatgaggagcatgaaagggacaatgaaatgaatatttctaatggagaaacacggtctgagaatgagatatttattgaggagcttcctgtgggactgcacgatgaagatacaacaatatctaaagataagagggatggtcaagctaagcctaaaacatataaagaggttcgactagctcaagaaggggaatgcaatgcagatgaggaaacaagttcttccacagatgacactgccaacgaaactcaactagagcaacagcagaagctgaaagagcaagaagaggtgcattattctagggaatcagatggctgggtaaaaattgagtacccggaagaaggtgaactcaatggtgatgcaccaatggatataagagttgagtgcaagtcaggtgaggaagctggaactgatactaagttgcttcctttaacaacacaagtcagtgataatgaaccagaaaatgaagatgtattctcagaagcaaattatgtaaataacaaattaaccgagccaatggagtttgtaccttccaatgacacacagaaggaggagacaccagagatggttgctgaagaggcaattatccctgatgataaagacacagaaaatttggccaaagagaaaactgaagtatctgcagaaccaccacctgcattgcaagaccgagggttaaacggtgactcgaagttattagaagagaatgagaagttaagggagatgatgaagaagttgcttgaagccgggaatgaacagttaagcgtgatatcagatttgactgtcagagtgaaggacttggagaagaaattagccaggagaaggacctttgttttccttgtgttcacaaccctgtttgatgcctctgttgcgggtgtaatttctatttactggggacagaatggtgcagaggatactttggccaatacatgtaacggtggcaattatgccattgtgaacatagctttcctatcctcatttggcaatggaaacactccagagctcaatcttgctggtcattgtgatgcaaccaataatgggtgcagtttccttagtggtcagattaagacctgccagaataaaggtatcaaggtaatgctttccataggaggaaattatgggaaccataacctttcttcagttgatgaagccagtctgaacctacttatcatgtgggaatgcctggaccttataaatgaggctaagatactcaagatcggtgtgctatgcttggagaaattatacaatgactcaaggatgcaattaatcactaatgagtcaatgaggcttgatggtttgaggaaaaaagggaaatttgcggagcacttatggaacaactttcttgggggtcaatcaagcacacgtccattaggcaatgcagttttggatggaattgactttgccatagtgacaggctcaacccaacactgggatgagcttgccaaggcaatatcagagtatggcaaacagaagaagatatatctaagtgcagctccccagtgtcccttcccagacaaatggctaagtagtgctatagaaactggtcattttgattacatttgggtccaattctacaacaacccaccatgccaatacaatgggaatacagagaatctcaagacctattggaataagtggattggaaccaaggctggtcaagttttcttagggttgccagctgcaccagaggcagctgggagtggttatatttcgcctaatgtgcttatttctgaagtgttaccatttattaatggttcttctaagtatgggggtgttatgatttggtctaagttctatgataaagggtatagtacagctattaaggcccatgtgtga

SEQ ID NO: 19056 - DNA, 405 bp, Glycine max
  Peptide Sequence Number=SeqID_135834
atgttggaagatgtattggtgatgggaaatatacgtgttcttgggaagacatatgagttggaaaaaatacactttgtaaggtggagaagtccttggtttgcatggaaaaatgaaatggtggtgttacatttcatgagcattgtgcagtccttgaaacctaggccaggggtagaggatgaatgggtttggaaaagaaacccgagggagggatacatatctactaaagcaccatccaaagtggtatcttttgtatggagactactactacttgatgcgatacaaacaaaaatgaaatttgaagaagaggaaccgccaaaccctgcaggacaattatctctgcgccctttgtggagaagtggagcaaacttcgatccatctattcctgcaatgcaagtttgcatttaa

SEQ ID NO: 19057 - DNA, 4188 bp, Glycine max
  Peptide Sequence Number=SeqID_135835
atgaccacgaacggccaactcacctcctggcctgccttcattcaagctcttcagacccgtttcgcaccttctcactatgatgatcccactggtagtctcttcaagctcactcagcgtggttcggtgactcgatatttgtcggaatttgaggaactcgctaaccgaatcgtcagtctccctccccaattcctactcagctgcttcatatcgggcttgactcccgaaatccgccgtgaggtgcaatcgctgcagcctctgactttggtgcaagctgctggcctcgcgcgtcttcaggaggagaagctcctcgacacgcgttcatccttccgcaaccgtgctcctccggttctctcggttcctccaccgcgacagaactccacacctgctcttctccaggccccttcgtctcctgcgacgtcagcaaggcctcctccggtgaagcgtttgtctccagctgaaatcgcttctcgccgtgaacgcggcttgtgctttacctgcgaggagaagtaccatagaggtcacagatgtgcctctagggttttcctcctggtggctgctgaggacgaccaccctgaccctcttatagaggacttggacccaggacccgacccacccgacagtccaaacccaactgcggcccaaattagttttaattcactatcgggtaatctagcacccgaaactctccgcttattgggtctggcctccggccaccatgtcgtcgttctcgtcgatgggggaagcacccataacttcattcaagaagaattggtgcagagcattggtcttccaacccagaccaccacccctttacgggtcttagtgggtaatggccagcacttagcttgctcaagctggtgtccgcgtgtcactctcaccattcaggacctcacttgtgacgtggacctttacgtcttacccattgcaggagcaaacattgtccttggggtacaatggttaaagacattgggaccggtccttactgattactctctcatgactatgaagtttttctatgaccagcgtttaattgagcttcgcgacgacactgacctcaccattaacatgctcactccacctcagctttgcagatttttgaaacacaatgaacatgcatcctgcttccacattgcggtcctcacagaggcagttcctgatgagccttcacaattattggaccctcaaattcacgcattaattgatcactttgggccattgttccagacacctacatcccttccaccggcgcgcattaccgaccaccacatccatttatttccccaggctactcctgttaatgtaagaccctacaggtacccccattaccagaagcaggagattgaactccaagtcgaatccatgttgcagaagggcttgattcgacccagcaccagtcctttctcctctccggtgctccttgtccgcaaacatgatcagtcctggaggttttgcgtggattacagagcccttaatgccattaccatccgtgatcgatttcctattcctacaattgatgaactgttagatgaattgggccacgcatgttggttttcgaaacttgatttgctccaggggtatcaccaaatacgaatgcattcctcagacattgcgaaaacggcgtttcgaacgcaccacgggcattatgaattcaaggttatgcccttcgggctatgcaatgctcccagcacctttcaggcgacgatgaacatgcttttccggccattcctccgccggtttctcattgtcttctttgatgatattttaatatatagcatcactttcactgatcatgttctgcatttacagcaagcttttcaggttttattagaaaatcaatttgtcctcaaactttccaaatgcactttcgctcagacagaggtcgaataccttggccatgtggtgtctcagcgcggtgttgagccagtctcttctaaagtggatgtcgtccgacaatggcccctgcctcagtccgccaaagctcttcgtagttttttgggtctcgccggattttatagacgctttattaaaggctatgccaccattgcggcccctttagttgcggccaccattacagagccctttcagtggaccccttcagcccaggaggcctttgaccaactgaagcaagccttgtcggaagcccctgtgcttaccctccctgactttcagatgcccttcacggtcgagacggatgcatccggcattgggatgggcgcggttctctcccaaaagggacacctcatagcctatttcagtaaacaattcccacccaagctccgccattcctccacctatgttcgagagttatttgcagtgacttcggcggttaaacagtggcgtcagtaccttctgggtcacaaattcacgatcataacggaccaccgcagcttaaaggagctactcacacaagtggtgcaaacccctgagcaacacacatacctggctcgtctaatggggtatgacttccaaattcagttccgttccggcgccactaatcaggcggcagatgcgttatcacgactctctgaggaagactcctctttgtccctcattttgtcggttccttgtttgacatttatggaggaattgaggaagcagttggctcagaatgagtcttatcagtccaaacttcaggacattcaagcaactcccgccaactttcctgatttcagtatttcaaacaacctcatcttacgcaaaggccgcatctggcttcctcctcacctgccattgcttcccacactcctcactgagtatcatgctactcctaccggcggccaccttggcgtcgcaaagaccatagcccgactgacggacaatttttattgggacgggttgcgagacgatgtcgcacggtttgtctctacctgcttagactgtcaacactccaagtatgaaaccaagcgcgccgccggcctcctatgccctctgccgatccctcaccgaccatgggaggatctctctctagactttattactggtctgcctgcctttcaggggaacaccaccattctggtggttgtcgacaggttctctaaaggcatccatttgggaatgcttcccacctcacacacagcatataccgtcgcagctctattcatgaacattgtcggtaaaattcatggtctccctcgtagcatgatttctgatcgtgatcccctgttcctgagcaggttttggcaggacctattccgtctcagtggcacccatctgaggatgagctcttcttaccatcctcagagcgatggtcagacagaagccctgaatcgcgccattgaacaatacctcagagctttcgttcaccggcgaccaagctcatggggcaagttattattgtgggtggaatggtcccacaatacttcttggaatgccgctactggttccactccatacgagattacatttggaaaaaagccctttaactaccctgcatatcttgccggagattcaaagatcgacgttgttgacgatatgattacgaaccgagaagacaccttccgcttgattcgtaaaaagctcctcaaagctcaggaattgatgaagaaatatgcagatgctaaacgacgacatgtggaataccaggttggtgactgggttatggtcaaactcagaccccatcgtcaaaattcggccaagccttcttcttcttctagctccggcaaactccagaagcgcttctacggtccatttgagatcactgagcgcattggtcctgtggcctattgtctgaaactccctgagggtgctcgtattcaccccgtgtttcattgctctatattgaaacctttcaaagggtcaccgccatctgcagattctgtttgtctccctgaccaattttctcacggtcaactcattgtatctcctttggccattttggattaccgttacaattcagataaccccgactccccgtgggaggtactggtgcaatgggaaggcttagatcctgatgagacctcgtgggaatcctggactcagttgagtcgtgactatcaccttgagggcaaggtgaatttccaaggcccgtgggatgatagacaaagaggggtgcagcaaattatgaatgaaatactcagctttgaatttctctccttccctttctctggaggaactggtcctcgaaaccagccaaattcatacctaacatgtgatcacaagcaagaagaaaaagctttaaccgccttctaa

SEQ ID NO: 19058 - DNA, 717 bp, Glycine max
  Peptide Sequence Number=SeqID_135836
atggaatcaattgttggtaatgagaggcatatagatcataggcataaaccaagctcaacccaacaatgggatgagcttgccaaggcaatatcagagtatggcaaacagaagaagatatatctaagtgcagctccccagtgtcccttccctgacaaatggctaagtagtgctatagaaactggtcattttgattacatttgggtccaattctacaacaacccaccatgccaatacaatgggaatacagagaatctcaagacctattggaataagtggattggaaccaaggctggtcaagttttcttagggttgccagctgcaccagaggcagctgggagtggttatatttcgcctaatgtgcttatttctgaagtgttaccatttattaatggttcttctaagtatgggggtgttatgatttggtctaagttctatgataaagggtatagtacagctattaaggcccatggtgtcaaagtgatcacgaacacttatagtaatagcaaacttgagcctagccaagaaggcgaagcaataagcaagaaagctagcaatggaaagccaaatggtcttgggatgaagttgaaatggggtggtcacttgtgtccctttgtttctgaaagcacgatcagccatggaattgaaagtcctgagggcagcaaaaagataaggagagaaatattgaagatagctacacatgagaggatctatggatga

SEQ ID NO: 19059 - DNA, 303 bp, Glycine max
  Peptide Sequence Number=SeqID_135837
atgaacccttactatgggaatggcatacttccgccgcctgccccagaaggccaagcaatacacaagaaagctaaaaatggaaacatagatgatctttggatgaacatgaaatggggtgggaccatcatcttgatatctgatttggagaaaagtaagaagtacaatatagatgaaagtatcaagggcatgcagaggatcggtttctattgccatgttaagttcttggatatagagaacattgaagttttgtctcttctagccgttatgaccctcatcttcaatggtggcgctatcctttattga

SEQ ID NO: 19060 - DNA, 1287 bp, Glycine max
  Peptide Sequence Number=SeqID_135838
gttgatgacagggtgaatggctatcttttcccaaaggataatattagagttctgagacaaattttattagaagtgatctcaaaagggaaaatatcacccttggcttgcaacattgcctcaatagggagaagcacagcaaagaatcttatggcttcagaagcaattgatggatatgcatctttgcttcagaatattctcaggcttccatctgaggtttctccacctaaggctgtttcagaaatagcccccaattttaaagaacaatggcagtggcatttgtttgaagcttttccaaatatgacatatcaaaatagagcattaagaagcaacacatttttagataaatacgagcaccagttgaatcattctcaaaaaaatagatccactactgcagtttcagctaatgatgtatttgtatatagcttatgggaagaagaaaaatatactcaattggctattaccaaaaaaagaagagaggatgaagagttgaaggatagaatggagcagtcacatggaacatgggaggatgtatataaaagtgctaagagggctgatagatcaaagaatgatttacacgaaagagatgaaggagagcttgagcggacaggacaaccgctatgcatatatgaaccttattttggggaaggatcctggccttttctacataaaaaatctctttatcgaggaattggcctgtccggtaaaggtcgaagaccagggagagatgatgttgatgctccttctcgtcttccactgctgaataatggttactatcgagatttacttagtgattatggagccttctttgcaattgcaaacaagattgaccgtttacacagaaatgcttggattggatttcagtcttggagagcaacagcaaggaaggcatctttgtccataattgctgaaaatgctttattagatgctatccaatccaaaaggtttgctttctcagaagccatgaggggaatgtatggggtaaaaggtgatgcggattctttgcctcccatgccggtagatggtgacacatggtctgtcatgcagagttgggctatgcctacaagatcctttatggagtttgtaatgttctccagaatgtttgtggatgcattggatgcgcaaatgtatgatgaacaccatttaacaggacactgttctttgagcttgtcaaaaagtatccctgttgtagggaggctcctcgccaagagaaggtacggggagggtcattatacgcagccttgtccttttgcatatgcaaagaggctgtttctggattcaaacccataa

SEQ ID NO: 19061 - DNA, 288 bp, Glycine max
  Peptide Sequence Number=SeqID_135839
atgtcaggatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcagagaaatggaggacactggaattggggtgaattctacaggctttctcgctgcaaaattcacttcttggttgatgtttttggtttgtgctaaaggtggtgtttgtcatgggaagtgcggtagacagactttgtggtag

SEQ ID NO: 19062 - DNA, 354 bp, Glycine max
  Peptide Sequence Number=SeqID_135840
atgccacttgtgattcccagccctaagggctctcttggaaagctaccgcctaggaatgcactttctccagaacctgaaaggtgccccacaataaagactattagccacaagtgggagtcttctatcagtttagtacttaccgttctcgctttcttcaacagtaagagaaggacttacaccatccggggacgggaagcctctgaaccttccgtcccactatgttcaactaagccacttcgtccctttctaacagctgattcaatagctgcggattccttcgcctattattccacccaaaaagagaactgcggattctcgatggttgaacagaagagagacagggcaagcaattga

SEQ ID NO: 19063 - DNA, 522 bp, Glycine max
  Peptide Sequence Number=SeqID_135841
atggatgtcgaactggctgagcaggctgaggaaatagccagtccagctgaccgccaccgccgaggcggagacgccgtattcgagcaccagcatccagccgatgaaccaggccgagagctcgccgaaggtggcgtaggtgtaggtgtaggcgctgccggagaccggcaccatcgaggcgaactcggcataggccagcgcgcagaaagcgcagcagatggcggccagcacgaaggacagcatgatggccgggccggcgtggttggcggcggcctggccggtgatgacgaagatgccgccgccgatcaccgcgccgatacccagggcggtcaggccccaggggccgaggtggcggcgcaggctcaggccgttggcgtcttcatgggcggcatgcgggtgcttggtggcccacacccaggtagatcagcaggccgagcagcgtccagcccacgaacaggtgccagtgcaccacgaacgcctgccagaacaggaacaggcaggtggccgcgcccagcgggcagatga

SEQ ID NO: 19064 - DNA, 864 bp, Glycine max
  Peptide Sequence Number=SeqID_135842
atggcaatggtcgtgctgaagaccggcctgatcctgctggtcattgtggtcggctggaagtatgtggacaccagcaactggacgccgttcatccccgccaacgaaggccccggcaagtacggcatggaaggcgtgctgcgtggcgcggcgatggtgttcttcgcctacatcggcttcgaagcggtatcggtggcggcgcaggaatcgaagaacccgcagcgcgacatgccgttcggcatgatgctgtcgctggtgatctgcaccgtgctgtacatcgcgatggcctcggtgatgaccggcctggtgccttaccagctgctgggtaccgacgagccggtggtgaccgcggtggcggcgcatccgcagctgggctggctgcgctgggtggtcgaggtcggcgcgctggtcggcctgtcctcggtggtgctggtgatgatcatcggccagccgcgcatcttcatgatcatgggccgcgacggcctgctgccgccggtgttcaccaagatccacccgaagtaccgcaccccgcacatcaacaccgtgatcaccggcatcggcatcgcgctgctggcggcgctgttcccgctggacatcctcggtgagctgacctcgatgggtacactgatcgcgttcgccgccgtgtgtgccggcgtgctgatcctgcgccgcacccagccggacctgccgcgcccgttccgcatgccgatggcctggctgatctgcagcctgggcgtgctgagctgcctggcgctgctgtcggcgatgacgatgcacaactggatgctgatgggcgtgtggacgttcgtcggtttcgtgatctatttctgctacgggttcaggcacagccgcctgcggggtaagtaa

SEQ ID NO: 19065 - DNA, 243 bp, Glycine max
  Peptide Sequence Number=SeqID_135843
atggcgaaagggtgcggaatgaccatagtttgtctctgcacgtcatcggactcgatcgtctctggatggcgaaaaggctcgccgcctctggatgacaaaaggcgcagaatgaccataatttgtctctgcgtgccatcggactcgatcgtctccggatggcgaaaagccgacaaaagcgaggctcttgctcctatgtatcctcaatttgtgatgaggaactcagacctacgtagttctggataa

SEQ ID NO: 19066 - DNA, 726 bp, Glycine max
  Peptide Sequence Number=SeqID_135844
atggcattggcggaggtagatggttttagttacgatggccaaatagataaagcaatatcaaaaaaggtacttgacaacctgaaagactatgctgtaagagcccttgtgaatgctgttgaccatctaggaacggttgcatacaagttaactgaccttcttgagcagcaaacattggatgtctcaactatggatttgaaggtcgctaccataaatcagaaacttcttacatgccaaatttacactgataaagaaggcctacggcagcagcaattgttggctttcattcccagacatcataagcactacattttgccaagtaggcctcactgcttttatgttcatctggaactagattctgtcaataaaaaggtacatttcagtcctcacatacagattgatgcaagacagaatccatttcaaaccagaacccgttttcaatcttcaggtacccctgcagccaaaactctttcatggcatttagcatcagagacaaagtctaccttaaaagggtcttcacatgcttccccttccccaaacattgagaacccaaagttttctggcaaggcctctggagttttccatctcttagataatgaagagaacacctggatgaaatcctcaccagcacaaattcactttccaaatggagtttctacttctagtacacccatgcatactttaggtggtacacgcaaggtgaagttgttttgtctagcacttgagtga

SEQ ID NO: 19067 - DNA, 1140 bp, Glycine max
  Peptide Sequence Number=SeqID_135845
atggctacgaattcgattacctcatcctccttccgattagtaacaacgagaatccctctctccctcttccgaaaaaccccacctctcctttcattccccacaaaaccctttttctcaaaacccatcaccttccagagacttcaaccaacaccaccaccacaatcatcatcatcatcatcatcatcatcatcatcaacatcagcatcccttcaacccatcgaagacctacctccgaagctccaagaaatcgtgcacctcttccaatccgtccccgaacccaaagccaaatacgaacagctcctcttctacggcaagaacctcaaacccctcgaaccccaattcaaaaccaacgacaacaaggtccaaggctgcgtctcccaggtctgggtccgagcctacctcgacccgaaccgcaacgtcgtctacgaagccgactccgactccggcctcaccaagggcctcgccgcgctcctcgtacagggtctctcgggtcgacccgttaatgaaatcattcgggtcacacccgatttcgccacgctgttagggttgcagcagagcttgaccccttcgagaaacaacgggttcttgaacatgctgaaattgatgcagaggaaggcccttttgttgtacgtggaagctgaaaagggtggtggtgagttcaattcagaaactgatgtcattgttgagaattctgcaagtggtggagaaagttctgatcttggtggtgattctgagatagcatcggtgccagaatttcagggtgatgagaatgtggaattgggggggagggggaagaggggcattgttgagaattcaagtggtggagaaagttcagaaattgttgatgagaatatagaattgtgggggagggggaagaggataagggagaaattggagaaggagcttgagcctgttgagttggaagtggaagatgtgtcttatcagcatgcagggcatgctggggtaagagggagtgatggggagactcactttaatgttagagttgtgtctaaagagtttgaagggaagagtttggttaagaggcataggcttatctatggcctgcttcaagaggagttggatgctggactgcacgcgttgtcgatcgtggccaagacgccggccgaagttgaagggtga

SEQ ID NO: 19068 - DNA, 918 bp, Glycine max
  Peptide Sequence Number=SeqID_135846
atggcctttcaggatcatatttttaaattaaataaagaaaatagctcgctaaagcagaatttggaggctacaaatgctgctctgcgtgtctccagaattgaaggttctggagcatctacaaatggcacttatacagtcaagggaagtagtgatcagtcacccaatcgacagcataagctcaacactcaacggaaaaatcggtatgctataaacaatggaaccatgtctgctttggaatctgatgctattcaaagtgaaatggaaatcaaacattcaaatttacaaagaaatcatcaggagcttgcagatttggttgatggatataccacagtagctgtccaacatgccccagaaatgcaaaagttgaggttagaactagagcaagaacgtaatcaattggcaaacattcagctaaaattccaagaggaacagagattgaacaagtctttccaggaggagcttaacatattaaagttggaaagagacaaagcatcaaaggagatgaacaaaatacatactgaattgaatgagaaagtatcagaaataaagcatcttcaacttgagttgacaagacaggaaaatgaaggaggggaggctgttgatagcttgaaaagacttatcaaaaccttagagaaggaaaacaccacacttaagatggaaaggaatgaaattgaggctgaacttgaaaatagcaggaagtctttaactgataaaatgatgtctgatgcttcacatattcagaaaaaggattctagcattcttggtgatatgccagatcactccaaaagatttccaggaaaggaagaaatggaaagatccttacagaagctcagtaaagatttaaaggaaacacagcaggacagggacaaagtggtgcaggaattgaaacgcctcaaacagcatttactggaaaagtga

SEQ ID NO: 19069 - DNA, 297 bp, Glycine max
  Peptide Sequence Number=SeqID_135847
atgtggggcaccattgctaattttaaggaaaatctcaacaagatcgccctcgatgttcatgacgacgacgacgacgaaattttccgagcgtatggcgccggaagccctgccaacggcgacaactccgttgtctccgatcgccggagttcccgcggctccacccgttccaaattggggattaggtcgccgcttgcgaacggcatcgatcatgcatctcttcatgagctaggaacgcgtgtgaattttttatcagcttcggaacttaataaacacgtatctggttctgcaatgaactag

SEQ ID NO: 19070 - DNA, 204 bp, Glycine max
  Peptide Sequence Number=SeqID_135848
atgaaaaaggaagccgcgaagaagatgaaaaggagaatgaactggaaaatccaaaggagagagtatgatgcgttagaggagagtgtggtggcaccgcacatcatggaggaggaggatggtggcacactggtggaggatgagggaaggaaaagggaagaagagagggaattctgtgacttgcagaaagtgtatgtgacaaagtag

SEQ ID NO: 19071 - DNA, 699 bp, Glycine max
  Peptide Sequence Number=SeqID_135849
atggtgtgtcaatctctgaatcctgaggtcccaaatgggaatcaaaatgaggtgctgatgaaaactgttgaaatggacttcttgagtcggcggcagcgtctcatcaacaaaatgaaggcaataatcagcaaaatggtagtttcaacaaaaaagaagcaatctgatgagcctgctgactactttctgcgagaagagattcgcaagtatgttaggatcaaacctaacagattaggaaaacaaaattttatgggggaaaatgcaagcttcaccagcataggacacacgtgctttgccatgaaggaagagctagaagaatacatggattatgatgttggtgagatctgcaacgatgactggaaactggctcaaaagcttatggttcatggctgtgatcctttacctaggagaaggtgcttttcaagatcccctaagctatacaaacaaccatttcccgtcaatgaatccttgtggaaactccctgatgatagaaatgtcagatggagtcaataccagtgcaagaactttgcttgtcttgctggcaatgccactcgtaagggattcttcaagggtgttgattgcttcaacctcaccaatcatgagatgccaagatgggtaagcctggaagctgattcagaccgcacagcagattttccttataggattggacttaagtgttggaactgggatttttgctgctag

SEQ ID NO: 19072 - DNA, 153 bp, Glycine max
  Peptide Sequence Number=SeqID_135850
atgtaccctactccaaatctccaagcaacgtttggatttgacccacaaaccgccactcctagtgacgagtttgctgggaaaatgtcacgtggcacggagaacgccactcgtaatggcgagttgcccaggcctaaaggggagttgcaactgtaa

SEQ ID NO: 19073 - DNA, 213 bp, Glycine max
  Peptide Sequence Number=SeqID_135851
atgttgatatgtgctgcagcaactggatacacagaatactactttgatgcacaatctggaaaagtatgcaggtggttgaaagcagtgcagttgaagcttgacggctttgaaatattggatgctatattgcaggaagcaagacagtcaaaaagtcaatatcaatacttaatgatagagttcatcacccaatctttgttcttcatggccgtttaa

SEQ ID NO: 19074 - DNA, 285 bp, Glycine max
  Peptide Sequence Number=SeqID_135852
atgactaagtatagtcccattcttcaacattcggaatggcgatcttggcccgaccctctttcttataaggtacttttgctacagcagagggcagttgccaagagtggagttcacgtgtcccaaagggaagagctcttgagctccctctccctctattttaagacagactttgagtttgagcggggagggcgagatgacaagggaatcggccaaaggcatctatcatctcatcggagaagcggtcctaatctaataaagggttgccttgcctaccaaaaggagtga

SEQ ID NO: 19075 - DNA, 267 bp, Glycine max
  Peptide Sequence Number=SeqID_135853
atgagccacgagcgcttgtatcaaagatgggtgaagaatgcttttgacaagaaggtacgcccgcacaagttaaataaatgggatcttgtcttgaagaaagtatcccaggccaaaaaagacaatagggggaagtgggatccaaactacgaaggacctttcatcgttaagaaagcattctcaggaggagcactagtgcttgccagcatggatgatgaagagttaccttcacccgtgaacaccgatatcgtcaaacgatattatgcttag

SEQ ID NO: 19076 - DNA, 354 bp, Glycine max
  Peptide Sequence Number=SeqID_135854
atgtttgagcagcctgagcaagacatgccccatgccatcaatgtgactccagctgagcaggaggcaattggaaggcttgaggctatgggatttgatagagcctcggtgatagaagatgctcagaatttggctgagagagaggctctctcattcctagagacttcagcattagaggccttcaatgttgagaaagcatttcaaaccattttgtttgacatataccaaattatgagtaaaaaggcactggctgcacagggagcagcttccactactagccttcctcatgggactaccataaatgtctcaaatatgtcaggtagtgtggagaagaaatcagcttgttgctccaattaa

SEQ ID NO: 19077 - DNA, 222 bp, Glycine max
  Peptide Sequence Number=SeqID_135855
atgttgctaagtaacaacatcatccatatctgtgtaagagtggtcatgttggtgtgcatgatccgcacttgtctctttgcagcggcatgggtgaaatcttgccccggtatgcatagtagctgcgtgatagcctccctctctggttgtgcttgcacagttggtcaccctgtaatatcagagggtggtccaggaactgataaaaggaaactactggccccttaa

SEQ ID NO: 19078 - DNA, 249 bp, Glycine max
  Peptide Sequence Number=SeqID_135856
atggaacttagtaatggaaagggcccatcaagggtgaatcttgggtttgtcgagccttggaccaaggacgtgtttgccctaggttttgtcacttccatggagttgtgtcgaggcttaccaaggacgggccttggattttgtaaacccttatggatcagcaagcgcgaaggtactggagacacggtggtgtctatcagtgggactcaccaaaggaggaccttgggtttcgcgagccctttggaggattga

SEQ ID NO: 19079 - DNA, 273 bp, Glycine max
  Peptide Sequence Number=SeqID_135857
atggaagtaaccatcttgcaaaaattggggcaaaagatggatcgagttacatcactgcttcgtctactgccaaatacatttaggattgttgatgtccttcttacttccagtttcaccttgacaaagatgtcatggaccataaaagaacacgctttacggtgcccttaccgaacccgtgctagagctagagtaatgggtgaagtagaggaggtacaagagcagatgaaggccaacatggagactgatgtgccatcattttcttctattttctaa

SEQ ID NO: 19080 - DNA, 288 bp, Glycine max
  Peptide Sequence Number=SeqID_135858
atggaatctcctcaagggagggcgaatagaatgctaaaatccgatttcccaaagaaagggatggggaaggagaaggaagtgaaaatggaaaagagcggaggaaaacagaataattttgggtcaatgaaagaaagggaatggaaaatcttcagaccagataaattctcggcaagattgccattctcgactggcgatatcccaccccacatgaacaaagaggaaaagaccgaaacacccagcttcctctccaaaaaacactaccctcgagaaaatcctattggtccgtga

SEQ ID NO: 19081 - DNA, 666 bp, Glycine max
  Peptide Sequence Number=SeqID_135859
atggaagcatggggtagtgttaaagatttccctactcaatctgagtatgaggggcatgtcaagatgttgaaattgattgagtctgcacattggaacttaaagaggttgattcaaaatagtatgggggacttgtgtaaatattgggatgccatgactaacttgatcacattgcagcacactaaaattaaagcctcatttgataaaagtattcatttcgtgggttacaatcacaatgtacaatcatataaaagattgcacatattcatttcaagcttagcagatataggttcaaacgagccctatgtagatatgcccatgcaacaagagtttgatgttatattaaaatgctttgcaaaggttgacatagttgggaaagttactataaaaagtaaacttcatgaaatagcatatcctgacatgacttcaatgtgtttaccatttaataaggtaaaaactaagggatcacaaaaaggacatgccgatgaccattatggatatcatccaattgctgtcttacttgatatgggtgaagacgcttggcctatagtgcgtaacaatttgcttaagaaacttggtctgtggcgggatgagtatgccattatatttggtagttatgagtgttacaatgacataaagagatctttacgagttgacaaactttctatg

SEQ ID NO: 19082 - DNA, 770 bp, Glycine max
  Peptide Sequence Number=SeqID_135860
gccaccctaggaagattctcaggaaagatttaacaactctttctcaagtgttgagtgttctctcgtactccaatctggctcctacttcccacacctcggacctgacaatggacatgaatgtgggagctctcatctctggtcagattacatctatggcccagtgtaactcttctagacttgggttccctgctcttatcacctctttatgtaaatccaatggggttgcttctgacagcctggtctttgaatgcctgagcccggtcagtaacttggcctatatcaggaaaaactgttggaaccctgatgatctgacagttactatcagaagggccaggagagcgaggacaaggccaactgaggccccttccacatctacagctcctcatccaacacgtaccctagcagctccttctgcctcaactcctatggttgcacctccagactctatttccgtagagcagtttaatgagtgggtagcctggcccggaactcagtcttctcttcatagggaagatgaaggtcccacagctcaggcagcacaagaagctgtagccacttctgagaaatcttttgaggccacttctgagcctttagaaccagtggcagatacaaattcaattcagcaggcagcagacccctccactcctgaggatcagactacaccagtcctgtctctgaacacctctcctacagctacccctgtgcttcatttaacagacgaggaggatgttcaaacacaggatactcaggaccgatcacaggatttttaa

SEQ ID NO: 19083 - DNA, 746 bp, Glycine max
  Peptide Sequence Number=SeqID_135861
aagatgaatggtgcagtgtactgatgccactgcgtgacctacaagaacttagcatgtcatggtgcggtctctcaagacccctggatccttccctgacaagacttgagaatctatcagtcattgttcttgatgggaacaaatattatcatccccaatgccagaaaacatttctccatttcaaaaatatcatcatcctaagtcttactaattgtgggtcgaatggaacatttccacataagatcttcaacattggaacattgtcagttattgacacatcttggaacaacaatctccatggtttcttgcctgaatttccatccagcagatctctctatagcttaagtgtaagtaacacaaacttgtctggagaaattccatcctttattgccctttctacacttccatcattgcaagcaattcaactttcagaaaatgagtttagtcaacttgatgaaatggtgaatttgacatcctctagactagagagccttgatataagtaacaataatctatctgggaggattcctagtttcctttttactagccaatcaattgagcttttccacaatcagtttagtcagctagacaaaatcagaaatgtgtctagattgtacagcctcgatttaagtagcaatgatcaattcgggcctttttcaacatctatcctccaactcagtacactttttgtcctccatttttcttcaaaccagtttaatgggtcagtacagttgaataagcttctcgag

SEQ ID NO: 19084 - DNA, 1083 bp, Glycine max
  Peptide Sequence Number=SeqID_135862
atgcgggtgtttcaatcgctggtgggcagcgacgatgacgccgacggcctgctggagccggcgcgccgtttggcgaccaagcgcgtggtggtgaaacgcccggactacgcgccgccgctggccgacgtgccggcgcacgccgccacgctgaccaaaagccaccgtttcgatatctacatgccgctgcaggcgcaggcggcgtcgaagatcgccagcaccagcacaattgaggtggtggccagcatgttcagcggatctatctccttttgcaccccggtggcgatcgtcaactgcgccgcctgtgcgatggcggaatgcgggttttccgtcaccgcgatcatcgtcacgcccttggcctgcagcgtcggcagcaggcgggtcagctcgtcggaattgccgccgcgcgagatcaggatcagcagatcgtcggcgcgcagaaaacccagatcgccgtgcgccgcgccggtggcgtcgagtcggccagcagcgtcagcagccgctgccaggtgcgcgcgtcgaggcgctcgcccagctgcgccagctcctgactgtaggtttgccaaccttgcaccgcctgccgccattcctgctgcatcacgcctcctcctgcatcaaccggcggtatttcatgtggtcgttgtacagctcgtggaatacccggtatttgcggtcgtagtagctttttatctggttggtctgcggcgtgaccgtcttgccgatgcggctcatggcgctcatcgcctccggcagggtgtcgaacacgcccgccgccacggtgcccatcatcgcgccgccgagcagcatcgcttcgctctcctccggcagcagcatggcgcagccggtggcgttggcgtgctcctgcacgaagatcgggttcttggtgccgccgccgctggccataatggtgtcgatgctgtagccgctgtggttcatggtttcgatgatgtggcgggtgccgagcgcgatggcctgaatggtggccaggtagtgcagcgccatgtcctccggcgtgcgcgacagcttcagcccggtcaggatgccggtcagcgtcgggttggcgcgcggcgagcggttgccgtggaa

SEQ ID NO: 19085 - DNA, 462 bp, Glycine max
  Peptide Sequence Number=SeqID_135863
atgttttctaacttaccattctctttatactgtagcttgctgtgggaaagcttgacaggtagagagcacctacttttttatggcagacttaaaaatcttaaaggctcactcttgacacaagcagtagaagaatctttgatgagtttaaacctttttcatggaggagttgctgataaacaagttggaaaatacagtggagggatgaagaggaggcttagtgttgcaatttcgttgattggggatcctagagttatttacatggatgagccaagttccgggttagaccctgcctcaagaaaaagcttatggaatgttgtcaagcgtgcaaaacagaaccgtgcaatcattctcaccacacattccatggaagaggcagaagccttatgtgatcgattgggaatatttgtaaatggtagcttgcaatgtgtaggaaatgcaaaggaggtaacattgctaaactga

SEQ ID NO: 19086 - DNA, 1047 bp, Glycine max
  Peptide Sequence Number=SeqID_135864
ggaaacgtggcggtgtatctcagcggtgagcaaaacgccgctggcgaactggtgctgaaaattgaagtacaggatagcggcattggcatcagcgaaaaggagcaacaacagctgtttcagccgtttgcgcaggccgcagccggccgtcagcaaaccggctgcggactggggctggtgatcagcgcgcagctgctgcaacagatgcagggcagcatgcggctgcacagcgagccgggtgaaggcaccctggttcacgtcacgctgccgctaccgagtcgcgcaccgccgccggtaaccctgtgcgcgactggtgcgccgcccgccgtgccggcactgcatatcctggtggttgacgatcatccggcgaattgtttgctgctgacccgtcagctggaagcgctgcagcatcgtgttaccgcgatcggccagcctgacctcgcacctgagatcatcgcaacacagcaaattgacgcggtaatcaccgattgccatatgccgcagatggatggttttacgctgaccagtatgttacgtcgccgtggttatcgtcacaaaatcatcggacttaccggcagtgcactggctgagacgcgcgaacgcggcctcgcggctggtatggatgcgtgcctgtttaagccgctgcatccggatcagcttaacgctgccctggcgcagcctgctaccctgccggcattgctgtcgttgccgcagctgcgcgccatggtgcaccacgatgacgatatggtggcaaaactgctgctcagggtatgcgaagagaatcagcgcgatttgcaacaggcccagcaggaactggcgcagcagcagtggccggcgctggcacgcacgctgcaccggctggccggggcagctcaaattatctatgcagcagatatcaatcagctgtgccagcagcttgagcaggcctgcgtcgatgcgcgcgatggcgacctgctcagcgtgggtctggctggcctggcctcgcgtattgaccagctacagctggccattgattgctggctgccgttcaatcatgttgtaaagcaataa

SEQ ID NO: 19087 - DNA, 384 bp, Glycine max
  Peptide Sequence Number=SeqID_135865
gataaggtgtcggcgcgcccggatttcagcgcgcttatctatccggtgctgtcgctgaaacagggcgtgacccacccaggcacgcgcgcggcgctgtacggaaaagatctcactgcccaacaaatggcacagctttcgcaggaagatcgcgtcagcgcacacacgccgccgacttttctggtgcaggcgctgaacgatggcaccgcctcaccgcaaaacgcgctggacatgttcagcgcactgcggcagaacaaggtcaatgtggagctgcatctgttccagcagggcggtcacggctttggcaccgggcagaagcaacatctgccggtgcaaaactggctcaccctgttccatgcctggcaaagcagcctgatgaagcagtaa

SEQ ID NO: 19088 - DNA, 402 bp, Glycine max
  Peptide Sequence Number=SeqID_135866
atggaagaaaaattaaacataagctcagatgcaagggttatgtggctccaaacagataaaaggacaactcaaagtttccaacacagaaaaggatgtgaacttatcagcactttatcagaaggctatgctagtgatgaaaaacaagtttcaagttctcaaaaagcttatgagaagccactctcaccacaacacattgcaaccgacaacttcagtagtagtttattaagtttctcatcttttggtgttggcacttgtatctgtggtaatctttcttgcaaggaattcataccagcatattcttctgataaggtgcatttggtcaaatttaagaaagtggcttatgtctttgcccagttcagtaaagttcccaataagtatttatcggagaagatgataaaatga

SEQ ID NO: 19089 - DNA, 270 bp, Glycine max
  Peptide Sequence Number=SeqID_135867
atgaataaagatcaaaagaattggaatgaaccttatggtgaagtgagtaggtcctttgatgtaagatggaaggatgaactaaagcatactctgcatctgctagacagtaatgacaacattcactctattgcatacaaccaagatatggtgaatccaactatactaactggatggatagaactcagagatttctatggactcacaagaaatcatcaagtgaccatgatccattttggacagagttttcttcccgaccatcttcaaaggtag

SEQ ID NO: 19090 - DNA, 663 bp, Glycine max
  Peptide Sequence Number=SeqID_135868
atgctttcctttgttgctcataaaaacataaagctttttaaaatagatgtcaaaagtgaatttttgaatggcttgattgaagcagaagtgtatgtcaaacaacctcctggctttgaagatcatacatttccataccatgttttcaaactccagaaggctctgtatgatctaaaacagacaccatatgcttggtatgacaaattgagttattttcttttagaaaatgattttatgagaggcaagaaatacactaaggagcttttgaagaagtttaaaatggaaaatgctaagcctatgaaaactccaatgcatgcttccaatcccttgagcaaatacgaatcaagctatgttggagacatagtagaaagaaatagcactaatggaggatgtcgctatcttggaccttgtcttatatcttgggcaaacaagaaacaaaactccattgctttatttacatttgaggctgagtatgtgtttgctgcaagttgttgctcacaactactatggttaaagtatcaactgaaacattattctagttttgaaaacaatatcctaatatattgtgatgacactagtgcaatcaacctttctaaaaatcccatacaacattcaaaggttaagtatattgagataagatatcattctattcgtgattatgtgtaa

SEQ ID NO: 19091 - DNA, 249 bp, Glycine max
  Peptide Sequence Number=SeqID_135869
atgactgacaaaaacaaaagctctccaactcgatcaacagtggtgtcaccaacatcaccacaaagctcatgtgggtccaatgatatcaaccaagatggcaacaacaacaaccatgaagtcatttctgtagtagttggttgctctcactgccttatgtatatgatgatcaataagggtgaaatcaagtgccccaaatgcaacaacaccaatttgattcattttaccaatgacaacaaaaagaggggatag

SEQ ID NO: 19092 - DNA, 390 bp, Glycine max
  Peptide Sequence Number=SeqID_135870
atgtacttcgccgtcctgaccaacttcgcgcagattcagagctccaccgcccttgccgtcggcatcatgatcggcctggccgcgctgggcgccggtctgggtctggccatcatggctggtaagttcctggagtcggccgcccgccagccggaactgatcccggtcctgcaggaagcacgcaccaaggccaacgagatcatcgatcaggcccacacacgtgccaaccagatcgttgatgctgctcgtaacgaagcgatcaccgaagccacccgtcagaatgaactggcccaggctgaaatcgacgccgccgccaaccgtgcccgtgaagatctgcgcaagcaggtgtccgcgctggccgtgaccggtgccgaagagctgctcaagcgctaa

SEQ ID NO: 19093 - DNA, 855 bp, Glycine max
  Peptide Sequence Number=SeqID_135871
atgatccagatcagaccagcgaaggccagcgcctgcgcaagaagggtgaaattgatattcatgcggcgcatccggccttcatccgaaaccgggtgcatcagcacccggttgtctcaaaccgctgtatcagccggccagagccttggtgacggcgccagcgaaggcagccgacagcgggttggcgaaggccagcagcaggccgacggcgaccgagatgatgaacgcggcgtcgatcaggccggcggtgatgaacatacggacctgcaggaccgggatcagttccggctggcgggcggccgactccaggaacttaccagccatgatggccagacccagaccggcgcccagcgcggccaggccgatcatgatgccgacggcaagggcggtggagctctgaatctgcgcgaagttggtcaggacggcgaagtacatggttatctccaggaacttaagttgctaagggtgatgaaacggatgaaggctcaggtacacgatcgacagcatcatgaagatgaaggcctgcagcgggatcaccagcaggtggaacagcatccagccgaggccgaacacaccaccggcaatggcaccgaagaaaccggcaccacccagcacccagatcagcaggaacacgatttcgccgccgaacatgttgccgaacagtcgcatcgccagcgagatcggcttgctcagccactcgacgatgttgaggatcaggttgaacggcatcatccactgccgaacggcgccgtcaggaattccttgatgaagccacccacacccttcgacttcagtgcgaagaacagcatcaggaagaacacgctgatgaccatgcccagggtggcattgacgtcagcg

SEQ ID NO: 19094 - DNA, 672 bp, Glycine max
  Peptide Sequence Number=SeqID_135872
atgatgcatggtccatgtggactagctaataaaagggcaccatgtatggccaatggcaagtgtttcaggtttttcccaaaaaagtttcagccagccacaattgttgaccaagatggttttcctgtttatagaagaagagacaccagacagactgtgcaaaaacagggtgttcatctcgataatcgatttgttgtcccatataatccacatttgttactcaaatatagaacacacctaaatgtggaatggtgcaatcaaagtagctcaataaaatatttgtttaagtacatcaataaaggatctgatcggattacagcagttattgtcaatgaccaaaaccaggatggcccacaaaatcaggttcatgatgaaattaaacattatcttgactgtcagtatgtgtcggctcctgaagcatgttggaagatttttgcattcccaatgcatgggcgtgcaccggcagttgaacgtctttatttccaccttgaaaatcaacaacctgtttattggaaagatagtcaagaaattggcacagtactggctaagactacaatcaaagaatcaatgttcacagcttggatggattctaataaaatataccatcatggacgagatcttacttatgctaaatatgtgtccaaatttgtttatgatgcacgaaaaagatgctag

SEQ ID NO: 19095 - DNA, 636 bp, Glycine max
  Peptide Sequence Number=SeqID_135873
atgaagaacagaacatcagggtttctgaaggagatcatagcaaatctgagctcaatggcaaagtcaaaaaccatggcgttgaagtccaaaacaaacgcgataagggctcgtttgatcgtattctcactgatgaagaacaagaagttcttgatgagttccctctctgagaagttccattctgtgtgggggcaaagttcatcatctcaacaacaaaaggaagatcattgcttattggaagatggcatcagcaatgatgatcatcaccaaaaaagcaaggccatagtgttgtacaacagcaatgcacactcatatgaagccttgccaaaccctagtgaaaccctagtggtggaggaggaacaagaccaagatgatggctttgatggttactacaattatgattgtgatgatgatgatgaaaagtacccggatctcacacacacactttttgagtctgaggatttggatcttggagggtcagtgattgatttggtgaagaattctaaggaagaggcagggaaagagtttaagctggaggatgagattgaccttgctgctgatcttttcattttgaagtttagaaggcaaatggtgttgcagaagcaagagtcattgaagaggaagagggaaaatgcttga

SEQ ID NO: 19096 - DNA, 198 bp, Glycine max
  Peptide Sequence Number=SeqID_135874
atggtgaggcgcaaagaaaggaggaagaaggtggtggcgtggcgtcgtgaggagggtgcatgggtttgcacggtgaaggatgaggtcactgctgtcacagaagggaatcgaaaacaagtaacaaagatttataataacttatacaaatacgttgctcaaccaattaagttagaccttggattgcatttcaagttttaa

SEQ ID NO: 19097 - DNA, 603 bp, Glycine max
  Peptide Sequence Number=SeqID_135875
atgtcaacccttaattcatcaccatgtattgaaccacatacaactacaagttgtcgacctactcagattggcttgacttctcaacatataaattcaggtagatacacaatattcaattccaaactaatagagcacatctcgcatgacactgatgacgaacttgatataacacagggagacattgttatagattatttatttgacgacatagcaactgaggattttgctcataccgattatgatggcaatcttgaagctccatatgacaatgaaaataccggtgcaagttacaaagatattggagatcctatttggcaatgcaagcaatgtaaagcgaagatgtggtatgatgagaggattaacaaagataagcagacaaaaaatccaaagttttcattatgttgtggtgatggtaaaatacaactcccaatactacatgatgctccacaacccttgcggcaactactctttgacagtagagactcacaagcaaagaaattccagcaaaacatacgtttatacaacctaatgtttgcattcacatctcccggtatcaaagtaggcacatcctataatacgggaagaggtcctcctacattgtga

SEQ ID NO: 19098 - DNA, 261 bp, Glycine max
  Peptide Sequence Number=SeqID_135876
atgggttctctgccccagcggggatggagcgaaagaagttatgagaattcaagagaaggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttgtga

SEQ ID NO: 19099 - DNA, 177 bp, Glycine max
  Peptide Sequence Number=SeqID_135877
atgaaaggcctttttgttacaaaacttgaaagcaatgaagtgcttcttagtccaatagctcttaagatggttggccccttgcttctggactcaaattcttcaagggatggcaccaatcctccttccaattccctatatggcaacccacaaacaaggaaacaaagagacaagcaataa

SEQ ID NO: 19100 - DNA, 576 bp, Glycine max
  Peptide Sequence Number=SeqID_135878
atggagaaaagagctcaaacaaaagaagaaaagactattgttgatattatgcatgtacaagctgctacaatccaagctaaagttgtggacgacaacattatgtgtaaggtcatcattgaccttataaacatgggtgtcatggaaaaaacaccaaaggcgtccaatatagctctagctaatgaggttgtccatcatgataaagaacccacatccaagcagtcaacaacctcaaatgaagctacgtcaaaggagaacaatgaacctaatgttgtcaacatctattcaaataacttagatcaagtgcaagaaatgatagttcaagcaatggactccttcgtcgaacaacaatggcaagagaatgagcaattcaggctcttcatgcaaaataccatcaccacccaattttccaatcttggtgttgttctactccaaaacttacagcaggctcaaatgactatgttaggagctattactgccccgacacctattgttgcacctgaacctccaactctcatccatcaaccaccaccacttgaaccgataccacctccaccaccacttcaagttcaagactga

SEQ ID NO: 19101 - DNA, 690 bp, Glycine max
  Peptide Sequence Number=SeqID_135879
gcaaagggccattttgggggacttgcagctcgcccaggcgagctaagacttaaacctgaagtaactggctcgccctggcgagctggttccttcaccctgaagtcatttggtggcccaggcaagccagaggctagcctaggcgagctagggtcacaccagttgctgcatggaggaacttttaaggataagaagagcactcaaaacaatatccctaaggatttgtttgagaaacacaagagggatcctttacaggaggtggaaccaccaaatagaatacatgccaatatgtacattctcaatcaagcagcttcgtatcaactagggttgcacatctcaaaggccgtcgagatcaaaattgttgcagataaggtgtgccctcgtctacccatttgggatgttgttaagaagggcaacaaactgtactataatgaaaaaattccctcaagacggatgaaagttgaagtgttgaactattcaaggaactggacctcatcatctggttatgatggaagtggcaacactgatcaccatgacttcattcaagtgttgcatttagtcaggatgtatcactttgatgatgtctattcgtgcctcaccaaggatgctgacagctactctatcatcaaacgcttgctaagtcttcctaccattcaacatgaaactatctacaatctcagaaagatagactga

SEQ ID NO: 19102 - DNA, 246 bp, Glycine max
  Peptide Sequence Number=SeqID_135880
atgcaaaggagagctaatcgaaacgggagagcattcaaaacccaaaaaccaaaagccacgacgggaatggaaaatggaaaggcgtgtagcaatgaaaagcgtgggacatcgaaaatagtgcataatttgaaaaggcgcatcgataaccgaagggttatgtacaaaacgacaaaagcaattaatggcaatggaaaagagttttgggcgggaatgagaagcgctggcattgcgacacgtcggccctag

SEQ ID NO: 19103 - DNA, 396 bp, Glycine max
  Peptide Sequence Number=SeqID_135881
atgtgggacattctagctggaatgtataaaggaatgccatgggtaaagaaggtgaagactcctcactttaagtatgaactcttctctatggaagaatccaaaggcatacaaaccttcaacaagatgaaagttgcggcatgcataacgctaagcgcgctaagcgagctgcgtctcgctaagcgcacgttgccaattttaatgacatccaggaagaggaagagcactgcttctagacccacagctcagtatgataccaggcgattccaatctttggaagcttggaatagatacactgacaacattctcggctggaatatccttctggagagaaatgtgaagctttatcatactgagtttgatgagttcaaggtggagttggaaaggcgtaatttttag

SEQ ID NO: 19104 - DNA, 459 bp, Glycine max
  Peptide Sequence Number=SeqID_135882
atgttgagtgaagtgccacggtgtgaagtaccgaagagtgtcaagctgccaagcagtctcggagagggattcagaggctatgcatgtatgagactatgtacaactgaggatgaattaaaggaattaattggtactacctataccaacaagatatatctacttttcggtagtccatcacttaagaacttcatagttaagcatgcttggcttggagtagttgtcagatgggtgaccttccgggatgtttcccaaaaagcgtacaatttagtagttgttattgatgtttctcataacaacttgtgggcaatcaaggccattttcagaggctatgaattgatatttggcttgagagtgaattttcacaagaataacatcctcaggtgtgtctccccttcaagttcctcgggttacctattggcgcaaacccatgccataccaaaacgtggaatcccatggtag

SEQ ID NO: 19105 - DNA, 840 bp, Glycine max
  Peptide Sequence Number=SeqID_135883
atgagagatcgattagaggacatgattcatgatcttgtacaagattcttttcagcaagctcacgcccctttatatgatacactagaaagtgattcaaagaagactttgcatctagggtgcaagaagtcattgacactgttgtcagcgatgttaagtctagttaatgtgaaggctagatatgggtggagtgacaaaagcttcactttgttgtcgaaggattccctagaagagcagtccgcacaagagcaccctgactgtgtccgtgctgttggagccgaagtgatgatcaagcaatactttggaccagcttcagtaggctcttgcacatctacatcgataagcccagaagagcttgtacaccctgttgagccagaggtagctctatcctatgctcatgttagcacaaagggaagctatgttgatcccttggggaaggacccggacactgatgcattagataggcgtgggttgtatgttgatgacaatcctccctgcttgattgcccttggaacagtttatgaggggttggcaaccatgcaccatgtgcctttgggcaatgatatggtgaacatgggtcttcaagaccaagtcttcatgttgctcaatgctcatgttgctccccctatctctaacaatgttgaggaagttcgagatgttgatgcttgtgtgtctatacccactaaagagaatgagttcaagattgaatcaagaacacttaaaggttcaagaggaaatttgatttcaagaatcaagaatcaagtttcaagattcaagttccaagaatcaagatcaagattcaagactcaagactcaagattcaagaatcaagagaagacttaa

SEQ ID NO: 19106 - DNA, 231 bp, Glycine max
  Peptide Sequence Number=SeqID_135884
atggttggagcattctcgcaaaacatcgtgaccctggctggtctccctatgatcttacttagtgagagtgacctgacaaatccattgtgtggtgtgtcttgttatgtactcctaagcgtcccagggtggtttttcactgacatggaatgtgataactcactcccagtttgttgtttgtgtttggatcctgtgatgatcttgaactttgtgttcgggggagcagatgactag

SEQ ID NO: 19107 - DNA, 1272 bp, Glycine max
  Peptide Sequence Number=SeqID_135885
ctggacatcaactcggtggtgaagggtctgcaggacgcatacgccaagaagcagccggcgatcaccgccgaccagctgaagccggccgttgaagcgttccagaagcgcgagcagggccgtgcccaggctgccaaggccgagtatgaaaaggctgctgccgaatacaagaccaagagcgatcagttcatcgcggcgaacaaggccaaggccggcgtgcagtccctgccgagcggcgtccagtaccgcgtgatcgaagccggcaagggcgccaagccgacccaggccagcaccgtgcagctggaagtggccggtccgttcccgtacggccagcgcccgaccgaagcccgtccggcccagcagattccgtcgatcaaggtcagcgacgtcgaaatgaaggccatgcgcgagaccctgctgcagatgccggcaggctcgaagtgggaagtcaccctgccgccggaccaggcctacggtgccgacccgcgcaccccgttcccgccgaacgtggctgtgcagttcgagatcaagctggtcagcgtcaacgcgacggtgccacgcaccgcatctgcaccccgcgcaaattcagcccgatcgcgctactgttgccgggtgcaaacaatggaagaaacggcgcgtgttgtcgcaagtccctgcatcggagtgtgcacgctggatccggaccggcaatgcaccggctgcgggcggcacatcgatgaaatcgcacggtggtcgtcgatgagcaacgaggaacgcagccgcatcgtgcatcgcgtgcaacccctgcgtgaacagctgcagcaatcactgcgcggctcgctggccgatcacgaacgcttgatgcgggcgttgcatccactggccgagccgccggccggcgacggctggaaccgcagcgaactgagtgacctgctgccgccggggccacctgtggaagccgccgtactggccggcatcgtgccgcgcgccaatggcgcacaggtcatccttacccgtcgcaccgaaaccctgcgccagcatggtggccaggtcggcttccccggcgggcgcaccgaacccgatgaccgcgacgcactggcggccgcgctgcgcgagagccaggaagaaatcgcactggcgcccggccaggtgcaggcgctgggctatctcgatctctttgtgacgatcaccggctaccgggtcacgccggtggtggccgtggtcgatccggacttcgtgccggtgccgcagcccagcgaagtggccgaagtgttcgagtgccgctggcctacctga

SEQ ID NO: 19108 - DNA, 666 bp, Glycine max
  Peptide Sequence Number=SeqID_135886
atgtcatcctttagagttttcttgggtatagctgcaagcctagacttggagatcaaacaacttgacatcaagacaaccttcttacgtggaaatctaaaagaagagatttatatggagcaacctgagggatttgaagttccaggtaaagaaaacttagtgtgtcaactcaagaagagtctttatggtctaaaacaagccccaaggcaatggtataagaagtttgactcacaccgaccattgtgcatttataaagaggaaaaatacattgagaaagttcttgagagatttaatgttcacaaagctaagccagttagcattcctcttgccagacaatttaagttgagaaaaaagcaaagtccaacaagggaagctatgtcatggttaaccaaaattcaaaagtgtgtggctctatcaactaccgaggttgaatatattgcagctactgaagcatgcaaaaagatgttgtggatgaagaattttcttcatgagttgtgccatgaacaacaaaattatgtggtgcattgtgataatcaaaaggagaagcttttacaacttgagaaggttcacaccaatgaaaactggtcatacatgatgaccaaggtgataccaactaagaagtttgcagattgttgccatggtgatagtgtggtggtgccccctaattaa

SEQ ID NO: 19109 - DNA, 501 bp, Glycine max
  Peptide Sequence Number=SeqID_135887
atggaagaagtgcaagtagaagccgtgataaatcttgaggacgatctaaatctcgttcttctaggagtacctattacttctatggcaagccaggtcagaagaaatatgaatgtcaatatctcaagcgagatgaaaaaatcgacactgctaagccaaattaaattaatccaaagaaaaaggaggataaaagcactacaaccatggcaacagattaagatgacaatcccacatggaggattttctcaacctatcaaagtggtgactttggtacggctgatcaatcactttggtgattgcaaatggaaacttacaaaaggcagtatgattgttgctcgaggaaaaaaagaaggcaccctatatgtcatgcagggaagaatatgcaagggagaggccaacattgcccatggtgtctcaagcatggagttgtggcatagacaacttggtcatatgagtgagaagggattacatatccttgaaggaaaaaccatttttcttatgtaa

SEQ ID NO: 19110 - DNA, 924 bp, Glycine max
  Peptide Sequence Number=SeqID_135888
atgaattgggattttgaagatgttcttcaaaaagcagaaggcatagataatgatgatcataagatcattcctctggaaaagaaaaagccttctgtccccaaatggttctggatggctgcaagtgtagtattgcttgtaagtgcaggattgatcttcaattactaccaaaatgttccggtagcagaccagtcaaaattggtagaaaaccagatcaagcaacaaaagcaggatttcattgaagaaaatcatgaaccagaacgacaggtcgctgtaaacagtgcagacagtattgcagcaataaaaagtgattctgtctttcagagaaacacagttgcggaaaaagatgttctggatgagattcttcctaaaagaggaagactgaaaaaagaagtaagaccaaaatttacagataattcttcttatagaaaattgaatgttgcttcgaaagattctacaggctacaataacaattatgttattgtaaacggaaaaaggatcgataatgttgaagaggctattaatgtgactaaatattcatttcaaatatttgcaaataatgttagcgaaaagttagtacagccaaaagatgacaaattcgataaactttttgaaaaataccagcaggtagaaggtgtaacttctattaaaattgcaaaacccatgtttgggatgcttagcagcctgaatatcgatgattctcagctggatcagatcaaaccattattgacaaagattaatggattaaagattctgattacagagagccctgaaaacgtaaattctccgggaggagcaaaagaaggaatattggatgatgtcctgttgagtattgacagtggtgatggcgggaatgttttagtaatgctggatgggaaactatcaatggatgatctcagtaagattataaaatccagtgaaacaaaa

SEQ ID NO: 19111 - DNA, 524 bp, Glycine max
  Peptide Sequence Number=SeqID_135889
atggggctccgaaaaaagggtagagaatggagaattgcaataagcaatcactacgcatggctccaaactcgtgggtggaagatgcatgaacgaaaacgcaattcatggggcaccgaaaaaaggggtagagaatggagaattgcactaagcaatcactacgcatggctccaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 19112 - DNA, 522 bp, Glycine max
  Peptide Sequence Number=SeqID_135890
atgcgggggtactatatggttattcacatcttttgtcaaccaggggcgaacgagcttgttgacgcgcagagactaacgtcatctcctgcacctttcgtcaaccaggggcaaacaagcacgttgacgtgcagacacttacgtcatcttctgcaccttttgtcatcccgaggcaacgagcccgatgacaagcaggggtaccgtatggttatcggcaccttttgtcatcctgaggcgacgagcctgatgacatgcggaggggcgaacgagcccgttgatgcgcagagactagcatcgtctcctgcacctttcatcgccaaggggcaaacaagctcgttgacgcgcagagacttacgtcgtcttctacaccttttgtcatcccaaggctacgagctcgatgacatgcgggggtaccatatggttatccgcacctttcgtcatcccgaggcggcaagaccgatgacatgcgggggtaccatatggttatccgcacctttcgtcatctcgaggtggcaagaccgatga

SEQ ID NO: 19113 - DNA, 153 bp, Glycine max
  Peptide Sequence Number=SeqID_135891
atgtactttcaatttgcaatcaagttgaacaatgtggtggacatgcagattgcttattcgctcatagatgggaaagaacaaggacaaaaggcattggtgatgacgagaacgaggttggggaaatatgggggtgggggtggacagagtgaatga

SEQ ID NO: 19114 - DNA, 224 bp, Glycine max
  Peptide Sequence Number=SeqID_135892
atggaattaagggacactgaagcaatagatgaaccattacaagacgaaaatccagtgatagatatgataaatgatgcatttgggaacaataaacaccatgatgtagaacctgatatgtatgaagaagcatatgagtttgtagacactgtgcctaatgaagtaaatgaagaaattgttgatttgcttaaagatggtatcgaagagttgtatgaagggtgtcgaaa

SEQ ID NO: 19115 - DNA, 300 bp, Glycine max
  Peptide Sequence Number=SeqID_135893
atggcaagccttctcatgattccttgccagcatctattgctaaagaagttgcaaaggcattgtcatagaaaggcagcatcaaactccattaggagtgagaaaacttcctcattcagtttcagaagcaatgccaatgttccttttcatgaattgcctggggcttcctttgatcaatacatggatgacaagcacagagtgctaagagctgtgttttctgatgacaaaggaacaactaaacagctcaatgaggtacttacttgcacatgtttccctcataatctagaatgcgaaagaaactag

SEQ ID NO: 19116 - DNA, 279 bp, Glycine max
  Peptide Sequence Number=SeqID_135894
atggaagcagcgccttcaggaggcaggaaacgccaatggcaatggcgtttccctgcacctatggctagccctgcactgctgctgctgctgctgcctgaccctgctgcagtcaaagcgctaacgggaatggcgacttgcaacgtgaaatcgccaaccatgtctgcgctttcgtccagagcttgccacttgtcgcacatgcatgaagtcgccagttcaactggcgcttcccatgtaggacttaactatcgaaaccaacttttgttggaaaaaggcttttag

SEQ ID NO: 19117 - DNA, 198 bp, Glycine max
  Peptide Sequence Number=SeqID_135895
atggctggtggaggagtagagattggaggaccaggaaaaagggctcatctttacgagcacaagttcagttggtatttcgtctatacatgcttcgttggggcccttggcggttctctctttggctatgatctcggtgtttcagctcaccgatctaatgccgattgctactttgatttgtttcatcatttttttctttga

SEQ ID NO: 19118 - DNA, 468 bp, Glycine max
  Peptide Sequence Number=SeqID_135896
atggtgtcgtcacaagggagaaatacatggacagtggatgatctagtgtcgtatgtggagaaaataatcattttatccgaagagcaagagagaatcactgaacttgtgtcacatggtccagcaacagaacatcaatttgcagcacaagagtttcatatgctcctgtcaagtgttgaaactcaaggcatagccagacgaagggaggctgttgaagcggaaccatatttgtacctacagatggtagagcgttgccatggaatgtattacacaccaccaacattttctcagtatccgacacagatgtatcagtatccatttgaaggtcatcaaagtgatacttctacaagcgaacattcattaggtggtgttgcagaaacatatcccaatttttcatggcctactatgacccattcacagcaacatgatgctccaattccaacacctaatgccctattaggtactcaatga

SEQ ID NO: 19119 - DNA, 1593 bp, Glycine max
  Peptide Sequence Number=SeqID_135897
atgaagatagatattgaagatgaggtgcttcccaatgatatgagtgggacacaattgaatgatgagagttatgaaggaggtgctggcattgttctgaagaaagggccatggacatcaactgaagatgatattttggtggattatgtcaagaagcatggggaggggaactggaatgctgttcagaagcacaccgggttgttacgttgcggaaaaagttgtcggctgcggtgggctaatcacctaaggccgaatttaaagaaaggggcgtttaccgcagaagaggagcgggtgattgctgaacttcatgccaaaatgggaaacaaatgggcacgcatggcagcgcatttgcctggtcgcacagataatgagataaagaactactggaacacccggatcaaaaggtgtcaaagggctgggttgccactttatcctccagaagtgagtttgcaagctttgcaagagagccagcatagccaaagctctggtggacttaatggtggcgaaaaaatgcatcctgatttcttgcagaaaaacagttttgagatacatgatggtatatttgacagtctgaaggataatcagggaatcttaccttatgtgcacgagctttctgatatttctgtttatggcaatatgctaaaaggtcttgattcttctcagtattgtagttttgtgccaccaacattacctaagtgtaagcgtcttaaagagtcaacaataccatttatcgattcctgtgatatgaaaaaatatgatttatattcatttgatcaaattcgagacaataattctaataagattgcacaatcatttggaatgcaagcaccccttgatcctggtccctcctcgcacagctcaatgtgttacagccattcactttcaaatggcaattcctctacttctaagccttatgaggctgtgaagttggagctcccttcactccaatatccagaactcgatttaggtagctggggttcatcccccccaccttctttgctcgagtcagttgatgatttccttcagtctcctacaccaatcagtacactggagtcagattgttcttctccacaaaatagtggcctgctggatgctttactttatcaggcaaagactatgagcagttcaaagaaccattgttctgacaagagttcaaattcttctactgcaacccctggtgacagagctgacagctctgctttgaatgtgtacgagacagaatgggaagattatgctgatcctgtatctccctttggtgcaacttcaatattgaatgagtgcactggtcttagagccaatatgaattcattgaacgaacagctaccagttcagaccattactggcgaccttccaaatttagagtctgttgaccaggtttggacccctgacagtgaaaatcaaaccttgtccctgttgaataatacttgtccggacttcttgcttacttcagattggtatgacctaggttctgggcatggcaagaaccaggctatcagtactgatgctgcaacggcctttcttggagatgatttagccactgaccataaatatatgactgctggaacttctataactatgtttggaaatccattctag

SEQ ID NO: 19120 - DNA, 2166 bp, Glycine max
  Peptide Sequence Number=SeqID_135898
atggtctttgcttctgctgcaacgagaaataccatagaggccaccattgtgcctctaggacgagaaccccctcctcatatagtgccaactaacccgcctcctgacccgcttgatcctgtggagcctcttgacccgggcccgacccaaataagtctaaactccttagcgggtcatcttgcccccagagactttgcgtttattgggcctgctcgctggccaccctgtcgtggtactggtggacagtggcaatacccacaacttcatccaacaggatctcgtcaatcaattgcgccttccatgccggaccacctctattcccttgcgggtcatgtgagcctcgacctgcaatacacacagttcaccatcaatttacatgtgttacccattgtcggcgccaatgttgctgtaggagttcagtggctaaaatccttgggtctgattatcatcgactataacaccctttgcatacaatttttctatgatggttgtcttgtacaacttcagggcgacaaagatttcactctgaccccggttacgtcatctcaatttcgccggttgtcacggacgaagacagtaggattatactgccatatctccctcctcgcggaggacttcaccgtgttccaagatcttcttccggccatccaatccctcctcactaagtttgcggtcttatttcaacagcccaataccttaccacctgagcgtgacaccgaccaccacattcatcttcttcctcagtcagctcaggtcaatgttcacccaaacagtggaatcaatgctccagaagggccttattcaaccaagcataaatcccttttcttctccgatgttgttggtgaagaaacacgatgggccatagcgggctatcaccagatatgcatgcattcagaggatgttcccaaaactgcgtttcacacccaccatggacactatgagttcagggtgaagccctttaggctatgcaacggtccatcatccttccaagctacgatgaacatgatctttcacccttatctccaccaattcatcattgtgttcttcgatgatatcctcatctacagcccatgctttgaagatcatcttcttcatttggagatagcttttcatgtggaatatctgggtcacctggtgtcacaccgaggcgttgaacccctggcatctaaggtcgaggctattcatcaatggccaacatcgcggataattcgagcagtatgtagttttctgggattggctgggttttatcgccgttttatatggggatatgcatccattgtagctcctttggtcaaaatcaccaccttggatcagtttaattggtctcctacggccctgaccgcgtttgatcagctcaaggaagctttttctcaagcacctatcttagcgttgctggactttgaccttccgttcaccatcgagacagacgccttaggggtcatacaaatgtcggaacagcacatgtacctggcgtggttaatggggtacgactatcaaattcaatatcgttccagtacccacaaccaagctgttgatgccctctcaagggatttggatatgattcccacactgtttgtggagtaccacaccacacctataggtggacatatgggggttgtgaaaataatagctcgcttaacagaaaatttcgaatggataggactccgagcagatgtcacgaaatttgttgctcaatgccttgattgcctgcatgttaaatatgagatgaagagaacagctggcctcctttgtccattatcggtgcctcatcaaccttgggaagatctctcactggatttcatcactgggctccctccatatcgtggtaactctgtcatcctggttatagttgaccaattctctaaaggaatacacttaggtatgcttccggtgtctcacacagcccatgccgtagcttcgttattcatggatatcatggggaaaatccatggcttacctagaagcctggtctcagaccgtgaccccttatttgtcagcaacttttggcaagagctctttcgtcggagtgttcaagtggagggtacatccacttggtttttcaaagagaacaagggagggtacatcccttgtggatctttggcttgtaaaggattttacaaggttgaaagaagtctcaagaactgttggttgcttggggactggatgtag

SEQ ID NO: 19121 - DNA, 279 bp, Glycine max
  Peptide Sequence Number=SeqID_135899
atgtcttcttgggagaggcgccacagaggtggtggtgcagagcgagtaggcgcagggagcagaggcggaagagtcacaggtcgtggcgagggtgacagggctagaggtggaataggggcgggaacaggagttacttctcctggagacgcgctagaccggcggcctggaccaacatcattggttggtacgcttgaacttcatgacatatctctgggtcatcatactgtgaaggagcaaatcgtgtttgcagggcctgaaggaacaccgaccatgatgtga

SEQ ID NO: 19122 - DNA, 414 bp, Glycine max
  Peptide Sequence Number=SeqID_135900
atgaccattcgaatgccatacgctcctggaatcagtatcaaaaaacacggagaattgtgggtgatccactatgcatcaagagacttcaatacaagtgtcattaaatgggtcatggagggatattcacttcggcgtggagacaagcttacacttcttgtaattcttcgccatgctaatggtccaagtaggattcccttcattgcatctgccagattgcagggatattcacttgggcgtgaagacaagcttacacttcttgtaattcttcgccatgcttatagtccaagtaggattcccttcattgcatctaccagattgcgtgagtgtcccatgctttgctctttacttcttttccttcttcataggtcatacaacctcactttcagctatacgcacaagccactagatcgttga

SEQ ID NO: 19123 - DNA, 447 bp, Glycine max
  Peptide Sequence Number=SeqID_135901
atggagaagaaagaaagcacggagaaaacctcgtgtagcaaacagaaaatggaaaacctcaacaaggggaaaactcaacggcaagtgaagctggaagaaacggaccacaaaaatgaagaaaaaaagaaaacgggagaaggtgaggaaatgacgaaacgcagtttagagaaaacaatgggagaaggctggagaaggaggcatgtaaagcaaccaaagcttgaagcgggttgtggctggttgtgttcgaatcggaagagaagagaagaaaatagaagaagaaagaaaggaagaggcacgggagaaatagagagagaaatggaattaggcacaaaagaagaaagaaaggaagaggcatgggagaaatggatagctgtaggggggacacgtgtcaccacttggagcatgggcacaatagacatttccatagacatctcatttatgacttag

SEQ ID NO: 19124 - DNA, 141 bp, Glycine max
  Peptide Sequence Number=SeqID_135902
atgcagagaggcaaatataaagaagaaaagaaatgggaaaaaagagtacttgctgaagaacaggagctttcctcattcttagttcgtctcacaacaaaggtaaagggtggcatggcattgtggttgtggtggccaatgtga

SEQ ID NO: 19125 - DNA, 228 bp, Glycine max
  Peptide Sequence Number=SeqID_135903
atgaccatgattgttgccgcttccgtgacccatgacagtggcggatccaagaccctaagtcagcgggggatacatgatcttggaaagaagatttggacatcaaagggagaagaaaaagaagctgccaagaaggagttcatagaggcccttaaattgttggaggaacagcagggagataagacttattttggaggagacaatattggcactcattatttatttagctag

SEQ ID NO: 19126 - DNA, 372 bp, Glycine max
  Peptide Sequence Number=SeqID_135904
atgtggatgtacccggttgagcgatacatgaagatcttaaaggggtataccaagaatctacaccgtccggaagcatctattgttgaaaggcttcccaagggtcaacatgacgaaagagtaggaggtaagggttcaagactgcatgttatcactcaaagtgtagaagatttgcaacaagctcatttgtatgtgttgaataacagtaatgaagttttgtcatacatactttaccatgaaggtttagtgaaggagagtaatccaaaaatgacgaagaacagagtcatgaaagagcataacaagactttcctagattggtttaaagatacaatctttgctgatgagcctaaaagaaatgttgtaacttggaaatga

SEQ ID NO: 19127 - DNA, 261 bp, Glycine max
  Peptide Sequence Number=SeqID_135905
atgctatcggggttttggcgtgtttccggtgtgaaagaaggaaaaagaaatgtgtacacgacggtgatgtacgtaggtgtcaatcggtactactacatgtgtttgaatgacctacttgcacttggcggtggggagtttgagttgaagaatgttgaagcacttgttgctgcgttgagtgtcttcaactgcttggttaacgttgcacaagctcaatctgcaaacgccaccactgatccttccgaagttggtctaaaagactaa

SEQ ID NO: 19128 - DNA, 501 bp, Glycine max
  Peptide Sequence Number=SeqID_135906
atggacggtgagcagagcatgcctgctccatctcatgggcaagttgatggtgctcagaaagttagagcattacatgggaggactactggccctacaaggcgttctacaaaggggcaatggacatcagaggaggatgatatcttacagaacgctgttgagagatttaaaggaaaaaattggaaaaaaattgcggaatgtttcaaggatagaactgatgtgcaatgcctacataggtggcagaaagttttaaatcctgaacttgttaaaggtccatggtctaaagaggaagatgaaataattattgaattggtgaagaaacatgggcctaaaaagtggtcaactattgcacaacatttacctggacgtattggtaagcaatgtcgagaaagacaagatgacttgctcctcataagctgtaggttcaaacctcttgcagtaccattcaaacaagctcttcaggctgatgatcattccaaccaccctgctgagttacctttttaa

SEQ ID NO: 19129 - DNA, 2874 bp, Glycine max
  Peptide Sequence Number=SeqID_135907
atggatgaagaacggaaagttttggtcacaaatcaagatataaaaaggagatgtaaggcttttttctataagcattttgatgatggacaaggatcgagttgtaatagggaaggactagaaacgcaggaggacaagaagaatttggcttatcaccttagaattcagattggagtggtaaaacaggtccttaagaggatggataatggtgaaatgattggactagatggtatccctattgaggtttgcaagtgggttaatcatcttgatcctactattaaaaaggaagcatggactcgggaagaggagttggctttaatacattatcatcagatttttgggaacaaatgggccgaattgtcaaaggtcattcctggaaggacagacaatgctattaaaaatcactggaacagttctgtcaaaaagaaattggattcttatttggcatcaggtctgcttactcagttcgaatctatacctcctcatgctggaaatttgaatcaaccaataagattgcagtgtagtggagatgataatggttccaagtggactgaaggagaggaaatttcagattacagccaaggttcagctaatgctgtttactttccatctgctacagggactagcagtgctgacttacaaactggagaggcatataggaaaaatgaagaatgtagtcttggaaaggatcattgtccgaatcaagtatcttgttcagagccatattacgtatcaaatgatgatgtttctatatgcatcccagaaattgctcaccaagaggcttgcacttctcaatttgttgagcaacagtcacatgaacctggaaattccatttgtggggattgtcaattcaattttcaatcctcacccaatgtttcatcaatggtcttggggcaggaatcgtcggagttgcaaagagattttatagctcctagtgaaatctgtgacatggtgaatgttccatttccgacttcagtggagttaggtgtttcaacgtccatgggaactgcatctatggattctctaaaaccagagcacatgttgatatctgatgatgaatgttgtagagtcctgttttcagacgcaatgaatgatgggtgttttcctcctgtagattataataaaagtgaagatatagctgaattttctggatactgttcattttgtcgatcttgtaatatccagatatccgaaactggtggaacctcaactgcaaagctaacttgtcctcagtgttctaataattataaaggaatttcatcctcccaatctgtccctccagtactttccattagagatgataggttgggccctagtgccaacagcaatcaattatttgtgacggaggatcaccactttgtctccagagcatctgctaacttcacttatctgaacgacatatcctgttctccttgtgttgatggtataggtagtgcagtaatggaaaaaacaaatgtgcatacagaaaaggaggactcaggatctctatgttatgaacctccccgctttccaagtttggatattcctttcttcagctgtgatcttgtacaatctgggagtgatatgcagcaagagtttagtcccttgggtatccgccagtttatgatgtcatctatgaactgtcttactcctttcaggttgtgggactcgccctctcgtgatgataatccagatgcattgttaaaaagtgctgctaaaacttttacaggtacaccatccatattaaagaaaagatcccgagatttgttgtcaccactctcagataaaagaatggataagaaacttgagactgacataacatcttctatgtttaccagaaacttttccagtttggatgtcacatttggtgacaatgagactcgaaaagcagatatgccttcatcttcattgcaaacacagaacagcagggcatctgttgatgatgataataaagaaaattgtggacaaacttataaaggggaacaagtattggagccaattaaatctgcaattttggatgaaaagaactctcagaaaggtactgttgatggtaattctcagcataatgtcaagcaacaacctcttgattctaaaatgaagattaatgcagctgctgggattgagcaacaacaatctggagttttggttgaacatgatgtgaatgacctgtcactgtcttctcctgatcaagttggtttaaattcagacagaggtctggattcaagtgctaaaactccaaaaagcttgaacaagtccttggaagcagcttcaaatcagagtggccatttgaaattatcttccaaaagtccatgcccaagggttaattcttgttctccttgtgttcgtgctaaggagcatgaaggactttcagttgctgttactcgtgtacaagctccaggagacaattctggggaacaaaccagaagagatggtggttttgaaacaagtagcatcttcggtggaacaccttctgcatggaaatccccttggttcttcaacacttttctatctagccccagacttgataccgaaattctaattgaggattttgggtattttatgagtccaggtgatagaagctatgatgctctcgggtggttgaaacaggtcagtgatcaaactgctgccacatatgccaatgctcaggagattctagcaaatggaactcctaaggcattaccgaaagatgcatctgaaaacgacaaggatagggaccatgaaaataattaccctgccaatcagcctgggaaccattctcagttggcttcaaatgctttgatagagcgacgaacacttgactttagtgaatgtgaaacaccaggcaggggtgataacagcaaatcctcagctatgagcttctcaagcccttcttcgtacttgatgaaaggttgtagatga

SEQ ID NO: 19130 - DNA, 237 bp, Glycine max
  Peptide Sequence Number=SeqID_135908
atggagatgacaaggaagggggaagtggtgttgtgggtgcttcagatggtccgtggtgtcgatgggcagcagtggcggtggaagtcaatgagccctttcgctttttcgatgattcatccatttgatgaagtttttgcagatttcaatcggttgaatcaaaggaggattgaaaatgatgaagtttgggctttaagggacgtcatttggttaagaattgagggagttatgaagatttga

SEQ ID NO: 19131 - DNA, 186 bp, Glycine max
  Peptide Sequence Number=SeqID_135909
atggtgccacctgcggacggcagagttgagacagagcactcaggatgctccacttcgcggcagtcacaaaccccaacggcagtcgcaaacggtgacgatggtaaggaggagatggtgatcacaagtcataaatggcggtcacaggtcttgtgggtgaaagggagaagaggaaggttgtgtttgtga

SEQ ID NO: 19132 - DNA, 850 bp, Glycine max
  Peptide Sequence Number=SeqID_135910
agggcaacacgtcctaacctttacagggctagacgcctttaccttcagaggactacacgccttcaccttcacaggactacacgtcctccccatcagagggctacacgccctcaaccttagaggactacacgtcctccccatcagaggacttcacgtcctcgtcttcggaggaccacacgtcctcaccttcagaggatttcacgtcctcaccttcagaggactacacgtccacgccttcaaagggctgtacgacctcgccatcagagggcaacaggccctaacctttagaggactacacgtcctcaccatcagaggactactagtcctcgccttcagaggactacacgtccttgccatcagagggctacatgccttcaccattagaggactacacgtcctcgccataacaagactacatgtcatcacaaatagagggcaacacgccctaagctttagaggactacacgtcttcgccttcagaggactacacgcccttgccatcagagggatacacgccttcaccattagaggactacacgtcctcgccatcacaagactacatgtcctcaccatcagagggcaacacgccctaacctctagcggactacacgtcctcgccttcagaggacttcacgtcctcacctttagagggctaccagccttcacctttagaggactacacgtcctcgcaattagggggctacacgccctcaccttcagaggacttcacgtcctcgccatcagagggcagtacgccctcaccttcagaggactaaacgtcctcgccatgagagggctacacgccatcacccttagaggactacatgtcctcgccatcagaggactacac

SEQ ID NO: 19133 - DNA, 447 bp, Glycine max
  Peptide Sequence Number=SeqID_135911
atggctcctctcattgctctcagaatattcatcaaagttcttgttgattcactcttctcaactgtctttccggtttttgctcaaaagcatcttgatgttgttcttgatggtcatctagatggatataagtactctgtcacttcagtgaatgagtttattcttgcgcaattgatgagattgagtctctgttcatcactcgaagttcaattgaaaaggaacaagttggccactacgttggatcaaatgtccatcaatgtgacacagaagcaggttggatcatcgggcaatggaaaccgacatggtggaaataaaggaggccatagtggagcaccttcattgtgctggtgggtagcactaacatggactatttggcagcaaaggaacaggatagttttctctaatgagaccttcaatggaagtaagctgatggatgatgcagtattctag

SEQ ID NO: 19134 - DNA, 450 bp, Glycine max
  Peptide Sequence Number=SeqID_135912
atgacgaaagagagaactgtgaggccagagagaatgggagagaaaggttcacccaaaatgctaatttcatctcataaactcatacagtcattaccagggattcaactagctgttggtgatgctgagttgcaggataaaatttcccctcagagactcattcgcattaaaatagactatataagtttagcacacattaatttctttgtggaggggattgtttgctgcatctgcctggcaaagtatgagaataacgatgagctgagagaattgccttgttctcatcttttccacaaagactgcgttgataaatggttgaagataaatgcattatgccctctttgcaagagtgatgttggtgaaaacttaaccggatcagtctctggagaagatgccagccaacaacggggtgagagcagggttgagaatggcctcacgaatacctcagtctag

SEQ ID NO: 19135 - DNA, 1401 bp, Glycine max
  Peptide Sequence Number=SeqID_135913
atgcttcacttttggggactttcagttagcaccaaccatagaggagttcgaagggatcttaggatgcccgatagaaggaaggaagccatacctctcttctgggtactatccttctatggcgagaatagcaggagtggtcaggatcttggaacgagaattatatcgagtgaagcaaagtgggaatggagtagtgagaatatcgaggaagtgcttggaggagaaggtggaaactctggcaagccaaggagagtgtgtatcatttatcaatgtattagcactgctagtgtttgggacagttctatttccaaatgtagacgggctggtggatctagcagcgatcgatgcttttcttgcttatcaccacagcaaggaaagccccatcattgccgttttagcatatgtttgttatcccacgtctttaatcatggaagtagatctttctgtcccctacaagttcatcgcatgtgctcaggaaaagacaaagaaaaatgggaagaactcttggcaggcatgacaggagcgtcaattaattggttcccacggtggaaagaaggagggaggatccataagacatggaataaagtgggaagaaaagataaagaacttaggggaacaaacaatggtgtcatatgcggctatcacaaatggttgaaatctagaacgcaagggataacttggctccaaaagctaaatgggttgaatggggaagaggcagaagtgcctgaggagagtgaagaggtgcaagccttgaaagttgagctcgaaaagacaaaagtagcaaaggagaagctgaaggtggcagtcactagagttaggaaagaatgtgatgagctgaaagatatcaacatgactgaggctgaagcgctagagtgggaaacaaaaaaggttagaaaggaagagtggtgcagaaacaagttccgaggggctttgttaggcaatcgtaatgagctcaaacttagaaaggccgagagggaaaaatcaaggatggagagcatgatgttggaggataagttaaagagttttcagaggtcgaagagaagtttgaaagagcagttgagcaagacggaagagaatatgttgataatcattgatcaatataaagagaaggtgaacctagctgctagtcatggacaaatgctggtagacaaacaagcgaaggtgtcgaccttgcgggttgaaagggaagtgagagaagaggtgatagagttattgcataaagaaggcatcaaatggatggatagatttgctctcactttgaatgagagccaagagcttccaaggttgttagccagagccaaggtgatggctgacacatactctgcttctgatgaagttcatagtcttttcaattactgccaacacatggttgaactaatgacccacataattaggaatcgttga

SEQ ID NO: 19136 - DNA, 680 bp, Glycine max
  Peptide Sequence Number=SeqID_135914
atggatgttattgttgtctcactagaactgtgtcttgaaggttcaagttacactttgccgttgttgatggcacgacctgggagcctaaacggcagtcagcatgttatagaaatagctgggagcgcctatgcttccacatcgtctgcatcacatcatgatagacattttaatggcacagatgtgacgcagcatgaagaaagaattagtggtgcaaggatgcctcctctttctcagccttcggtttcagcaactagtgtatctaatgggtcaaatagtaggaattcatcgtttataagacgtggggatactcggcggaataggagtcctgtgcattcagggttatggatatctattgagctggtcctactagtgagccagattgttgcgtctatcattgttttgtctttgtcaaggcatgaacatccacgtaccccattgtttcattggatcattggttatgcttctggatgcgctgctaccctccctctgctttattggcgttattatcatcataaccatatgcgagagcaagattcatctcaatcaaggcaatcatctcctcggattaatgatccttcagggacacttcttttcagttccagaactaacagtggagaagatggtcaggctgctgttgcatcctccagaagcaatcaagcttcattattgatgaatagaag

SEQ ID NO: 19137 - DNA, 129 bp, Glycine max
  Peptide Sequence Number=SeqID_135915
atgcagagagatgcaccaactctatggaatgtccttctgttaggaagcagtgggattctattgttccattcaagcacagtgaatattggaattggaagaaaaattcatcacattctgaaatggcaataa

SEQ ID NO: 19138 - DNA, 339 bp, Glycine max
  Peptide Sequence Number=SeqID_135916
atggatcaagttcagggtcaagccttcagcaaggtacatgggaagatatgggatctggcaatgatagaagtgtcaattgaagccatcgcgtctttcactcaatactatgaccaatcacttagatgcttcataaaggagttcgaagggatcttaggatgcccgctaggggggaggaagccataccttttttccggattctatctttccaaggcaagaatagcaaaagtggtcaagatctcagaacaagagctagaccgagtgaagcaaattaggaatggagtggcatggataccaaggaagcacttggaggagaaggcggaagctctggccaactgttag

SEQ ID NO: 19139 - DNA, 3087 bp, Glycine max
  Peptide Sequence Number=SeqID_135917
gcatggaccacggataaatacgtttattatccgaaacaaaaacattataatactatcattcttgtgttggacttggagactttgatagagtttgatccattcaactgcaaaatgaggatcgagcaagagagtgatggagtctccgcttccacaaagcacctcgtctttgcgtattacgtcactggtcatggttttggccatgccactcgagtcactgaggtggtgcggcatttgattcttgcggggcatgatgtgcatgtggtcactggtgctcctgattttgttttcacctctgaaatacagtctcctcgcctattcattcgcaaagtgcttttggactgtggagctgttcaggctgatgctttgactgttgatcgtcttgcctctttggagaagtattctgaaacggcagtgaagccgcgtgctcaaatcttggctcaagaaactgagtggctgaactctgtcaaagcagacttagtggtctccgatgttgtcccagttgcatgtcgagcagcagcagatgctggcattcgctctgtttgtgtgaccaatttcagttgggacttcatctatgcagagtatgtcatggctgctggacttcatcatcgttcaatagtttggcagatagccgaggactattctcattgcgagttccttatccgcctcccgggatattgcccaatgcctgcttttcgtgatgttattgacgtccctctggtagtgaggaggttacacaaatctgcaaaagaggttaagaaggaacttggggtaactgatgatgtgaagctagttattctcaactttggtgggcagccatcagaattgaagctaaaggaggaattcttaccacctggctggttgtgcctggtttgtggtgcttcagagactgcagaacttccgcctaactttgtaaaacttgctaaagatgcatatacgccggacattattgcggcatctgactgtatgcttggaaaaattggatatggcactgttagcgaggccttggcatacaagtgtccttttgtctttgtccgtagagattatttcaatgaagaaccttttttgagaaatatgcttgagttttatcaaggtggtgttgaaatgattaggagggatttactgactggtcactggagaccttatcttgaacgtgcaataagtttgaaaccctgctatgaagcaggcattaatggtggtgagcttagtggggcaagaagattgcgtgatgccatagttcttgggtatcaactccaaagggcccctggtcgagatattacaatcccagaatggtatgcaactgctgaaaaccaacttggccgcacaacacctggttcccctgtggatgatggaagatctgcgtttagcttggacattgaaaactttgacattcttcatggagatattcaaggacttccagatactgtggcattcttacagaacctatctgaattacaggacaagcacacaaggcgggagcgtaaggctgcggctaatctcttcaactgggaggaagaaatatttgtgacaagagctcctggaaggttggacgttataggtggtattgctgactattctggaagtcttgtcctgcagatgccaattaaagaagcctgccatgttgctttacaaagaaaccatccaagtaaacataggctatggaaacatgctgaggctcgacagaatgacaaagggagaaatccaactgctgtcttgcaaatcgtatcatttggctcagaattgagcaatcgtggcccaacatttgacatggatttatctgattttatggatgaagacaagccaatctcatatgagaaagcaaagaaatactttgctcaagatccttcccaaaagtgggcagcatatgttgcaggggcaattttggtcttaatgactgaattgggtgttcaatttgaagatagtatcagcatgctggtttcatctgcagtcccagaagggaaaggtgtatcatcttctgcatctgtggaggttgctagtatgtatgctattgcagctgctcatggattaaatatcagcccaaggcatctggccatactctgccagaaggtggaaaaccacattgtaggagcaccatgcggtgtcatggaccagatggcttctgcatgtggtgaagccaacaaacttcttgctatgatttgccagcctgcagagattgttggccttgttgatattcccagccatatccgtttctggggaattgattctggaataagacacagtgttggaggtgcagactatggttctgttagaattggtgcctttatgggtatgaagatgataaaggccaaggcatctgaggaattgtctgagacttgtgctgctaatgggttgagctatgatgaagtggaacaagatgatatagaactacttaaacaggaaacctccttagattacttatgtaacttgccacctcatagatttgtgactctgtatgctaagacaattcctgagtccattgttggtgagacatttttggagcaatatcaaaatcataatgatcctgtcactactattgatccgaagcgtacttacggagttagagctcccacaatgcatcccatatttgaaaatttccgagtcgtgaacttgaaagcacttttaacatctgcagcttcaacctatcagcttacagccttaggagaattgctatatcagtgccactacagctacagtacttgtggacttggatctgatggaacagataggcttgtaaacttagtgcaagagttgcagcacagtgcagcatctaaagctgaaggtgggacattatatggagccaagataactggtggtggttccggtggaacagtttgtgtagttggcagaaactgtctcaagagcagtgaacacatttttgaggttcagcagaggtacaagaatgctactggttatttgcccttcatttttgagggttcatccccaggtgctggaaaatttgggtacctaaaaatacgccgtcgagctaccccagaaaaggcgaactctagcgaggatgatggtgcactcaccccggaaaagcctaatgccagcgaggatgatggtgcagttgtggtggagaataagagttga

SEQ ID NO: 19140 - DNA, 285 bp, Glycine max
  Peptide Sequence Number=SeqID_135918
atgggctatgatctggtcaccgctttcgccaccgtcgccgcctgcatcaacaatatggggctgggatacggagaaaccgccgccggtttcggcacgctgaacgacgcggcgaaatggctgattccgagcggcgtacagggcgccgttccgctctgccaacgccaacacattcacaacatgaatgatatgaatatgcgttttaacaacaagatgttggccctggccgccctgctgttcgccgcgcaggcgtcggccgacacgctagaatccatcgacacctgcgcg

SEQ ID NO: 19141 - DNA, 203 bp, Glycine max
  Peptide Sequence Number=SeqID_135919
atgatcagaaagcgcagcgcttttaatgccgccgcaggtggagccgacgcagccgccgaagaaactcgccgccagcagcagcatgatggtgtgggacgggatccgggtgtaatcggcgatggccagaccgttgtcggtcatcatcgaactggtgaggaaaagccgtgcacgaaggcgtctttgacgccgtacatgcccgagcg

SEQ ID NO: 19142 - DNA, 408 bp, Glycine max
  Peptide Sequence Number=SeqID_135920
atgagtgagatagaggaagtgcaagaacagatgaaggccgatatagaggccatgctaagcatgagacgaatgatggagagcaatgcggccacagttgtcgccaccagcgccgccgctgaggtggacctgactcacccatccgacataaaccaaacaagccgtccagtcctgtacatggtaggtcagggaggacaggtgttaggcagcacgggcggtctgcatatggtgcaaaataagaattctttcccaccgtacggcctacctcccaactatacaccacccaatccagtgcacgtgcccaacgagaacaccaaccactctattcccattccccttgaaggccaacaaccccagttggggcatgcaccctttgctaagcctgtgggggaagcccgtgaagagccctaa

SEQ ID NO: 19143 - DNA, 678 bp, Glycine max
  Peptide Sequence Number=SeqID_135921
atggagctgaaatcgttctcttcttgttctgtgtccacatctgaggttgcccatgttggaagatcctactccactttgatctccagtttcagacacaaagttggagttagattttctacccacttccagtgtcgcagagggttgtttctgacgacttattgtgcctcggataacacttatttgacagataaagcagtcattagttcagttggtcaagataattttgcagcagaaacgagttcccatcgaattaatggaacaaatggctcaatttcaagattctattccacaaatctgaaattacttgatgcctttgatgatgaatatgggggagttgttgttcatccagataggttaccatccaacccatatacctttgcatctgtgttgcgtttgtctctttctcagtggaaaaagatggcatcatatagcacaaagttatatattaagttacctgatcatttacagggaaagaagggaatttggcttaagttgcctttagaccaatctgaccttgttccaattgctgtgaaggaaggcttccaataccaccatgcagagccaggatatgtgatgttaacatactggattcctgaaggacctagcatgcttccagcgaatgcatcacatcaagttggagttgggggatttgtcatcaatgacaacaatgaagtatga

SEQ ID NO: 19144 - DNA, 297 bp, Glycine max
  Peptide Sequence Number=SeqID_135922
atggagggtaaacacgtatatacgagaatcttcacagaaatcaaggcaaccttagcaggaaaaggcaaggtccaacgcgtcgtcaaagaacaggaggttgtgcggatcggtgcgctggacgagcgacggggacttggggatcttgacgtcgtcattgttgaggcaacagaacacaacgacctcgtgatcggcaccaacagagacgcaaaggatgcaagagtggttaaaggtggtggcgtggaggaggaggtggtcgttgaagaggaggcagaaagagaagacattggcggccaatag

SEQ ID NO: 19145 - DNA, 309 bp, Glycine max
  Peptide Sequence Number=SeqID_135923
atgtcatcaagcctaatcactaacatgtacttcttcttcttcttcttcttcgctgccccgctcacttcccccgttacgaaaattgacatcgccttcatcgaggaggaggccgagaggcttctcgaagagcgccttagcaccgacctgtgcaatactgacgcactctacacactcatggaggtcaaaatcaaagcgcgagtaggagtggccgaaaggagcaaccctggtaacgatcccatcaatgagctttgttctatggcagaagagagtaggcatgagaactcaagcactgaaaggagtggcagatga

SEQ ID NO: 19146 - DNA, 252 bp, Glycine max
  Peptide Sequence Number=SeqID_135924
atggctgacaaaaagaaggcattcagcaatggtgtttataaaagcatacaacatcgagtggttgctgccgagaaagcagagaggttttctatagcctttttctattgcccctcagaagaggcaattatagaaagccaaatcaatccagctacgtacaggaaattcactttgagggagtatagacaacagactgagaaagatgtaaaacaaaccggggataaagtggggctctctagatttcttcattcgtag

SEQ ID NO: 19147 - DNA, 129 bp, Glycine max
  Peptide Sequence Number=SeqID_135925
atgaatttccttttgcagggcatggaggacttcttggacgaaatgttaacaatgatgagtcagaccaaatcaaatggaaaatcgaatgagaaaagagatctcaattggttgtgcttgtgcgtgagctga

SEQ ID NO: 19148 - DNA, 768 bp, Glycine max
  Peptide Sequence Number=SeqID_135926
atggattgtgagcctccattccttgaaacctataagacccttgtgcaaaaacacgttgaggattcaaagaatattgactcctcctctttgttggagagatcaggcgaactacctttgatcgatcttggccgattaaatggcgaaagagacgaatgtgtgaaagaaattgcagaagctgctagtaaatggggtttcttccaagttgttaatcatggtatttcacaggagctgctggagagacttcaatttgagcaaaagaaattgttctatcaaccttttattaataagtctgcacaagttaatctctctagtttatctgccaaatcttatagatgggggaatccatttgctaccaatctgagacaattgtcatggtcagaagcctttcacttttctccgacagacatctcaaggatggaccaacaccaatgtctgagattaagccttgaagcttttacaacaagaatgttccctcttgccgaaagcttggcggaaattctaacctgcaaattgatgaatacgaaatcaaactatttccaagagaattgcttgccaaaaagttctttcattcgactgaatagatatccctcatgccctatatcgtcaaaggtgcatggcctgttgcctcacagtgatactagttttcttaccatcgtacatcagggccatgttaggggattgcaattgatgaaagatggaaaatgggttgatgtcaagcctaatccacaagctctagtcgttaatattggcgacttctttcaggattaa

SEQ ID NO: 19149 - DNA, 111 bp, Glycine max
  Peptide Sequence Number=SeqID_135927
atggctcgaggaactatgatgttggcttgctactactgtattttgggtcttggttcaagatgggtgtcattggttcaatggatgttggctgagatgcagcagcatctttaa

SEQ ID NO: 19150 - DNA, 964 bp, Glycine max
  Peptide Sequence Number=SeqID_135928
tggtgcaagggtactagggtgttccctagcgcagaaaatcgaaggcattgagaggataaagaataataattccgaggcaagaggatgcttcgtggctcccatcatagcggcagcggttgaaatgatggcgaacgcagctgaagtttcagccttgaaccgcatcaaactgcatcttttgggtgaactctctccactggccactcccctaaactattttgatgaatcaaaccctagcccctctgaatcttccaattcccaatcttcttctgtttctcttaaccactacttcactgacctcttcgaattcgactccaaaccccaaataatcgacctccaaactcccaaaacactaacttcagctcagaagaaacctcaattgaatcggaaaccgtcgctgctaatcgctgttccaaagaagaccgagtggatccagttcgggagcccggatccgaacccggtgatggctgcgccggagaacctgccgcagaagaatcactacagaggtgtccggcagcggccctggggcaaattcgccgccgagatccgcgacccgaacaagcgcggctctagggtttggctcggaaccttcgacaccgccgtcgaagccgccaaggcctacgaccgagccgccttcagactccgcggctccaaggccatcctcaacttccccctcgaagttagcgccgtggcggagaccgtctccgtcgccgccgccgaaggcaacgtcgagagaaagcgccgccgcgaggaagaggaggtggtggtggaggaagtaaagccggtggtgaagaaggaaaagataacggaacaggatgtgagttgttttagggagatgccgttaacgccgtctatgtggaccgggttctgggacagtgacgtcaaggacattttcaacgttccgccgttgtcgccgttatctccttttggattttcaccgctcgtggcgcgtcctgtatggggatga

SEQ ID NO: 19151 - DNA, 273 bp, Glycine max
  Peptide Sequence Number=SeqID_135929
atgaggattggtggaatgggggaaagcacaatgggagggctgttactgaaattaccacgtgcatcaaaatttgtgcagacagagattattaaggtgggttctatgatgcaaagccttagtcctagatccaggcaaatatgcgtaaacttcaagagtcttcactcttccactatgttgcgtcttcaatgcaggattctagaaaagaagaaaaatatatatcttgtcttgacaaaacacttcgatataaaaccgaatatggcggtgacaatgtga

SEQ ID NO: 19152 - DNA, 171 bp, Glycine max
  Peptide Sequence Number=SeqID_135930
atggccggtctctctaggctgatctctccaagtagagataacgaaatggacccaaaccctatgggcacccgcaaaatatccacaagcggagaggataattacctgcttattgaagctgaaaatgggaacaggtctttgagaatattgtcatcacatgatattcaagtttaa

SEQ ID NO: 19153 - DNA, 810 bp, Glycine max
  Peptide Sequence Number=SeqID_135931
atggccactttagacgaacgcccttctgcgaaaaggtggcttcctctcgaagctaaccctgacgtcatgaaccagttcctttggggtcttggccttccagtggatgaggcagagtgcggtgatgtgtttggcttagatgaagagcttctggaaatggttcccaagccagttctcgccgtgctttttctttatccaattaccgcgaagtctgaagaagaaaggttgcaacaggaaaacgtaaaaaaggattatagcagtaaagtatatttcatgaagcaaaccgtgggtaatgcttgtggtacaatagggctgcttcatgcacttgggaacataacctctgaagtcaagcttgttgagggttcattctttgataagttctttaaatctactgcaagcatggatccattgcagcgggctgtatttcttgagaatgacagagagatggaagttgctcattcagtagccgccactgctggtgatacagtgataacggatgtagtgatgaaaggtttagtttggctttcttatcttgaaaatctggcatcagataatgtggacactcatttcatctgctttgcttgtgtggatggtgaactgtatgagcttgatggaagaaagtcaggaccaatatctcatggtccatcctcaccaagtactttgttgaggctacttgcattaagtgctacctcctacaatgaccaagatcctctccaacactccccctcgacccggttgttagcccaaaagaattgggcaggtttgttgtgcctgaacatagtgggcttatggatgtgggagcaatatgactaa

SEQ ID NO: 19154 - DNA, 318 bp, Glycine max
  Peptide Sequence Number=SeqID_135932
atggttgcaaccacccctcaaccacgtataaacctcgagtccttatttgattccaacggcaacaacaaccacaggttcagattcatcattgttgagtgttatgtctcaaacggaaaattccaccgtacaccgtgccgtcaaaaccttcctctccatttctcacctttgcatgtgttagagaggtcgacggtgacaccgattttgccgcaggcgccagtggtgactagtgagggtgggggtggaagtgtagtatccgttgcaaggcgggtgcctcttggaagagaaggagctccagggaaggacgaccggcaacaataa

SEQ ID NO: 19155 - DNA, 1020 bp, Glycine max
  Peptide Sequence Number=SeqID_135933
atgtgcgctttgagagtgttgactcggtccgtgtgcagcagcagcagctcctacgtcaaaacttccaaaccctatctcactctcattctcatcacacatcatcagtatcactatcagcaccagacccatagaactcttattcttgactcttccgcttctgaattcgtcaagcttcacaaactcaatggccctgattctgggatcgttgaaattagcttggacaggcctgaatccaaaaatgctatagggaaagagatgctgcgaggcctaaaccaagcgtttgagttgattaatcagaaatcttacgctaatgttgctatgatcagcagttcagttcctggggtattttgtgctggggctgatttaaaggagcgcagggccatgagtcagtcagaggctaagatttttgtgaaatctcttcgctccacattctcatttctagaggttgatgttcgtgttccaactattgctgttattgaaggagtagctcttggtggtggacttgaaatggctcttgcatgtgatattcgaatttgcggattgtttgaacgcttctgtgcgatgaaagtattagactttttctctacttgtttcttctttcatggaataggagaaaatgctctgatgggtttgccagagacaggacttgcaataatccctggggcaggtggaactcagcgactgcctagattggttggaaaagcaatagcaaaggatattatatttactggtcgaaagattgatggcaaagaggcactgtccttgggtctagtcaattactgtgttcctgctggtgaagcttattcaaaagcacttgcaattgctcatgatatcaatcagaagggtcctgtagctttaagaatggctaaaagagctattaatgagggagttgagactgatctaacatcagctttggaattggaagaagattgctatgatcaggtcttgaatactaaagatcgattagaaggcttggctgcgtttgctgagaagcggaaaccgagctatactggtgagtaa

SEQ ID NO: 19156 - DNA, 429 bp, Glycine max
  Peptide Sequence Number=SeqID_135934
atgagcggtggtcgactttgtacattgcttggagaattagggtacgaaggctgggaagcattggaccctgacagcttcgaatggccctttcagtatgagcagttcaagcaagaagggaagctgttagagggcgaggatttggactttgcttacgacagcatctctgcattctctgataggagagacaatcaggaggccgtttttggcaccgaggaaggattgaaagatatcaaggaggcgactttggcgtatagagaggaggctttggccttgcagaggcagctgaggcatctgcaatctcagtttgacatgctttcgggccaggcctccaccttgacacaaggaaggcgagcacgccttgctgcaacctctattgttaatggacaccttgctaatatagatgatagcctttctgtcaggaatttacag

SEQ ID NO: 19157 - DNA, 1113 bp, Glycine max
  misc_feature (654)..(654): n is a, c, g, or t
  Peptide Sequence Number=SeqID_135935
atggctattcagtgcctgaagcactgcagcctgcagccgatcatagagtggcgtgccggtgtcaatctgctggttattttttacggtcgcgccctggctgccgaccgtcgcccgtccgtcaacccagtcagcctgctgcagctgtgcggtaaagtgcgccagctgttcagcgttaagcacggcaggaatgaaggtacgcggctcgcccgtatgatagcggtagccactcttgttgatcgatgccacatagttggtatcaaacaggttatacacgttgagctgcaggtcgaggttattgttgaccttatacccaagcttcgcgtcagccacccagtagccttcggtgtgatccggcgtgcccacggccccatcgctgccgcgacgcaggctgccaacgccagcgcggatgagccatcctgcgccacgctggcaccttcacgcaccgacgcgtgctgcatggtagttcatagccttccacgcgcttctgccggtttgcgagtaagtgccgtcatcattggcatcgacctcattttcgatgtcggtgcggaacagtgcggcgttcagcagcagccgcttgtccagcacctgccacttggtgcccacttcgctggatttggcattctgcggtttaaaatcagtacggttggcgctgtngccgctgccacccgccgccagcgcgaagctgctgccacccggtggctgctgggagatggcattgccggaatttcgccgtgtccaccgtggtcaccggcgtattacgcgccacgcccgccggacaagccagcgcgccgcgttccggtgccgccacagggccgtcgcgctgtcgtactcggtgtgatagttgtcgagacgaatgccgccgttcagctcaaagtcaggggtaatcgccagcgtatcaaatgcatagatgccaaacgtgtcagtctgcccgttagcgttcgcaccgttgcggtccagaccgccaatcgaaatgctgctgatgggatggtagatattcaccgcaggcggggtcagcgcgttgacgccataggtggtctggttttcacgcgtgaaatctaccccggcactcacatcatgcccgacggaaccggtggcaaatttcgagggatattg

SEQ ID NO: 19158 - DNA, 423 bp, Glycine max
  Peptide Sequence Number=SeqID_135936
atggctgttgtggtggacttaactatatcaggtcttgatgccctttttcgatttatttttctaatacattatcagggtccatttcgacttgttgctgaggaggggaaatctaaatgctcttgggtgaatcttgatgacatctcaaatacctatgttagaggcaacgacttcttaaaaattctggcattctgttccaatcctatgcagtgtaaaactgtcgttaaaaatttggaaaaatcacatcatcaacgtgtatctgagttgcgacggcttcgctcaatatttggagtaagtgaaaaacaatgggttgaagcacaggtcgagaatgccaagcagcaggctattttaatgacacttaaatcacaagtatcatcagatgaagctcatattcatcttgatcttcattctcttaggtatttataa

SEQ ID NO: 19159 - DNA, 186 bp, Glycine max
  Peptide Sequence Number=SeqID_135937
atggtggtccaatgccatatcattttcttcccttttcagactatttcagatttatgctgggagctagctcaactccaagacacatacattttacaaggtgattatgatttgaaggtcatgcgccaagagtactacattaatcggcagaaagcagtttttgattcaaggggtgtgctagttgcctaa

SEQ ID NO: 19160 - DNA, 122 bp, Glycine max
  Peptide Sequence Number=SeqID_135938
atggagactgaaagacgtggatggggtggtggacaaggcagaaatacatcattacgctctgcaagtggagatttgattgcaaagactgtacgacatggaaggtgtgcgtggtggaaggcagg

SEQ ID NO: 19161 - DNA, 798 bp, Glycine max
  Peptide Sequence Number=SeqID_135939
atgaccagtgacaatcacatgcatattacattatcattcaaagtgtcatgtagggtaacactcactcaatccctgtaccttattggactagaatatacatctgccacgttcgcatgtgcattcctaaatatggtgcctgtattcacctttattatggcgctgccactggggatagagaaagtggacatgaaaaagctgagtgcgaaggccaaggtgttgggaacttttgtgtgtattggtggagctttgatgttgatcctttataaaggagtgcccttaatcaaccaacaaccagagcacatagcagacaaaggcacaataagatcatcagcctccaagttaaagaaatggatcataggttcactgcttctaactgcaggatgcttcttgtggtcttcacggtttcttatacaagcaagcattagcaaaaagtatccatgtcaatactctagcactgccattttgtccttttttgcttccattcaatcagcaatattgactttggtcatcgatagaagtaatgccaaatggattctcaaaggaaagttagagataatgactgttgtatatgctggtcgggcttgtgctatgtggcaatgtcatggatcagtcttggttatatctggcacgtatattctactttgggttaaaagtaaagaggaagaccaatgtgccatgaagggtactcaagaaagtcaagaagatgaatgtaagaataatttggaggccagtccaaatgtaccttctaagctaaggcctaatgaggaacaaggattctctgaattacaagtgaagtag

SEQ ID NO: 19162 - DNA, 543 bp, Glycine max
  Peptide Sequence Number=SeqID_135940
atgagttatgacttcttgaacctaattcctaaagctatgttgggtcgttgcctggcccttatccaagctgcatccgatgttcaagaacaaggaggagttcatgacagtgatcattttttgcatgctattagagacatgctaaaaatttattcaaatactcaagctcaagctacactgtccacatatgtatcagctcctggcattgtccaacagatatcagctcttcattcagatttgttgagccttcagtcggaccttgagaattctcttccagaagacagaaataggtgtattaatgaactgcgcaatcttattaaaaatctgcagaaactgctctttgcatcttcaacaacagcacagccaatactgacccctcggttatgtaaatttaatagactcactagtactaaggcttttgttacaaggtatgggacagtaagtagggaatcagcaaatgtggcaaaatggactgactatgcaacagtggtgaataggagagaggagggaattcagtttgagggagcttggagcaagttaggttag

SEQ ID NO: 19163 - DNA, 403 bp, Glycine max
  Peptide Sequence Number=SeqID_135941
atgtttcctcacacaaagaagttaaggaacatattggaaccagaaatcttccctcatagtggagaaagagaaaataatgatagaattcaaaaagctaagaaaaaagataaaaagaaggtcaatgatgatgatgaaaactatgttcctgaatatgaaggtggacttgggtcaaattcttcaagtaaaaattacgagaacgacagacatgatgagtttagtgctacaaatgatcttgagtcacagaaaagaaagatgataaaatcatcgatattgaattctaaaagagtctacaatgattcatccatacaccactctcttgataaagaagtgaaagagtatttacctaataatgcatctcatgcctcagagttgactaatgtagaacaagttgaatcaaatacag

SEQ ID NO: 19164 - DNA, 1383 bp, Glycine max
  Peptide Sequence Number=SeqID_135942
atggctcctccatgggttcaagagctcaatctcattcacctgagcattcctataaccattgataaaatgttttcggtcatgccgtcaaggcctattcctgttaaaccaggtgacagtttatacctttccaacctcgatgacatgatcggagctcgtgtttttacgcctacggtgtacttctatcaatccgatgacacatgcttctcagaaaaacctgtcaccaaaacactgcagtgtgctctcgctgatgttctggtgccttattaccctctctcaggcaggctcagaaagaccaagaatggtaaactggaagtgtttttcggaccagatcaaggagcactcatcgtcgaggcgcggtctgatatcgccttggccgaattaggagacctcacagctccaaacccggattgggagcctttgatcttcaagtttcccgatgaagaacaatacaaagtcctcgaaatgccactggtcattgctcaggttacccttttccgctgcggtggctttagcctcggtttgaggctgtgccattgcatctgtgatggcatgggagctatgcagttcctaggtgcgtgggctgccacagcaagaacaggaacactagtaacagatcctgagccctgttgggatagggaaatttttaggcctcgtgaccctcctgaggtgaaatttccccacatggagtttatgacaattgaagagggatccaacctgacaatgacactatgggaaaccaagcctgttcagaagtgttacaggatcaagcgtgagttccagaaccacgtaaaatctcttgctcagccatatgatgctgcaggctgcaccacttttgatgctatggcagcacatatttggagatcttgggtgaaagctcttgatgtaagaccactagattaccaacttaggctaacattttcggtcaatgctcggcagaagcttcggaatcctccactgagagaagggttttatggcaatgtggtgtgtgttgcttgcacaacaagcactgtctcagagcttgttcatggaaagctcccagagactacccttttggtgcgcgaggcgagacagagtgtctcggaggagtatttgagatccacagtggatttggttgaagtggataggccaaggcagcttgagtttggtgggaaactaaccataactcaatggactaggttctcaatttataagtgtgcagattttgggtggggtagaccactttatgctggtcctatagatttaacaccaacacctcaggtttgtgtgtttctaccagaaggggaagctgattgtagtggtggttctatgattgtgtgcatatgcttgcctgagtctgctgcagagaagttcacacaagacttgttgctcaattcggttttttga

SEQ ID NO: 19165 - DNA, 573 bp, Glycine max
  Peptide Sequence Number=SeqID_135943
atggctttcgctcgagggcaaggctaccatgtgacaattataaggtttggaaggagaaagttctacttcatttgggaagaacaacaaactatcactgagaccaatactccagatgtgcatgataaagtcaaggatttattaaaggctatagacgagcaatttatgacatttgataaatcccttgccagtacccttataatgcagttttcatccatgaagctcattgggattagacacatcatgcacataaaggacattgtggctcaactgaaacccttggaggaggaggacatgttactaatggaagaggcaagtgataaagaaggagtcaaagtgtttcttctgcaagaagaaggtgatgagaatcatgaaattgaccaaatacaggctaaaggcccaaatggagaaggacaaagcccccgagtgaagaaggatgaaggtaatccttgtggcgtctatcctgacttatcttccttcaccgaaagtggcgtctaccctgacttatcttccttcactggaagtggcgtcatccaaatctccgtagcctgtatcaagcgatccgctcctagtcag

SEQ ID NO: 19166 - DNA, 342 bp, Glycine max
  Peptide Sequence Number=SeqID_135944
atggcattcaaccttctcattcctatacaatataggacttcacatcacacttatactccaacaatctccccctcaagtgtgagtctctttcacatggtagtctccccctcgagcgaaagtcattatcacccacaaatacttgtaccgccactccacccacaagacacgttgcctggacctactgccaggatgacttttaatacaaggaatcctcaagcctacgatccactgtcatcatcttactcgtttgagctggtcgttggtcaccaagttgaaccatcaattttggtagcaatcgttgagaaactgagggatacataccagggagatttacaccaatga

SEQ ID NO: 19167 - DNA, 570 bp, Glycine max
  Peptide Sequence Number=SeqID_135945
gctaatgataagggtatgttatatgaggtgaaacaatttctctcaaagaactttgatattttgcttgaggctaatgataaggttattgcaagccttatgtatgctcaagtttgcatcaaacttgacattgcatttgctgttggagttttgggaagatatcgaagtaatctaagtattgaccattggaaagatgcaaagaaggtaatgagatatactcaaggaacaagggactacatgctcatgtatagaaaaactaatgatttggaggtgattggctactctgattcaaaatttgttggttgcattgataccaggagttctacttatggttatgtttttatgctagttggtggagctatatcttggaaaagtgcaaagcagtccttgactgttacttccactttggaggctgagttcatttcttattttgaggctacttcgcatgatgtatggttgaagagttttatatccaggctcagagttgtagactttatttttaggccgttgaagttgtactgtgacaacgatgttgtggtgtttatggctaagaacaataagagtgaaagttga

SEQ ID NO: 19168 - DNA, 1836 bp, Glycine max
  Peptide Sequence Number=SeqID_135946
atgcctgaggctcctggagactccaccaaagactatgttcttgaagagaagaacaagaaaattttggacttcatagaggatgtgaccaacaacgcagatgaagtccagaagaaggttctctctgaaatcctgtcccgcaatgcaaacgttgagtacttacggcgacacggtgtcaatggccaaaccgtcgaccctgacaccttcaagaggcttctccctgtcattacatacgaggacatccaaccagacatcaaccgcatcgccaatggtgacaaatctccaatccttacctcaaaacctgtcacagaatttctcaccagctctggcacatcagggggtgagagaaagttgatgccaacaattgaagaggagctaggaaggaggtgtatgttgtacagcctcttgatgccaataatgaatcaatttgtccccgacctagaaaagggcaaaggaatgtacctaatgttcataaaatgcgagtccaaaacacccggaggcatagtggctcgcccagtcctcacaagctattacaaaagcccttactttagggacagatcctacgacccatatacaaactacacaagcccaaatgagaccgtcctatgtcttgattcctaccaaagcatgtactcccaacttctatgtggcctttgccaacacaaagaggttctaagagttggtgccatattcgcctctggcttcatccgtgccattaggttccttgagaaacattgggcccttttgtgcaatgacatcaaaacaggaactattaacaactcaatcactgattcttcagtgagagaggctgtgatgaggatcctcaaggctgatcccaagcttgcggattttatccacaatgagtgtagtaaagggtcatggcaggggattattactaggctttggcccaatacaaagtatgtggatgttattgtgacggggactatggcacaatatatacccactctggattactatagcaatggcctcccacttgtgtgcaccatgtatgcttctagtgagtgttactttggggtcaacctcaaccctctttgcaaacctagccatgtgtcttacactcttatccccaccatgtgctactacgaattcttaccggttaatcgaagcaatgagcttgctgcttcaagaccttcaccaacttctctcaatcaggcacaacagcaagaattggtggagcttgttgatgtcaagcttggccaagaatatgagcttgttgttacaactcatgccggactttataggtacagagtgggagatatactaaaggtatcaggattcaagaacaaggcccctcaattcagctttgtttgtagaaaaaatgttgccctgagcatagattccgacaagactgacgaggttgagcttcagaacgcaatgaaaaatgcagtgacacacttggagccatttgatgcacacgtgagtgagtacacaagctatgcagacacaaccacaatcccaggtcattatgtcttgtactgggagctcaatctcaaagggtcaacccctattccaccttgtgtgtacgaggattgttgcttaaccattgaggagtcactcaacagtgtgtatcgccaagggcgtgtgtcagacaaatcaatagggccccttgaaatcaagattgtggaacaaggcacctttgacaaactcatggactatgccattagcttaggggcatcaattaatcagtataaggcaccaaggtgcgtcaagtttgcccccattgtggaattgttgaactcgagggtaacatccaactatttcagtcctaagtgtccaaagtgggttcctggacacaaacagtggatccatcagaattga

SEQ ID NO: 19169 - DNA, 1725 bp, Glycine max
  Peptide Sequence Number=SeqID_135947
atggaagacattgttgatcacttggctttcgagcggaacaagacgcagttcgatgtcgacgagatgaagatcgccggttctcttcacgcttttgaagtttctgacaaaatggctcgcctcgtcgccagcgatccggcattcagaaaggatgacagagttgtgcttgataggaaggcgttatttatgaacactttgaggaaaacagcttatgcatggaaaaggattattgagctccgtcttagtgaagaggaagctgctatgctcagatcctttgtggaccaacctgcttttacggatctacattggggaatgtttgttcctactatcaaaggacaaggaactgaggaacagcagcagaagtggttgcctttggctcataagatgcaaataattggttgctatgcccaaactgaacttggccacggatctaatgttcaagggctagaaaaaactgcaacctttgatcccaaaacagacgagtttgtaattcatagccccacattgacttccagcaaaggtatttggctaacaggatatcttcttgcgattactgaatatgattttaactcctttgatgctgatttaaacagtggtggcctggtggattgggtttcattgtccagctgtgagcggagcttggatgatcacttacctcttccaggcataactgttggcgatattggaatgaaatttggaaatggagcatataactccatggataatggggtgctaagggtttcacaggtaacaagggaaggaaaatatgtacaatccagtgttccacgacaattagtttatggtactatgtttgcattgctacaagatatagtgctgttcgaagacagtttgggtcaaaaaagggaggtcttgagacacagattcaaagctgctttgcattccaccaacatagtaaagttatgtcttggtctgagtgggaatagcatttctcttctgcttgtccatggagttttaaaaaatccaaacatctcagaaatagtaattgattataaaacgcagcaagctaggctcatccctttgttagcttctgcctatgccttcagatttgttggtgaatggttgaaatggctttatatggatgtgatgaaaagattgcaaaccagtgatttttcaacattacctgaggctcatgcatgcactgcagggttgaagtccttcactacttcagcaactgctgatggaattgaggaatgccgcaaactatgcggtggccatggttacctttgcagcagtggtctgcctgagttatttgcagtctacattccttcctgcacatacgaaggagacaacactgtgctgcttttacaggtggctaggcatctcatcaagactatttctcagttgggctccaggaaaaagcctgttggtacaacatcttatattggacgagtggaacagctgatgcaatatcattctgattttcagaaagcggaggatgggttgaagcctaatgcagtgctgggagcatttgaagctagggctgctaagaaggtgattggttgtgctcaaaatcttagcaagtttaccaatcccgaagaaggtttccaagaattctctgtcgatctagttgaggcagctgttgctcattgccagttaattgtggtttccaagggagcccggtcccgcaacaacttcgtaatgcactctaaaataacttataactgcactgttgatcctggagaaagttatgaattgctttcaatttaa

SEQ ID NO: 19170 - DNA, 612 bp, Glycine max
  Peptide Sequence Number=SeqID_135948
atgtgcaagctgaacaagatccacgagctgaagacaacatcgtacgatgagcgcatgaagaatcacaagagccatgcattgcacacgacgcaccagatcgtcaagtcatggatccatgcatcgcgaaaggttctagagaggatcacagatgtagtcctctcagaaccttcaagaaagtcgaaggagttggttgaaccgacaaagatgtgcaaagatctgaggcacaaggtgccagagatattggaggtggaggtggatccaaagggaggaccaaggattcaagaggcggcaatgaagctctatgtttcgaagaacgggttcgagaagcttctcactcttctctttctctttgtgctcaatctctctgacctcaatctctttgtgtgctcaatctctctcttgcaacaacactcaatctctctcttcgtagccccgacactattgcttccgaagagcgtggtgcgaagaaaggggttagtttcgagattgatgaagcgaccgttacgacaatggacagtgactcttccgtttagagcagcgtcaccactttgttcgcacatggcaccagggatctccacgaggttgttgaggagattcaagatgagtttgtga

SEQ ID NO: 19171 - DNA, 228 bp, Glycine max
  Peptide Sequence Number=SeqID_135949
atggcatttagaaggtggagcccaatgacgccgatgtattgtgaaggggtgaggttgagaggggcccgtagggaaggggtggattatgggctggattgtgaaggaggaggaggagaggagggaggcagtggtggggaagctattgatggtgatggcagtggcaatcatggtggaaagtggaggcgtctaaagaaagttgacaagaggggagagaagaaggttaagtga

SEQ ID NO: 19172 - DNA, 720 bp, Glycine max
  Peptide Sequence Number=SeqID_135950
atggctgcgacgttgagtcttccaatcatagacctctcttctccccatcgtctttccacacccaactccattcgtcaggcatgtgtggagtatggtttcttttacctcgtgaaccgcggggtggacaccgagattgtgagcaaagtgttcgaccaaagtggcaagttcttctcgcttccggttcaacgcaaactggacttggcccgcaaggaatatagaagctacacccctctctattctgagactcttgatcctacttcactctccaacggtgatccaaaagagacctattacattggtcctatagaagatacctctattgctcatttgaatcaatggccttctgaaggacacttcagaattactgccaaactggagacctacaatggaatccttatattggaaactaatggctgctggaaaaaatctgctgctctgatagccatgcccttgaatctggaagaagattactttgagaagataggtgccttaaacaaagcagcagcttttcttcgccttctgcactatccagctagatttgagtcaaaaactgctattctggtggcgattaaaggatctgatgagcagatatgtggtgcctctcctcattcagattatggcatgatcactcttctaatgactgagggtgttcctggactgcaggcaggggattctatctccctgtgtcaggattcctattgcatatcagaatttgagtag

SEQ ID NO: 19173 - DNA, 312 bp, Glycine max
  Peptide Sequence Number=SeqID_135951
atggactccagcactgtcacacgccgttgtcctctccagatctgcgtgcgtgagaccacgaccacaccaccacaccaagaacatcatctacgcacgaactacctcggacaacccctcttgcgcgagccgccacctacaagaccaaaatccacgcgcgtgatttcggggcaccagatccggatcaaagccatcaaaatcggaggagctaaagaggtttggcactggttccgcgacgagcgacataacatactgtttgaggttttaaaaaatttaaagagcttcacatcaactaagatgagggaatctgaatga

SEQ ID NO: 19174 - DNA, 144 bp, Glycine max
  Peptide Sequence Number=SeqID_135952
atgatctattttcttgccgacggcatcggtcatgtcgttgagaaagacaacatcaaagaaacgcataaaaatgacaaactaagcaaagccattgacatcatgcttcaggaagatttcccagagcaaatccttgaagtacgatga

SEQ ID NO: 19175 - DNA, 402 bp, Glycine max
  Peptide Sequence Number=SeqID_135953
atgaagaagtttgctgacagcaataggcgtgaggttcactttcaggaaggagattgggtgctgagaattggtccagtcgcatatcgactccaacttcctccaaattcaaagatacatcctgtctttcattgttcgctcctcaagcccttccatcagtacaccactctggacatgcatgccattgttttgcctcctcagtcaaaagataacaaacccataattgctcgccttgtcattctgaacacaaaatggattacgtcagacacaagacctgaattgatggtcctagtccagtggcagggactgttacctgaagacacttcatgggaaccatgggccaaactaaaggaagcctatcaccttgagggcaggtgctttcagatgcgcagagggatattatga

SEQ ID NO: 19176 - DNA, 846 bp, Glycine max
  Peptide Sequence Number=SeqID_135954
atggggtttccttggactttcagtgttctatcgccacttcaccaagggctatgcatccatcatagctcctttgactcgcctcctagtcaaagatcaatttcaatggtcgtcgaaggctcagctagccttcgaaactctcaaagacgccatttgcagagctccggttttggggctgtcggatttctcccaaccatttgttgtcaagacagatgcttccgcgatcacggcggccatgaaaaagtggcgctagtatttgttggggcaccacttcatcatcttgatcgaccacaggagcttaaaagaactcatgtcccaagtcatacaaacgccagaacaacaaacctcaacgggccaaatgataacattgattgttcctcattttacatttttgcaagatctgaaaatggagctccatcatcactccagctatcaggaactcaggcgaaacatcaagaacaatccctaagcttacccaacttatgtgatcactcaggactttatcctatagcaaaatcgaatttgattaccacaaggggactcccagccttcagaggacacaccgttatcttggtggtggttgaccgcttttcaaagggggtccatttgggtatgctccgacctaattacacggcatccaccgtagccaaccttttcatgaagatcatggggaagatccatggcatgccaaggagcttggtttccgatcgtgaccctttgttcgtgagtggtttctggcaagaattatttaagctcttaggaacgaagcttcggatgagttccgtgtatcaccctcagtcagacgggcagatagaagttctaaatcgggtcatagagcaatatctctga

SEQ ID NO: 19177 - DNA, 183 bp, Glycine max
  Peptide Sequence Number=SeqID_135955
atgtcacatacctcaattgcggtagtgatgaaccccaactcgtttgtggtagttgcagctttggtggcagttgtagcttcagcggcgcagtttgcgacagtcacagggtcaagaggaaggaaaaaggacaaaggacaaagagggtttgagcgcgcgggggccaaaaatgaattcaggttttaa

SEQ ID NO: 19178 - DNA, 321 bp, Glycine max
  Peptide Sequence Number=SeqID_135956
atggaagagaagtcccacttctctatcaagagtgatgagaaaaatggacttgattcctctccaaagcagctcaatgaaggccacaacaagacggagactcgcttggttggtgattctgtgaagccaagaaaccgaagaagcactaaccatcatagggtgcacaaagctactgaaaatgcttcaggtagttctttacaaaagtctcttgtttcagtttcatggcgtgtgcctcacaataataataagaaacctcgtcagaaacactctgggtttgacttggactattcgccaccaaagacacaccctcctcatcacaactaa

SEQ ID NO: 19179 - DNA, 365 bp, Glycine max
  Peptide Sequence Number=SeqID_135957
atggttgaagcaactcgatccaaaacaaatatggaacacatggaggaagccatagccaagcttgcctctaaccaactccatgccaccaccaaattagacgaactcatccaacacattactatgttggaaaccagccaacaacactcacccacaccttcatcttcctcagctaaccctcaccccccttcctattaccccaacctccctcgcatgaagctcgaggttccttattttgatggctctgatccttcggggtggacctttaaaatcaaccaattcttcaactaccacgcaactcctgagcccaaacgcctagtcatgcttcctttgccatggaagggccctgcgcttgcctggttccaatg

SEQ ID NO: 19180 - DNA, 117 bp, Glycine max
  Peptide Sequence Number=SeqID_135958
atggctttgatcaaatttggtgccgttgccggggagcaatgtccaaagtgctttgcgatggatttagcgaccacttttgctaatctggaaagcggagtagtagtgcaaatcccttag

SEQ ID NO: 19181 - DNA, 426 bp, Glycine max
  Peptide Sequence Number=SeqID_135959
atgatagcagccatacttgacagggtccaagtggagaaagacgaaggcctagaggcactcccaagaatcttgattgctaaagaggtcgttattccatctaagtctcactcaccacctgtggatgacacgatgtcctctatcatatttgattcttcatccaaggacactgatgttatttcctctacaccgatgtctcaacgatcaatgttacctgagtcttggataccacccgagacaaacttggtaaatcttatgtctgaggataaaggtgaggatgtggatgaggatacatctatcgaggaggatttttctatggataaggaggaccctgtcacagagctggagctgctgaaggaagactcttcacaggactcttccgatgagtcttactatttgactatacttcttctttttgggtatagctga

SEQ ID NO: 19182 - DNA, 147 bp, Glycine max
  Peptide Sequence Number=SeqID_135960
atgtacctttggcttttcgcccgcactcccgtcatagggtatgttgagacaatacttgtagtcagaagcttcatgaggatcgacatatattacgaggaaggaatggaagaacgaggtagcgagattgtgttagagttaaagacataa

SEQ ID NO: 19183 - DNA, 1251 bp, Glycine max
  Peptide Sequence Number=SeqID_135961
atgtcagcagataatgcagggaacatatacacattgccaatggccaacactgtagttagcctgttttcaatagtcctgctttgcataacagcagctcaagggaggaaaagacttcaccttaacaatgaacggctaacatcctatccagttattaatgatattgatggtatctgcaaaacaatggtagagacacaaggttacacatgtgaagaacatcaggttacaacagaggatggttacatcctgagcctgcagaggatgccagaaggacggtccggagagaaagctgacaagccgccggtgctattacaacatggtatctttagtgatgcttcaacatggctggtaaattctccagatgaatcattgggatttatcttagcagacaatgggtatgatgtgtggctcgccaatgttcgtgggacacaatacagcagcgggcacacatcacttattcctaatgacacggcctattgggattggtcatgggatgaattggctagttatgatcttcctgcttttgcccaatatgtgtacaactatactggtcagagaatacactatgcaggtcattccttgggaactttaatggctttagctgctttatctcaagggcaagtggtgaacatgttgagatcgactgcattactttgcccaattgctcatatgaatcagattccatcactactaacaaaacttgctgcagacacatttatagctaatgacatgtactggttaggaatccacgaattcaatccgaacgggggtggtgcggcatcaaaatttgtggaagacatctgcaataaactaaacttgaactgctcaaacctaatgtcgcttgtcacaggtccaaactgctgcctaaattcgtccagaacagatatctcttctgagccaacagcaactaagaatttgatccatctatcgcaaatgatcagaacaggaaaaatagtaaagtatgattatggtgaccaaggacaaaatatgcagcactatggacaaccagttcctcctctttatgacatgacggcaattccaaatgaattccctctttttctcagctatggagggcaagactttctatctgatgtaaaggatgtgcaggttttgctcaatgacctcaaagatcataatgggaacaagctcgtggtactgttcaaggaagattatgctcaccttgattttgtcagggctgtcaatgctaaacaaatgatttatgatcctatgatatctttttttaatgttaattga

SEQ ID NO: 19184 - DNA, 507 bp, Glycine max
  Peptide Sequence Number=SeqID_135962
atgtcctcacgccttatcactaatatcttagtgtcacgtcattaccttcttccccttctttccttgctctccttccccaacggaaaccaccaccacatgccaccaccgtcaaccgcgctgcgccaccaccgtcgccgaccgccaccactgcaccgtccaaccccttctccccttcttccccttatcttcttctttctactttttacctccaatccaactgaacctcaccgcttccactaccgcattactccatcgaagagggggatcaaaagtgtgcgtcagcgactcaacgttgtactggtcgctgacttcgatggtagcgaaaaaggtgaagacgacaccgagacttcaagcggcgcgtgttggtggagtggggtgggttgttttctgttggagaaagggaagaagaaagagaggggttggacggcacggtggtggcaatcgatgacaatggtggtgtggtggtggtggcttccgttggagaaggaaaggaaagtgatgacgtga

SEQ ID NO: 19185 - DNA, 165 bp, Glycine max
  Peptide Sequence Number=SeqID_135963
atgggggtctttcctttgataataggagaaatcccttattctaaggaggtggatgcaggattggcttcggtttgtccacaggtactggagtacaacaatggatccctgggtaaccatccaccaactattggatgcccctttggtgatctgagactaccagattag

SEQ ID NO: 19186 - DNA, 549 bp, Glycine max
  Peptide Sequence Number=SeqID_135964
atggaaaatgcaaaggagaagataaaatgcaactttaataacatcaagaaagaggtgagatcatcagcttcaaggcctttgcatgcaactgaatattatcttaatcctcatttgcattatgaacctactttcagacatgatgagttgatgaccctcagagggattttctctatggaagaggcaaaggacactagaaaagttatgcaacctggagaatggtgggagatgtttggtgatggaactccagagttgaagagatttgctattcatattgagtctgacgatgaatggataattgaagagggatataatgatgaggatgagcaacctcaaggtgaaagtgatggtggcaatgttgaattagtgggagatgttggaggaagttcaaatgatctagttgtagacattttcgatctagataatttaattttggtggaacctaatgatgatgcacaatctgaggaagaccttgatgatgatggagatggtgatgaaagtgatgatattcatggagatgatcctattagagaattgagcaaagttctttaa

SEQ ID NO: 19187 - DNA, 530 bp, Glycine max
  Peptide Sequence Number=SeqID_135965
ggtggccctcttggctctctaaggttgctggtgagactatcaatggattaacccctcggagggccgacacttttgagaagattgataaggctgtgagtgaattgtgccacaacatagaaggaaacatcaatgttggctcatttagcaggttgatatatgacatgatgcttgcgtgggagagacctagctactacgatgaagaagataccacggagaatgtagcaaaggagaaagaagaaaggaagataactttgaataccactcaggaacaggatgatatccctcttttttattcacatgtgagtgtgagtatgagtacggtgactgatgctttggagatgatggtcagcatgacgcacagaggtgcttgtggttgcggctgtgaagccaacactggagatggagcaaggatcatggtgcctctacctcaccagttttacaaggaggatgtctatccaagatgggctgcaaactctcactacaccttggtaccaattccggagggacaacaacttgatggttcaagatga

SEQ ID NO: 19188 - DNA, 1071 bp, Glycine max
  Peptide Sequence Number=SeqID_135966
atgttaagccagagggggggtcctattaatgaaattgggccagagattgaagtagatgcattgcctctaaattacagtgtagaaaaagtggttgaggttgttcctgaggactctactgagaatggtattgaagatatggatgttgatggtgctaatggtgtgggtaaaggtcgttcagatgctgaagctgaagttgttggagttgaaactataccaaataacctggtgtacaagatgcaaaaactggaagttgttgaagttgaaacccaagttaacaatggtgcaaatgatgatgaagttaaagaacatgatgaggatgctaacttttctgatcattctgaaagtgacccagactatgcatatgtgtctccagaagatgatggacaatcaagtgacacaagtaatgatagttaccactctaaagaatttcagtctcttcccaacagtgatgctgaaggggacaccaattctaaaattgtgtatcctcaatactatcctagaagttgctttggacaagtgcatttggaggttggaatggagtttgatactatcaaaatgtttattgaagtcgtaagagactataccatttttcttggcagggatctgaaatggcacatgtgtggaagggtcttcaaaaataagcaagctacaatgaaatgggtgacaaaaagggtggctgataagcttagggttcatccaaacctaaatcatgtagcggcacatgaacatgttagagaatattatggtgtgcacattgatgaaataaagatgtttagggctatcaaagaggctcagtcactggttgaggggaagagtggtcttgatggttgttttctgaaaaggtactacggcggtcatttacttgcagcagtgggacaatatgaaaacaatgcattttttgtgattgcatatgcaatagtaaatgttgaagataaagacaattggaagtggttcctcacattgttacatgaagacattggagactacgaacaatatggctggaatttcatgtcagacatccaaaaggtgcaattcaattgtcttgctttgagtaattttgacgcaaagtag

SEQ ID NO: 19189 - DNA, 339 bp, Glycine max
  Peptide Sequence Number=SeqID_135967
atgacactgctctctcttggatttttgaattctccaagcagacgttggaagtcttccctggtggcacccactttagcggttattcccttcacctccaaaatgaggcattgtgcgatatctttccatgcaaagcggtctcttgattggtttttagagaaggattctagaagaattgcacatttgtctctaagatcgttaatggtagttttgatcctcggggttggaagatcaacctcttccacccagttgggaattggttttggagctgactctagagctgctcaaatcaagcggaagcatagtcaaagggggaatgaagtaaaatcaaaagaaggttga

SEQ ID NO: 19190 - DNA, 708 bp, Glycine max
  Peptide Sequence Number=SeqID_135968
atgaaactgattgatgcatcactgcggcagcaaaagaaactgcagaatatgtctcttcatgttccctaccaaatggctgataaagtgacagtgtcacatttggaaactagtagatgtttgtttcctgaattttctggacaagactctggatcatttgaggccttgaagcttgaggaggagcctgcagcagtacccaaggaaaaaaaaggtcgtggtcctccaccaacgtggtatgttactagaagtgaactagattccttgtcatcatacatgagaggcaggcttacactagagaaggtgaatgcagcgatcaatgatatggtgtcttatgctgaagcaaatgctcaacttatagttgcccccaaaaagaagttggcagaaaatctttgggaaaaagccctggaaataagagatattgcaaccatggaagggattaagggaaaacactttttccttgaagctgacataaaaggaccatcgcttaaacttgacaacactggaaaagcaatactgactatcctaacaatatcagagctacatttacttgagtttttcctggctttatcaaagatcactgttatggtttctgatcaaccaaactcggttgctaaagtggtgacttttgacaaggttcttcgtcaccttggccgaatcaatgagacccgtgtcggacataatcgggtcattattctacaaaagcctcactaa

SEQ ID NO: 19191 - DNA, 321 bp, Glycine max
  Peptide Sequence Number=SeqID_135969
atggctgaaataggttcatttgcatccgaatcatactcttctgaaaataagttgaaggtagccccactttactccaatgctaatttctctcagctagaagtggtagaccattatgatgttcatccatattcagcttctgatgatgacatacccactattgattactctctactcttctgtgatgaccctaataagcaattccatgcccttgaatgcctccgtgatgcatgccaggaatatggcttcttctatgtaaatctcttagctcttgtgtcctactatttacaccgtgtcatgaatggcttcttttttcttttctaa

SEQ ID NO: 19192 - DNA, 510 bp, Glycine max
  Peptide Sequence Number=SeqID_135970
atgcacgcagtcgccgtcagacgactacacgtcctcgtctttagagggctgctcgccctccccttcaaaggactacacatcctcgccatcagagggctacacgccctcaccttaagaggactacacgtcgtcgccatcagagggtcgcgtaccctcaccttcagaggcctacacgttctcgccttcagaggactacatgtcctcgccttcagaggactacacgtcctcgccttcaaagggccacatagggctacacgtcctcgccatcagagggctacacgccctcaccttgagaggactacacgtcctcaccttcagaagactacacgtcctcaccatcagaggactatacatactcgccttcagaggacttcacgtcctcatcttcagaggactacacgtcctccacttcagagggctacacgtcctctccttcagaggactacatgtcctcaccttcagaggactacatgtactcgccttcagagggccacacgccgtcgcctttag

SEQ ID NO: 19193 - DNA, 1290 bp, Glycine max
  Peptide Sequence Number=SeqID_135971
atgatggaagacaacattttcaacatcctttacctccttctttttcttattattttaaaactattattcttcagaaaaagagataaaaacccaccaccaagtccaccgtctcttccggtgatcggcaacctccaccagctgaaacagccacttcaccgcatcttgcacgccccctcacacaaatacggccctattttctctctccggttcggctcccaaccagtgctcgtcgtttcatctgcgtccgccgccgaagaatgtttcaccacaaacgacatcgtattcgcgaatcgtttcccctccatcaagaccaagtaccttggctacaacaacaccattcttttggtagcatcctaccgcgaccagtggcgcaacctgcgacgtatcagctcacccgagatcctctccactcaccgcctcaactcctttttggaaatccgaaacgacgagaccctcaacctgctccgaaatctggcaagggcttctaataaagtggaattcaggtccatattccaggatctgacgtttaacattatcatgagaatggtgtgcggtaaacgctattatggcgaggaaaacgatgtgaccatcgctgaggaggctaacaagtttagagacatcatgaacgaggtggcgcagttcggactcattgacgagcatcggaataagaacgaagaaaattcaaatactaacatgatagaccatttgctttctttacaagactcacagcctgagtattacactgacgaaattatcaaaggccttattatggttttgattgtggcgggaatggagacttctgctatagcgttagagtgggcgatgtcaaatttgttgaataatccagaagtgttggagaaagcaaggattgaattggacacacaaattgggcaagagcgtttgatagaggaagctgatgttaccaaattacaataccttcataatataatctctgaaactttgcgattgcatccaccagcgccgttgctgttgccccatttctcatttgaagattgcacggtgggaggttatgaagtgtcacataacacgatgttatttgtgaatgcatggactattcatagagacccagagttgtggattgagccaacgagttttaagcacgagaggtttgagaatggtccagttgacacccacaagctaataccttttgggttggggatcgaggagggcgtgtccgggtggaggcatggctcaaagaactttggggttcactttaggttcatagattcaatgcttcgagtggaaaaggattggcgaggaacaagttga

SEQ ID NO: 19194 - DNA, 318 bp, Glycine max
  Peptide Sequence Number=SeqID_135972
atggggtgcctcctcacaaagggggtcgcagtgaccaggcctgggcgactgtttataaaaaacataggtctctgcaaagtcatacatgatcttggaaagaagatttggacatcaaagggagaagaaaaagaagctgccaagaaggagttcatagaggcccttaaattgttggaggaacagctaggagataggacttattttggaggagacaatattggcactcattatttatttagcaagcatcagcttatttttgcaaaccctccttctgtcaatactcaatacgaatttaacaaattaatcgtaatcctcttgtag

SEQ ID NO: 19195 - DNA, 261 bp, Glycine max
  Peptide Sequence Number=SeqID_135973
atgggttttgccaagactttcagtcacattacagacaatttttattgggctggtatgcgtcaagatgtgaagtgctttatctatgagtgtcccacttatcaagtcaccaaggggcaccatgattttggtggtggtggaccgcttctccaaagggacacatttcaccatgttttcgacaagcttcacagctcatcgagttactcaggtgttcctagactatgtttgcaagctccgcggcattccttaaagccttatttctaa

SEQ ID NO: 19196 - DNA, 297 bp, Glycine max
  Peptide Sequence Number=SeqID_135974
atgacccatcaccaagtcaagtgccttcttcacacaaatcgagcctatgcgttcttccacctacagctcattccctctaagccacacccacctaacccactcgttgaaaccctcacacaaacctcagccatacaacaacttctcacccaatcttccttactttttactgaacctaagacccttcctccaccccgcacacggaccactctatttatcttttcctcaacgccaaacccgccaatgtttgtccttaccgctacccctactttcaaaagcaaaagattgaatggaaaatag

SEQ ID NO: 19197 - DNA, 576 bp, Glycine max
  Peptide Sequence Number=SeqID_135975
atggagcaacatgtacatcatgtgccagagccaccatccagccgacaacaccgttcccaaaccattgctcgcctaaaggatgttgtcctccaactcaccaatactcagagctccctccattcaaaaattgatgaccctatccaacgtatctcctcccttggaggacacacctttgaccatgaatccaccctcactcctaccccgcaccgaaatctacgtcacatgaagctcgatgttccatattttgacaatttcaatgttgtgtcgtggattttcaagatatcctatttttttattatcatgacacccgtgatgaggagagcattcaaatcacctccttctacatggattgtttggtactcaactggtttcgatgggtgtttcgcaatggccaaatttcctcttgacccgaatttgtttttgcgttggagatgtgtttcaccgtcctattacaacgacccgaagggtgccctcttcaagctcattcaatacaaatttgtcaaccagtacctctcctctttggagagctcgatgaattggatagtgggactccctccacatttttttctaagctag

SEQ ID NO: 19198 - DNA, 810 bp, Glycine max
  Peptide Sequence Number=SeqID_135976
atgcagttggtaaaccataccatccctgatggagtatttgataatatattaaaaggagtttctgatttctttaatcaaacaaccttggatgagagaaggaactacagcaaaaaatttccattggataaaattcgatgggaactaaactcctccgctggggaaaacagggaatatctaaaggttgttgctcatccccaatatcattttccttccaacccttcaggtttcagcaaaattttagaagaatatggcaaagaaatgagaaagatagtaattggattagcaagggcagtgtctaagaccttagggtttgaagaacacttcgtggagaaggcattgaacttgaaatcagggtttgacgtgttggccatgaacctttatccacccaatgccaaatccaagggagccgttggcctgtctgaacacactgaccctggcttcgtcattacacttttgcaagatataaatggtggtcttcaaattctttcccacaaagggaagtggatcaatgcttatattccccatcatgccatactcatccagcttggtgatcaacttgagatcttaaccaatgggatgtacaagagtcatatccatcgagttattgttggcaacaataaggtgcgaaggatctctgtagtgggcattcacggaccttcgttggacaaattaatcagccctagcatagagtttgttgatgaaaaacacccacagggataccgtgggatgacctacaaagaatccttggaagtaaacggggatgacgagatcgatgtgcaatcatcacttgagcaagctagattagtgtga

SEQ ID NO: 19199 - DNA, 183 bp, Glycine max
  Peptide Sequence Number=SeqID_135977
atgcatgcatatgcattttgtcatcctgtgagtcggaggataagcgaagatttggccgataccacaccgaattccagacaaaggtcagtggtggtgtggtttcatattttactgcgtgctgccatctcttttattcagaaacttaggggcaagtacgagcaggttatgtttaaatatgcttag

SEQ ID NO: 19200 - DNA, 396 bp, Glycine max
  Peptide Sequence Number=SeqID_135978
atggacttcagccagaccgtagtagggagatgggtgcggatcatgcgcaccagcacgaccaccctcacgcaaatctggatgacattgctacttagcaacatcttgcccaacgaccacaactctgacctccctctgccgaagtgtcatctggtttacgccatcctaacacaggtgagtgtacacatagctcagctgatctctgacgctatttacctgtttgtagggatctcgcctatgagacacccagtggacccgaagaagtccaatagggccctagggtttcccgctctgattacaggcctctgtcagttctatggagtgtctgtcacccccgacaagctcatccggccacctattaatagggccttcatcaaaaagtactgtacacctaagtag

SEQ ID NO: 19201 - DNA, 445 bp, Glycine max
  Peptide Sequence Number=SeqID_135979
atggcacgcagggacaaatatggtcatctactccctttgtcgaagactcaatgtctgtcgaatgaggctactgaagtctcctttgctatcccgagacaatcgagtctggtggcatgcgaagaccgtcacggtcatccatttttttcctttatcgcttccaaagcaccaaggcttttgctgaaaggtttcgttgattgggctagtgaaggaaatgggcaagaaactcaggataggggcaaaatggtccattttggaacattcctcagccgcttggtccacctgggcccactagatgacttaggagggaagcaaccaactcgcctgggcgagcaagttgcttttggagcgtgggaggctaaggagaaagggttcagcacccttggcaagcatatttcactaaaaattagtgagaaaaaggagaaagaacaagaaaatcaaggccgag

SEQ ID NO: 19202 - DNA, 591 bp, Glycine max
  Peptide Sequence Number=SeqID_135980
atgggaagtttaaagtggacctcttcaataagatctaaggggacctatcgtggattagaatcagagccactagaaggaaaggtgtcttcttccgtggatgagtcatcttctccaagagtgcaggagtcatctggggatgtttcagtacctacgagacaaccaggcattttaacaaacacctggtgtgctggaactctggttgatgcaaaaagtgacccagactttttatcgaacacctggggtgcggtattttcctgtgaagccagacaagcagatgtagtgtcttggcctccaccaatgccaccagacaaaccagtgcctagcaaggtttgcaggttagcatctgctaggaatagacagaaaatccaaggcctcaagaagaatggaaggagcatagaagaagaatcactgcctaggtgcaggctacagcaggatcgtcctggtcagatcaagaacgacgagaataattcctggtcaacaatcgtggctggagataaggattatgagaacaaccaatgtcacgtgaagcttggacttgctctccaacggtggcaaggccattgggagatgcccaaggagggggagaggtga

SEQ ID NO: 19203 - DNA, 390 bp, Glycine max
  Peptide Sequence Number=SeqID_135981
atggtttttctatttccttttctcctggtaccagctgagaaaattataactaggcatatacgaagatgttgtgtatgtctgggggaatttgagctgaaggaagagttggtacagataccttattgcaagcacgtgttccacttggaatgcatacatcattggctgcaatcaaacagcacttgtccactttgtagatgttccatcatccccactaccaagttcctcaacccagcaccgcctattaacattatatcaacagacccaccccagcagcatggtgctatcatttcggacttcccattacaaattctatcattgccacctcagtcacaagaccatcaagaagttgttggtgcttcctcaaatgctgctaatttgtcaagggaatga

SEQ ID NO: 19204 - DNA, 978 bp, Glycine max
  Peptide Sequence Number=SeqID_135982
atggacaacactttccttgttcaagagctacttcgcaaatatgctcgcaagagaatttctcctagatgcctcttgaagattgatttacataaggcatacgattccatttcttggaagttcttggattggatgcttaagtctatgggtttcccagctcagttttgttcctggattatggaatgtatcactatcacttcgtttagtgtggtggtcaatggatccatctatggtcatttcaaaggtcaacatggattaaggcaaggggatcctctttccccttacctctttgttctctatctggaatatttttcccgggatcttcaaagcctcaaggataacatcaactttcagtttcacccaacttgtgttgttgttcaactttcacacttggccttcgcagatgacattacgctcttgttcagaggagacttgccttctgtttcagcaatatttgctaagctccaacacttttgtaatgtttcagggctatctatcagcaccaacaagtcagccatttactcagcgggagtggtccaagatgttctttcagatatccagcaactcactagatttagtttaggctgcttcccttttagatacttgggaggcaatgtttgggacttcattagttcaacttcagatttagttttgattaagaagatcatacacaccggggacattattaccatcaaagaaggcaatgtggaggttgccaagcaaactctcaactcttggagtagcaatgagcagttgcttgttgggaaggcttatgactacatcagaggggccaagccaactgtcaattggaattctaatgtttggaatcctgccattcctcccaagatgtcttttatcttatggcttgctatcaagaattgtctactcactttagaccgagctgctttcttgaacaagggtttactctgtcctttgtgcagaactgaagcagaatcccatgctcatttgttcttttcttga

SEQ ID NO: 19205 - DNA, 141 bp, Glycine max
  Peptide Sequence Number=SeqID_135983
atgagttccaaagatggtgtaaattttcacgataatccaacagttagcaagtccggaaaagagaaaactcagtgcaaaggacatttctttaaacacagacattatctcaagaatcccaatggtggttgtgtgcggatatag

SEQ ID NO: 19206 - DNA, 432 bp, Glycine max
  Peptide Sequence Number=SeqID_135984
atggctatggggacttcaaaagcccaaatctctttggcggttctacaatcattaacactaatcagcaagtttgattttgtcaccatgagcttggatccgttgtcgctgaacttcgcaggtggtgagtggttatttgatgccattggaagcggaacgacggagaaattgaaaagccacaaagagaatctaatagcaaacctggttcgagagacatggtggcgcggtggcggtgatcaacaagagagtggcaacatcggagaagcaaaagttcgagagaacgagagggtttcaaacgaggcgaggctcaagggggcgtcttccaaaggaggaaaatgcacggagtcgccaccaacgaaggtcgacaaaagcggggctcttgctcctacgtaccctccatcgaagaggaaatcagacctacgtagttctttttaa

SEQ ID NO: 19207 - DNA, 252 bp, Glycine max
  Peptide Sequence Number=SeqID_135985
catcctttggcaatggcgtgtcttggactacttatgctctcatcccttttgatccattcattgcaataccaaacgggattgggacaacattttctgtggcacaactaattctgtatgcaacctattacaagtctacgaagaagcaaatagcagcagcaaggaatgcaaaagaggtgaatctctcagaggtggtagttggtaacagtactgtccaagatcccaacaataacaagatcagtgctgctccctatg

SEQ ID NO: 19208 - DNA, 1498 bp, Glycine max
  Peptide Sequence Number=SeqID_135986
ggagcaacaactactggggttaaggcctgccactcctccggagaggcctaaaacgccaccttatgcccctccaagagctccttctcctaggcctccctctccaagggttccttctccaaggcctccatccccaagggctgcttctccaagggcggcttctccgcgagttacctctcccaaagccacgtcttcccggattgctcatcaccacaaggaggttggccacagaccagaaccaactttgaggcaacagcaagcctcagctactaagatccagtctgtttacagaggttatatggccaggaggagttttagagctctaaagggtctggtgaggcttcaaggagtggtaaaaggacagaatgtgaagaggcagacagtgaatgccatgaaacacatgcagctgttagtgcgagttcaatgtcagattcagtctcgaaggatccagatgttggaaaaccaggcacgatatcaagctgatttcaagaatgataaggatgcagccagtatcttgggcaaactcactgagtgtacaatcacaaatcacatcttttcagcaatagatggtcatgctttccttgtggcatctatcttattagatgtgaagttagtaacttactatgatttcagtcacggaaatgaagagtgggatgatagcttactgaccaaagaggaagtagaggcaagattgcagaggaaggtggaagcaatcatcaaaagagaaagagcaatggcatttgcatattcacatcagctatggaaagccactccaaaatcaactcacaccccagtgacggatacacgatcaggtggattcccttggtggtggaactggttggaaagacaaacaccagcagcaactccacaagaaagacaaagcttgaagaattttcaaatcacacctccaagaccatactcagagcaaaagactagtccaagacctggctccagcactcaaaggcagccgcagcagcagcagcctcattttgcctttgataacatggacactcccacaccaaagtccacaaaatcaaccatagtgacatcttcaaaaccggcgcgaacgcctccatttagaactcctcaggcaaacggctcaggctcaggctctagatatccgagaccaaggggtgtggggtccaattcaccctttgatgtgccattgaaggatgatgacagcctcacaagctgcccaccattttcagtgcctaactacatggctccaaccctttccgccagggccaaagtacgtgctagtagtaatccaagagaaaggcttggtggaactccaactagtactgattcaaagaggagactctcattccctttgtcacaaggaattgggtctttcaagtggtctaaagggttctcaaacaaggatcaaagaatcccagataaatttcagtcacttgaatctataggaaacgtgagtgtggattcaacggtgtctttgcccgcaagggtggtgggaagaaagccttttacaagatttgtgtga

SEQ ID NO: 19209 - DNA, 201 bp, Glycine max
  Peptide Sequence Number=SeqID_135987
atggccaaatttggaacgtctttatcaataggcatgttggctacagtcggggatggggatggtgtggatgtaggtaccaggggcggttcatgtgcatcaatcagggatggggatggtgtggatgtagtcgaaggtggagatgttgtagttgcaacattagaagatctgactggcatagatacaatagacagggtagggtag

SEQ ID NO: 19210 - DNA, 306 bp, Glycine max
  Peptide Sequence Number=SeqID_135988
atgacggcgccatggcggtatggcttcacgggtttttggaaaaacaccaccaataacgatggcgttgcagggatgagcagcgcgagcaagaacaacaacacacaaactccagcgcgaccaacagcaccacgcgaacgcgacgcggcaccccataccagcaccatgacggcgacaacggcgaactccagcgcgactacaatctgcgatggcaacgtgggaggaataaccagacccaaagaacacctgattgggaagtcaagtagcgttgcatcttgcatgaaaactccaccaaatgtagtcgaatag

SEQ ID NO: 19211 - DNA, 195 bp, Glycine max
  Peptide Sequence Number=SeqID_135989
atggagcacttcacaacgtatctttacataccaagaactacaagatctttcctttcattctggggtgacagcgaggctcaaatgttgttggtctgtgaagacatgttgttaggtgccccatcaatagaacaggaagtggagggaagaaaagcttatgatgaggatctatttgagtcgatcatttccaagatttag

SEQ ID NO: 19212 - DNA, 429 bp, Glycine max
  Peptide Sequence Number=SeqID_135990
atgtccttgtcatctgaggttgagcctggtagttaccaagaagctcttcagcatcaatggtggagagatgagatgaaagccaagatagaagctctagaattgaatcaaacttgggacattgtggacactcctccaagtgctcgacctattggttgtaagtgggtgtacaagatcaaacaacactcagatggaagtgtggaacgatacaaggcacaacttgttgccaagaagaggtctacatggttcttcctcttggctttcattctcggccatcccaatgttgtaaactcctcaagtccctttatggtctacttactcacttattcaagattgttgggatcaaaaccagtttccacacctatggacaacaccgttcatcttcgagaagaatctggtgatttattggctgaccctttaccctatagatag

SEQ ID NO: 19213 - DNA, 610 bp, Glycine max
  Peptide Sequence Number=SeqID_135991
ctacatctatcttcctgacagatacatatgtccctgtgaatctacttggagaatctttgggtttccaatacatggcagaaaacccgttgttgaaagattacacttccatcttccaggccaacatagtgttctctatgaagaccatgatgatattgatgatgtattgtctaagccaagtatctctgattcaaagtttatttcatggatgaacaccaaccaaaattctgttgaaggaaaaaatcttacttatgcagaatttgtttctaagtttgtatacaatcagaagaaaagatgttggcaccttaggaagaaaggctacaccattggcagattactatgggtcccaccaattacaggggaattattttatttgagaatgatgcttactgtttataaaggacctaccttatttgaggatttaagaacaattgataatgttcagtatcctacatataaagaagcatgttttgctatgggatttttgcaagatgataaagaattcattgaggcaataaaagaagcaaaatactggggttcagcatattatataagaaagctatttgtgttgttacttttaattgcaacaatgagcaaacctgaacaagtttga

SEQ ID NO: 19214 - DNA, 2238 bp, Glycine max
  Peptide Sequence Number=SeqID_135992
atggcgaaacgggggcgagggcagccaccgaatacggtgcctccgccaccggtgaatcatcctcaaccggcaactaatctggtagtggagactgagaatcacgagttacagaagcacgaagaaactattgaggaatttgaagcaacaacgaagagtcctgaaaccctaattgaagaaccgaaggaggtcactgatcgaaaactgtgggtagatgttctaaacaacaatcgtaatccgtccaacggcgtaacaatggagtttgtagcacccaaactgatcaatggtgaagtggaagtggaaattgaagcggaggacattgcgtcagaacttcaattttgggaaaacgcgatgatactgtatgtgctgggaggtattttgagcatgactatgttgaagaactacatggtgaagatgtggaatttcgttattcttccagatatgttgtatcacgatgacggttacttccttctccgtttcatgaatcgcgaagacagggaaactgtgatgatgagaggaccctacaccatccgcaacatgccaatcatactgaaggaatggacgccagatttcaatctaagcaaagacctggagaaaactatgccgatttgggtaaagttaccacaattgcctctatgcctttggggattgaaaagcttgaacaagataggcagcgcaataggcaatcctttgatcactgatgaatgcacagctcagaaacttagagtttcttatgttcgcatattggttgaggttgatattacccaaaaattggtagaggaaatcaccatatctgacagaactggaggaaagataaagcagattgtggaatacgagtggaagccagaattttgtgagaaatgtcaaaaggctggtcatcaatgtggaaagaagaaagttgtcaagaaatggatacctaggaacaagcaagcagatgaggtaaaggcagatccccttccaaagacacctgtgcagaatactgaaactgaaggagaggacaaaccagaaggttggattacagtgggcaaagctgcaagacatacatgcaaagctatagaggtaattggtacatctaatgttgattgttctaatggtttcaaggctctagaagttttgaatgactctctaggaggcctagggatgctaaaggagattagctcccgtctcctaaagcttaggcctaccattgctattttgattgaaactagagtgaaaaataagaatgctaagaaaataagagataagcttaaactacctcacaactacctggacaattacaagtggcatgataatgggaggttatggattgaatgggataatagtaaaattgatgtgaggcatgttaagtgttctagccaatatgtgcacgtgggtgtgtataacttgcagggggagttcaaattctggcttactgcagtgtatgccttaaatcagttggatagaaggaaagttctgtggaaagatttggaggctatccataaacatcaacagggtccttggtgtgtgattggtgacttcaacaatgttactaaggctcaagatagaattggaggaaaagctgtgacagaaagtgagtacattgatttgctgaacatgatggagactacatgcttggctgagatggataccacaggtgagttttatacctggactaacaagcaggtgataggaaccatctactctagaattgatagggttctgggtaacttgaactggtttcaagacaacttggatactgtgttgacagtgctgccaaccagtgtttcggaccatgccctgctctgtgttagtagaaaagatcccattatcaagaacaataaaaacttcagattcagtaattgtctaattgagatggaagggtataatgatatggtgaaagccagttggagcagacctactagaggtagccctatggtgagactgtggaacaagcttaagagactgcagcaggatatgagaaggtttagcaaacccctgagtaatctaaagcagaatctgatcaaagccagagaagatcttcaatttgctcaggaaaaccttagaaacaataacatgaatggagatagaattgatagagtgaggcagctgacagaagaggttattaatcttaatgaattggaggaaaagatgcttatgcagagagcaaaagtggattggataaggaaaggtgatgggaataactcctttttccatgatattataaaaagcagaaataatagaagaagtatatacatgctgtag

SEQ ID NO: 19215 - DNA, 1353 bp, Glycine max
  Peptide Sequence Number=SeqID_135993
atgggtcactttgagaaacccatcattaaggtggagcctttggatgaaccaattaactctacaaaagttgttgaggacactgaagtcgacatcatgagttggacaaacaagggtgattttggtccgaacaaagttgaggaccctgatgcaacagactattcaagctcgtttgctgacactacctctgatgctgaaaatggttatagattgagtgatgctgaagtggagtcagaattcttgggtgataatggcttggcaaacacttctgatggttctgcatttcctatgaggaagaggaagttgaccaatcgttggaggaactttatacgacctctaatgtggcgttgcaaatggacagaactaagaattagggaaattgactcacaagcattgaaatatagtaaagagcttgcagaatatgacaagggaaaacatacagcacctgatgaatttactttagaagagtttggttcaaagtcattgccatttttgggtgaacagctcagaagtaaggccaaaaagagaagaagaaggaagaaagttgaagacacaactgatattggatcgtatacatcacagaataagaagtctgatcctgatggctatttggctgatgattttggcaatccagtgatcacagagccgcatgttgattcaacagacagatttgacattggagaagatcaacctttgttggatttcaatgaaatcgatgcttccttccagaagatgctttggacaatagacaatatacatgctagggtccacaagctgaagactgatgttgatggaatcctgtccaaaaatgcttcaaagttttcttcatcagaaaatttgagctttcttctaaatcacggtgatgtgcagcagactagctctgctcaaagtcctacaatctctgcagggaatggagatacagtatctgttggggttatttataattcaactcaggatggagccgactttgatataggagattttgttatgcatgatagtgctatttcaagttatggagaaggtcctatgattcctgatataattgagagcactgttggcttattgtctgctgttgatgtcaccctccattcggccttggttgttgacccgtgtgaagatgtgagctggtctcttggagcacctcctgggtctgctattggtatcattacccactgctggaaaatcaaccttgtcctcaaggttgtagatgattgggacttcagtaggttcatgaagaaattgagaccatattttccactctggaaaacagctatcaatggcaaaatagctaatccatgttgcaaacccctcattcagccacaaacgtgtccattgtatgcagcttccagcaactag

SEQ ID NO: 19216 - DNA, 1563 bp, Glycine max
  Peptide Sequence Number=SeqID_135994
atgacggaggtggcgagatcagtggtgcacgacgttttggggcaaagggtggtcgacgtggaccagccaatcgtcgattacatcgtaaacgtcctcgccgacgatgacttcgatttcggcctcgacggccaaggcgccttcgaagccctcggcgagctcctcgtcgccgccggctgcgtcgacgatttctcccactgccgctccgtcagtcccaatcccaatccctcattcatttccttcaaagtgtgcagcacgctgtgcgacaagttcgggaagcacggtttggtgaaggagaagcccgctgttcgaagccttgcggcgccgtttcgaatgaacgaggggatggacgacgtgcaagctcccaagaagaagcccgagcccgtcgacggccctcttctctcggaacgcgaccggttaaagctggagaggcgaaaacgcaaggatgaacgccagcgagaggcacaataccaaatgcacttggcggagatggaggcggcgcgagcggggatgccggtggtgtgtgtgagacatgataacagcgggggaccaaacgtgaaggacattcatatggagaatttcaacatctctgttggtgggcgtgatctcattgtggatggttgtgtcacgctttcatttggaaggcattatggtttggtgggaagaaatgggacggggaaaaccactttccttaggcacatggctatgcatgccattgatggtgttccgaggaattgtcagatactgcatgtggagcaagaggtgacaggtgatgctacgactgctttgcagtgtgtcctcaactctgacattgagaggactcagcttctagatgaagaagctcagttagttgcccaacagagggaattcgaggacaaaatcgaaaagggtgattcgaatggagtggtcggtagggatgacatttcaaaaaggcttgaggaaatatataagaggcttgaacacattgatgctgattcggccgaggcacgagcagcatcaatactagcacttattcttatgctcatgtgtctttcactttgccttatttgttgggtaattgattttccaaaaggagaacctgtgatgggtttgagtttcactcctgagatgcagaagaaggcaacaaaaacattttctggaggatggcggatgcgaatagctcttgctcgtgcattgtttatagagcctgatatattgcttcttgatgagcctacgaatcatcttgatcttcatgctgtcttatggcttgaatcgtacttggttaaatggccaaaaacatttatcgttgtttctcatgctagagaatttttaaacacggtggttactgatataattcacttacaaaaccaaaagctgactacttataaagggaattatgatgcttttgagaagactcgagaagaacaagttaaaaaccagcaaaaagcattagaggcaaacgaacgtgctagatctcatatgcagaagcctaggatctgctgctcggttatactagtttactgggttgttaatttcaagcctcaagttttggatctatacaacaagagctacaccttatgccactaa

SEQ ID NO: 19217 - DNA, 378 bp, Glycine max
  Peptide Sequence Number=SeqID_135995
atggagctgcagaaacttagaaaaataacaggaatagtaaagaacaaaagggaaataatggtggacaatgtcttgatacatgaggtagctgaaacagatgagcacacctttaaaagtgcaagtcagtatcctgtggagaggcttcaggatgtggagagaggtgaaggggaagaagaaagtctgaatcctgttcctatccccatgtcagatattcatatggcaacaacaaaccctgcagtgtctcaagagcaatcaactctgaagtcctgtatgtatagagatgggaacattctcaagaacaaaagaaaacgcggggagcgcaaagcgtgttcaggcagctggaacaagaaatgctcgggggaatctgagaaccagtga

SEQ ID NO: 19218 - DNA, 488 bp, Glycine max
  Peptide Sequence Number=SeqID_135996
atgtatgtagtgaagggtatgaatcaagcagctgcagctgcaccatctcaggaactcgtgcatgacattcacttcatttcaagttgcaggaagccatggtaccaaagagcaattgaggtgactaacctatggaaaagtgtatcaaaatctacagaaattccaacacctaattcaactttatggaagagatcatcaatgccaaaatcccctcaagtacctactacaccaagtcctaacaacaagaacaggctaagaaaatgtgcctctctaaaggttgcatcatccttcacaagggtttgtctttgtgcaccaatctattcctacaatgagattttgagagctgaggtgccacctagaagaagcaatagttatccaagatcaaagccattgcaaaatgaacatgaaagaacaaatagtgctaggcttagcactgagggaaggagagtattcaggggcaaatcattgactgatgatgttctaatgaggag

SEQ ID NO: 19219 - DNA, 252 bp, Glycine max
  Peptide Sequence Number=SeqID_135997
atgaaacaaaaggggcttttttgcttgcctagaaaccagcgtgggatggtgttcaccagtttggagaatcatcatgcgctcatttctcccactgcaacggaagtcgtgaacaatgttgtattcaagatcgcgaccttgaagcgcgagaaggcaatgaagatggacgagattctgaagctgagaaaggagacggattcgttactatgtaaggcagtgctggaatcagagatgagcgcagttgagaaagcttga

SEQ ID NO: 19220 - DNA, 264 bp, Glycine max
  Peptide Sequence Number=SeqID_135998
atggcaaaaactgacgacaagatgagcaattttgatgtgggggatttaacttgcggtaactcaacaggttttggaactgtggatttttttattggtgaacgtcacaaaaaggttgacatgttagaatgcaaaatgggctacagtaacaatggtagggctgcaggctacagttacaatggtggtggtgctgaaggtgaaaatgcaacatgcacagtagaatgcccatcacttttggaaccctcccacactgtgtcgataatgtaa

SEQ ID NO: 19221 - DNA, 255 bp, Glycine max
  Peptide Sequence Number=SeqID_135999
atggattttcaacctccactggaacaacaagcatgcggccgacccttactagcatctagaatgcatgtctggactcttgaactcacacaagccctgcttggtgatcctgaaccactgaggcttccacctcttgcagcaatacattttccttcttgcgattttcatatgacaattttaagaaggtttggccctccattgcaatggcctatcctcctagttggcccttgttggatcaagtggcctcggaataattaa

SEQ ID NO: 19222 - DNA, 291 bp, Glycine max
  Peptide Sequence Number=SeqID_136000
atggtgtttgagtgcgaccagggcacgacggtggctggacaggagcgcgaggaaaggcaagggttattccaagatttttattcaaattctgctaccggtcttagaagactcttaggatggcttaagggttcaatgatcattttcaacaatattaagaacttattttctcggtgctgtcatcactttcgatatcaacggcaggatgatggaccttgcctatacattgtaaggatcgcccacaaacatgcaatgctcttgttgcagatagctcaggatggctctaaagtctaa

SEQ ID NO: 19223 - DNA, 546 bp, Glycine max
  Peptide Sequence Number=SeqID_136001
atggtaatgtattttactagctactacatgacacttgggaactggaaaggatcagagtggccgcaagttcgtatagcagtgttcagtcagcaccatgttgatggactcgacttatcctcaaatcctcttctgtatatgatgcgctgctatcctggagttccagaacagaagcttcgagctcacttaggttcttttggtgtaaccggaaatcttgcgctgcagccaatgtatactttgtcagaaataatgtatgttgggacacttggtgggtgttgtggtcagaaaagcagggttgcctttgcaaagataacttttaagaagccacacataatattgcttgatgagccatccaatcatctggatttggatgctgttgaggcgcttattcaaggtcttgtgctgttccaaggaggcattctcatggtgagtcacgatgagcacctcatctctggaagcgtggaggaactatgggttgtatccgaaggaagagtggcaccattccatggcacattccaagattataagaagatactccaatcatcctag

SEQ ID NO: 19224 - DNA, 1075 bp, Glycine max
  Peptide Sequence Number=SeqID_136002
ttccatggtccctggttcaagaaatccaatgtggggtgaggagttcaatttttctgttgatgaacttcctgtccagatcaatgtcacaatttatgattgggatataatttggaaaagtgctgttctaggttcagtgactgttccagttgaaagtgaaggtcaaactggtgcagtgtggcatactttggatagcccatctgggcaggggcccactgtagtccatcaaaagccagggcctcttcaaactatatttggtcttcatccagatgaggttgttgatcatagttattcttgtgcacttgagaggtcattcttgtaccatggtcgtatgtatgtctcagcatggcatatttgtttccattccaatgtcttctctaagcaaatgaaggtggttattccatttgaagatatagatgagatacgaaggagtcaacatgcatttattaatcctgctataacaattattcttcgcatgggtgccggtggacatggtgtccctcctttgggaagtcctgatggtagggtcagatatatgtttgcatcattttggaacaggaaccatgcattaagaaatctacagcgtgcagcaaagaatttccatgaaatgttggaagctgagaagaaggaaaatgcagagtcagagctgcgtgcacatagtagttctgtcagaggaaataagatactggacaaggctcctgaagaaagcatgccaaaaactggaagacttcaaccttttgtcaaagaagaggctttagttggtatatacaatgaagtttttccctgcacagctgagcagttttttaacttgttattgaatgatggttcaaattttactagcaaatatcgttcagtacgaaaggacactaatcttgtgatgggtcagtggcatacagcagatgaatacgatggacaagtccgagagataaccttcagatccctttgtaacagccccatgtgccctccggacacagccatgacagagtggcaacatcatgttctatcactagacaagaaaaacctggtgtttgagactgtgcaacaggcacatgatgttccatttggatcctactttgag

SEQ ID NO: 19225 - DNA, 591 bp, Glycine max
  Peptide Sequence Number=SeqID_136003
atggcccagaccaagaaatcaggtcaaatgacgtctgaggcaacaaaggaaattggtgacaagattgataccttggaggatcaggcctcacagggatgctttgttgcccgtggacgccaggatgtactgactgcggccattaggcaaccagaacaccctggtcgtgtttatgttgctggaatcggtgtcacaatcaaacaatactttggactggctccaaggacctccctcacgtcttcatccatggcttccgaagacttggagcagctaacgcaaaaaattagggaccagctggagaagttgatcacaaaaaagtgctcgacaatttatgttgtccttcagccagatgcagtcccactgaaggttggtccttcagctgctcgtgctagcacaaaggagagttatgttgatccctcaggcaacgacccagacacgggtgactgtgggaccagtgaaacctgtagaatgatgagaatcatgaaacaggccaaatacagtctaaaggcccaagtggagaaggacgaaggcccaagtggagaaggacaaagcccccgagtggagaaggatgaaggcccaagtggagaaggatga

SEQ ID NO: 19226 - DNA, 255 bp, Glycine max
  Peptide Sequence Number=SeqID_136004
atgaagaagaacacctatacggtggagaattccggtggcagcggcgacggtggcatcaaggcatggagtttcggtaaccaccagcttttggtgagaagggtgatgcaagtaaccatgtccattgcagggcttgctgtgttgtggatgtttctctctaactctgcctcttccattgaatttcataccttctcacattacttcagtgctcagtcaataaaggtaattttgtttaagagacagttaaacggatactaa

SEQ ID NO: 19227 - DNA, 267 bp, Glycine max
  Peptide Sequence Number=SeqID_136005
atgaataagaagaagcaacagtgtgggagattgaagcaaatctctttaagaaccaaaaaacaagcaggaacaagagaagcagcttggagagccatttcaagaagaagaaaaaaacttacctcgatatcgatagcgacaatggcagtgagactggccgcgagaacgacatcagagcccgaggcggagacgcaagagttggatgttgtgaaccgtgaatggaggagttgcgacagagaggatgacacgggcgacactagtctgcgatag

SEQ ID NO: 19228 - DNA, 522 bp, Glycine max
  Peptide Sequence Number=SeqID_136006
atgtggcttagagatcccttcaaacaattttacgaagatgcagatttccaaatagcttgtgatgctttcaatggcaattcctctgacataaacaactatccaaatggagggtttaaatatattaaatcgaataacagaactatttggcttaacaagttctggttcaactctagcaaagagtacccagggtttggtgagcaggctgtgttcaacaagattaaattgaaccctttaatttcccaaatgaagctgaagattaggttccttagcactagctattttggagggttttgtgagcctagcaaggacctcaacaaggtctcaacaatgcatgccaattgttgtgttggcatagacaacaaagtcaatgatcttaaaattttgcttgaggattggaagaagtatatggcattgcctgaaattgagaagaaacaatcaaatcttacttggagcgtaccacaaagttgcaggattttgaaatactcatacaataagagtcaatatttggagtttactaattga

SEQ ID NO: 19229 - DNA, 153 bp, Glycine max
  Peptide Sequence Number=SeqID_136007
atggaatggaaaaatgcacgaacagatgtcacagtgcaacagggaagggaacgagcgtcaatggtgttgcaacgaaggaggaaacgaggtgtgagtgagtggtgccggggagggatgaagaaacttgtatggatgcagaaaaaatcaccctag

SEQ ID NO: 19230 - DNA, 456 bp, Glycine max
  Peptide Sequence Number=SeqID_136008
atgaccctcccctatatatcttcgcatagtgaggatcctcaggcacggggcacgggggcaatgggagtgggttccgttcgccatccgccgtcgttgccgccattctctccggcgaaactagggttcgaatcgccctggaaagcgagacccaaccctgcaggtcgcgccgccatcggagccgtcacacgccgtcactattcctcgcgatttccggcgcgtgtagtccacgcgccgccatcctttcgtcggaagctcgcccaacttgtttcggcagcttcttcgttctcttctaagcttgtttcaggcgttggtttttggttttggcaagctcttgtgcctgcacgtgctttcttctatcctttgttctgttgggtttccgttgttgatcagaaatggcttcttctggaccagttttctccttttctggaaccccaacaatcacgactgcaaaactga

SEQ ID NO: 19231 - DNA, 1323 bp, Glycine max
  Peptide Sequence Number=SeqID_136009
atggcgagcaacagagagagagaagaatcgctgacattcacaatcccttcttcctcttcccattcttcccccatcaccgtctccgaccaactcgacagttacctcgccgaccccagaagcgcctccggaagcttccagaacgacggccttctctcctccggagacgcctccgccgccgatcccgacttcggtttctcccgccccgatttccggcagagccccctcgtcggcaccgtcgagttctaccgacgccacgtcttcctttgctacaagaacccccgcgtctggccaccgcgcatagaagccgccgagtttgatcgcttgccgaggttgctccatgccgccgttgtcgcaaggaagagtcacatgaaaaaggagactcggttaacgatatgtgagggtcatgatgggactgagacatctaatggggatgtgttgatctttcctgacatggttagatacaggagattaacacattttgatgttgaaacgtttgttgaggaggttcttgtgaaggatggggaatggcttcccggaacgcctgaggcattgagaggttcgtatgttttcgtgtgttcgcatggatcccgtgatcgcagatgtggggtttgtggacctgtcttggtcagtagattcagggaggaggtagagttgcatggtcttcaagggaaagtctttgtaagcccatgttcacacattggagcaagtcagtatgctggaaatgtcattgtatttggacctagcatgaatggagaagtcactggccactggtatggctatgttaccccggatgatgtaccttcattgcttcaacaccaaatcataaaaggggagattttagatccattatggaggggtcagatgggtttatcagtagatgaacagaagaaaaagcaagaacagcggcttctgttgaatgacttgagaaacttagaagacagaactctagggtgtagagctcaagacaattttgtgagctgctgccaatcaaacggagttagctgctgccaatcaaatggagttggctgctgccaatctaatggagactcttttttctgtcagaatcacgtgttattggaaagaagaatggaccctgatgtcattgaatcagaggcaaagctctcagctgatgataagagcagtgagactgtgatttctcggatcaataggatcaatagtggaaaaggagcttcgcgcaagtttccgtccatgacaacttggctcattggctgggagcaagaagatacttatgcagctcttgctgttttctgtgctgctgtgtcagttgtcgttgcctataactgctacaaacaattgagataa

SEQ ID NO: 19232 - DNA, 462 bp, Glycine max
  Peptide Sequence Number=SeqID_136010
cttttgacagctatatctacaatagatgacttgaactatccagaaaagacagacgcatattacatcgttaatgttccatatgtattctcagcgtgttggaaggttgtaaagcctcttttgcaagaaagaacaaggaggaaagttcacgtactgaaaggttgtggcatggaggaattactgaaggtaatggactatgcatccctccctcatttttgcagaaagaaggattcgagggtgccccgacatcatgtagctggaaatactgaaaattgtttctcctttgatcatgtcttccataaacaaatctataattacatcacgcagcaagctatattcatagagtccttattaccaatcagacaggattctttccatgtagacttgccagacccagacccagatgatgccaaaattgccaagactatagaaactgagttccacaaaattattattatagattaa

SEQ ID NO: 19233 - DNA, 171 bp, Glycine max
  Peptide Sequence Number=SeqID_136011
atggcaggttgtaaagcctcttttgcaagaaagaacaaggaggaaagttcacgtactgaaaggttgtggcatggaggaattactgaaggtaatggactatgcatccctccctcatttttgcagaaagaaggattcgagggtgccccgacatcatgtagctggaaatactga

SEQ ID NO: 19234 - DNA, 270 bp, Glycine max
  Peptide Sequence Number=SeqID_136012
atgcttccacctcttgcagcaatataccttccttcttgtggtttccatatgaccattttaaggaagctcgagcctccattacaatggcctgttgttccagttggtcctagctaccatgacaagtatgttggcgacccatggtaccggtttcttgctgaaggtgattttgttcatggagacgaacttttattctattacagaagtcatgaggatatttgggaaatggttattaggaaacagaggaattggggtgacaacgatgattggtga

SEQ ID NO: 19235 - DNA, 540 bp, Glycine max
  Peptide Sequence Number=SeqID_136013
atgacttcacattcatcattgactacaatcaagggcccatcaaacttcttagcagcaatacggttttcggctgcattccgtgtttccaagaacatcatcgaggttccattgtcttaccatagacaatggaggccatattacccgacactaaaagaatttagaaggactcacggcattgacgacaatgtcatcatgcggttttttgctgctgacaaaaatacttccttcgaggtggatgtcattggacctatccatcggcagagccgtccaaggtcggtccttccaccgacaactttcaattttttgtttggatcacaaaaagtaattcctgttcggagaggctatggcaaatgcaaccaatggcagatcaccatgcacgatggtgtcccatctgttgcccagccatggttccaacatctctctgagaataatttaatggctggagatgaggtaatattcttcttcagatttgacgaacatgtatgggaagttctatttagaaaagaagttgtatgggatgatgaggacctctccagttga

SEQ ID NO: 19236 - DNA, 396 bp, Glycine max
  Peptide Sequence Number=SeqID_136014
atgagggatccgaatctggagttgcaggaatcgggttgggaggagctgcgcaaggaagcgcgcaagatcgagggcgatctcgacgtcaagctctcctcctacgctaaactcggcgctcgcttcacccaaggaggttcaggttcaggttatgtggacagtggttcaccacctattgggtccagtaggtcttggaagtccatggaaatggaaatccagtctttgctcgagaaactgttggacataaatgattcaatgagtagatgtgctgcatctgctggaccggctacttctgtaactcaaaagttggctaggcacagagacattcttcatgagtttacccagtttaatgtttcaactttctatcagttcaaaaagaacggatctctagcagtatag

SEQ ID NO: 19237 - DNA, 1632 bp, Glycine max
  Peptide Sequence Number=SeqID_136015
atggaagaggagcaaaaactagttaaggagggcacaaatttggagggaagtgaaagtgagaccaaacttgagctcactgtggatgaagtggtggaagagtatgtggggtccttagggttctctcagatggtgcatgtgctcttggtgtcattggcatggatatttgatgctcagagtactttggccacaatctttagtgatgctcaacctcctgtttggagatgcaaaactggattgtgccaaggtaacaacaacaacaatagcactggttctgtctgtgggttggttcctgggacttgggaatgggttggtggcaacacaagttccatcatagctgagtggaatcttgtatgtgatagaaggtttctggctgctgttcctgcttctgtctacttccttggctctctcataggttctggtgtctatggccacctatctgattcattgctgggcagaaaaaaaacagtgcaactttcctgcatcttaacctccataacagcctttgccacatctctctccccaaacatttggatctatgctttcttccgttttgccaatggttttgccaggtcaggaattggcataagctgccttgtcctaaccacagaatcagtaggttgcaagtggcgtggccaagttggccaatacggtttctttttcttcacaatagggttcctcacactccctcttgtggcctatccgacaagaacatgttggagaaacttgtacaaactcttgtcacttcttccactagcatattctgtcctattactccctttggtctcagaatccccacgttggcttctaataagaggaagatccaaagaggcccttcaagttttggacaagtttgctagactcaatggaaagaaaaaactccccgataacctctctttggttaacccttgtggatcacaaaatggtgaaagtgatgaaacaagtcctaataacaacaaagagaacctttggaccacaaaatgggcagctattagaatggtcactgttatgttatctggctttggagttggctttgtttactatggagttcaactcaatgttgaaaacttgaacttcaacctctatgtctcagtggcaatcaatgcacttatggagattcctgctgtggtgattggtacctttctattgggatttactaataggcgtttgttgttatctatgtcctcttatatagctgcagtgtcctctatactatgcacatttttatcacacaaaggaagtacatcaaaagtgcataataacaatagtggtaactggggtcaattgattattgaagcaattggattcatgggtgcttccacagcatttgacattttgtacatatattgtgtggagctttttcctactaatgttaggaactttgctgtgtcaatgcttcgccaggccctaatgttgggggcttctgttgcacctttgcttgttgtgttgggccgtttgagcccatctatctcttttcttgtgtttggtgtcttggcaatttcaagtggtgttttgagcatttgcctacctgagactagaaatgctcctctctatgagaccctgaagcagcaagaggaggaggagaaacacaattgggtgtctcataatgattgtgcccttgagatgggaaaataa

SEQ ID NO: 19238 - DNA, 453 bp, Glycine max
  Peptide Sequence Number=SeqID_136016
atgaaggtcaaggcagggagaatccctcagattaaggatcaaaatgaagaagaaaaagagagtcagaaggctaattctcaaaaagctaatgaagatatccacccttctaagggtgtggaggttaaaaaagttcaaaatccaattgttcctaaatctatccaagatgatctcaatgtgaagaacatagttgatgttcttgccaaacttaggaccgttaactcaagtttggagcaagaaagctcaaagaaagaaaaaatgaaaaaggagtcatttgagaaaggaagagaagttgaagctactcctgatattggtgaactctctaccttttctattccatttcctcctctccccactgagtctatcaacatagaacctcccaaggtttctatggatatttccaacattcatattcctactcctccattttctactaaaccccttctaaaacagtag

SEQ ID NO: 19239 - DNA, 2325 bp, Glycine max
  Peptide Sequence Number=SeqID_136017
atgacgacgctgtcggatattggagttgctgctgccataaacatttccagtgcattgcttttctttgtggcatttgctattttgaggcttcaaccatggaacgatcgagtgtactttccaaaatggtatttgaagggtttaagaacagatccagttcatggaagaccgcttgtgagcaagttcatcaatttagactggagagcatatcttggctctttgaattggatgccagaagcacttagaatgccagaacctgagcttattgaccatgctggattggactctgctgtttacctgcggatttacttgatagggcttaaaatctttgttcctattgcgttcctggcttggattgttctggttcctgtcaattgcacaagtactggtctagaaggggcccagatgaaaaacataacctccagtgacattgataaactctcgatttcaaatgtccatagaggatctgaaaggttttggggacacatagtaatggcttatacatttaccttttggacttgctatgttttgctaaaggagtatgagaaggttgcaacaatgagacttggctttcttgcagcagaaaagcgtcgtcctgatcaatttacggtgcttgttagaaatattccacccgaccctgatgaatctgtgagtgagcttgttgagcacttctttctggtcaatcatccaggtcactatctgactcaccaggttgtttatgatgccaacaaacttgctaagttggttaaaaagaagaagaagttgaagaattggcttgtctactatcaaaataagcttgaaagaacttcaaaaagacctgaaataaagactggtttccttggtctttggggaaagaaagtggatgctattgatcatcacatcactgaaattgacaagttgtcaaaagaaattgttgaggagagggaaaatgtcacaaatgatcccaaggccatcatgcctgctgcatttgtttcatttaaaacaagatgggctgctgctgtttgtgcacaaactcagcaaaccagaaatccaacactttggctgactgaatgggctccagagccacgagatgtatattggcgaaacttgccaattccatatgtttccctcactgtcaggaggttaatcacagcagtggcattcttttttctcactttcttttttatgatccccattgcatttgttcaaactctggcaagtcttgatggaatccaaaaagcggcaccatggctgaagccacttgttgacatccctttcattaagtcattcattcaaggttttctgcccggtattgtgttgaagctattcctcatcttcttgccaacaatattgatgatcatgtctaaatttgaaggctatggatctatatcttctctggagagaagatcagcttctagatattatcttttcaattttgtgaatatattccttgggaacatacttactggaacagcatttcaacagctgagctctttcattcaccaaccagccaaccaatatcctgtaacaattggcactgctattcctttaaaagcaagtttcttcattacttatataatgattgatggatgggccagtatagctgcagaggttttgatgttgaagccgctaattgtttatcacttgaagaatttcttcttggtgaaaactgaaaaggacagggaagaggccatggatcccgggagtattggtttcaacactggagaacctcgtatacaattgtactttttgttgggtctagtatatgctgcagtgacacctgctgttcttcctttcataatagttttctttggcctggcctatcttgtgttccgtcatcagatcattaacgtttataatcaggagtatgagagtggtgcagcattctggcctgatgtccatttccgtatcgtgatggcacttctagtctcacagatagttctgatgggactcctcaccaccaagaaagctgcttcgtcaactccttttctcgttgtgctcccaatactaaccatatggttccataggtactgcaaaggccgttttgaatcagcatttgttaaatttcccttacaggaagcaatgatgaaagatacattagaacgaacaacagaacctaacctgaacttgaaaggttatcttcagaatgcctacgttcatccagtttttaaggacagcatggatgacgatgatgatgaggaagatatactcagtatggacttggaaactgaaagtgtgactgtgcgcacaaaacgccaatcgcgaaggaatacaccattgccaagcaaaaataatgatgcatcatctccttctctgtctgatggcattggaaatcatccagagccttaa

SEQ ID NO: 19240 - DNA, 396 bp, Glycine max
  Peptide Sequence Number=SeqID_136018
atggatagcaacataagcctttccaacaacacgcatagatgcaaggaaaaaggaaatgtctcaaccttcaacttaaagttgatccacacaacgaagttagcctacgaacttcactcatttcgcttctccgaccatagtcgtgacaaagaccacgatgcacggcagaggtcatacctatttgcaaagttgcaagataatacatatccaccaccatatggcttggaacatatctcttttggatacaacctctctagtgccactgcgaccactgtgctagcacaactcatcgccgtcattgggcttggcaattacgaggacattgagactaaatctggaactcgcagactagatcatgttgtcgagactagatccagaattcaccaggttgaaggttga

SEQ ID NO: 19241 - DNA, 249 bp, Glycine max
  Peptide Sequence Number=SeqID_136019
atgtgtattattaatcaggaagctatcaagcagttgcagtcccttatggaaaacttggatgagcaacagaagaacacattccagattatgcaccggggctatccaacagaaacattagtacggtttctcaaagcaagggatgggaatgttgtcaaagcacataaaatgaagcctataccccctgatttgtacagacgtttgcgagattctcaacttgtaggaatgtcgggtttctcaaaggaggtataa

SEQ ID NO: 19242 - DNA, 516 bp, Glycine max
  Peptide Sequence Number=SeqID_136020
atggctggggtcgtcgacaatcagcacgactcaaaacttggcatacctgatgaaagtgaggaggtagatgactctcctattgagcaagtgaggctcaccgttccaacaaccgacgacccaacacagccagcactgacattcagaacatggactctggggttggcctcatgcattatcctctcctttgtgaaccaattcttcggctacagaaccaaccctctctacatctcctccgtctcagcacagattctctctctcccagttgggaaactcatggcagcaacacttcccaccaaaccaattcgtgtcccgttgaccaaatggtctttctccctgaaccctggccccttcaatctgaaggaacatgcactcatcaccatctttgccagcgctggatctagtggtgtttatgccatcaacattatcactattgttaaggctttctaccacaggaatatccatccacttgccgcttttctcttagcactttccacccaggtcaacattcattactaa

SEQ ID NO: 19243 - DNA, 288 bp, Glycine max
  Peptide Sequence Number=SeqID_136021
atggctctggcctttaagatttggaataaccgatcaaacagaatatcatataaaactttgtttcaaattggctttgacgaggcagaactaaaaagctacttaccagtcatgcatgctaatttactacatgatggatcaaagcagtttgccaagaatgatgttgattcttcaaagtatgttataaccaatggaaataagagagtgattttggaccaggttggggaatttgcagatggtgtagctgttaaagaggtcgtgaagaaacttttcgcatatgcaaggagttga

SEQ ID NO: 19244 - DNA, 397 bp, Glycine max
  Peptide Sequence Number=SeqID_136022
atgctggggatatggatcctagcaaagaattcaattgatttcaagattgatagtattgaggttcacaatcaggcaacttccttcatgatcaacaagaattatcagtggactttgttttgggaatatcttgttgatctaagaactcgtattaaggtctcgcggcttctaggagacttcaatgacatctccaagccttctgaagttaggggaggcaactcctttacttggtttagaggcctagcttcatgtagtattgctaagaggctagacccagctatgtcatacacccattggagtactcacagacaacttccggaagaacgtcatccggaatgttcccggaagaagcttcttccggaagatttccattgtcttccggaagaagcttcttccggaa

SEQ ID NO: 19245 - DNA, 549 bp, Glycine max
  misc_feature (9)..(9): n is a, c, g, or t
  Peptide Sequence Number=SeqID_136023
atgtatgtnctggttcccatttcctattggaacaacctatatgatgccaagaagttccccatcatcagttctcacacatttgattcctctggcgcaacatataatgtcactcgggttttgaatgataaaacttttgacattgatatggatagttataacaattacagcaagctctatctcagtatcacatttgcattcgactatggattgagctttgcaactctgactgctactattgcccatgttgccctcttccatggaaaaacgatttatcagatgtggaagaagacaacatctgcactaaaaggacaacaacttggagatgtgcacacgagaattatgaagagaaactatgaacaagtacctgaatggtggctttggcaagcaactccaattgccatggtggggagtcctaatgtctcttgtaattgcgttagttttcactttgccaattggggtcattcaagcaacaacaaacacgcaagtcggactcaacgtgattacagagttaataattgggtacatttacccaggaaggccacttgctaa

SEQ ID NO: 19246 - DNA, 2322 bp, Glycine max
  Peptide Sequence Number=SeqID_136024
atgagcggcggtggtggatcttcgagttgtgctagggttccgatcccaaacaatgtacgcaaaatcatccaggacatccgtgagatcaccggcaagcagcacaccgacgacgaaatctacgccgtcctccgtgaatgttccatggatcccaatgaaaccgctcagaagcttctctatttagatacttttcatgaggtgagaaggagacgtgaccgcaagaaggagggattgagcagcagagcttctgatgagcctaggttaaagcaaggcggacaagggagggggggaaggggtggttctggaggatattcctctaactttcctggtacaatttccccaccttttagagatggtggtggtgggaggaaccaagctaatcgaagggaaaatggagtcaatcacattgcagagagaagtcatgctccctctactcagccattttcacagaaaactaagactaatacaacatctcaagctacaagagtttcagctgttgcaccccaaggtgctgcaaatcaatccaatgggaagtcaggtcatgattctggtggccaatctcccatagttagtgtacctaaaagtacttcagctgctaaggacactggccatcaagaaaatgtccaacctcaagcagctgttgttgcagcagcatcctcctctactcaaacctttggctcagttaccagctctaaccaaggaatgtctgtgtcaagttctgatcaacttcaaacttctgtatccgatgttcattcttctttggatcctgtagtggcatcatctgtctcccggagtcttggtgtgagtggtgctattagtagggaagttgtgagcaaccgaatatctgctggaccaaatcatgttagaggaagtaaagttgttcatgaagttaatgatttatcggcatcaaagaatgaaaaatatgggtccatgaattcagcaagcaaaacaaattccccacagaagttaaatgaagttgaaaataatcatttatctgaaccctcacaacttccatctccatccccaaatgattcattgaggccatcttccagttctggtagccagtcacctctagctaataccacagaggtttcaacttcagaagcttgtgtgcaatcttcagcagagttgaggcaacatgttacttttccaaaccatttccaagtatccaaggctttaaaaagtggtctgacatttggaagctttgatactttaggcccaagtgaaaagtccaacagtgaaactgatggtgacaataatgcttctcctgcccttgaattgagtgacgaagctgcaacttcaagcaatcaaagtgcatccttgactgcacaaggagatcatcttgattatccacattcttcatcttatttgattgaaaaggcaccagctacaaatggcaatcctataactggtactgacacaaaggttgatcagtcaaagaaggaggttttgttggctcctgaaggccaacaaattccaactgttcaaactgctcaaaactatggtttgaatttcatttcctccatgttaggcactcagcaagttcaatttgagggaactgaacctcagtcacaagatacatctcgctttcctaactttgttaatgcaagttctcaggctgtgtcccctagcccaactccacccctgcagaattctatacctgtgactccacagtcggtttctattttcaggccaccataccctgctaatttcttcccatatggccactattaccctccaatttatgtgtctccaatccaccaatttttaaaccacaatggtttccctcaacaaccatcagctggcagcatgtatctaccagcagctgctgggatcaaattccctctccctcaattcaaggctggagccaacacaggaaatgcagctcatattggaattccttctggatcatttatcactccacctgtaggatatgcgccaggtcaaacagttaatactggaagctccactggaaatgaagatctggtagtgtctcagttaaaggaaaaccagatctatacaacaggacagctgagtgaaggctctgcagtgtggatacctgctccaggccaagacatgtccagtttgcaagttaattctctgtataaccttggccctcagggacaacatctcaccttccccccaacacaggctgctcagggggcatttgctggtatgtatcaagcagggcagacaatagcttcaccttcaacccttttgcaacagtctcaggctgtggctgggcccgttgaaactgtaggccccccttcaggatcttatcagcagcctcagcctgcacagatcaattggaactctaatttttag

SEQ ID NO: 19247 - DNA, 2424 bp, Glycine max
  Peptide Sequence Number=SeqID_136025
atggtgcctataagaatcagagaaagagaaaggatccacaacattaggttgaagaggaaaaagttggaggacattccggaggaaaccgagcttcctattgatactaatccagcagagcttgaagaagcgagccttcacttggaaacagatttggaaatactgagccgagccatggatatgggactttgggcactctgcctcgggtactctacgaaccccgcggactacaagcttctagaagaagttggttatggagccaccggcaccgtctacagagcgatctatctccccttcaaccaactggtggccatcaagtccttcgatctcgatcgctgcaacgtcaatctcgacgacctgcgcagggaggcccaaaccatgagcctcatcgaccaccccaacgtggtgagggcgctctgctccttcgccgtggaccggagcctctgggtggtcatgcccttcatggaccagggctcctgcctccacctcatcaagatagcttactcccacggcttccatgaagacgttatcggatccatcctcaaggagactctcaaggccctccactacctccaccgccacggccacattcacggcgacgtcaaggccggtaacattctactcgacacctccgcctccgtcaggctcgccgacttcggcgtctccgcttgcttgtacgacaacgccggcgaccgtcaccgttccagaaacacttttgttggaaccccttgctgtcttgctgatcagtgccctcgggacaaggagaaaatatttattgtagaaatcataagattgcgtaaaaaagataaagatgatcagcaacgtaaatttatgcatttccgtaaacatctttctactttgttccttaactggatggctcctgagatgctgcaacctggaagtggctataattccaaggccgatatttggtcttttgggattacggcacttgagttggctcatggccatgctccattttcaaaatatcctccaatgaaggttctcctaatgacaatacagaatgcccctcctggacttgattatgatcgagataaaaagttctctaaggaaatggttgctatgtgcctggtaaaagatcaaacaaaaaggccatcagcagagaagttactgaaacattccttcttcaaacatgctaagcctcccgagctctctgtaaagaaattgtttgctgacttaccacctctttggaatcgtgtaaaagccctccagctcaaagatgcagcacaactagcagtgaagaaaatgccttctacagaagaagaggcaatatctcggagtcaatatcaacaaggagttagcgcgtggaattttgatattgatgatttgaaagctcaagcttcattggtgagggatgatgatgatattgcagagatgagggaagaagctgaaaagaaattttttactaattacaaggccattgcaattgattcccagtctggtactgtcaaaatgaattcagagaaatcaccacagaataaaatcacatcacaggtaggtgcttttgacataaaacagactgagcaggatgaatacttgaacaaaaaggagaagaatcccaaaagtgatctccaggaacctggattgcccaaaaatattatttggaagagaaatgggtcaattacggaggcaacaacatctactctagagaaagatataggtatgtgcaaaatcaaaggtcaatccaggaaaatccgtcaaacccaaagtggaccgctgttgccaggcactgttctcagtcattctgcattagaaaggggacgaacattagaaaggcttgagaatggaaatcagttactgggtgagaaaaataaccatgaagcgcgacgagcgccaagttttagtggtccattgatgcttccaatgcgagcttcagcaaatagtttatcggctccaataaagtcttctggaggattcatagattccttggatgacaagtctaaggctaatctagtgcaaattaaagggcgattctctgtgacatcagaaaatttagatcttgtgaaggatattcccgtaagttcagtttcacgccgatcttcacagggatcagtatcaccactgcagaaatctgccagtgttagtgattggatgttggattccaaacaaatggctcatttatcttctattgaatctatttctcttcaccaattcatcagtccaccaaagattctatcaccaacggatcttataatgaatctgttaaatagcttgcaatctgctgaagcaattgaagtttcacagaatgggaagttgccaccattacctcgcagttcagaaatcaatggaagtgttgatacagcagcttcagagagggaacgtcttctgctgctcaaaatttcagagcttcagactcagatgatcactttgactggtgagctgacagctgagaagttaaaacacatgcag

SEQ ID NO: 19248 - DNA, 3960 bp, Glycine max
  Peptide Sequence Number=SeqID_136026
atgggaaacacagagaaggcaattaacgaagctgcagaggaactaagtatacaagctatatcacaagcagacacaggggagcctaacacgagggtgcaaatagcaagtactggtaccctcgaaaccagcttttgttatttcaacacctatcatcttggtgctatcgttgattactctatgcctgactctccccttactctcgaagaggccatccgtaaactcaccacccaccaaatttcccttgccgagacccttcagaccatgacccttaaactcgacgagctcttacatcgtcttcctcccgtgctccctgaccccgtagcctcgtcttcttccccaacacctgctgctcctcctgccatcacccacaaaatcaagttggaggtaccacgtttcgatggtactgaccccatggggtggatctttaagatcacccagttttttgaatatcatcagacactagagaacgagagacttaccgtagcatccttctacatggatggctgggctttggcttggctccagtggatgaatgccccttcgcagtatgaagatccgacgggaacccatttcaagttgactcagcgcggtacggtggctgaataccttgccaccttcgaagaccttgctaaccgtacgattgggctccctccccccttcttacttaactgttttgtttcgggcctgacccccgaaatccaccgcgagatccaggcttatcatcctttgaccctcgttcaagcggcgggcctggcatgcctgcaggaagagaaaatcttggacgcgcgaccccatcttcgccccaaaccacccccacccttaccctctccttctctgacacaaccccttcccctcaaaaccattatccctaaccctacccctcttttacccagccctccccgtccctcaccacctacggatgatgacccttcatcccctcacatactccagcccaacctgcaacccgaacccgaaacacctcaacccgacccggcccaaattagctttaattcattagctggaaatgtcgcgcttgaaacgttgcgtttcatggggaccatcggaaaccaccatgtggtactactggttgacggcggcagtactcaaaatttcattcaacatcagcttgtttcccaattgagcttgacccctcgcactactacccccttacgtgtcatggtgggtaacagtcaacaattggagtgtactagcgtgtgtgagtccgtttcggtcacaatccaggctactcaattcattgtcgacctccatgttcttcctattgcaggggctaacgttgttgtcggcgtccaatggttgaagtccttgggccctgtgctcacggattacaactccttgcgcatgaaatttttccatgcaggtacttttgttgagcttcaaggtgacacagagacgaccctgaactcattatcatcatcccagtttcatcgtcttcttcacaaccaaccaaagagtttatactttcatgttgctatccttcacgacgacaattctatggtcaaccccgacattgatcccatcattcaggaactcattgatcgctttcatctcctctttcaggcccctgagcagcttccaccggcgagacccacagaccatcgtattcacctggttcctcatgctaccccggtgaatttaagaaacatgatggtacatggcgtttctgtgtggactatcgggccttattctctcaccgttaaggaccgatttcctatacccaccattgatgagctcctggatgagctcgggggtgctcgttgcttttctaaattggatttacttcaggctcaggtggagtaccttggacacatggtgtccttcgccgaagtccaaccagtaccttccaaaatctctgcaattcagcaatggccaatccctcagacgactcgtgttgtccgtagtttcttgggcctcgcaggcttctataggcgcttcatcaagggttatgcatctatagcagctcccttggtggtcatcaccactttggacatgtttcaatggtcagcagaggcccaagcggcttttgataatttgaaatgtgctttatcagaggcccctgttcttgcattgccggattttagcttgccctttacggttgagacagacgcctcaggggttggaatgagggaggttctttcccaacaaggccaccccatcgctttttatagcaaaccattcactgctaagcttttaggggcatccacatacgtgaaggaattatttgcgattacggcggccgtgaagaggtggcggcaatacctccttggccaccattttattattattacagatcataagagcctcaaggaattgcttactcaggctattcagacccctgaacaacacacttatttggcccaattaatggggtacgattatcaaatagtgtatcattccgacaatcataatcaggccgccgatgccctgtctcgtctcccggagcaaggttctccttccttgatgatcctctcagtgccatgtctcacgctcatttcagaactttgtcagcagttggagtcccttcctgagtatgtggagcataggaacgcgatcatgcaatctcccctgagtcatccccacttctccattaccaacaatttaatacttcataaaaacagaatatggttaccccgaggatttccgatgatacccactttaatcacggagtatcactgcactccgactgggggtcatatgggcatagccaagactcttgctcgtatcactgaaaatttctattggcagggccttcgagatgatgtcactcaatttgtttctcaatgccttccctgccaacaaaaaaagtatgaaatgaagaaaagcgcgggtttattatgtccattgtcgataccccaccgcccttgggaagacctttccctcgatttcatcgtcggactccctctgtatcatggcaatactatgattctagttgtcgttgatcgtttttctaaggggattcatttggggatgcttccctcatcacacacagctcacacggtagccaccctattcatggatattgttggtaaaattcatgggctttcccggagtttagtctccagtgatggccagatggaggtcatgaacagggtaattgagcaatacttaagggcctttgtgcacagtaaaccgcgaacttggggaaagctcctcctttgggttgaatggtgccataacaccgcttggaatgccgccactggttcgaccccatatgaaatcacattctggcgcaaaccattcaattttcctgattatttaacgggatcttctaagatagacgcggtagaagacatgcttaaagaaagggaagaaacatttcgcatcatcaggaagaagctcctgaaagctcaggcaaccatgaaaaagacagttgacaccaagcactgtgaagtggaatatcggccgggagattgggttcttctccgactctgtccacatcgtcaagcttcagctaaacgatccccggaaatgaaaggaaaattagcaaagcgtttctatgggcccttcgaggtgacagaaagaattggacctgtggcttatcgtctgaaactgccggagcaagctcccacttatcctgtctttcactgctcccttctgaagccatttcgtggcaatccaacctctccagagactagtgaacaatctccgacggggtcatgggaagtcttggtgcaatgggaagggctttctccggatgagacttcatgggaagactggaactccctaaggcaagaatatcaccttgaggacaaggtgattctgcaagggccaccggatgatagcatgggaaacacagagaaggcaattaacgaagctgcagaggaactaagtacacaagctatatcacaagcagacacaggggagcctaacacgagggtgcaaatagcaagtaaatccaagaggaaggtgatgaggcctgcttacctcaaggatttcatgtga

SEQ ID NO: 19249 - DNA, 3849 bp, Glycine max
  Peptide Sequence Number=SeqID_136027
atgacgattctcaatggcctcagtcttgatattgaagctgaaaaaacagttgcatttgtggcacaaagtggctggggaacatccaccatgattgtcaggactcaagagccaggcctcattatcggaactatacttgacaatattgtgtataggaaaaatgcatcagaagatgaagttagaaaggcatataagaaagaaacgaaagacagttccggttgtgtggttgcgccgaataaatctcagcagcaaccaatgaaggcctatattggcgacgggtattgttcacctatgaataaagcacaccctaagacggaaggaggcggttccagtgtgatgtgtcgcgtgtcgtgtgcacgaacttctctcaccgaaaaggggccctacatgggatcttcacgaaaccatcttcgaaaaggtcgcgagaaaatcttaaacaggtcactggaaagagacgaagccaatgcaaaactatcagaagccatgagaaacaagccaaacacgagatgtgggtcagccaaaaagatgcaaactgagccaaacgaagccaaaacaggttcgctggagaagaagcacgacgaggaagtgcatgagcttcatgcaatggagtgtggcggcgcatgcaacggcgaaaggattcgtggaggcgcttttaatcgaagggtcacaccgaataagaaagaactctcagtcagtcctagtcctctctccctttttgggcgtctcccagtgaccttgccaccgttcgagagcaggtccaggcttcacgtgacactggagtctccctctattggtttgtctggttacattgctggaggccaagacactccatctgcttgtctggcttcacaggaaaataccgcaccccaggtgctcgataaaaagccttggtcattttctgcatcaacaagagttccagcacaccaggtgtttgttaaaatgtctggttgtcccacagttggcaaaggagaggcttcgatgccttggattaatttgttcaaagacaacagaaagccttccaagggatttgacctgaaattttcttctccatcttctgaagatgtagtgttgcttgatgaagatgattttcagcacctggaaaaggtgtggggacacagtcttataggctatgtagtaggccgtttcccaggaaaaaaagccctgctggaatgctgtcagaaatggggcgtaaagttctcatattctacccatgaaaacggttggcttgtattcaaattcgattcagatgatatgaatcatgtgttatctgcaagcccctacttcatcttccaaaggccccttttgctaaaagtcatgcctcttttcttcgattttgctaatgaggaactgagcaaaataccagtctgggttaaactccggaaccttcccctagagttatggaatccccaagctctaggaaaaaatttgtccaagataggttcccccatacgtacagaccgcctcactgcctttaagggatctatttcctttgctagagcattggtggaagttgatgcctccttagatcttatcgaagaggtccactgtaaacttcccaccgttaagcaagataacaaaacaaccacatcagaagggcctacagcaggttcaccctctgttcagtctcaagatgccgaggtggtagcttttacagagaccaatcctaataatccctttgggaaatccaaggaagaccaggttggactgtccactcaaccttgcatgatgcaaccacaagcaactgataatattcctgctctccaaactccttttgatatttctggagttgagaattccaaaagagatttcaacagtatcctctctcccaaggatcggttcaatggcgttgacattagtgcttatgagatgcaagattttgttgactgttattctgagcttgggctggggaaccttaacagtcataggtccatgtatactcggactaatggtagagtttggagcaaactggaccgggccctttgcaatcagctctggctcaactcctttgaaaactcttcttgtgaagtggtgggttttgaatcaatttccgaccacgctcctttagtggtgaccacgaaggtgttggtgcccaaagatggcaggagtcatcaagttcctggatgttgcatgtttaaagtttgcaagagactgaaaactcttaaatctcctttgaagcttctctttaaacaagaattcagtcacattgctaaccgggttaaccatacaagaggtcaggttatcctgctcaggaaagcagagtcaaggaatgtagctcagctcatcaaaaacagcacatcctctcaatccaaaattgctaatgcccttctcaatcatttcaaggctttatttagtgctcaggagctgcatcatcctgcctctttagcagtctacaactcgggtcctaaaattcccattgattgctttgcctttttacttagccccatcactaagcaagatgtctggaatgttattttaaggatggacaacaataaagcatcggtgaatgatggctacaatgccttattctttaagaaggtttggaacatcataggggatgacatttttgctgttgttaatgagttctttatgtcaggcaaactactaaaacaaatcaatcatgctcttattgctctcattccaaagtctgaccaagcatcccaagtgaaccattttagaccgatctcttgttacaatttgatgtacaagattatctctaagattttggccaatcgaatagccccaatgctagagcatattattggtgcatcccaatctgcgtttctaaagaataggaaaatgatggacaacattttccttgttcaagagctccttcgcaaatatgttcgcaagagaatttctcctagatgcctcttgaagattgatttacataaggcatacgattacatttcttgggagttcctggattggatgcttaagtttgtgagtttcccagctcagttttgttcctggattatggaatgtatcactaccacttcctttagtgtggtggtcaatggatccatatatgatcatttcaaaggtcaacgtggattaaggcaaggggatcctctttccccttacctctttgttctctatctggaatatttttcccgtgatcctcaaagtctcaaggataacatcaactttcagtttcacccaacctgtgttgttgttcaactttcacacttggccttcgcagatgatattatgctcctatccaaaggagacttgccttctgtttcagcaatatttgccaagctccatcacttttgtaatattttggggctatctatcaggaccaacaagtcacccatctactcagcgggagtggaccaagatttagtttggactgcttcccttttagatacttgggtgttccccttttatcttccagactcaatgtctgccactatgctcccctgctttctcagattacaagccttattcagggttgaaacagtaaaactctcctatgcatggaaggtggagctaattagagctgtcattcagggaattgtcaacttttggatttgtatctttcctttacctcaatccgttctagaccgtatcaatgcttcctgccacaactttctttggggcaaagctgagttgcttgctgggagggcttatgactacatcagaggggccaagcctgctgtcaattggaattctgttgtttggaatcctgccattcctcccaagatgtcttttatcttatggcttgctatcaagaaccgtcttctcactttagaccgagctgctttcttgaacaagggtttactctgtcctttatgcagaactgatgcagaatcccatgctcatttgttcttttcctgcaaaatctccctctga

SEQ ID NO: 19250 - DNA, 684 bp, Glycine max
  Peptide Sequence Number=SeqID_136028
atggcatcggagagttcgtttgtgcagcccgctataccgaagtttgacgggcattgtgatcactgggcgctgctcatggagaatttcttaaggatggaaggaacacctcttaccgaagtagagaggaagtatattgatgatcagaaattaaaagatttgaaggcaaagaactacctatttcaagcattagatcgttcaatcctggagacaattcttaacaaggatacatcaaagaatatatgggattctttgaaacagaagtaccaaggcacttcacgagtcaagcgtgcacaatcgcaagctctaagaaaagagtttgaaattctccacatgaaggagggagaatctgtaaacgattattttgctcggacacttaccatagccaacaagatgaaggctaatggtgaaaacaaaggagatgtggctgtagttgaaaaaattctgagatccatgactcccaagtttgattatgttaagaagcgcaggccttgcagattgctcatacagatcaacatgcagaatagggacgaggtcgtggaggctttggacgaagaggaagaggacgaggctgaggacgtggcaaacagggatttgacaaatccactgtggagtgctacacttgtcatcaactcggacatttcagctgggaatgttcaaaccaaagaaaggaggccaactatgtag

SEQ ID NO: 19251 - DNA, 2472 bp, Glycine max
  Peptide Sequence Number=SeqID_136029
atgaatgacaacacttatactgttactggagtcttttttgtgccagatttgaggaataacttactaagtattgggcaattacaagaaaagggacttagtattctgtttcaacatggaaagtgcaagatatggacatttgagttttcagggtttaaatacgctttaccagcagagtatggtatatggtttgccaacaatgaaaacaccaacaaaactgtgccaggacttcttggtagggaagcaatcacgagcttcattcccaaagaagagtacttggagggctacacagaaaaatcagaagctctttctgtctttaagaaatttaaaattcttgttgagaaagaagctgactcattaatcagaactgcatacacaccacaacagaacggaattgcagaacggaaaaatagaaccatcatgaacatggttcggagcatgctctcagagaagaaaatgcccaaaactttttgggctgaagctgccacctggtctgtgcatattttgaatcggagtcccacattagcagtgataaataaaacgccggaagaagcctggagtggagtcaagccttcagttaagtattttagagtttttggatgtatttctcatgttcatgtgcctgatgctaaaagaaccaagctagatgataaaagtttgtgttgtgttttgttgggggttagtgaagtatcaaaagcatacaaactttatgatccgatttcacaaaagatcataataagcagggatgttgtctttgacgaagataaaagttgggattgggataagcagtatgaagaaaccatcttatgtgatttagattggggtgataaggatgtggaagctgttgtagaagaagaacatgaggtacgacacaatactgataccccaaaagaggatattattatttcctctgattctatggccgaagtaaacacttctagtcccgttcaacgaaggtgtagaagaccacccctttggatggaagattatgaaactggagaaggactttctgaaggcagtacagaagctaatctggctatgtctgcaactggtgaaagtgatcctactcactttgatgcagctgttcaaattgcaaaatggaggaaagccatggacgaggagatggaagcaataaacaaaaatggcacatgggaattgatggaattacctgacggagcaaagaaagttggagtaaagtggatttataagacaaaattcaaagagaatggagaagtggacaagtacaaagctaggcttgtagtgaaggggtatgcacaagaatatggggtaggctatacagaagtatttgcactagtggcacgtatggagacaattcgtttggtggtagcacttgcagctcaaaagggatggccaatctatcagctggatgtaaagtcagcatttttacatggagagttggatgaaacagtgtatgtggaccaaccttgtggttatgaacaaaaaggggaagagcataaagtgtataagttgaagaaagccctttacggacttaagcaagcaccacgtgcttggtatagtcacatagaagcatattttctgaaggaaggatttgagaactccatgaagcatgaatttgacatgacagatcttggtaatatgagatattttctaggtcttgaagtgatgcaacgaatagatggcattttcttatgtcaaaagaaatatgcattagagatgttgcaaaggtttggaatggataaaagcaattcggtgcaaactccaattgttcctggtgttaaactcacaaaggacgacactggtgtaaaggtggataagacttactataaacaaattgtgggaagtcttatgtatctaacatctactcggcccgatatgatgtttgtggtgaacttaattagcaggtacatggagaatcctactgagctgcatttactagcagccaaaagggtgctgagatatttaaagggaacaactgagtttggaattttctacaaaaagggaggaaacaaagagcttcttgcttacactgacaacgattatgcaggggatttggatgacagaaaaagtacttcgggttatgttttcttattgtgttcagctgctgtttcgtggtcatcaaaaaaacaaccaattgtgagtctatcaactacagaggcagagtttataggtgcagcatcatgtgcttgtcaagccatatggttgaaaagggtgttgggaaaattgtgcaaaatgcaagaccaagctactgtaattcgttgtgatagtagttctgctattaagctttcgaagaatccagtgatgcatggtcgttgtaaacatattgacgtccgattacatttccttcgagatcttacaaaggccggaactatcaagatgatgcattgtgggacacaagaacaagtggctgatattatgaccaaaccactcaagcttgatactttcttaaagctacgcaggtcactaggaatgtgttcagagtctgatataaactaa

SEQ ID NO: 19252 - DNA, 1053 bp, Glycine max
  Peptide Sequence Number=SeqID_136030
atggagcataatggggacaaaggaaacttccttatctgggatgcaacatgtatcaagatgtttgataaaactgctgcagaatgtcgagatgaattgatagcgatatgttctgcacgatgcaatgatagattaaatgatactgtggttggggacgacattaaggtgtttccaccgtgtgttgatgaaatactgtctaaaaattgggctgtcagatttaagtaccattcacaattgcgccaatcatctgtgttgtatgtcagtgaagaaccccattatattcaaacattgacaaccacccttggattgaagggagaagcaagtatgggaaaggcaatagttgttgagcctgaaagttcaccgccaatttaccatcctacggtggatggttattattttaggaaggatgcagcttgcagtatgcctttgaaacaaatgggaactgggtatggtagatataaagtctttattttacattgctattatcgtcaagtgagtaacaactctttcatcgttcttccaacaccaaaaccaaactctgcccgcacaatgagttctgtaatatccactgcctccaccgtcaacttcattcaaataccattagcatgtcatagacaatggcgtcctacttacccactgtatataacgtttgattacaatggagaaaaacattttataaaggttagaagagacggtaacaaattttattttgcggatggattgaaggacttcagaagagcgttgggtattcatgaaggcatggtggttcattttgctacacccgatagaaatacaagcttttatatgcatttcatgccaccactggacagacaaacatcaggcagaccttacagtatcaccagaacatacatatttaccgttgatattaccaatcatatcatctctactcctacacctctggtgttgccacctaatgctgtggatatcattgggcacagatatcaatatcttactgttgaagcacctcgtggtcatcagatttggaggatgtctatccaagatgggctgcaaactctcactacaccttggtactaa

SEQ ID NO: 19253 - DNA, 2010 bp, Glycine max
  Peptide Sequence Number=SeqID_136031
atgatgtccgcaccagctaatttggagacggggggagaagagaagaaattagaaatagagaaagagaaagaggtggagagtcaggtagaggtagcagatactgagtcaaagccatggaaagagcaaataacagtgagagggttggtggtgagcatggtgcttggaatcatatacagcataatagccatgaagctcaatctctcggctggaatcgttcctaacttcaatgcctctgctgccctccttgctttcttgtttgtccgaagctggaacaaagttctccaaaaggctggttttatctccaaacccttcacccggcaagaaaacaccatcatacagacttgtgctgtctcatgctatagcattgctgttcatggaggattcgcttcttatcttttgggattaaacaggaagacgtatgagttgtctggagttggggctgagggtaacaatccaaatactgttagagatcctggatatgcttggatgactgccttcctttttgtggtttgctttgttggcctctttatcttgattccactcagaaagatcatgatagttgacctgaagttgacgtttcctagtggcttggccacagctgttctcatcaatggtttccacacgcagggggacaaaatggccaagaagcaagttggtgggttcctgaagtatttttccatcagtttcatgtgggggtttttcaagtggttcttctcagggacacagggctgcggattcgcgcagtttcctacctttggattgaaagcttggaagcaaacattctatttcgattttaacatgacttatgtgggagcagggatgatttgcccccacctagtgaatttgtctttgctccttggagctgttctatcttttggagtggtatggccgctcattgatcttcgtaagggagattggttcccgaccaatttagatgagagcagcatgaaagccttgtatggctacaaggtcttcctgacagttgctctcatcctcggtgatggcttatacaactttgtcaagattctagtttcctcaatccttagcgtacatgaaaaaattaagaaccgtaaaaatgcagtaagcggtgatcagcagggggataacggtgaagagcttaaaaaaaaacaagtgtttctgagggacaacatatcgatgtggattggaaccggcggatacatagttttgtcggtggtagccataattgtaatcccacaaatgtttcctcagctgaagtggttctacgtggtggtcgcatacatcttagcgccatccctggcattctgtaacgcttacggaacgggcctcaccgacatgaacatggcacacaattacggcaaagtggcactctttgttatagcagctatgagcgggagagacaacggggtggtggcaggactcgtaggttgtggtctggttaaatctgtggtctccgtggcttgcactctgatgctcgatttcaaaactgcgtattacacctgcacttctcctaaagcaatgttcatatgccaattagtgggcactgcgttgggatgtgtaatagctcccctcagcttctttctgttctacaaggcgttcgatgtggggaacccgcatggggaattcaaggctccctatgctctcatttacagaaacatggcagtcttaggcgtcgaaggtttctcggcacttccccaccactgcttgcagctctgttacgggttcttcgctttcgcggtggctgtgaacatggtcagagacctctcccccaagaagattgggaaatggatgcctttgcccatggtaatggcgatacccttccttgttggtgcttactttgccattgatatggcccttgggactttggttgtttacgtgtggcacaagcttaactccaagaaggctgaggccatgattccagcaactgcctctggactcatttgtggggaaggcctctgggctctccctgcttccattctcgccctttccaaaattaaacctcctatctgcatgaattttcttgcttcctag

SEQ ID NO: 19254 - DNA, 204 bp, Glycine max
  Peptide Sequence Number=SeqID_136032
atgactccattgatgaagaagatccaagacctacaagctccacatggagctacatcaacaagagttaagacacctacaatgaaaatacactttcaacatcagttatttagaacattctacatcggctctaaaaccgatgttgaaagtgccaacgttgaatgtatcaatgttaacatcggttttgtaaaaccaatgttaacataa

SEQ ID NO: 19255 - DNA, 348 bp, Glycine max
  Peptide Sequence Number=SeqID_136033
atgtcgttgcagtcacggaagcgcagcccagcttgcgacaaagacgaactcaggcagaaggagaaagaagaagaacgccctaggagtcttaacgcgaaccacaatggacttccaaaatcgattcccaccctttctgggactctttcctttcctagttttcttcgagttgcgaaagacgtacctcaatcgataagtggcagagacgaactccacaaacacgaactccacaatgtggttgcagtcacggaagtgcaggccagtttgcgacaaagacgaactcaagcagaaggagaaagaagaagaacgatagggttcgagcgtgcgggttgtgcaatttcatatttttaa

SEQ ID NO: 19256 - DNA, 378 bp, Glycine max
  Peptide Sequence Number=SeqID_136034
atgagcaagtccaatttcacctcagtgtttttggatcatgatcttgctatgttggaagagaagtttgttactattattgatgttagtagcaatgaagagaaagtttataataaaacttgggaaagatctaacagactcagcctaatgttgatgagaatgactgttgcagacagtattaagacaactctccctaaaatcgaaagtgctaaaaagtttatgggattagtgggagagtattctcaaacagctgaaaagtctgttgttgggacattaatgagtacattgaccaccatgaagtttgatggttcacctactatgtatgaacatgtcattgagatgacaaacattgtagcaagacttaagaccttgggaatataa

SEQ ID NO: 19257 - DNA, 333 bp, Glycine max
  Peptide Sequence Number=SeqID_136035
atggggcttgatggggttgcggatagtgtcgatcgcagaacaaacatgatggtgtttcattttgcttgcagagaacgaattgatgattatagcaaattaagggtcataatattatatgacatctcaattacggaaaggcaatcacaacagctaggtaacaagcagcagctgaaagaaaagaaagagcgtgaggggaaaaagaaaaaagcaaagatgcctcctgatgtaattcaatttcgtcctaccgtagcacctcttcaattttcttcaccaacaaaaagaacctcaccaacaagaagaacaggcaatcagtggcacaattattacttttaa

SEQ ID NO: 19258 - DNA, 195 bp, Glycine max
  Peptide Sequence Number=SeqID_136036
atgaattggagaggttcctgtcttctgtttgccactcttttggtggagaaaatacttctgtgcgtgactagcaacttgaagaggagcacagcctttagtgttgcaagaaataacattgaggagggtgaaatcgaaagaaggagaagcggaaaggtggtaaccgtgtacgtgaaaggagcaagaataggggaatga

SEQ ID NO: 19259 - DNA, 444 bp, Glycine max
  Peptide Sequence Number=SeqID_136037
atgtctagtcaaactcacaagatctatggacttcctatgcctgtgacatataactgccaatcggaacacccttctagaggtatttacatatcttctagtgaaacaaacgagttcaggcatggcatgcttttaatttctgcaagaactttaatgtctctgtcaaaggcaatgacatcagaatcacctccatatgcttccaagaaagcacatattggacaagaacaacaaaagcagaaaaagaaagaagtgaatacagaaagttcatgtcccattaatcaacataggccaaaagctttgccacattacactcaagatattgatggggaagaaagtgataattgcagtgaatatgcaaactacacaactacgacttggggcctatttcctcggttctgccttttgaatccaatgcctggattaagaatagtggataaggttcaatga

SEQ ID NO: 19260 - DNA, 556 bp, Glycine max
  Peptide Sequence Number=SeqID_136038
ggaggataaagtttatgtcaatgataatcatgtggatggtggatcacaagaaaatgctgccaagtctgaaattgtgacccctgaaggtgataacttaggagaatggttgagtctaggcatcaaaggagacaatatccctctggaagcagctgaacaaaaccctgcagattcccaatcaagacctctccacaataaggtattctcatgcatatactgcacgagaaagttttacagttcacaagcctttgggggtcaccagaatgcacacaagagggaaaaacaagcagctaaacgaagttaccgatctcatatgatgttgacaacaacatcaatgggccttgcttactcttctttggcatctaggtcactgggaatacaacctcactcgcttgtgcacgagccaagcagagaaaggtctgctatggcggctagcttcagtgatgccggttattggaatggaatggcgtcatggacaccaccctctatgcttgaacaagccgggcatttctcatggccaggtagccttcagttggagttgcccaagcaagaatcagat

SEQ ID NO: 19261 - DNA, 709 bp, Glycine max
  Peptide Sequence Number=SeqID_136039
atgaagcaccccaatgggaaggcatttggtgacatacccctgccaaacactttggggggacctcagtatcacccacaaccacaatccttgcattttgcatgggaaagactgcctcttgccatagtggaaagggagaaatttgatcatatagagggaaggctgagggctattgaaggaagcagagattatgccttttttgacatggtagaattgtgtctagtgcccgatgtcattatccctccaaagttcaaggtaccagatttcaataagtacaaggggactacttgccccaagaatcacctaaaaatgtacaacaggaaaatgggggcatacttgaaaaatgaaaaattgttgatgcatttcttccagaaaagtcttactagggcagcctatcagtacaattctgatatggctctagatagaatgcagctacaaaacatgtgtaagaaggagggtgaatctttcaaagaatacatccaaaggtggagagatttggcagctcaagtagggctcccaatgatggagagagagatgataacaatgatagtagacacgttaccggtgttctactatgtgaagatggtgggttacatgccttcaagctttgctgatttggttttcaccggcaaaaggatcgaagttcgtctgagaagaggaaaatttgattatcttgctttgatgaatgagaaacctggggcaaatagagaga

SEQ ID NO: 19262 - DNA, 402 bp, Glycine max
  Peptide Sequence Number=SeqID_136040
atggcttattccctagtggatgacgccgcctcttacctcttctcctttgtcttccgctgcatctccaggtggaaaatcaccattaaaggacctcagagcagctcaagaaggccttgtattttgatgcaatcctacccctcaagcttattggatagaagactccaagaggattgggctagagcagctaaagaaggctctaggcttctcatgtacctcaggatggtgcctcttctcacctattctcctttatcttccactgcaactccatggctgaaaatcaccattgaaggacctcatcgaagcttaaagatccagcctcatagaagcttctcaagcaagcttccatcaagtggtatcagagcacaagaacttcaagtaggttgctccttaaacctccattaa

SEQ ID NO: 19263 - DNA, 567 bp, Glycine max
  Peptide Sequence Number=SeqID_136041
atgagttcatggtcgtttcagctgctggacgcggaggaccgacccctcggtgcccttgacggggttaccggggggtcggccgagatcgtcgcgcaggacgtgctcggcggctcgggaacgctgaatctggatcggcgcaaggacatcgactggatgtctcaccgggtgcaggcgacctacatcggtggggcggcgtcctgggcggtgggaacctacctgctgtcgtcgccgtcggagaagcacagcgccttcgggatctcgtacgaggtcggtcttctcacgaagatgaacgtcatcagcgaggacaccgtcgatgcgcggtactcgctccctgtggggactccggtgatcacgacggtcgtcgcgctgatccagtcgaccggggagacgcggatctcggtgacgagctcggcgagcgtcctcacgtctgcgatgacgtgggaggcggggacatcgaagctgacgatcgtgaacgacctgctgcaggtcgccgggtactggtcgctctggtgcgacgggtcggggctgttccgcctcgagccgtacaccgatccagcgaagcgcccg

SEQ ID NO: 19264 - DNA, 480 bp, Glycine max
  Peptide Sequence Number=SeqID_136042
atggccgttccaggactcgatcgtcccgacgacgaactgcctcggcatcgagatctcttcgaccgatccgtagatgcggcggccgtcgggatcgcggaacatgaagatcgactcgtcgacctgcacgagcgccgtgagatcggcgacgttcgccgtctcctcatcgccgatcgcgtgatcggtgactcgacccgacacctcgactacacgcgcgagcgcctcgcccgtgtaggcgacaggaagccgtcggccggcgtactgcttcagcgaccgctgccgccccgccgtgatctgcacgctcggattgaacggcagacgcgcagtgcggccgaagccgcccccactcgacagccagagcgccctcgagcgcgcctgcacgacggcctccgtgaccgccgaagcgccctccgaagtgaccgccgtggcccggtagtgaatatcgccgaagctcagcgactcccagtcgatcagcgacgccgt

SEQ ID NO: 19265 - DNA, 228 bp, Glycine max
  Peptide Sequence Number=SeqID_136043
atgggccaaagcgtttactatcgcgattcagtgcaaaacaaggcatttgggatgaaggtagctcgcccaggaaagctgttacttcattctgaagcaaccttgctcgcccaggcgagctggttacttcaccatgaagttattttggtggccaagcaagtcaggggtcagaaaaagtgtaaaaatgagcttttttccctccctttgagtattttccgccttctttcctga

SEQ ID NO: 19266 - DNA, 504 bp, Glycine max
  Peptide Sequence Number=SeqID_136044
atgggtgaagtagacgaggtgcaagagcagatgaaggccgacatggaggccatgaaagagcaaatggccacaatgatggaggccatgatgagcatgaagaagataatggaggtcaatgcggctgcagttgccgctactagtgccattgctgaggtggacccgactcccccatctggcctcaaccaaataaatcatccaaccttggatatggtagttcagaacaagcatgccttcccaccatatggcttgcctcctaactatacaccacccaatgtggcgcacactcccgatgtgaataactccactcccatagtcattgggagccaacaacctcaatctgatcatgcacatgtctctcaactcatgggggagacacatgaaataccccaccacaatctctccgacttcgagccttgcattggatatgccactgaggggcaagcagttagtgatgtacccttgccaaacactttggagagccctcagattcgctcacaaccataa

SEQ ID NO: 19267 - DNA, 339 bp, Glycine max
  Peptide Sequence Number=SeqID_136045
atggctccacctgctagatcctatcctctacatggcctcaaacttccaatcactgtgcttttcatctttttcctctcctttctaccttccaaatctggtggatcagtgatggtggagagcacaagggagggtttagaggaaagtaaaatggtgatagggtcaaagccacctgcttgtgttaacaagtgcaagagttgtaggccatgcatggctactctggtcgttccaaatcaccaaaagaggaagaagggtttcaaagtgtcgtctcgtggggacgatgacacctattaccttctttcatggaaatgcaaatgtggtaataagctgtttcaaccatga

SEQ ID NO: 19268 - DNA, 279 bp, Glycine max
  Peptide Sequence Number=SeqID_136046
atgaagaacgatgtagaagtcgattacggtcgcaattcggtactgcctcagccttgtttttctcttcttctctctgatttctctcaatatatgaaggcgaaaccccttccttcagccccatcacgcctatttataggaaatgaggggacttggttgatcagcagctcgcctaggcgagctggttacttcacccctaagtcttttaggggcctaggcaagccaaaggctagcccggggtcagaaaaagctcccaaaggacccttttgccctcccttttga

SEQ ID NO: 19269 - DNA, 330 bp, Glycine max
  Peptide Sequence Number=SeqID_136047
atgggagcaggagcaagtacagagccacaaggtcacgaatcacaaggcgttgggggaatccaacggccaggagtgaagactactatgggttctgatgggatgaagggttggtgttgttttgggccccacaaagctgatggtgtacggataaagaggaagagtcataaacagttggtctctcatgcttgcacctgcagggctgcacgtaactgttcagatcaacataatcacgtcattgcatcaccgtacacatctatctcacttcctctttctcctcctcttttcattgtccagtcttttcattctacaccacttcacctaataatatag

SEQ ID NO: 19270 - DNA, 345 bp, Glycine max
  Peptide Sequence Number=SeqID_136048
atggttattgaggaaaatcatactcatttggtggctttggtcgagcctagaattagtggtgcttattccaacttagttgtcaataaggttggggtggatggtgcttttcatgagaaagttgggggtaggagattggactataatgttagcagtaaaatgcttcaatgtctttcttcctatgagctcatggatatggatttctttggacccttcctcactttatcaaaaggtagcctcaagaagcatattgaccgagtggtggctaataaatcttggcaagtggcctttttgaattccaaggttatccacttagccttgcctgcttatgatcatcgtggcctttag

SEQ ID NO: 19271 - DNA, 360 bp, Glycine max
  Peptide Sequence Number=SeqID_136049
atggctcttgtctcagtcaccaccgcaaattcctcgaagcatattctcttacgcactctctctcgttctcacgctttctccttctctctccaccgtcaatttcaaccactctcctcttcctccgccgtgctccgccgtcttccccggtgccacgccgcctcccccggtcccccactcccaccttccgaaaacgattccagcaggcaccttaaaggagcagatgttgctacatctttatccaaaattcaagatagaatacagatcttctttgctgttcttttctggatgtctctattcttttgggcttccgcctgggatgggaggaatagaccagacaagggatcaagatttagaagataa

SEQ ID NO: 19272 - DNA, 189 bp, Glycine max
  Peptide Sequence Number=SeqID_136050
gtaagggactgtaacactagctacttccaccagtcctttttggctggtcgaaggtgtaatagaattgatgcattgttggatgctaaaaatgtgtgggtttgtgatggctctcaaattcatactatgatcttgaatcattacaaatctttgttccagtgtgaagatcatatgcttacctacttgacatga

SEQ ID NO: 19273 - DNA, 660 bp, Glycine max
  Peptide Sequence Number=SeqID_136051
atgaaggaggagttggtggtgcaagaagggtaccttttcaaagaagagacgaagctcacagtgctcaaaacatccctcttcttcagcggtgatggcttcgctgtctacgattccaagggcaacctcgtcttccgcttcgactcctatggtcccctcgcacgtgacaaggacgagcttgttctcatggatccccatggccgttctcttctcaccctccgtcgaaagaaaccgagtcttcatcaacggtgggaagggttcaaaggggagagaaaggacggtgacaaacccgtattcagcgtgaagagatcgtcgatcatcggacggtcgaggacgagcgtggccgtggaggtgtatgatagccccggtgtggagtacctcattgaagggtgcttcccgcagcggtgctgcaaggttttcaatgccgctaaggaacttgtggcagagattcgtcgcaaagtggaccccaccaccagcgttatgctcgggaaggaagtcttttggctttgcgtgaagcctgcttttgatgcggcctttgccatgggaattgtcttggtacttgatcagatcaacggtgagaattactttgatgatagaatcgtggagccagcggtgcaccctgctacagaagatccggggtttgtttcaccggttccagtttga

SEQ ID NO: 19274 - DNA, 690 bp, Glycine max
  Peptide Sequence Number=SeqID_136052
atggatggtaacccaccaagtgctcagaaaaaggcaaagtcctcaaaaagaaagaaaggtgaatgctcccaaggagccatcaattgcttggacacttggttcactaatgaagggaagaatagtgattataagctgatttatgttgtcaagaatatgaaagggactttctacctagaactggtcaaagttttctacacatgtgcttgtgttgaccttggaggaaatttcatctccactgtaaatggagtagacatggtgatagatgatgctgtatggaaggaagttgttggtctagacatggttggtaggctaactgctgaagacaggttgattgtctacctcatcacctacattctcacaccaaggccaagcaatcatgctcaggagaccgatgatgatctccaaatagtgtatggattaaaatctggaattcaaatgaattgggttctgcatattgaagacatcatgctcaaatgtcattgtattgtagattatgagatttcatatgatgtgcttgcctctagattcattgactattttaaggttcatgtttctaatgagattgttgactacaccaaagcctctagtgagataactaaaaggcatctcaagaagcttggtatgaggtatgccaaccttaaatggataatgattggagagactgctgagggaaacattaatgagatgtaa

SEQ ID NO: 19275 - DNA, 285 bp, Glycine max
  Peptide Sequence Number=SeqID_136053
atggaactttgtgaaatacaaaagcaaagggaaaaagtggagaaagcctattacgagatgaaggctacaaaagaagttgttgaaaatacttccaaagaacaagtagagaaggaagcaagagttaagcaacaagcagtgggtgatgctaccaagattactgaggtccttgttgatctcactatctatgaaaaggctgatgagattttccaacaaatctatatgaacctgcgtccaagtaggctaacacctcacatgaagccacttcaatggaaaacaaggttctag

SEQ ID NO: 19276 - DNA, 369 bp, Glycine max
  Peptide Sequence Number=SeqID_136054
atggttgttgcaaaagaaggagttaacataagttgtacaccatcaatcactagtgggaagagctcacatattcctattagaaggaactctaaacaagttcaaataacaaatagtctacctactgatgggataaacaatttgttaaatatccatgtagtcaatatcatggatgaacacttgctactgaggacaagtgcttcaagttctacacttcagttgcaagaatctcaaaaaaaaagaaaaccaagaatcacccatgaaagtaagagaaagatcaaaagtccactcaagaagaaactcagggatcgagtgcagaagactgaaatgctatcttcagaagatggtagattcatgttcactataggctaa

SEQ ID NO: 19277 - DNA, 372 bp, Glycine max
  Peptide Sequence Number=SeqID_136055
atgatgcgtgtggttacgttaatcaagccacctccacaaaaagaaggatcattgttcaaaactttggaactagcacaatttgtcaccaagggagtattgcaaactaaggtaggtatttgcattcgtggacaccaagggaattttattcaagcaataaccatcttttcctatggggttccagaaccaagagcagctgaagcttgggctttattgaaagcaatggaatggatagcagaacttaacatgatgaatgttgtttttgaagtggactgcagcaaggtagaagcagatggagttctacatggatgcaaaggtgttttagattttattgtactatcactaaatgtaaagtcagcctatctcattatctaa

SEQ ID NO: 19278 - DNA, 336 bp, Glycine max
  Peptide Sequence Number=SeqID_136056
atggggatccatttgaatcagttcatgggtagcagttccagtattggcgccaagagagttagaaatgtttgcgttgcctttcgtgccgctactgaacagaataaccgtgctggttgcttgcgagcgttggagatgctggagcatgaatattgctatctcaagaacaaattgcacgaattgttccaaattgaacagcaacgtgctttggccgcaggagtaaggctaagggcacgtatctccggttatagacaagccaagcgatacccagcttttgtgctttgttgtgtagggaatagaaaaaagggatcaacgcctctggctttgtggattctctag

SEQ ID NO: 19279 - DNA, 402 bp, Glycine max
  Peptide Sequence Number=SeqID_136057
atgcgtattcctttcttggaacacgcacccgcgagtcacgcgtcaccctcccgccgaagggttgaatatctacactttgctactttggagtcattgaagaaatctaggagatttactttggtaaatttgaagaagcttgtttatcagaatgagcctttcatcatggcagaacaagctaaacacgtgttttatgttcaagatccttgtaatgaaagatggttagaggttctacacagaaaaacaattggtgttaatattgaagatgatgattcaaccgttgatacttgtctcaatcctttcttcggacaaatgccgactaacgccaacggagaagaagaagttgacgacgtccttgaaaatcataatgatcatgatgaaggagaattaattaacatcgtataa

SEQ ID NO: 19280 - DNA, 177 bp, Glycine max
  Peptide Sequence Number=SeqID_136058
atggcccgcacgaaaaaatcaggtcaaatgacgtctgaggtagcaaaggaaattgcagataggattggaacctttgtcgcccatgggcgtcaggatgtactgactactaccattaggcgaccagagcatcctggtcgtgtttgtgctattagagccagtgtcacgatcaaacactaa

SEQ ID NO: 19281 - DNA, 219 bp, Glycine max
  Peptide Sequence Number=SeqID_136059
atggactctcatagcctcttgaggctgaggttggtcattctgttgctagtgtcagcacaaaggaaagttgtgtcgatccctcagggtaggacccagaaacgggtgactcagacaaatgtgggttgtatgtcgatgatagtccttgccgactggtctatgttgaggaagttcaagatgctgatgctcgcgttcctgtacccactcaagaggttcagttag

SEQ ID NO: 19282 - DNA, 565 bp, Glycine max
  Peptide Sequence Number=SeqID_136060
aaaagataaagaacttaggggcattcataatggcattattggtggttatcatgaatggctgaaagttcatacacgaggtttagattggctcgccaagctaaaggttgttagcgaagagagtttcgaagcaccggaagaggacgaagaagtccaagctctcaaaaacgagttaggaaaggcgagacttgccaaggagaagttcaagttagccactacagacatccggaaagagtgtgctggattacgagaagagaatgcaactgccacaagagcccttgaacaagagaccaagagggctcgtagggaagagcacggccggaacaaattccgaggggctctgtgggggtccaaaagaagtttgtttcagcggttatgcaagacagagaccaacatgttagctatcatcaccaagtaccaagaggaactaagtctagccacggcccacgagcatagagtggcggacgagtatgcccaagtgtacgcggaaaaggaggctagaggaagggccaaagcagtggcgaacacctactctgccccgaggagatccacgaacttctcagctatt

SEQ ID NO: 19283 - DNA, 231 bp, Glycine max
  Peptide Sequence Number=SeqID_136061
attgattgctcgaaagagccgtacctagctaagggaagaagctatctagccggacagagaagacagggctattgcagtggctactatggagattccttctgccaccgaaacccagacgccaaagggatgtatcctatcctctattctaagcgcgatagacgagtacccggtcaagtgaagcttgatagtcactcaaagctcaagctcgagctaaagttcaacgaatcctag

SEQ ID NO: 19284 - DNA, 444 bp, Glycine max
  Peptide Sequence Number=SeqID_136062
atgtggcaagctaggataaggaaggaggaatccatgaaacttgataggttaacacaacaaatgtctgataaaataaaagtggttcaaatgccacaatttgatgagagtcctattttgaaaagcagaaggagaatggctgagtttaatgttgaaaatggaatgaagaatttacgcatcattgttagtgatgaggataatcgtcagctcaaaatgatcaagcctcttgctaggataatggtattcaaggcaaaatttcagtgcacaaagtgggggaaaatagtagttttggtaggaatggttcagttcatattagaagggtcaactacaatggaagaaaacaagccggaatctaaggaaacatatatgatcttggaggctaatggggaaaattatatcacacaggatatcacccacgatgatccaataaagcaagagttgagatag

SEQ ID NO: 19285 - DNA, 222 bp, Glycine max
  Peptide Sequence Number=SeqID_136063
atgccacttggccatgacagtgatacattcaacatggttgtgcgccaagcttttgatgatggtcttcatgaatgcactacgactctagtccacaccatgatggtcataatcattcctcaacgtgcaaaagcatcagcgtcacaattttcggccacggtcgtgctggattttaacatgttcatggtgcgcctaattcaagtaattatccttaggaagctataa

SEQ ID NO: 19286 - DNA, 273 bp, Glycine max
  Peptide Sequence Number=SeqID_136064
atgcaatcacaggaacttgtactgcctccggagcctgaggtttgtccttcaactgctcgtgtcagcacaaaggagagttatgttgatcccttagggaacgatccagacacagactcaagtctagaatcaagagtcaagcaagttccaagaatcaaaaagtcattcaatcaaagcaattattttgatgatgccaaagactcaagtctagaatcaagagtcaagcaagttccaagaatcaaagagttgttcaatcaagaatcaagattcaagtaa

SEQ ID NO: 19287 - DNA, 546 bp, Glycine max
  Peptide Sequence Number=SeqID_136065
atgatagatctcctccagcacaagccgttgcagcccagaaacgcacactgctatatagacaatggaggctgcacgagttctgtaccaagtccgggattgaagagttatttgggtttcactcttgcctttgagaaattgtgtgcccttcataactttttcctatccatcaacatattcttttacttccttagcgtggcaagaggtctgttggtggtggttacccctgccttttgcttaagggtcgtagggatattccaattctcaaagcctttgaagaatcattcaaagattttaaagagatgtatttctggttgtgaccttcaaacgattgttgggatgaattatttgtccctgacgataatgaggaaggtaaatcatcggagaagcccttctcgtatgtctctttccttgttggcaatagttgatgcaatcctccctaggaagggaccaatcactagaaccatgagcaagaggctccaagaagattgggctagagctgctgaagaaggccctagggttctcatgaaccttagggtagatttctga

SEQ ID NO: 19288 - DNA, 228 bp, Glycine max
  Peptide Sequence Number=SeqID_136066
atggctactaccttttcttacgttgggcttccatgccgactcactttgtttcttgttttattgtcatcaaggttgggatcgtcagtgtatcttgtgatcattattaatgtagctccatgtagagctttgaaatggagaaggaggaaaggtgattggagacgtcacttcaaggaaaagattagtcaagaacaagctcaccaccataagaagtcatggataagagcttga

SEQ ID NO: 19289 - DNA, 558 bp, Glycine max
  Peptide Sequence Number=SeqID_136067
actcatcttctccttgaagtggcgtctcctctctctcttcctttctccattccgctgccattcatcttccaagaagcaaaggaatccattgatgaagaagatcctaggcctacaagctccaatggagcttgcatcaatagtgttagtggtcctcctatgtggatgtcttccgacttagagattaatcgtatcattatgtcaaaagattgggaagccttccaaaagaagggtcttgctgagttagactttgctatgttgactctggctggagtgaaggggtatctgacttatgttgcgtcagaagcttatgcacaacgaaagcaggaagaaaatgtccgccttaaggaagaaaacattcatcttaaaaaggggaaagtggctcatcttaaaggagagatggtcaatggtgagctcattcctactcttcctatggctcttggtattgtgaatgaagattttgtgttacaggagactgaagactcaaggactcgtgacgattcaatggctaatgattttatccagaccccagaaactaatgctgaccatggaacatcttga

SEQ ID NO: 19290 - DNA, 162 bp, Glycine max
  Peptide Sequence Number=SeqID_136068
atggctaggcttctactaatgctggcttgtattgaggaacaggagcaaatatttggattcaccaaaaatagatgtctattccttgaagttagaaagaaaagaatgcacctcaggaaaaatatcagcactagacaattgcaaggaaataagcaggattcttag

SEQ ID NO: 19291 - DNA, 573 bp, Glycine max
  Peptide Sequence Number=SeqID_136069
atggagaccacagagaaaaaaaaggacaaggatagaagttccatcatattctatgagtgtaagaaaccaggaaacttcaagtcagaatgtctagaccttgataagacaaatcacaagaagaggtacttcaagccaagggacaagaaagtactgatgagcacatgggaagaactggacgacacatcatctaatgaggaaacaaaagaggaagaagaagtcaacctctatatgatggcaaatattgtattagaaggatcaaactttgaatcaaatgaagagaatgaacaagggtccataagaattatggcaacttggaagcaagttggacatatgacatccaaatgtagtcatctaccaaaggctagattgtccaatgcttttagaactaaccagaaaggatccaagaaaatttgggtacctaaagagaaaataattcctgttgtagatatattcaaccacaacaagagcacaccaatcatggtacctggacagtggttgctcacatcacatgacaggagaagagcgtatgttccaatgtctgactcccatgcatggtggaacagtcacttttga

SEQ ID NO: 19292 - DNA, 405 bp, Glycine max
  Peptide Sequence Number=SeqID_136070
atggtgcgttgttggtatgctgattggtctgttcctaacatatggctttcaaatttgaaatgtccatgtgggatgactggcttggtgaatagaattcaggagcagatgcaacagaccaacaatgttcctctcaatcttaaggtgaataagcctgtgagggttaagcttggtaagttgaagctcttgaaagtcaagttgagggccacgaagatcataggactcaattatttactccctttagacccttgtccttaccctagtcactacagcatggttcagaacaccatccccacttttgaactccacaaactctcaaaccaattctatggtttgcagaatcctgctaaagtgcttgcagacttcagccccgctcagtcctcatgcattagcagcaactcctcctaa

SEQ ID NO: 19293 - DNA, 905 bp, Glycine max
  Peptide Sequence Number=SeqID_136071
tcgacgacttcaagacagagttggagaggcgtaatcttcacaaacgcctcacctacttggctgatgggactattgatcttgctttggtgaaggaattttatgttaatctctacagctctgagggtccttcaccaaagcaagctagagttagaggccacctggtgaagatagacgtagaaaaccttaacacctttttagagactcatgtagtcctagaggagggggagacattacccacctactctaggtactgcaggttgcccatagactacagagaaattgaggctactctttgcatactagggaagggtgttctctcatactccaacctggctcccacatctcacacctctgacctgacagtggacaaagctaggctgatctttggcttagtctctcgcatggacatgaacataggagtgttcatttctagccagatgaattctgtagcccagtctaactcttctagacttaggtttcctgctctgatcaccggcctatgtcgagccagaggggttgtctctgatagcctcacttttgagcgcccaagtccggtcattaatttggcctacatcaggaagaactgttggaatcttgatgatatgacagtttttatccgagggactaggagggcgaggccaactgatcttccttccacatctgcagcttctactccagcatccacttcagcagctccttcagtcccaactcagatggattctcagtactttgaagccatgcttcagagcattcataaggggcaaatcaatttacttcagagtttacaggtggtggtgcctccaggatccattccttccattgagcagtttttggagagggatgcatcatctgaggtcactattccagagccattcattgtagaggaggaggcaggtgagacacag

SEQ ID NO: 19294 - DNA, 1017 bp, Glycine max
  Peptide Sequence Number=SeqID_136072
tatgaacatactcgaactacgtccattgaggtggagttactacctcatattgtttgtggatgggttctatatacggccggtggacgatgtcttgcttagggtaatggttctgttgattcctggtaccgagaacatggatgtgttaattggagagagaggcttcttggtctgcagaggtagtggactagatggctatggaatgggagtgggacttgcgtccaactcttgtcttcctcttcttttccaaagaagaggggatcatatgttggtcagtcctttgttggacgatagggtcttatttttgcttccttgggatgataagagggttgttttgcctttgactcttcctgactggagtagtcaatggacaagtccgttaggactatattggataggagggtttagacttctcatgtcctttcttggtctgtttctccttggacacaatttcttgttcttattcttgttgggcttgctttcttgtctgaaccaagccctgctgctctctaagaatcctttgaacctttttagcgagtccaaagatctccaaagctttgtcttcatcagccactgttctggccagtttcttctgcctcctttgttgaatatcatcttgatcaacaagagggacaagagacaaagccaaaaggaagagcaaaatggtcttttcatgaaggtttctgactctaaattcgcccaggctagatctagctcgcttgggctaagatgtaacttcaaccctaagcaagcaactcgcctgggcaagtcgatgccttcaccattaagccacaattcgcttgggcgagctacagcttgcctgggcgaatttccctgcactccttggttgttttctataaatagccatgcatggttgaagagaaaaatagtccagcagtctaaaaccatagagaaaacacataagaagaaggagaagaggaaaagtggagccgaggcgttgcatggagccgaggcgttgcagagttgtgaccatggatcacttccttcgttatttctctt

SEQ ID NO: 19295 - DNA, 735 bp, Glycine max
  Peptide Sequence Number=SeqID_136073
atgacacttttacctctgagcaaattcagaattccagtgaaattacaattcaaattcatcttcaagcttcaaggcctctgcggcagcctcttcctcttcgtcatcgatgacaaaatacggattgtgagcctctggcttgaacttgtagccagtaaagaaatagaaagcaagggtggccaactcagcagcaaccacactggtccaagaataacgataggaggtaatagtctccaaggcataaacgacaaccctggtgaagtaaatgtaacagataacgacgacatagtagtgcctgaagagagtaagcttcatcaaattaacagcggccttgccgtcggtcctagcggcctcacggaggttcttgatggaccagacaatggggaaaagcacagcgcagcaacagacgacgtcaacaaggaggaagacctgtttccaggtagcccagtcatggccgtagggcccattctcgtcaataacgacctgagcaatgttggcaatgacttgaagggggatgacaacgatgagaacctttttttccttatcctgaaggaagggtttgaggaaggaccagccagtgccaatcaagacaatgagagtgaagagcgagatgcccttgaggaagctgaaaatgtaaaagatgatatcccaaccgtgggcgcttccggtgcgcttgatgtaggatttgtcctcggcctcgcacaagagattcagggctttcaagataaccacggctag

SEQ ID NO: 19296 - DNA, 138 bp, Glycine max
  Peptide Sequence Number=SeqID_136074
atggagagggattttggccattttctcgaagagcttctgtatgtgagagattctagagagagaaggagaatagagcttgaagaggaagtcgtcctgagagctggagatgagtttgtgagtgattgtgaggttctagag

SEQ ID NO: 19297 - DNA, 2661 bp, Glycine max
  Peptide Sequence Number=SeqID_136075
atggctgaggctgtactggaagttgcacttggaaatttgagctctctgattggaaaagagcttgaactctatctgggttttgatcatgacttggaaaggcttgctagcttactcactaccattaaggctacgcttgaagatgccgaggagaaacaattctcagacagagccataaaggattggctgcaaaagctgaaagatgcagctcacatccttgatgaaatcttggatgagtatgccactgaagcattgaagttggaataccatgaaatcaagtgtggtctatcaaacaaggtacaaagttcttgcttatccgcttttcatcccaaccatgttgttttccgttacaaaattgctaagaaaatgaaaaggataagtgagagattagaaagaattgctgaagaaaggattaagtttcatttgactgagatggtttcagagagaagtggaatcattgagtggcgccaaaccagctcattcatcactgaaccacaggtctatggaagagaagaagatacggataaaattgtagactttttgattggtgatgcttctcatttagaggatttatcagtctatccaattgtaggtctgagcggacttggaaagacaacacttgcccaactcatcttcaattgtgagagggtagtcaaccactttgagctaagaatttgggtatgtgtttcggaagacttcagtttgaagagaatgacaaaagctattattgaagcaacaactgggcatgcctctgaagatttggatctagagccgctgcaaagaagacttcaagatctgcttcaaagaaaaagatatttgcttgttttggatgatgtgtgggatgaagtgcaagagaattggcagaggttgaaatctgtattggcttgtggggcaaagggtgcttctattcttgtcaccactcgtcttccaaaggttgcagcaatcatgggaacaatgcctcctcatgagttatcaatgctctctgataatgattgctgggaattgtttaaacatcgagcttttggaccaaatgaggtagaacaagtggagcttgtgatcatagggaaagagatagtaaagaagtgtaggggagtgcctctagcagcaaaagcactaggaggtcttttacgcttcaaaagagatgaaaaagagtggatctatgttaaggaaagcaatctatggagtttaccaaacaatgagaactctgtaatgcctgcgttgagattaagttacttgaatttgccaataaaacttagacaatgttttgcttattgtgcaatatttcccaaagatgaaataataaagaagcaatatttgattgaactatggatggctaatggattcatttcatctaatgaaatattagatgctgaagatgttggtgatggtgtgtggaatgaattatattggagatcattttttcaagatattgagaaagatgaatttgacaaagttacaagtttcaagatgcatgatcttgttcatgatcttgctcaatttgttgcggaagaggtttgttgcattacaaatgacaatggtgtaacaactttgtccaaaagaagtcaccatctctcatattataggtggttatcatctgagcgagccgattcaatccagatgcatcaagtcaaatctctgaggacctatatattgcaacctttgcttgatattcgtcgaacttggcctctggcctatactgatgaactttctcctcatgtattgaaatgttattctttgcgtgtgcttcattgtgaacgaagaggaaaattgtcgtcatcaattggtcatttaaaacatctaagatacttaaatctttctaggggtggcttcaaaactcttccagaatcgttatgtaaattgtggaatttacagatattgaagttagactattgtgtatatctccaaaatttgcccaacaatttgacaagcttaacagctctacaacagctatctttgaatgactgcttctcaatatcaagcttgcctcctcagatagggaagttgacttccctaaggaatctaagcatgtgcattgttggcaaggaaagaggattccttttagaagagctgggaccactaaaacttaaaggagatcttcacatcaagcatctagaaagagtaaaaagtgtaagcgatgccaaagaagccaatatgtcaagtaagaaactaaacgagttgtggttgtcatgggatagaaatgaagtgtgtgaattacaagaaaatgttgaggagattcttgaagtccttcaacctgatatccaacaacttcaaagtttgggtgtggtacgatataaaggttcacatttcccacaatggatgtctagtccttctctcaagcaattggcgattggcagatgcagagaagtgaaatgtttgcaggaggttttacaacatatgacttccctgcactcgttacaattatacaatcttccaaaactagaatccttgcctgattgctttggaaaccttaccttgcttcgtcatttaagtattaaaaattgtcccaagttgatgtgtcttccaacgagcctaagccttagcagtctgaaaagtttgactatctatggttgccctgagttagagaagcgatgtgagaaggaaataggagaggactggccaaaaatagctcacattctccaaattgacttttataattggcagtga

SEQ ID NO: 19298 - DNA, 852 bp, Glycine max
  Peptide Sequence Number=SeqID_136076
atgagttgggttttgaaggttccgttccgatcaaaggattccactgcatgcggtggtctgacggcaagcagtgacaactcatggtggtcgtgggtcgaggaggagatgggtttagggccaggggagaagaaggctccaagaactcctcaacaagatggagttgtggagaggaaaaatagatctcttgaggaaccagcaagaaccatgttaaacataaaccacctgcctaggtatttttgggcggatgcggaagcccaagggaagtttctctcagaagtgaagaggtggaataaagaaagcctagtagccaagggctataaccaacaagaggatataaactttggtgaaacctatgcaccagtagctaaattagaagctataagattactgcttgcttatgcttgtgttgtggatttcaagatcataaaaatccaaatcatgtatacaagcttaagaaagctctttgtggacttaaacaagcttcaaggcaacgacatgagagacttagcaactttcttcttgaacaaaagtttgagagagcaattggatcatggaacttttctttgtcaaacaaagtactacaagaaacttcttaaaaagtttaagatggacaaaagtaatgaggttgcaactcctatggctacaaactgctaccttagtgctgatgaaaaaggaaaatccattgatcaaacaaggtatcaagctatcactaattccttactttacttgattgctagtagaccaggcattatgtttagtgtttgcatgtgttcacgctatcagtctagtcttaaggagtcttacctcttaactattaagatgatcatgaaataccttaaaggaaaacattag

SEQ ID NO: 19299 - DNA, 543 bp, Glycine max
  Peptide Sequence Number=SeqID_136077
atggcatctactctcttcgcttgcccgtcgttgtgttcctcctcttcttctatattttctacttccgtcaaattctccttaaacccgaataaaatttctcttccgttcgccggaaacaaaaaacctctttcagctccaattcgaaggcggttcaatgtcattgctatggctccccctaaacccggtgggaaggccaagaaagctgggaaggctacacctgctcctcccgttggccctgctcttggttccaagggtgtcaatattatggctttctgtaaggattacaacgctagaaccgccgacaagcccggttatgtcattcctgtggaaattacagtctacgacggttcaaaagaccccaaggcggaaaaggtaggaaaggtcacgattgatcaattgcgtacaagtgctgctgaaaagctaccggacttgaattgctcgagtatcgaatcagctatgagaattatagcgggcactgcggcaaatatggggattgtggttgatcctcctgttcttgaacccaaacagaaggaatttgtgtag

SEQ ID NO: 19300 - DNA, 1172 bp, Glycine max
  Peptide Sequence Number=SeqID_136078
atggcagaaaccaaaagcaagaggatgaagagcattgggcacaaacctataaccctaaaaccaagcttgaagaaggagaaggaaacaataaagagtcactcttccagcaagggcaagaggataacaaagtctccatcaccactaccctcttcaaagtctcaaggatttttctttccagaactccttgagtaccatgggttcaagaagcttgtggagatgaagggcacttactaccctggctttgtaagattcatctatactacaactaacattgatggtgacactggttatctatgtgccaaggttgttggtttgtcatctgaagggacgatggtaaatgatagaggaatgaaagatgttggtgtgactttcaacaaaatcaccaagtacaagaatctgatgaaggacccctccacttacactgctattatgtccaaaggcaagggcaaagagagatttggtatatgcctcttgttcctagaacacagacttctagcttgtgtgctcacttggatcattactcctatgtaccaactagagccactgccacagttaaggctagctactgataggatcattggacctccatttgaaagaggtctagttgatttgtcctatcttcaatcttatggggaccattgtgtaggcaatgcttggatccatcatgagttgaagcttgttagccatggtgccctggtgctaccactccttactcatctagaagagacattttccttccatctgcctgttagagagatgaccattactctagatgatgtgtcttgtttgctacactttcctgtgacaagtagacccattgatcatatcccctcactctttgacagagaagtagtgaagatcctgcggatgactcatctgagcattccaatagagacaaaggcttcagcggtggcaaatacatgtgttagggtgaggttgacggagagactagatgacctacaaatggatgttatcgtgtggtgcccatatgaggaccataaagatataaggcctttcacacaacaaacccatttctctggcttcaccagatgcaagactgacgtgaggccttatcatctagagaatgcagagtggcagaaaaatatcattcctcttggcgatgttgtgccacctaggggtccttggccttgcacctatgactatcttccttg

SEQ ID NO: 19301 - DNA, 237 bp, Glycine max
  Peptide Sequence Number=SeqID_136079
atggaggtgccgacaggtgctggaactgatggtgaaggaagagctaaagtagagggagctggagtagaggtagaagcaggagtagaggaaggaggagcagctgaatcaggtcccctagccttagacttggctaaggactcaaaagtcaaagaattagatactacccctctggcgatgcataaggctatgataagagctgggaagctaagcttggaggagctggactgggccatctaa

SEQ ID NO: 19302 - DNA, 198 bp, Glycine max
  Peptide Sequence Number=SeqID_136080
atggctagttgggatctcttaatagattggagctctaaagtctatataaagcttgaagatgctcatgttaaggttgtcaaatcacaagagagaacaatcttagacaaaatgaacaaagagaggcttagtgacaaagaatattggggttataatcttagggggagattaagggtaatgccaaagtggcctagagagtag

SEQ ID NO: 19303 - DNA, 378 bp, Glycine max
  Peptide Sequence Number=SeqID_136081
atgagggagacacatgaagtacctcgagaccacactttagccgacttcgagcctcacctcggatatgtgccactgaggggctggcattttgtggtgtacccctaccaaacactttggggggcctcagtatcacccataaccataacctttgcattttgcaaagaaaggttgagagccattgaaggaggcggagattatgctgttgctgacatggtagagctattcctagtgcccaacattgtcattcctcagaagttcaaggtgccagattttgacaagtacaaggggactacttgccccaagaatcacctgaatatgtactgtaggaaaatgggggcatacgcgaaagatgacatttttttgatgcatttcttctag

SEQ ID NO: 19304 - DNA, 246 bp, Glycine max
  Peptide Sequence Number=SeqID_136082
atgtctcggctggaagacgctaacatctccaggaaaggtgcagatgacgacgcgcagatgatgacgttagtcactgcatgcaatcgggctttgagtcttacggatagcaaaatgagactttttcgcagtctcggccagaagacgctgacatctccagggaagtcggaagacgctgacatcttcggggaaggtgcagatgacgacgttagtcactgcatgctatcgggctttgagtcttacggatag

SEQ ID NO: 19305 - DNA, 1321 bp, Glycine max
  Peptide Sequence Number=SeqID_136083
gcgtttggcgaactgctgcgcagccagccgcaggtcactctcgttaagctggccgggctggcgcgcggcggcggcgccgagtttgtggcggcggccgatatggctttcgctgcacgggaaacggcgggactggcccagtgcgaggccttgatgggcattacgcccggtggcggcgcgacgcagtatctgacgagccgaatgacgcgcggccgcgctctggaagtgatcctgggcgccgagcttttcgatgccgctactgcagagcgttatggctggattaaccgtgccttgccagccgccgagctcgatgatttcgtcgatctgttagcgcgcaatatcgcggcattgccagagggcgtgattgcggcggctaaacaggcgatgcctgtaccggatctgcaggccggtttttatcgcgagcacgacgcctgggcgggattgccggtgcgcaaaccccggagggggagcgcaaccttgaaggcctgctgcggcatcttgcccgctaaggcaccgcctcgcgctagcccgccccccactgcgtcagcagcgcatgcagcctggccggctccagcggtttgcgcagcaccagatagccttcctgctcggcctcttgcaatatctgcgttcgaacagcgctttcaggatgtcgaaaccgctctcgccggaacgcaggcgctggtcgcacagcacggcgaacggcgtaaaaccgtcgtcgacgatggcgaaggcttcctcggcggaggccgcgcagcgcacggtgatgccccaggtgctcatcaggctctcccaggcggaggtcaccaaaggatcgtcgtccaccaccaggcaggcgccgcgcagcggcgcatagcgggtaggcgtggcggtgttgtcgtaggcggccgcggtttccggcgctttgtcttcgccgatgtattgcgtgaagcgcatccagaagcgcgaacctttgccttcgacggagtgcatgccgtacttcaccttcatcagcttggcgcagcgcgccaccaccgccagccccagcccgtggccggcgctgtcgattttccacgccagctcggggcggtagtaaggggagaagattttgcttttctcttcgtcggcgatgcccacgccggtgtcccacacttccaccaggcactcggcgccgcgcgggcggatagcgatcagcacgccgccccgttgcgtgtagcgcagggcgttttggatcaggttgatcaacgattgccgcaccagcagcgggtcgcccatcacgctgatgcgccgtttaggccgccaggtgcgcagcgccagggcgcggctgttggcctcttcgcggaacagg

SEQ ID NO: 19306 - DNA, 468 bp, Glycine max
  Peptide Sequence Number=SeqID_136084
atgactcaagagctggtagcccgcggagacaccttacggttatccgcacctcgtcattcagtgaccccaagtgtgattgacgagcagagaccaatatggtcatctgcgccctttccggagatgtcatcattttccgatggagacttttcaagtctcacaagttatccagaactacaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttatccgcacccttgtgtcatccagaggcggcgggcccgatgatacgcggaaatacccgagtggttatccgtataaacattcttttgctatctgtaagacagaacgcgtgatagcatgcagagactga

SEQ ID NO: 19307 - DNA, 504 bp, Glycine max
  Peptide Sequence Number=SeqID_136085
atggttattatattgacacatgccagaataaaagatgcgcagggaagttatccagcttcagtgagcaattccttcaaggcgtcaaaactattgattaatgatcctatattggaaattcaggaatttaaagagaggcttttagatttaggctttgaggtgagtccagttttactacctggcgatcaagcaagttcacaagttttagggggaagccagctatcatcaaaggattcgtttctttcaaaagctgaagtcaaatctatttctaagatcaatgacatttttgaggatgttgtttgtgttacggtgggcattattagcaaaatagtcatggataaccattcatggtgttatccagcttgccttcagtgtcataggaaaactgacatccaaacaggaccattcacatgcggatgtggcaaggataatgatcagcctgttctgaggtatagagttgaagtaatggttacccaaaacaatgagagtagcaagtttttgctctag

SEQ ID NO: 19308 - DNA, 360 bp, Glycine max
  Peptide Sequence Number=SeqID_136086
atgggtgagatatgtgttttgtctagacaatgtgtagcagactacatagagtggttctacatgatttcttatctcttcatgaatccaacacaacctggggatccacctaggcatccatttgtcgtgcacaatgacatatttgttgaaccagatattcctcagcactcggtggcggcaacaactatggacgaagcacctgcttactgtctaaaaggttggaacggttacataaggatagtgactaaaggtaaagaagcatacaatgtcatggaagactgtttaaggatcgccagaggtgtgactgcggatcgcaatgtatatgtgcggtcacgacgaaggtggcgtatggaagatgcatga

SEQ ID NO: 19309 - DNA, 456 bp, Glycine max
  Peptide Sequence Number=SeqID_136087
atggtggaaaaagacccatcattgaaagttgtcatgattcaggagacaatttgcagcaaatatccatacatactatcttataggaaggcatggaaagcaaaacaaaaggcaatagttcgtgtttttggtgattgggatgagtcattttccattcttcctaaatttttgaaatttatccaaggtgtctcagagcctttgatacaagtggatagagcacatttatatgggaagtatcatggaactttacttattgcaaccacacaagataggaataacaatgttcttccttatgcatttgccattgtagaaagtgagacattattggcatggaaatgcaaaaaattcaacaagaagaatgctctcatattctatgtcgatatgacatcgaaagaacaaggtgttagagatagggggagcaacaacatgagcatggagcaacctaaggctaaagcttga

SEQ ID NO: 19310 - DNA, 564 bp, Glycine max
  Peptide Sequence Number=SeqID_136088
atggaggggccgattagcactgtgatcattggaggggctggatcaggtgcaggtgctagtgtagaagcaggagtagaggtggaagcgtcagaagggctcaaggactcaaatgtcagcgaatctgggacaactcctcgggtaatgcatagagcagtgataactgccagaaatctgagcctggaggagttggattgggccatctatgagatctgtccagaaatgatggagctcaagtccatgttggattatgataatacactccaggtctgggcaagggttgtgaggtccttcctcagaagcttccaaggcatgcccttagcattcaaaacaaatcctcgccttgggatgcagagtttcgaagcaagctcctatgggtctggatgtgtatggcagaatctggagtatgtggagtaccactcctctggctccaaaaccacggggactcgcttagcccaggcttattcaaactcagaggcatggtggcttagagagactggttcgcttagccgtaaccacaataccaaaagcctctatgacactgacctaactaagcttacttgctaa

SEQ ID NO: 19311 - DNA, 315 bp, Glycine max
  Peptide Sequence Number=SeqID_136089
atgtctcccccaaatttgggacaaatttgtcttgaacctagcttttctatggataatgctctcctacaacctaagacaagatccaacaccggagcagctgatgagtcctacagaatgagctgctttggctctggtgttggattagatggctggtgtggaagcaatgtcttccaagattattttgatgatgccaaagaatcaagagttaagagaattccaaagattcaagatacaagattcaagaatcaagtttcaagaatcaagattcaagattcaagatcaagattcaagaatcaagaatcaagagaagactga

SEQ ID NO: 19312 - DNA, 153 bp, Glycine max
  Peptide Sequence Number=SeqID_136090
atggaggatttcatggcccaggtggcttggctaggagtccagccttctcccatggggggagatatgacaacagtgcaggacacttgggatccctggcctagcccagcacaggacacacccttgtgttggatcaagtggcctcagaataattaa

SEQ ID NO: 19313 - DNA, 330 bp, Glycine max
  Peptide Sequence Number=SeqID_136091
atgagagaacgaataccatcaagtactaatttttgcatgaatcccttgtcacgacctgccctccggcgggggcatgaaaaggcctctcggatgcgccaagggtgcgtcttctttcgaaggaaaacgcgtggagtcgccaccaacgtttattcggggaaaacattggaaaaaccaaaagacgatggtctacgtattttgaaaatgaaggttcaggagttgtttacgcactggaaggcgttggaccttgaacgatctcttttggggtcgataaaagcgagacttccgctcctacgtatcctcaattgcgatgaggaactcagacctatgtag

SEQ ID NO: 19314 - DNA, 231 bp, Glycine max
  Peptide Sequence Number=SeqID_136092
gtgtcacttcagtggaggtaaaagtgttatgggtcggtggtgattgttgcgtcggttggttcgtcgttggaggtacaccaactcgatcaattgctcatgaaaatggatttgtggcgatgattatgaggtctgacacaaaaattggtattagaggaatgacttcatatactaggtgtaggaaatgtgggtgtcctttcaagctttgtgggaaaccagtggttggtgggccag

SEQ ID NO: 19315 - DNA, 5490 bp, Glycine max
  Peptide Sequence Number=SeqID_136093
atgccgccaatgaagtttgtggtgaagaaggcatggagcagtggtggatgtggtcgggtaggagcactagagatgggaagctgcccgggacccatagagacacccgctcttctcctatctactcgtaaagggcttcctcactttatctcccctgacctactcacttctctcccttcccccgattcccatctccttcaaatttctccactccactttttggaaggacttgcttcaaccactatatcaaaattaggagggcttcaccaaatgcttggtttgcaccaatatggaatggcggctgtagccagggattccattcaatgccttcctgagtctaagggagctaccaaactcggagcctcttttgaaactccttgtggtcgtctgttgattaaacccaaagattatgttgaaatgatttcatgcatgaggcctaatatatgggccactttggctgatgaagtacctgcttgggtgactgataaaaggaacaaaacctcagtagacagaactgtgcgatggcttgatgactgccttgcattaaatccggtagttggatcagtctttggtgccattgttggaggcacgaatttggatgaaaggaagcgatgtgcagaggaggtagccaagcgaaatgtatcagggctcttgatcttgggggctttgtttttgctgcatagttttggtgccactgtttgctttcactgctgcttattgggtgatagggatgtagactttgatgtgggtcctaagcctaaggtgtggagggtatatcagagaaagcgcgtgagaggagagaaggaaggtcagtggggtcacctcatcattggtgattacagggagagtctgcgtgctcttggggaattggtagtgaaacctacaatgggtgatcggctggacgctttggaaacacaaatgggagatgtaacaacaacattgcaagcgctggctcaacagatgcaacaacacgctcaacagatgcagcaacagagtttggttttaactgaactaagcaaacagatcggtcagaaggcgacggagacacagaaaagtgagcgttcagtagaagatcatgtgaatggcgaatctcgccttgctgggaagaaggtgaaattaccagtgtttgaaggcgatgatccagtcgcatggatcacgcgtgcagagatctattttgatgttcaaaacacggcggatgagatgcgtgtcaaacttgcacgtctgaacatggaaggttcaaccatccattggtttaatcttctattggagacagaggactatttgacgtgggagaagctaaagaaggcgttaattgctcgttacggtggtcgtcggttggagaacccgtttgaagaactgtcaaatctacgtcagattgggagtgtggaggagtttgtggaatcattcgaattactttcttcgcaggtggggaggttaccggaagaacagtatttgggttacttcatgagtggattgaaaccacaaattcggaggcgtgttcgcactctgaacccagtgacgagaatgcagatgatgcgtatggcgaaggacgtagaagatgaactgagagaagacgatgatgaaggagagagaagttacggaaggaagcagggtgtagatagagtaggccgaaatgattgggccgggtcttcacaaagacagcggagcgggtccagtttcaacccgaaagaaacaaaccgatccacaaatacgggttggaataacccaactatgaaatcgggtttgatggggtcaaatcaaaattcgtcgccgtcaatgctttcgacgggtcgaaaaggtgatacagagcgtcgtggagggtcgactgaccgatggaagggagttagaagtatccacaatgatgaaatggctgagaggagagcgaagggattgtgtttcaaatgcggtggaaagtatcacccaacgttacacaaatgcccagaaagagcaatgaggctattgattctaggagagggagagagcttgaacgaggaaggagagattgtgtccttggaagctgaggaatctgtagatggagaggaagaggttgacgctgtatgcaacgtaattggagtcttgggtagtatgggagaatatagaactatgaagatcggagggaaattagaaaatgtggatgtggtggtgctgatagacagtggagctagtcacaattttatttcaccaaagttaaccactgctctagggttatctgtgactcccattgttgaaaggaagataaagttaggtgatggccataaggtaagctctcaaggggtctgtgaaggaatcaaattggtgttaggggcattagaagtgagtgttgatgctttggttttggacttgggaggacttgatgtggtattgggagtatcttggctgtgtactttagggaaggtaatgatggattggaaaaatctgacaatgcagttttggcatcaagggaaaacaattgtgttacaaggacaaggagaaaaccaagagagacaatgtttcttaaattctttcttggaggacagacaggggcgtgtgggtgaagaatggtggttgtcttctcaaagacagaaagttggaggtaaggaaatgatggatgaaggattgaaagaagtcttgagcaagttcactgaagtattccaggacagcattaggttgccacctaggaggtctcagtcacatcagattaaactttttcctgaccatggacctgtgaatgtgagaccctacagatatccccaccaccaaaaagaagaaattgaaagacaagtcaaagaactattggaagcaggagtaatcagacagagtatgagtgctttttccagtcctgtcatattggtaaaaaagaaagataatagctggaggatgtgtgtggactacagggccttaaataaagccacaataccagataagtaccctattcccattgttgatgagctacttgatgagttgtttggggccactattttttctaaaatagatttaaaatccgggtaccatcagattagagtgcatgaggaggatgtccataaaacggcttttagaacacacaatgggcattacgaatatcttgtgatgccatttgggcttatgaacgcaccagctacatttcagtcaactatgaatgatatttttagacctttcttgagaaaatttgtgttggtcttttttgatgacatattaatctatagccaaaatatgttggatcattataatcatttggaacaagtcttggctgttttagtttcaaactgttttgtggccaatcaagctaaatgtaagtttggttatgagcaagtggattatctgggccacatcatatcgggtaagggtgtggcagttgacccagagaaggtgaagtgtattcgtgactggcctcctcccaaaaatgtcaaaggggtgcgtgggtttttaggtctcactggttattaccggaaatttattaaggattatggaaaggtcgcaaaacccttaactgaattgactaagaaggataattttttgtggggaaaagaagcaactgaagcttttgaaaatctcaaagacattatgacaacctcaccggtccttgtacttcctaattttgctttaccctttgaagtggaatgtgatgctgcaggcaggggtataggagcagttttgatgcaaaatagacaacctatagctttttttagcaaggctttgtctgcaggtaatttggctaaatccgtctacgagaaggagctgatggcactggtcttatctatccaacactggaggcattatcttctgggcaaacaatttgtggtgtacactgaccacaaaagtttaaagcactttttgcaacagagggtaacttcaccagatcaacaatgctgggtagctaagttactgggctaccaatttgaggtcaagtacaaacccggcctagaaaataaagctgctgatgctttgtccagatgtcatggggaggtggaaatgaatgtcttagtgtcctctcctacatggctagaagggcagaagttattgcaggagatagcacaggatacgcagatccaaaagatgattgttgagttgactgccaaacctgatgctaaaccaggattttctgtgcagcagggagtgttattctaccagggaaggttagtaatacctgctgattcaccttctattcctgtgttacttgaagagttccatagtacacctatgggaggtcattctgggtttcttaggacctacagaaggcttgcagcaaacatatattggactggaatgcagaagcggattagagactttgtgagagcatgtgatgtctgtcaacggcaaaaatatgctgctactacgcctgggggtctacttcaacccttacctattcccaatgcaatttgggaagatttatcgattgatttcatcacaggattgcctaagtcaagagggtttgaagctgtgttagtggtggtggacaggttgtccaaatatagccatttcatcttgctgaagcatccttatacagcaaaatctgtggctgagttatttgttaaagagggcacacaactcaaaatgagttctgcgtatcaccctgagactgatggtcagacagaggtgataaatcgttgtttggagagctacttaagatgctttgcttcggaacagcctaaggcttgggcacactggattccttgggccgagttctggtataacactacttatcatgagtccattggtaaatccccttttgaggtcgtatatgggaggccacctcctgctctgaccagatttttgagtaatgaaacgaaagtagctgctgtggctctagaattaactgagagagatgaagcgttaaatcagttaaagctgcatttactaaaggctcaacaacagatgaaagcttatgcagatagaaaaaggagagatttgcactttgagattggggagtgggttttcttgaagctgagaccacatagacaacaatctgttgtgaaacgaattaatcaaaaattggcagctcgtttttatggaccttttcaggtgattgctaaagtgggagaggttgcttataagctaaaactgccagaccagtccagaatacacccagtgtttcatgtgtctgtgctcaagaaggctgtgggtaattaccaagtacagggtgaacttcctagagagcttgagattaatttggaagaagatatctatcctgataaaattctggggtctaggattacattgcaagatggagtggccattcctcagagcttagttcagtggaagaacaagacagtggatgatgtaacttgggaggatgatttttttttgaagggccagtttcctgattttagccttgaggacaaggcaatctttaaggagggaggtattgatagggatgtagactttgatgtgggtcctaagcctaaggtgtggagggtatatcagagaaagcgcgtgagaggagagaaggaaggtcagtggggtcacctcatcattggtgattacagggagagtctgcgtgctcttgggaattggtag

SEQ ID NO: 19316 - DNA, 564 bp, Glycine max
  Peptide Sequence Number=SeqID_136094
atgactgcactaggaggagcgacttctcatcatcggccaaaccctagaagattgcaattgtccaatgctgagcttgtcgctcccatctccgatgtgtgtgtgccaagcattattctccagcgagatccactcattgacgatgccacaaaaaactcattagcgactcctttgtccgtttcaggggttggtttccccaaagatggttgttcaatattgcttgctgcaaatttgtacctacgtgatcctgttaccctaaacctgtcatggcaaaagaaaagaccatttcttgactgcttgagccttcatgcggtcttgagctctcagcaaattagctctcagctcttgcaaaatagcatctctgtcttcaagccattgttaacttcttccacctctgatgttggcagtaatcccttaaagataaaaggttattggattggaggatttggtcttggagagggcattgatgagcgacctgctcttctaagtgctattatatattgtaatctgaataaggtggatgcctcagatggcactctgttattagcaaatttgactacagaataa

SEQ ID NO: 19317 - DNA, 1182 bp, Glycine max
  Peptide Sequence Number=SeqID_136095
atggttagaactagagggttaggtcgtggcttaggtagggttatagcatctgcacgtaagcaatgggaagttgtccctgttgctaaggatgatcctatggtgactaaagacgtacatgcatatgttgaagaaactggagatgatgttgagggattttcaagtgagtcgtgtgacccatcaatgctgactaactatggtgaccatgttgcattcattgtatggaatggaaaggaacgtcctgaattgaagttatcctcccatggaaggaaggttcagaaatttgggaggcctgctccaaaaattgaagggctagttgctgccacaagattaagtcctttgatcgcatgttcagtaaacactggcgatcggggacttatattcacttttgtggagaggtggcataagaaaactagcaattttcatctttctattggagagctgaccattaccctggatgatgtggcgtctctgtttcatcttacaattataagcgcattccacgactttgaatctctgtatgtcaacgaagcggtcttgatgttggtggagttacttgaagtctccagagaggaagctagagctgagacaacacaatacttgagtcagagtgaaagctatgcatggggagttgccgccctagttcatatgtatgatcatttgaatgatgcatggttacatcaccctattaaatgttggatatatgagcattttccctctgtttctgagtgtttgaatgatctagactatgatgagatctcaccacatgcctaccgatggattgctacgaaggcttcttcgaagtcattatcagcatcgacgtaccggaaacatctagatggactgacaattgctgatgtttgttggatgccttacagtgagcattatggagtcatctacaatgggtctcgttgtcatcaaacaccaaccagagaaggtggtgcagaaatttggatatgttcagaccattcctccacagactacgagttccatgttccatttgaagatattgatgacaagtggatgcattactctgactatcctacagtagcggggcagctttgtgttgtgccaagacaatgtgcatccgataacatgatgacacatatgtgggagccacatatccctgaggtcccagtggcaccagcagcaccaccggcacatgtcccttctgatgtggagtag

SEQ ID NO: 19318 - DNA, 228 bp, Glycine max
  Peptide Sequence Number=SeqID_136096
atggcgttggagttggaattggaattggaattgcaaggaaaccttttctttaaggttgtaggaggagaagggaagaggttgttgaggttgaagagaggaggtggtgtatgtaagggagtgagttggggagagtggggagtgagatatgggagtatatatagtggggggaggagggaggaagggatggaggttgaagtgagacatgtaggaggaggagaccacgtgtag

SEQ ID NO: 19319 - DNA, 489 bp, Glycine max
  Peptide Sequence Number=SeqID_136097
atggaaaaccacgaaggtcaaatcggggcttcattctcaaccaaaaccgcgagccaagttggaagattccgctctgatggaaaggttcctttcggtgtgggttttcaatggagaactatggtggttcgtggtggctactggtggctgtgggtggtgaggaagaagcttgggatgttggaaatgctcttggggaagaggaagagaaagaaatggcatttttccaaggctacacgaaatacaaaggctaaaacactcaagtgcttttgctctcggaaaaggaagcgtttctcacactctagatgtcgtatcgaagttcacaacggtcagatcacggacatctgtccattgaaccaccacaccgaatttcgagaaaatccaacggttaaagaatgtaggagggcacttttaccgagacaacttcaggtagcttccttgagaagcttttctcgagaggcttccttgagaagcttcctcgtgaggcttctttga

SEQ ID NO: 19320 - DNA, 249 bp, Glycine max
  Peptide Sequence Number=SeqID_136098
atggagagaattcaaattctaagttggcatcagagccagctcctccggctgccgtccaccaccactgccgctgccaaattttctggcgagaccaaaatggctgcttctggcccggttttctccttttctggaacgcccactatcactactgcaaaactcaactggaaaaattacctatcttggtcagcttcagtggaattgtggtttcttagccaaggacattatgaccacttgggtgggatcctctag

SEQ ID NO: 19321 - DNA, 966 bp, Glycine max
  Peptide Sequence Number=SeqID_136099
atgaccgcttcttcaaacttgactcaaggaagcaaccttccaaatgttgttgctgctactgtacttttggagttcaatggaaagagatttgccccttctccaagccctagaagcaaagacaaagaagctttgggagacttagccttcattgatgcggctaatagccttcatcaaaaggaaccaataactagtctttcaggaccattttggtttacaaagctatggctcaatttgatcttcaggaagcatttgaggcaagatgctagattttcacttgccctagagcttgaaggtgcaagattggtttattatacctcaacaggaaaacctttagaacaaagcttcaggaaatatattaaagtgcttatgaagatgattgattttactaaagatctagcaccagtcgtccaccttttgattgctcgacctgaatgtttgaagaagacttttcttattgaaactccagtgcctaagaaaatttcagaggatgatgatgcttcaaatgatgaaagtggtgataaagaaccaaaacaaggcaaaggcaagaaagtgaagcttcctaaaaagaccaagagtagcactatgactaagctagttaatcctcccttgaaacttgatcaaggaaaggaatgtaaagttgagaacatcaaaacttctaaagaaaaagtctctgaagattctatgagtatacccaaggatggaagtgtagtgaacatttcttcttctcaagagcaagaggttgagagtgatcaagataggaatcccatcaatcccattgcagaagatctcatggaaaatatggtcgaagtagaaatagaaaatatgattaatgtggatccttcaccaacaacagaaattgaattggatgaagctagttgttatctatgtttgagaaattttccaagttatgagaaattgagttcgttttctatgaggacatttcgatggggaagtgtgtgcatctaa

SEQ ID NO: 19322 - DNA, 246 bp, Glycine max
  Peptide Sequence Number=SeqID_136100
atggagagcctagcctttcaacaaggtggggaagactcgtcacaacacgacatcgtttgtggtgtacaggctaacttgcgtgatgtagacatctgggtgtttgtttggtttactggtgtcattgtacgtttcaatggtcatgcttttccaattgggaggcaaggtagcctccatgatgtcggggacgaaaggattcttgtactgttgtgttgggtatccgacttgacactgacatttgtggcttag

SEQ ID NO: 19323 - DNA, 372 bp, Glycine max
  Peptide Sequence Number=SeqID_136101
atgagttctttcggaagaaccttcttctggagaagctaccggaagaaggttcttccagaagaactcattgttctaccagaagacccttcttccagaaaagctaccggaagaagaagaaccttcttccgaacaagctaccagaagaaggttcttccggaagaaaaagttattcttcaagaagaaccttcttccagtagcttctccagaagaacttcttccggtagcttgtctgaaagaactttttgttctaccggaagaaccttcttccggagaagctaccaaaagaagttcttccaggagtttcagaacctttcatctttgccattttcagacaatttccatgtcttctaccctaaagccatcatctcctaa

SEQ ID NO: 19324 - DNA, 270 bp, Glycine max
  Peptide Sequence Number=SeqID_136102
atggggtgctctcagttttgtatcacaaaacccacttctctattcagagcgagtaagggtctggaagaacaaaactgccttcagattcgtgtatgcatcgcttcgtgtttgatttgcaatggctggagatcagtacctgtatattttacagacccttggcacagattcttaacggagaatgacttgatgggtgaagatgaggtggtgttctattatcggcctaaccaacatgtgggagatcatcttcaggaaggagcccatatgggatga

SEQ ID NO: 19325 - DNA, 183 bp, Glycine max
  Peptide Sequence Number=SeqID_136103
atgttgcaaagatatgggttgaatgtgaatggaaaatcgactagattcagaaataataaaatttttcaaaataatacaaaggatcaagctgaaagttttgatgatgccaaaggattgcatgaatcatatgcttctcaaagatttactcaagacaaagcaattagagttaatcaagatggatga

SEQ ID NO: 19326 - DNA, 510 bp, Glycine max
  Peptide Sequence Number=SeqID_136104
atggcaaaagtttcaatactgtcaactgaatttcctcctatttttggaaggaagaggagaggctggcgatttttggtgagggtgaccaaggcagccttggatagcgggcaggtgattgattggcgtcaaagtgcatttttggaaggtaggcatttgcttcattgtgtgctgattgcgaacaaagcaattgaggaggcccggaggagtaggaggaagtgtcttatgcttaaggtcgactacgagaaggcatatgactctgtacaatgggggtttcttttctacataatgagaagtactatagatcagtttatccctcaaaggggattgcgtcagggggatcctctagccccatttctctttattatagtagcaaagggactagcaaggcttatgagggaggcagagaagaagggtatgtatgctggttttctggtggtgaaggataagatggaggtagacttcttcaatatgcaaatgacattgtgtgttttggagatgcaacagtgttga

SEQ ID NO: 19327 - DNA, 780 bp, Glycine max
  Peptide Sequence Number=SeqID_136105
atggcctctagaaagagaagagctcccacttctcgacctcaggaaccctatgacacctcacggttcgtttctgaggtcgcatgggagagatacgagcagaatatccatgccagaaacatcctcctagagaggaatgttgagctgcagggcaagctgattaagttcgatgttgcaacattgaacgagtttctaaagacccccgtggttttggagccaggggagcgatattcaacatactccagattctgtcacactcacccagaccctcaggagctcgccgccagattgtgcattccaggcgtcttatcttattctaacctcgcccccacttctcacatgtctgatctgaacatggatatggcaaggttagtctacgggctggtgatgaagatggacatggacgctagggctcgaggtccttcagatgcttctagttctacccctgctcccactctagcacctgcaccagcactagttccttctctagcaccctccggccccttcacttcgagcacaaatgtgatagtgccaatgctgcagagcctccaccacggcttatgcctggtggcctggccaggagtccaaccttcttcttctggggaggtcattgatgaggatggcgcagcagagaccggcgttgatacagactacgtagcggatgtcgctgcggcacagggcacttgggatccttggcccactccagcacaacacactctgatgcctgctcaggatgcccccactacacctcatgatgacccagcaccagcccaggatgattga

SEQ ID NO: 19328 - DNA, 687 bp, Glycine max
  Peptide Sequence Number=SeqID_136106
attgatattaaccagcatttgatcactgcaatggttgaacgttggatgcctgaaactcacacatttcattttccacatggggaggcaaccataactttagaagatgtgaccttgcaattgagccttaagattgacggattgcctataattggtgccagtactagtgatgtatgtgtttcttgtcaggctttattagggggcattgcacctgataagtatatcaatggaaaaatgatttatctaacttggttgcgggaaaattttcaagaacttcctgttgatgctgatgatgttgtgattgagcaagatgctagagctcatatcatgatgctaaaaggacactcacaaaggtttgctaccactatcaacactccgtcatctacatacatcccaccatcatcgagctcctgttattgttcatcattacctactcagatgcatggcaagagtcatgaggataaggaggaagatgatgataacaacaacaccaacaataatgatgataatgatggtgattttgttcctcaacaacaacaaacaattacacatgatcatccaagaataagaaaaggaagaggtcatagaacaagaggacaacaacaaccaccaacaaatcaaatacaacaagatgaaaaacctcgacgcacatctagaagaactcgttgtgacacatcatttctctattaa

SEQ ID NO: 19329 - DNA, 606 bp, Glycine max
  Peptide Sequence Number=SeqID_136107
atgaggagtgaggcgtccaccgcgtccagtcctaactacattgaggtacccagagcttatcatacgcaatgggctccatattaccctgcttatgtgcagatcgaatacaatggagcgaggcacctcataaagcataaaaaaaatggtcagcaatactacttggccgatggactgaaagacttcagaagaaacatcgacatacatgaaggtgtattggtccattttgttgcacccgacaattatgccagttttcatctggcttttatgccactgctgcatacacaatcatgtggaaggcctcccgcaaccactaggacttatgtgtttactgtggatgttaccgatgctatcatctccgaacatacaccattgttcttgcctactgctgctgccaactttcttgatgcatcaacacaatgtatgactgtgcgacataggggtggcattcgtcacatatggagcatctccatgcataatggtctacaatatgtggatgaccctgttggaagcccacactctataaatagaatgaggtgctctcagttttgtatcacaaaacccacttctctattcagaaaaaatacaccatctattcagagcgagtaa

SEQ ID NO: 19330 - DNA, 252 bp, Glycine max
  Peptide Sequence Number=SeqID_136108
atgtcttaccatttatcaagaaatagcctaagtgagtccacatggcactctcacttaggaaaactaggcagcaagtgtcgaggtcaccctatcgtgcacaggcaactccctgccccccatggtgatcaacctgagtctcaaggaagttccaaaccgagtgacatgcccccaagtagaagtatttttcctcatgaaaaactacgagtacttattgaccaagtttgtactatttccatgcaatatgaagtatga

SEQ ID NO: 19331 - DNA, 207 bp, Glycine max
  Peptide Sequence Number=SeqID_136109
atgccttttatagacttcagtgaagaatttgttacgggatcaatgttgagccttgatataaccgttgtctcacaactggaggtgaaaacatgtggtgtgctctgtatggcaaggataagaataaagcctagcccacttagcccgtgggctaggtgggctcaacccgtggttgacgggctagcccgtcaacccaccatattaaaataa

SEQ ID NO: 19332 - DNA, 273 bp, Glycine max
  Peptide Sequence Number=SeqID_136110
atgatgaacctaaagctaaaaagcttcgagaaatgggatgcacctgaggagaaccacagagaaggacgcagaggaagattgaagttcttttcggagataataaaccaagaagcacaacaaccacaccctggagaagggaacgctccagagaagaaccctcactgtgtcatcgtggtgttgccagagaaggacgaggagtcgatggtggccgaacacggtagcgtgagcacgatagtgacgggcgactacgacgacgacgatgaattggacgag

SEQ ID NO: 19333 - DNA, 112 bp, Glycine max
  Peptide Sequence Number=SeqID_136111
gtttgaccatgatgggaaaaagattgaagcatttgttggatcaaagagtattacacagagcgttgtgtcccgatgtccttcagcacaatattccttaaagcagttcacctag

SEQ ID NO: 19334 - DNA, 1851 bp, Glycine max
  Peptide Sequence Number=SeqID_136112
atggccgcaaaatcgccgtgcatcgatctctgcgtgtttgatacgaaaaccggctggtgcgaaggatgcggacgcacccgtggggaaacccaaagctggagcaagctttcgccttaccatcgcaaagcgacagagcgggcgcttccggcgcgcctgaaagcgcttaaaacccgagaggccctgaaatttgtgctggccctgcaaaccggtgccattgctggcttcctggtgttctcactgctggccgataagtgggggcgcaggccgatgtttctgctctacctgtttatcggtgcggtggcggtcggcatgtatctggcgaccactcagccgctgattctgatggttgccatcttcatggcagggtttggcgtaaacggtatttttgccggctccggtcctttcctcgccgagatcattggcgacacgcagtcacgcggctttttaatggggctggcgtataacggcgggcgcctgggcggctttatcgctccgctgctgattggctttgtggccagcgttggaggattcactgccgggctggccaccacggtgatcgcctttcttgccgcgatggtggtggctaaagcctgtgacacggctgaacacctgacgcgctgtcaggtgttcagccagttgtgtggtatacccactgtagccagaatcatcaccgcaaaatcctgcaccacatcgcggccacgccaggcttgctggagaagtgcccaggagaacaccatgataaacagcctgcgcaccgttacgctgctggcggcaatgacggtgagcgcgccactgctggcgcagacctttgtttacgtatccgccgccgccgacggcaccatcgcgcgctatacgctggacgcgcgcagcggcgctttgcagctgcttggccacactgaggccgggggcaaagtgatgccgatggcgctcagtgcggatcacaaaacgctgtacgcggcgattcgcagtaaaccgctgcagctggcgagctggcagattgactcgcagagcggcgagcttaaccaccggcgcaccgtgccggctgcggccagttacccctacatcagcactgaccgtcagggacgctttctgctgggggcctcttatgacggcgacgtggtgcaggtttatcgtctgacggccagcggcaccatcgctacgccgccggtcggcagctataaaaccggtcatgcggcacattcggtgattgtcgatgccagcggtcgtcacgcttatgtgggcaatcttggcaccgatcgcgtgctgcagctccggctgggcgcaaacggcacgctcagcgcccttggtaagggcggggtagcaaccgccgccgataacggtccgcgtcactcggtgttgtcgccggataatcgctatctgtacaacattggtgaaatgggcggcatcattacccagttccggcgcgaaaccagcggcgaactgatcaaagtggcggaaacgcctaacgcggtggcggcgcagtatcatctgcaacatgggcgtgaacggccgccgggttacagcgacagcacgccgcgcatctggtcagcggatatccagctgacgccggacgggcgttttctgtatgtcagcgaacgcaccagcagtaccgtgagcggttatcgtgttaaccagcaggatggcaaactgacgctgatcggcagctggccggtggagaaacagccgcgcggcatggcgatcagcgccgatggccgctggctggtggtgagcggtgagaagagtgcggttattggcagctacgcgattgaggcgcgcagcggagcgttgcagcgtgtcggcgaggcgccagccggccgggacgcgaactgggtgaccatcgtcagctattaa

SEQ ID NO: 19335 - DNA, 1602 bp, Glycine max
  Peptide Sequence Number=SeqID_136113
atgcctctctcctgtctcctcctcctcctcctcttcttcctctcacgccacactctctcttccgcttctcagcctcgcaatcccgaagtggaggctttgatcaacattaaaggaggtctgaatgaccctcacggcgtcctcaacaactgggatgaatactccgtcgacgcttgcagctggaccatgatcacttgctcttctgattaccttgtcataggccttggagcgcctagccaatctctctccggaactttatctccggctatcgaaaatctaacaaatcttcgacaagttgttctaacggcggatgaatgcagattactgcagaacaacaatatctcaggcaatataccaccggaacttggaaaccttcccaagcttcagacattagacctttccaataaccgtttctcggggctcattcctgcatctcttagtcaattgaatagtctccagtacttgaggctcaacaacaataatttgtccggatcctttcccgtgtcactggccaaaaccccacagcttgctttcttggacttgtcttataacaatctcagtggaccattgcccaagttcccagccagtattgtggggaacccattagtttgtggaagcagcactactgaaggttgctctggctcagcaaccctcatgcccatctctttctcgcaagtgtcatcagaaggaaaacacaagtccaaaagactagcaatagcttttggggtcagtcttggttgtgcttctctcatccttctgctttttgggctattgtggtatagaaagaaacgacagcacggagtcatcctttatatcagtgattataaggaagagggagttcttagcttgggaaatctaaaaaaattcactttcagagagctcctacatgccacggataatttcagctccaagaatatacttggtgctggaggctttggcaatgtctatagggggaagcttggagatggcacaatggtggcggtgaaaaggctgaaagatgtaaatggtagtgctggtgaatcacagttccaaactgagttggagatgatcagcttggcagttcatcgcaatttacttcgcttaattggatattgtgctacttctagtgagaaacttttggtttatccttatatgtctaatggtagtgtggcctccaggcttagaggaaaaccagctttagattggaacacaagaaagaggatagcaattggagctgccagaggtcttctgtatttgcacgagcaatgtgatccaaagataatacacagagatgttaaggctgccaatgtgcttctggatgactattgtgaggctgttgttggagattttggccttgcaaagctccttgaccatgctgattctcatgtcaccactgctgtccgtggcactgttggacacattgcaccagagtacctttccaccggccaatcatctgagaaaacagatgtctttggatttggcattctcttgttggagctcataaccggaatgacagcactcgagtttgggaaaacggtgaatcaaaaaggtgctatgctagaatgggtaagtctattctcgcaaccaaataactctgtttgttgcattccagattatatgacgtaa

SEQ ID NO: 19336 - DNA, 1032 bp, Glycine max
  Peptide Sequence Number=SeqID_136114
atggttgccaaaaatcaattctatcatatttcattggcattgcttttctgtttgggattctgggcttttcaagtcacatctcgcactctccaagatgcatccatgtatgagaggcacgaagaatggatggctcgctatgccaaagtgtataaagaccctgaggaaagggaaaagcgtttcaagatattcaaggaaaatgtgaattacattgaagccttcaacaatgctgccgacaaaccttacaagttaggcattaatcaatttgcagacctcaccaatgaagagttcattgcaccaagaaataaattcaaggggcacatgtgttcctcaatcacaagaacaaccacttttaagtatgaaaatgtgactgcattaccatccacagtggattggaggcaaaagggtgctgtgacacccatcaaggaccaaggccaatgtggatgttgttgggcgttttctgctgttgcagcaacagaaggaattcatgcactgaattctggaaaattgatctctttgtccgaacaagaagtagttgattgtgacacaaagggtgaggaccaaggttgtgcgggtggttttatggatggtgctttcaaattcatcatccaaaaccatggactcaacactgaagccaattacccctacaaggctgtcgacggaaaatgcaatgcaaatgaagcagcaaaccacgctgctaccatcactggctatgaagatgtccctgttaacaatgagaaggcactgcaaaaggctgtggccaatcaaccggtttctgtagccattgatgccagtggctctgactttcaattttacaagactggtgttttcaccggttcatgtggaacccagttggatcacggtgtcactgccgtgggatacggtgttagcgctgatggaactcaatattggttggttaagaactcgtggggaaccgaatggggcgaagaaggctacattatgatgcagaggggtgtcaaagctcaggaaggactctgtggcatagctatgatggcatcttaccccactgcataa

SEQ ID NO: 19337 - DNA, 656 bp, Glycine max
  Peptide Sequence Number=SeqID_136115
gatttgggatctttgatcatcacttcttcggcattgagatactctcgagaactgatgaccttcatctatcccagtcacactatgctcttaccatccttgaacgagctaacatgattgattgtaagccaatgcgcacaccacttgaagctatggccaagatgatgtccaataatactccccttgatgatccatgttacttttgtgggcttgttggtgctctacaatacctcactcttattcacttcgatatttcgtatagtggttgtcctaccactcggcactctaccactgactattgtatctttcttggcagaaatcctatctcatggagtgcaaagaaacaaccaacagtttctcactccaagactgaagctaaatatgaggccatggaaaacattgtagctgaattgacttttctcttgaaagacctttacatttcacttgcttgcactccattattattttgtgacagtattagtgctcttcacaagaccatcaatccagtttttcaagaccacaacaaacacattgaattggattgtcatttcatttgcaaaagagttgcacttgtcaatcttgtcactcaccacattcctaccaatgatcaagttgctgaccaatttttaagcctgtgtccaatcctcgacctcgtttga

SEQ ID NO: 19338 - DNA, 549 bp, Glycine max
  Peptide Sequence Number=SeqID_136116
atggcgatgctttcgcttctgttgtgtcttcgtcctctccgaccactcttcctcggtcaagcccgtcggcctcattgcactctcgttgcctacgacaaggccacctccgtcgcagagcaagaccatcacaagaaaatctgcggagcaccgtgcgactctccctccgccaactacgtcctcctccaccagaccacaacttcttcaccgacgactgcgacaacgacttcctctccggcggcgacggcggctgctccttctccgcctcctcgctggcgacaactcccacccccaccaccaccaccactaccaggccaacaacctccctgcgccactgccactcttctacttctttcatttttcctctccctgttcatcgcatttttctgggttttttatgttcaagatttgtttttcttttgcttgtattatgttgtgactgattttgagagagtgggacttgatagattggttgtgtgggatgatgttgccgatgttgggtttgcagtggcggaaggttgtcggggagtggtggtggggtggagtgattga

SEQ ID NO: 19339 - DNA, 351 bp, Glycine max
  Peptide Sequence Number=SeqID_136117
atgaaagaagtagaagagtggcagtggcgcagggaggttgttggcctggtagtggtggtggtggtgggggtgggagttgtcgccagcgaggaggcggagaaggagcagccgccgtcgccgccggagaggaagtcgttgtcgcagtcgtcggtgaagaagttgtggtctggtggaggaggacgtagttggcggagggagagtcgcacggactttcttgtgatggtcttgctctgcgacggaggtggccttgtcgtaggcaacgagagtgcaatgaggccgacgggcttgaccgaggaagagtggtcggagaggacgaagacacaacagaagcgaaagcatcgccatcgaaat

SEQ ID NO: 19340 - DNA, 444 bp, Glycine max
  Peptide Sequence Number=SeqID_136118
atggaaaggagtatgattgatgctgccagtggtggagctcttggtgatatgacccctactgaggctaggaatttgattgagaagatggcttccaactcccaacaattcagtgcaagaaatgatgctattgtccttagaggagtccatgaggtggtcacggattcatcttcatctgctgaaaataaaaagcttgagggttggaggaatcatccaaatctgagatggacaagtcctccacaacaacatcagtctgtcctttctttccagaatgttgctggtccaagcaagccttatgttcctcctccaatgcagcaacaacaaagacaacaagcagttgaggccccttttcaaccttccttagaggagttagtcaggcaaataaccatccagaatatgcaatttcagcaagagacaagagcctccattcagagtctgacaaattag

SEQ ID NO: 19341 - DNA, 762 bp, Glycine max
  Peptide Sequence Number=SeqID_136119
atggtaactgaaggtgaaattagtagtagaagatatgctcttctgctagcagtgaatgattctgagtatgtaaagaaagcatatggtggctactataacgtctatgtagaagcctttggggaagaaggagatacgtgggatttgtttagagtctacgacggggatttccctgacttcagtgacctcaataaataccatgggtttgtgatcactggtagccccagtgatgcctatggaaatgattactggatccttaaactctgtttcatgttgcaaactcttgatgccatgcagaaaaaagtccttggcatttgctttggtcaccaggtactatgcagggctttgggtggaagggtttgtaaatcgaacacaagttgggatgttggctttagacaagtgcatttcatgaaagatctaactcgatcttataggtacctagcggaacatgaaatgatgacagaatcgctttccatcattgaggtacaccaagatgaggtttatgaggttcctctgggtgcagaagtgattgcatcgtcagacaaaactagagtggaaatgtttgcgatttcagaccacattcttggaattcagggtcatcctgagtatagcagagatatactgtttaatctgattggtcggctgcagaatatgaatgtcatagagggaggattagctgaagatttgaagtgtcgatttcagtcagctgaggcagacaagaagtgctgggggaaaatatgccgaaactttctcgggggaaaataa

SEQ ID NO: 19342 - DNA, 279 bp, Glycine max
  Peptide Sequence Number=SeqID_136120
atggcaccactgatgggagggtgcttttggctttggtggcagctgaagcagcagtgccaacagcaacagcaacatcagcggcaccagaatatggccacagattatgggatccaacaatggcctgggaaagcaaagcaaccaattaactgggctagaaacacaaaaacagacacaaagacaaagaaagttgagctacgggtgacgaatgcttctttagtctatttgcaagtgtcctatcaattgtgctccaaacctcctcttttctctcaatccttttag

SEQ ID NO: 19343 - DNA, 1077 bp, Glycine max
  Peptide Sequence Number=SeqID_136121
atggttgagagtgagaaaacagaagcaggcttcgaagggtttgagaagcgcgtggagatttcattttcattcagcgagagcggggagcccaagaaactagggcttagggccctgagtggggcccaaataaagtcaattctggaagccgcccgttgcagcattgtgtcgcagctctcaaattcggaattggactcttacgtgctctctgagtccagcctctttgtcttccctttgaagatcatactgaaaacttgcggcaccaccaggctcctcctatccgttaagcccattctcgaccttgcagcttcactatcactctctgttttcgccgttaagtactcgcgcggctcctttcttttcccaaatgaccagcctgcccctcacgacactttcttaaacgaagttgcattgcttaatcactattttgcccatcttaatgccaaggcctacgtcatcggcaacccaaatcgctgctggcacctctactccgcctgcggcgaagctgccacgttgtcgttgaccgttgaaatttgcatgaccgggttggaccgcgacaaggcccgcgtgtttcacaaggaatggggagggggcaaaatgacggaaatgtccgggatttcggagattgttcagagtcacgtgatctgcgacttcgagtttgagccgtgcgggtactccatgaatgggatcgagggtgcggcgttttctaccgtgcacgtgaccccggaaaatgggttcagttatggaagctacgaggtgcaggggttggacccggggtcaaatggtttcggggcgctggtgagaaaggtgctcaagtgcttttgccccagtgacttctctgttgctgtcacgtgtgaagtgggtgccgaggactgggccatgtcggatgctgacgtggaggggtattgctgccagaacgtggtgaagcaacagttgctgccggggaagggctgtctagtttaccggacttactccgctagaggcagagggagagggtcgcccaaaatagccatcgtcaagtgcagcaatgagattgagaaggaggagcttgtgctttcttcctgtctcacttctacttag

SEQ ID NO: 19344 - DNA, 270 bp, Glycine max
  Peptide Sequence Number=SeqID_136122
atggctaaaggcacggaagaaagtttctcttattcattagtggactggttgcagaaccctgtggaatgtcgtaggaaaagtatcaggttatgtatgaacagaatgagcaggggaggaatttctggaaggttcagcgttggatcctgtgtagatgctaatatggttgaaatttgtttggctatagcgtgtctaatggtgaacttttttaaattggatttggagatcacatggaaattgttatctgttaagtttatggaccggcatgtgtaa

SEQ ID NO: 19345 - DNA, 1015 bp, Glycine max
  Peptide Sequence Number=SeqID_136123
cggcgaaaacatccctgcgaaatcgaagcgattcaaacgccaattggtgaagttcgaggagctgccggagtacttaaaggacagcgagttcatattggactattaccgctccgaatggcccgtgaaggaagccttgtggagcatcttcgcgtggcacaacgaaaccctaaacatttggacgcatgtaggaggatttctcatattcgctgtgttggcggcgatgagcgccacctcggagctctggaatttgctcagatggaacgacagatcgtccacggcgctcgggttgtcgaccacggcggcggagatgaacgggtctaacagtgacgccttcccggatttgcattttagacacgttctggactcttccatccttggtgagatgaaaggatctggggtagaaacaattcctcgatggccatggttcgttttcttagctggaggaatgggatgcttagcttgcagttctctttcccatcttctggcctgccactccaaaggctataacctatttttctggcgtctagattatgctggcatttctcttatgattgtctgttccttctttgctccaatttactatgtttttttctgcaatccttacgcaaggttattctatttggcatcaatatctgtgcttggagtccttgccattattactctacttgcaccttcactttctacacctcggttccgacccctcagggcctccttattcctctccatgggcttttcaggtataattcctgcagctcatgctgttgtcctgttttggggccatccccatatacttgttgcacttggatatgagcttgctatggccattctatatgccaccggagctggattttatgttgctagaataccagaacgatggaagccaggagcatttgatatcacagggcacagccatcaaatttttcatgtttttgtcgttcttggcgcacttgcccatagtgttgccatactagtcatattagatttccgacatggatctcctacttgtgtgcattag

SEQ ID NO: 19346 - DNA, 342 bp, Glycine max
  Peptide Sequence Number=SeqID_136124
atggaagtgagtggaaggagctgtggcgttttgggcctcccttattgtgtacctgtgagaaaaaatggaaggaggtttgtgacaactttggctaaaaggaatgagtctcaagagaagagtaagggaccctctttcacactgagggtttccaagtcaactatcgctcgtggtgccattggactgtttggattggggttcgtcgatgccgggtacagcggagactggtcgaggatcggagtgataacaccgcagactgaggatttgcttaagcttgcagcttttctcgtggttcccttgtgtatttttctaattttttttctgcccagcgagcaaaattcttga

SEQ ID NO: 19347 - DNA, 705 bp, Glycine max
  Peptide Sequence Number=SeqID_136125
atggatctgaagcgcgatggaaacgggattgaggatctgagcggtggcggtttacctttacaagaggtgcattttagaggctactccaaggaacaacactccctctttctcacggttactctgttcgcctcctacctccgacgaaaactctcactcttgggacatgatagcagaccaaagacaggaaacgcggaaacagaacaagagagtaaaacagcagaaataggggtgcaagtagcaaaggccaagagaaggatttgcagacccacctacctcaaaggctatgtgtatcaggacaccaaagcaacgtttcaggacatcacgtattggaaccacgactacattccttcccacaacgatgaactattccgagcttttcattggcttattgttgcaaatgctaagaatagatttcttactaaaaggaaattcaagcttagccctaaatgggatggaccttttcaggttttggagaggatcaataacaatgcctataagttggacctcccagaagagtatagagttagcaccacttttaacatttttgatttaattccttttgtaggtggagttgatattgaggaggagaagaaggaactaaaaaatttgaggtcaaatcctcttcaaagaggagggaatgatgcaattctttctaggaaggaatcagtcattagagtcatgagtaagaggctccaagaggattga

SEQ ID NO: 19348 - DNA, 462 bp, Glycine max
  Peptide Sequence Number=SeqID_136126
atggcttcggtgtcctttgccgtgggacttttaccttacgcttcagttcgatttcccgtattgagcaacgccaactcactgaaactcagttcctcagctagcatctctactccaattcttcagcaaaagctctgctctcttctttcccccctccctctaagccctcgccctcgccctctcaccattgtatccgctaagggctacaaaatgaaaacccacaaggcatctgcaaagcggtttagggtgaccggacgaggcaaaatagtgcgtaggagagctggcaagcagcatttgctcgtcaagaagaataccaagcgcaaatcccgactctccaaaatggtcatattcacattatctaggggttattccgtacccatttttaatgaattgtctaaaattgcgcatgttaggagtttagataatggaatattggtaatggacagattttgtgatgggccataa

SEQ ID NO: 19349 - DNA, 1083 bp, Glycine max
  Peptide Sequence Number=SeqID_136127
atgatttgtcagctggaggctgctgcagttaacttggtcgctagtgagaaaccagctgatgtttactcggagattgctgttagggttcatgatattatgagaaaggactgtatcaaagatccagctgcctatccaaatgctttgttagcaaaagttttaattgatcagattgacaggaaactggtcaaacagacagtgatgacttcagtttatggtgttacctttgttggggcacgagagcaaatcaagagaagattagaggagaaaggtcttattactgatgaaaaacttttatttgctgcagcttgctatgctgctaaagtgacattaactgcgcttggagaaatttttggtgctgcacgtgtcattatgggttggcttggtgattgtgcaaaggtaattgcttttgaaaaccagcctgttcgttggaccactcctcttggccttccagttgtacaaccatactgtaaaactgaacggcatctgtctcttcattgtgagacacctgaacaatgtcctgctattaggcaatgcaatggacatacaccaagcatggcacaaatattgcgaagcactagttttaagcaacatagatttataggtgtcatcacaacacttgtgaatctcaccattgacctgcagatcaaaacatctcttcaatttttggctttgagacgagagggtaatgcagtagatgccaagaaacagagatctgcatttcctccaaacttcgtacattcactggatggttcacacatgatgatgactgctcttgcctgtagggatgctggcttatgttttgcaggggttcatgactcgttttggacacatgcatgtgacgtggagaaaatgagtcagattcttagagaaaaatttgtggaactttatagcatgccaatacttgaaaatttgctagaaggatttgagacatcatacccaggattaactttccctccactgccagagagaagaggttttgattcaaagaaagaccccaggttgctttcagggaaaggactggaaggaagtctcctgttactagaatgctcagaacactacttggctggtttaaaggagagttaa

SEQ ID NO: 19350 - DNA, 2862 bp, Glycine max
  Peptide Sequence Number=SeqID_136128
atgagttccagcgtgactggaagtatagtccatcagggccagttgcttgttcatattgctgagaatggacactcttttgagttggattgcaatgagaacacacttgttgagtcagttatgcggtctattcaatctgttactgggattaatttcggtgatcagcttgttctttgtttggatatgaagcttgagtcgcagcggccgctatctgcatacaagcttccatctgatgagagggaagtgttcatattcaataaagcaaggcttcagaacaactcgcctgttccaccgccggagcaagttgatatccccagtcatttggagcctccaccgccagcctcttcccatgatccacaccctcttgatgatgcttcggatcctgctttaaaggctttaccttcttacgagcggcaattcagataccattatcatcgggggcatgtgatttatactggtaccatgatgaaatatgagcattgtgagaggcttttgagagaacagatggtccaagaaagagcggtggaggttgcaaggggtaatttggatcagtactatcgaatgattaaccaaaactatggggacttcatgaaacgttatatgcaacaatgcaggatgcattctgatcttttggtgaatttcgggaaggatattgagaaactaaggtccatcaaacttcatcctgctttacaaactgctaatcgcaagtgcttactggatttggtcaaggaagaaaacttgaggaagtcggtggagaattgcaccagctcccacaagcagtttgagaataaagtttcacaatttaagcagacttttggggaagtgaagcgtcgggctgaggaattgttgtccagcagggatttcttgcccatcaagaatttagaacaagcaattaaagaacaccagagatatataaatgaacaaaagagtatcatgcaatctctgagcaaggatgttaacactgtaaagaaactggtagatgattgtctatcctcccaattgtcctcctcactccgtcctcatgatgcagtttcagccttgggtcctatgtatgatgttcatgacaaaaatcacttgcctaaaatgcaggcttgtgatcgtgctatttcaaagctacttgagttttgcaaggagaacaagaatgaaatgaatctttttgttcataattacatgcaaaacataacttatgtttcttatctcatcaaagatcagaagctacaattccctgtttttaaagaggcaatggctcgtcaggatggcttatttatggatttaaagttgttccatggtattggtcctgcatacagagcttgccttgctgaaatagtgagacgaaaggcttctatgaagttgtacatgggcatggctgggcaaatggctgaaaggcttgctataaaacgggaggctgagctcaggagacgggaggagtttttgagacttcatagttcatgcattcctaaagaagttttagcatctatgggattgtttgacactccaaaccaatgtgatgtcaatatagctccatttgatggtggtttgcttaatattgacatatcagatgtggaacgttatgctcctgaatatctaacgggagtaacttccaagctggataagcaaggaagctctaaaagttcatctgctttgagtagtgatagctctcacttggctgaggctgtagatattactggtgactcaattgagagagatgattccgaggacttgcttgatggcagtgagttgcttgaaattgctggaacctgcaagatggaagttgagaatgcaaaactgaaagctgaacttgctggtagaatagctttaatatgttctctctgtcctgagttagagtacgagtcattggatgatgaaagggtgaataatatattgaggaatgccgcagagaagacacaagaagccttgcatttgaaagatgaatatattaaacatgttcaatccatgcttaagatgaagcagatgctatgcgtgtcctatgagaaacgtattcaagaattggagcagaaattgtcagatcagtatgtgcaggggcagaagatgtccagtgtaaatgatgcagctgaccttccccttgtggctgggaagacagataattacaagtcagaatctatcagtggtgaagccaacatgccttgcatatctacttctgagcccatggatgaggtttcatgcatctcaagttccttggatgcaaaacttggtttgttcatgttcacagagcatactggtaaagcattagatggggtggatgaaaacatgttggattcctctggagttcagaacccacagttggattcatctatgatggagcctcatcgcgaagaagcacagagtggtgataaagataaaaaaggcaagataatagtacaattgggcatgtcactgacaaacagttctactggtgagaacatgcctgtgtcacatgatcttgtaccctgtgactcggcagtttgtcaagacttggaatccaaagtaaatgatgaaaaggtgttggaactacaaagtgcacttgcagataagtcaaatcaattgaatgaaactgaaaccaagcttaaaactgttatggagaaggttgctgtgctcagaagggagttggaagcaagtcaaaaactacttgatgaatctcagatgaattgtgctcacctggaaaattgtttgcatgaggcaagagaggaagctcagacacaaaaaagttctgctgacaggagggcctcggaatatagtttactgcgtgcatccgttattaaaacgcgcagcttttttgaaagactcaagacctgtgtttattctcctggtggtgtggctggttttgcagattccctacgtaatttggcgcaatctttggccaagtaa

SEQ ID NO: 19351 - DNA, 474 bp, Glycine max
  Peptide Sequence Number=SeqID_136129
atggcgcggctgctgccggccaaagcgccgctcacggtgatcaccaattcgctgacgttaatgaatgaattacgcaacggtcgcgatatcactctgatggggctcggcggccagtttcatcactggtgtaacgcctttatggggcgcatgacgcgagacgaaatcgccagcctgcgcgccgatgtgttttttgtcagcatgtcggcgattattgatgatgcggtgtttcaccagtcggccgagacggtggaaaccaagcgcgcgatgttcgaggcggcgcagaagcgcatcctgatgatggataacaccaagtttgagcggcgcgcgctgcatcgctttgctcacctgagcgagtttgatgtggtgatcgttaatcagggcacgccggtgccggtgctgcgtcgcctgcaggagttgggggtgaatgtggtggtggcaccgatgaaaaccgggcagggacgcacagaggcgtaa

SEQ ID NO: 19352 - DNA, 2010 bp, Glycine max
  Peptide Sequence Number=SeqID_136130
atgaaaaacggagcaaacggtatgactgacagaacccaaacgctggatagcgcaccgcgggtggcgaaaccggccagcggcaagcgcctcaatctggcgcggctgctgctggaagggcgtgcctttatcgcgctgctggtgattatcgccactttctccctgctatcgcccaactactttaccggcgcgaacttcctcaccatggcgtcgcatgtggccatcttcggtttgccggcgatcggcatgctgctggtgatcctcaacggcgggattgatttgtcagtcggctcgacgctgggactggctggcgtgatggccggctttatgatgcagggcatcaaccttgaagcgctgggcgtggtgctctatctgccggtgtgggcagtggcaattctgacgctggtgctgggtgcactggtagggctggtcaacggcgtgctgattgcgatttttcgcgtcccggcgtttgtcgccacgctcggcaccatgtatgtggcgcgcggtatcgcgctgctgatcaccaacggtctgacctacaacaaactctccggcagcgaagcgctgggcaatacaggtttcgactggctcggttttaaccgcctgttcaacatcccggtcggcgtgctggtgctcggcgcagtggcgctggcctgcggtttcctgctgagtcgctcggcgtttggccgctggctgtatgcctcaggcggtaacgagcgcgccgccgatctctccggcgtgccggtgaaacgcatcaaaatcagcgtctacgtgctgtcgggtatctgtgcggcgatggccgggctggtgctctcttcgcagctgacctccgccggtccgaccgcgggcaccacctacgagctgaccgccattgctgcggtggtgattggcggtgcggcgctgaccggaggacgcgacggttttcactggcgccgtgattgtgctggcggtattgctcaacaccctgcaatacggccggcgcagtcgctaaccctgcgcgcgctggccggctggcgcgcgagtaaccgtaaaacaaacctgtaccctaataataacggagcacctatgttcactaaacgtctgtttatcgccgccgccgcgatggccatctccacctttgccttacccagctgggccaacaacggcctgatgaccatcatcgttaacgatccctctaacccttactggctgactgagggccaggtcgcgcagaaggcggcggagaagctgggctacagtgccaaagtcagcgcgcacaaaggagataccaacaccgaaagccagctgattgatacggcgatcaccaataaatctaaggcgatcattctcgatccggctaacgccgacggctcgattggctcggtaaagaaagccatcgccgccaatattccggtgtttgtgatcaatgccgaactgaaccagagcgggctggctaaagcgcagctggtgtcgaataacgcacagggcgcggcagtaggcgcgatggagtgggtgaagcaggtgggtgacagcgccagctatgtcgagctggtgggaccgccgtcggataacaacgccgccacgcgcgccaacggtttcgataccgtgctgtctcagtacccgacgctgaagaaagtcggccaggaagtggcgaactgggatcgcacccagggctttaacaaaatgcagtcgctgctgcaggctaatccgaacatcaaaggggtgatcagcggtaacgatgagatggcgctgggtgctatcgctgcgctgaaggaagccggcaaactcagtcaggtgaaagtgggtgggttcgacggttcaccggatgcggtcgacgcggttaaagccggtacgctggcttataccgtgatgcagccggtagcgcagtttgcgcagaaggcggtagagcaggcggacaccttcctcaaaaccggcaaaaccggggtagcacaggagaagcagctgtttgactgtatcctgatcaccaaagacaacgccggtgatttcgtttcgccgtttgtcctgaagcagtaa

SEQ ID NO: 19353 - DNA, 324 bp, Glycine max
  Peptide Sequence Number=SeqID_136131
atggcgcataacccgcaagagacctccgctggtcacttcctgaatgaaaccttaccgggcgacagccgtcaggcgcgtcagctggcacgacgccagctcatagccgaagccgtgatggccgaaggcgcggtgcgtattgaagatattactgagcgtttcggtatcagcctgatgaccgctcatcgcgatattgatgagatggtcgagcgcgggctgctgcataaatcacgcggcgtggtctccgccacaccaaccagcctggtggaatccagcgatctctaccgtgcaacgcgccagctggaagagaagcaggcgattgccgaa

SEQ ID NO: 19354 - DNA, 1375 bp, Glycine max
  Peptide Sequence Number=SeqID_136132
atggccactgctaatctgctggcgcgctgggtcaaacgcaccgcgctggtcctgaccgccaccttaaccctcagtcacagcgcgctcgccgccacgcccatcgtgatggcgaccaaaagttttaccgagcaacatatcctgtctgccatgacggtgatgtggctgcaaaagaaaggttttcaggtcatcccgaaaaccaacatcgccaccaccatcgggcgtaacgcgatgatcaacaagcagattgatatgacgtgggaatataccggcacctcgctgattattttcaaccatatcaacaagccgatgtcgtccgaagaggcgtacaaaaccgttaaacagctggacgcgaagctgggactggtttggctcaatcctgccccgatgaataacacctacgcgtttgccatgcagcgccagcgcgctgacgccgaaggcatcagcaccatgtcgcagctggtggcgaagctggaacaggtacgcaacaccgatccggatcacaactggaaactcggtctcgatctggaatttgccggccgctcggatggtctgaaaccgctgcagaaagcttacaacatgccgctggatcgcccgcagatacgtcagatggaccccggcctggtgtataacgcggtgcgcgacggctttgttgacgccggactgatttacaccaccgatggccgggtaaaaggctttgatttgaaagtactggaggatgataagcacttcttcccaagttacaacgtcacgccggtagtgcgtcaggatgtgctggaaagccatcctggccttgaggccgcgctgaatgcgctgtcgccgctgatcaccgatgaagccatcaccgagatgaacaagcgtgtcgatatcgatcaccagtcgccgcagcaggtggcgccacacctggctggtgctggtggcggtgggttttgccatcctcgtcggcgtgccgctgggcattctgattgtccgcttcaaatggctggcaacaccggtgctgggcatcgccaccatcgtgctgaccatcccgaccattgcgctatttggcctgatgattccgttgttttcactgatcggtcagggaattggcgccctgccggcgattaccgcggtgttcctctattcactgctgccgattgtgcgcaatacccataccgcgctggaaaacctgccgcccgggctgcgcgaagccggccgcggtattggcatgaccttctggcagcgcctgcgctgggtggaaattccgatggcgctgccggtgatttttggcggtatccgtaccgccgtggtgatgaacgtcggcgtaatggccattgcagcggtgatcggtgccggcggcctgggcctgcaactgctggacggcatcagcggcagcgat

SEQ ID NO: 19355 - DNA, 2311 bp, Glycine max
  Peptide Sequence Number=SeqID_136133
cctgcggttatggggagttgttgcggctgcgtgctgccggcccgcgagtctgccgtaccagcacaggctaagtcaggtgtttctgtaatagaaaaatcgcttagccgtgctgagggcgggtatcgggcggacggccccgggcgtgtaaaaagtcccgagaaaacggcgaccgccgtcggatggcaggaacggacagcccttcgcatgcaccacatgattgtcgttataaccggcatgcttatcgacataatagccaaccagcagtgccagcaccagcagggcgctgataaacagggttacgcccggccagccgtagcggtgccagaacacgccgcccagggtgccggccacgctggagcccacgtagtagctgaacagccgctggccaccgaatgggcggcaaagaagccggcagtaaacagcatcatgcccggcaaaatcagccacagcgaactaaaggcggtcagcagcagaccggccagcatgatcgccgtggcgcccgtcatcaccggaccgcggccaaagcggctggtcatcgcgccggctttcggcgagctccacgaaccggtgagatacaccacggacagcagcccgaccaccgcctggctcagtgaccacggcgcgctcagtaaacggcggaagttgatcagcaaactgcgtggccgcagcgaggcagggcgaaaatggcgcgacgcgggcagaattttccagaacatcagcgcgccagccagcgcacagcagccaatgacgccaatggcaatacgccacgagaaaaagtcggtcagtacaccggatagtaaacgaccgctcatgccgccaatcgagttaccgctgatgtacagccccatggagaaggcgatgacccgcgggtgcatctcttcgctcagcgtacaaatcgccgccagcatcagcgcggtcaccatcaccgatttacgcccaatcgcatctgacagcgggccggtgaacagcaggcccagcgccatcagcccgggcgaaagtggcaagaccggcagagaacagcgccagcgtcacgcgcataaactgcggcgatccacgttcaatccattcagtagcggtatcggcggtaacaggcttcgtggacaagctgtcctcatcaagcgttacagcctgggaagagcgactcacagtacatcctcaattcagcaaatgtctgaatactgtggaacaggcggccgggcgcgcggcgcgcattcatcacggtcagcagggagagttgcgtattggctttacctcctcggcgccgtttaccggactggtgtcggatgcgctgtatcactatcggcaacgctggccggacgtgcatattcagatgcaggagtacaacacgcggcagcagctggcgccgctgcacgaggggcgactcgatctgggcgtcatgcgcaatacgccgctgccggaggatcttcagcaccgcctggcggcacggccctgtacggtgaaattctggcgctgctgcatcgctaccaaatcaaaccttacattacccaggaagtgggtgaagccatgacgattctcggactggtggcaaccgggctgggcgtgtcgattttacccgcctccgctgcgccagccgagtgcgcagatgagcaatatgatgacgctgctgctgcacaatgccgaggaatgaacccgcggaagcgcgaaaatatccgggagcagggcgtgaatctggacagtcagcctggccatattgaccaaataaaacagaccaatgccggtgcagtgtatcgtctgattgaccattacggtccgatttcgcggattgagctgtcgaaacgtgcccagctggccccggccagcatcaccaaaattgtgcgcgaaatgctggatgcgcatctggtgcaggagaccgagtttcaggagccaggcagtcgcggacggccggcgatagggctgatcctcgataccctggcctggcactatctggctgttcgcctccagccggggttcattaccctgacgctgcgcgatctcagcagccgcgcgctacaggaagatcgcctgccgctgcctgccagcgccgacacgccgctactgcagacgctgcaggagctggtcaacgcctttttcattcgccatcagcaaaaacttgagcgtctcaccgctatcgccattaccctgccgggactgatcaacgccgcctccggcgtggtgcaccgtatgccgggctatgaggtacaggatatgccgctgggcgaaaccctggcgcagcgcaccgggctgccggtattcgtccagcacgatatctccgcatggacgctggcagaggcgctgtttggtgcctcgcggg

SEQ ID NO: 19356 - DNA, 387 bp, Glycine max
  Peptide Sequence Number=SeqID_136134
atgtccgacagcaggccaaccggcacaaattcggtggtattgaagacaaaagcagcgatagccagcagcaccacgcgcagccaggctgttttacgggaaacggttgttgattgcattgaattcaaatcggctaaacgacgagtgagggggcaggaacgcacccgcgtgctgccggcccgcgagtctgccgtaccagcacaggctaagtcaggtgtttctgtaatagaaaaatcgcttagccgtgctgagggtgggtaccgtgcgggcggccccgggcgtgtaaaaagtcccgagaaaacggcgaccgccgtcggaaggcaggaacggacagcccttcgcatgcaccacatgattgtcgttataaccggcatgcttattgacataata

SEQ ID NO: 19357 - DNA, 1289 bp, Glycine max
  Peptide Sequence Number=SeqID_136135
atggccggcgtgctgtttgcggtgatcctgaccgcgctgatgcgcaacaagcggccatcgtggaccgcgcgccgtgccgtgcgtcacggcctgcgtgaactgctgcgctttatcaaggagattgagcgcaacggctcatcgctgctgggacgccagcgttttattggcctgatgctggataaggtcaacgtggtgctgccacgcctgcaccttgatccgcagtccgatatggcgccggcgggaatgctgctgaccgaggtgtggctgggggtcaatagctttgactactacgcgcgccatcaggcgctgctgagccgttatcagctggacagcgggcagatgtttcacgagctgggactgtttcttaagcgcaggctgaagtcgctgcagacgccgccgcatgaggatttgcaggaggagctcgatgtgctgctgatgcagctggaacagctggcgcagcgtgacgaggcgctgatgctgccgctgtttcatctgttcagcatccggttatacctgtttccgcaacttagctggccggtggccacgccgcgtcaggccgaacgcctgcagcagcatcgttaccgcctgcagccacagcataacgcgcccattgccaatcaccaccagtgcgccgctacggcgggtaggccgcacgccaccgacgctgagcggccacgccagctgcacgccaaagggattggcgggatccagcaccgtcagcgccaccggcggatgtgtggcctgcgcgctgccgagctggcgcagccggtcgatggccggattttcagcaaactgcgcgccgcccatgccggcaacaaagcggccgcgcagcagccgtccggcatcctccatgccgcgcaacagcggctgcagcgccggaaagccgccgggaatctgctctgccacggcggcaccgcgcgtgatcacgccaaagcggtcgagcatattttcagtcagcgccagggcgcgttcggtatcggccagcggctgccgcacaatcagcgaccagcgtccggccatgctgttgagcgagggctgcgcagcagcactgcggctggccgcgaaactggcccgactgtggcgactgcgcgcaggacgggccgggcgtggacgcggcgtgtggctggtggtgctgagctggcgcagcgcggcccaggtatccatggtcagatagccgcgccataccagttcccacatcgcggcaaagacttcgccgggatcgacagattgttcaggctgcgccatcacgcgcggcagcagctcgcgggcgaaccagccgccgccgtcct

SEQ ID NO: 19358 - DNA, 1683 bp, Glycine max
  Peptide Sequence Number=SeqID_136136
atggtgtatgagtcgcggattaacgacatcatcacgcttggcgccacctcgtggcgcatccagcaaattacgcatgatcaggtggtagtggtgccggcacccggtcgctcggcgcgcctgcccttctggcacggcgacagtcttgggcgttcggcgacactcggcgaagccattggccgctatttgcgacatgccgccagcggggtgttgcccggcagcgacaaccttgacgccagtgcccgacacaacattcgtgcgctcatcgacgaacagattgccgccacaggcctggtgcctgacgatcgcaatttgctgattgagcgctgtcgcgatgaaaccggcgactggcgcgtgattttgcattccccttatggtcagcgcgtgcatgcgccatgggcgctggccatcgctgagcggattggccgtcagatgggcctcgatccggccgtggtcgccagcgatgatgggattgtcgcgcgcttccctgacagcgaaggccgggtgccaggcgctgaactgtttttgtttgcgccggacgaactccagcgacaggtgacggctgcggtgggacattctgcgctgtttgccgcccgcttccgcgaatgtgccgcgcgcgccctgctgctgccgcgccgcaatcccggtaaacgttctccgctgtggcagcagcggctgcgcgccgggcaactgctggaggtggcgcggcagttcgacgatttcccgattttgatcgaaaccgcgcgggaatgtctgcaggacgtgtatgacctgccggcgctgcatcagctgatggcgcggatacaacagggcgaggttaagctgactgaagttactaccgatacgccctcgccgtttgctgcaccgctgctgtttggctatgtcgccgaattcatgtatgccagcgatgcgccgcaggcggagcggcgcgcctcaatgctggcgctcgacagcacgctgctgagcgatctgctgggccaggttgagatgcacgagctgctggcacccgaggtggtggcccgcgttgagcaggagcttcagcgcaccgtccccgattatcaggccagcactcaggaagctgtggttgatctgctgcgcgagctggggccgctcactgtgccggaaatcacggtgcgctacaacggcgaggcggcgctgatgccgctgctaaccgcgctgcaacaggcgcaacgcatcattcaggttacgattgcggcagaggcgcgctgggctgtcgccgaagatggcgtgcggctgcgcgacgcgctgggcacggcgctgccagctgatctgcccgccgggctgctcgcgccggtggcccgtccgctgcatgacttacttaatcgctatctgcgcacccacgctgtcgccaccagtctgcaaatcgctgtccgctttggcctgggccgggtcgtggtcgacgacacgctggaagagctgcgtcagcagcaacgcgtactgaaaggcgatttcctctcgcctgcggtcgatgcgtcaacgcagtgggtagcggaaagcgtatttcgtcgtttgcgcgtgcgatcgctgcaggcggcgcgtgaggccacccgaccggtcgaagcgccggcgtacgtggcttttctgcttgagcgccagggattgctgagcgacgtcgcggcatctgcggcacagggcgcctttgccggtatcaacggcgtggtgcgg

SEQ ID NO: 19359 - DNA, 787 bp, Glycine max
  Peptide Sequence Number=SeqID_136137
gtcaaaagcccgcgaaacgctgcgcggcatctcaaccgtgattattgacgaagtacacgcggtagccgggagtaaacgcggcgcccatctggcgctcagcctggaacggctcgatgtattgctagcgcagcctgctcagcgcattggcctgtcggccactgtgcgaccgccagaagcggtggcggctttcctcggtggcgcgggcgctacgcgtatcgtcaacccgccggcgcagcggccgctgcagctgacaattactgtgccggtagaggacatgacggacatccagcagcgtcccgatgcgcgcgccgcgcaggagagcagcctcgccgccggttccatctggccgcatattgaagccggcattctggatgaggtattgcgccatcgcgcgactttggtgtttaccaattcgcgtgggctggcggaaaaactcaccgcacgactcaatgaactgtatgcgcgacgcgccacgccagagcatggcgtaacggagcccgccttcgcctatggctcttttagcggtggaaccgaaaaacgcgccacgcctgctgaagcgtatattgcccgttcgcatcatggctcggtgtcgaaagagcagcggctggagattgagaacgccctgaaagccggcgagctgcgctgcgtggtggcgacatccagtcttgaactgggaattgacatggcgcgctgcagcgtattggccgggccggtcaccaggtggggggtacgccgaaaggcattatctggccacgcacgcgccgcgatctggttgatgcggccgtga

SEQ ID NO: 19360 - DNA, 1428 bp, Glycine max
  Peptide Sequence Number=SeqID_136138
atgtccgctcagatacctgccgcagattattcaggtgcagagaaacagcgcctgtcagaaacacgttccattgattacatcccgctcagcgagcgtcacgggcatccgtttagccagttcacattgtggtttggtggcaatttgcagattaccgccattgttaccggtgcgctggcggtggtactgggcggcgatgtggtgtggtcgattgtcggtttactggtgggacagatcgtcggcgcggccatcatgtcgctgcacgcgattcagggcccgcgccttggcctgccgcagatgatcaccagccgtatgcagtttggcgtgtttggcgcggtgatcccgctggtgctggtgtgcattatgtatgtgggcttctcggccagcggcacggtactggccggccaggcgctggcgaagctggtcaacgtcagcaatgcagccggcatgatcatcttcagcgccatcatcattgtgattgcggtgctcggctatcgggtgattcataaactcggcaaagtggctagcgtcatcggcgtgctggcgtttgtttacctgttcatcaccctactctccagccacgatttagcggccgtctggcaaaatcagcacttcagcgttgccagttttctgctggcggtatcgctctcctcgtcatggcagattgcgttttgcccttatgtgtcggactactcgcgctatctgccggtggatgtctccgcgaaaaagctgttcagttcggtgttttttggcaccgtgctgggcacgcaggcatccatgacgctgggcgtcattgtggctgcaattgcgggtaaagcgttctccggtaatgaagtgggctacatcgttgggctgggcagcagcgccaccatggcgatggttatctacttcgccatctgctttggcaaaatcaccttcaccacgctcaatgcctacggcagctttatatcgctgaccaccattgtctccggttttcgccagcaaaccgcaatcagccgtggcggacgtatcctgtttgtggtgctgatggtcacgctctcctgcatcattgcgctactcagcgaaccggcgtttctcaaatcatttacccacttcctgctgttcctgctggccttttttgtgccgtggagcgctatcagcctgacggatttttatctgattacccaagggaaagtcgatgtgcccgcgctgtcgcaaccggatggccgctacggtcgctggaactgggcaggcattattatttacttcctcggagtgctggtacagctgccgttcattgataacccgctgcatcatggttccctgacgtggatttttgccggcaacgatgtgtcatggatcatcggctggtttgttaccgcgctgctgtggctggccgcacgtcgctttgatcgccgcgggaaactggccgactctgtttaccctcagtga

SEQ ID NO: 19361 - DNA, 1068 bp, Glycine max
  Peptide Sequence Number=SeqID_136139
atgcaggagtcatggatgccagcctcagcgctttcactgttcaccccggccacgcaacagtggtttcgccgcactttcccggcggcgacccccgtacaacaggaagcctggcgcgccatcgccagcggacaacactgcctggtgattgcgccgaccggctccggcaaaacgctggcggcatttctgcatgcgatcgacgcgctgtttcgcgagcgcagccgtgacgaacccgtagcgcgcagtcataagacgcgcattctgtatatttcaccggttaaagcgcttgcggctgacgtgcagcgtaacctggcgctaccgctggcgggcgttgccgctcagcgcgcggaattaggtgaggcggacatcacgctggaggtcggcatgcgctccggcgacacgctcagcgccgaacgggcaaagctgcagcgccggccgccggacatcctgattactaccccggaatcgcttttcctgctgctgacgtcaaaagcccgcgaaacgctgcgcggcatctcaaccgtgattattgacgaagtacatgcggtggccgggagtaaacgcggcgcccatctggcgctcagcctggaacggctcgatgtattgttggcgcagcctgctcagcgcattggcctgtcggccaccgtgcgaccgccagaagcggtggcagctttcctcggtggcgcgggtattgtgcgcatcgtcaacccgccggcgcagcggccgctgcagctgacaattactgtgccggtagaggacatgacggacatccagcagcgtcccgatgcgcgcgccgcgcaggagagcagcctcgctgccgggtccatctggccgcatattgaagccggcattctggatgaggtattgcgccatcgcgcgactctggtgtttaccaattcgcgtgggctggcggagaaactcaccgcacggctcaacgaactgtacgcgcgacgctccgcgccagagcatggcgttacggagcccgccctcgcctatggctcttttagcggcggaaccgaaaaacgcgccacgcctgctgaagcgtatattgcccgttcgcatcatggctcg

SEQ ID NO: 19362 - DNA, 303 bp, Glycine max
  Peptide Sequence Number=SeqID_136140
atggctatgattgtatgtctaatatgttaccacactctttccaggtatgaaaaaggtgggcatttgttcctaccatcttatatcatgcgcactcacggatccaagaagcagcaagatgtaatgaagaatgttgaaaggaaacaaatgcaaaaagtttttgaggccttggacacacttggcaacaccaaatggcgagtaaatagaagattacttaatgttgtggagtccctttgggctggaggaggtaacattgctggtctgattgatcgtaaagatgtaagcataaacagtaacaacttttga

SEQ ID NO: 19363 - DNA, 192 bp, Glycine max
  Peptide Sequence Number=SeqID_136141
atgcattctgatagacaaacagatgccacttgccttcaaattagaaggcaaaagattttgaagaattatggtgtcatagaatgtgatcccttagtccttgctgggatggacaaatctgttaagcatatgttaatgccttacatgccgatgttagtacctccaaaaaagtggaaagggtatggctcatactag

SEQ ID NO: 19364 - DNA, 582 bp, Glycine max
  Peptide Sequence Number=SeqID_136142
atggaggtcattttagggaacgtgacaagctattttgattcagctaagcagcttgtgaatgggattcccttgccactagatcttggatccaacattgatgatgtaaaagtgaaagtcaccacggctgctgattctctctccaagaaggctaaagaaaattcaaggatgatacacaaagtcatagatggagtgagactggctcttgttactgttgctgttgttatgatctttgttgcatttctcggattgttattttctttacttgctttgtcgtgtcctgtatactccttggtggttattggatggattcttgttacaggcaccttgttactttgtgctgcatttctatttgtccctaagtttatcagcagagaacctttagtttccattgctgatcttacccttttcatttatgaagaattggctgtaaatgtccattacatggaatgctttggttcctttgctcccataagaggtttgactgaagatgggagccaagcccaatggtttgtagatggacaggaaacatttgaagcaattgctacttcaattcaagatgcaaagtcagttgttcaccaataa

SEQ ID NO: 19365 - DNA, 1396 bp, Glycine max
  Peptide Sequence Number=SeqID_136143
atgtcaggcattgtttctgaccctcaaaacgctctagagagttggaagtcaccgggtgttcatgtttgtgattggtcaggtgtaagatgcaacaatgcaagtgacatgatcatagagcttgatctcagtggaagctcactaggaggcactatttcccctgctcttgctaacatctcttccttgcaaattcttgatctttctggaaactgtctggtgggtcacattccaaaggaattaggctatttggttcagcttagacaactcagtttgtctgggaattttcttcaagggcacattccatccgagtttggttcacttcataacttgtactaccttgacttgggaagtaatcatcttgagggagagattcccccatctcttttctgtaatgggacctcactgagttatgtagacctatctaacaattccttagggggacaaatccccttcaataaagggtgtatccttaaagacctcaggttcctattactttggtctaacaagctagtaggccaagttcctttagctcttgcaaactctaccaggcttaaatggcttgatttggagttgaatatgttgagtggagagcttccttctaagattgtaagtaattggccacaactacaattcctttacttgtcatacaacaattttactagccatgatggtaataccaaccttgaacctttctttgcctccttggtgaatttatctcactttcaagaactcgaattggcgggaaacaatcttggtgggaagctgcctcataacattggtgatctaattcccaccagcctccaacaacttcacctagaaaaaaatctcatatatggctctataccttcacaaattggcaaccttgtcaacctgactttcttaaagttgtccagtaacctaataaatggatcaatccctcccagcctcagcaacatgaataggctagaaagaatttatttgtcaaataattcactatcaggtgagattccttcaacccttggtgctatcaagcatctgggacttctagacttgtcaagaaacaagctttctggttcaataccagatagttttgcaaatctatcccagttaagaaggcttttactttatgacaaccagctttctggaacaatcccaccaagtctgggaaaatgtgtcaatttggagattttagacttatctcacaacaagataacggggttgattcctgaagaagttgcagacttgagtggcttgaaactatacttgaatttgtcaaacaataacttacatggttctttgccattagaactcagcaaaatggacatggtgctagctattgatgtatccatgaataacctctctggcagcatccctccacaactggaaagctgcacagcactggagtacctcaacctctctg

SEQ ID NO: 19366 - DNA, 1044 bp, Glycine max
  Peptide Sequence Number=SeqID_136144
atggcgtttgcaacttcgttttccacccctcaccttcagaggggaatccatccaacaaaatctcaatctctccatcactttctcttcttcccaaaccccattttttgttgtttcccttcttctattccactcaccatcaaaaccccaagaactcaattccatctctctgcctcagtccatgacaattgcgtccaaaagctcgaaaatttgcacgaacccgttaatggggttcatcaaacagagccccctgacccaccgcagagaatattcatccaaaactcaccttggattttgaacgacttgttgctgaatgatattgaagaggagaagaagctcaatttactgaggaggaggcaaattaaggcggagactgaagcattggagaagatggtagaagaatacagagaactagagagagaaatgcgcgagaagaaccttactcccaatttgcctcacgtgaaggctctgtttttggggtggtttgaccctctcaaagaggctatagaggcagagcagaagtcgaagaggtcaaagaagcacaaagcagcatttgcgccccacattgattccttgcctgctgctaaactggctgttattgtcatgcataaggtgatgggtttggtgactcaggagtatcgccgtgcgggctgtgttctccttgtggatgctgctgttcagattggtatggctgtggaacaagaggttaggattcataagttcctggaaaagactagaagtcaccagagtaagaaaacagaggctggtgatgaagacagtatggataatgataaacaaaaattaaggaaacatgtaaatggtttgattaaaagaagaagattgaaacaggtccagatgctattgaaagagaaagaatctggtccttggggtcgtgatactcaggctaagctgggaagtcgattaatagaattattaattgaaacagcatttgtacactcccctgttaatcagtctgctgatactccacctgatattcgaccagcattcaggcataaatttaaagctatatcaaagaacccagagtga

SEQ ID NO: 19367 - DNA, 618 bp, Glycine max
  Peptide Sequence Number=SeqID_136145
atgggcaacacatcctccatgctcacccaatacgacatcgaagaggttcagcaacattgcaaaaacgcttttacgcaacaggagatagtttctctgtaccaacgcttctgtcagctggatcgcaacaactgcggtttcatcccttccgatgaattcctctccattcccgaattcgccgtcaatcctctctctcagagtttgttgaggatgctggatgggttgaacttcaaggaatttgtggccttcttgtccgccttcagtccccgtgccactctccaccacaaaattgaatgtaagctcgtctatgacaccgattgcaatggaaaagttaccttccatgacatgttgagggctttaagggatttgagtggacccttcatgtctgagcaacagagagaggacgttctgacacaggtccttgaggaagctggctatgcaaaggattcttcattagtcttgtctgacttcatgaagggtaagactgcgtacaacatccctcccccataccttcgcatagcgaagagcctctgggtaatgggggagtatgatcttaccatttacttcaaagatatggaaagcttttaccagaatatgattttaatgctagttaggacttga

SEQ ID NO: 19368 - DNA, 1074 bp, Glycine max
  Peptide Sequence Number=SeqID_136146
atgccttttaggtacttcatggtaacgatcaagtcaaaattgagaaatcgaattgctgttgttagaagaggtgatttggaggatgtagaagagggaacaaaagaccacaagtacccaagaatttcatataaacaacttagagaagccactggaggcttcactgcttcaagcttaattggttcaggccggtttggacaggtctacgaaggaatgcttcaagataatacaagagtagctgtgaaggtgttggatacaacacatggtgagatttcaaggagctttagaagggaatatcagatcctgaaaaagataaggcacagaaatttaataaggatcatcacaatttgttgtagaccagaatttaatgcccttgtttttcccttgatgccaaatggtagccttgagaaacatctatatccaagccaaagattgaatgtggttcaattggtaagaatctgcagtgatgtagctgagggaatgtcctatctgcaccattactctccagtgaaagtagtgcattgtgatcttaagccaagcaatatactccttgatgaagatatgacagctttggttactgattttggaatttcaaggcttgtactaagtgatgagaatacatccaccagtgactcagcatctttcagttcaacacatggtttgttatgtggctcagttggttacatagctcctgaatacggaatgggaaaacatgtttcaactgagggtgatgtttacagttttggagtacttgtgttggagatggtctcaggtagacgccccacagatgtactcagccatgaaggctcaagcttgtgtgactggattaaaaaacaatacacacaccaacaccaacttgaaaactttgttgaacaagcactgcataggttctctcattgtggcgtgccaaaccatcgtgttaaaatttggaaagatgttatacttgaactcgtcgaggtggggctagtatgcacacagtacaatccttcaacaagaccaaccatgcacgatatagcccaagagatggaaaggttgaaggacaacctcactaagtcaaacttgccccctcatcaatag

SEQ ID NO: 19369 - DNA, 1239 bp, Glycine max
  Peptide Sequence Number=SeqID_136147
atggtcatcttcgtaggaataagtgattggttcatggctgaaagtgatataacagccatgaaggagacgctccgtgcgcaacagcaacttctgcagaagctgtatgcagagttggatgaggaaagagaagcctcagcaaccgcagccagtgaagccatggacatgatagtgcggttgcaaggggagaaggccgcggtgaagatggaagcgagtcactacaggagaatggcagaggagaagataggtcatgctgaggccagccttgaagtttttgaagagcttatgtatcagaaggagatggaaattacttctcttgagtatcaagccctggcttataagaacaaacttctcacgttggggtctgatttcaatgctagtgattttgaattcgatgaggacctgttgttgagtagacatgatcaacaacataatggagaaaatggtcatgctagtaacgcggtaagaaggctaagttcactgcccccaattccgttaaagaataacttgagatctgctaggaagagagatagatcacctagtcctgttccaattccagtttcagatatggttcctaacatgttggagagtgatactgatcaagaagtttcttctccaagcttcgatttgccaagaaaatcggtagactatggacatggaactcttgatgcatactgggaccagattcaaaagttagatgaaaaagtgaaagtgatttcagattgcaaagaatcaggaggagaaaaacgtgccacattgaggagtagaagagggagatcgtgctcagtgttttcacaagcaagcactaagataacctgtgacttaaaagatagagtagcagcccctactactactagttcagataaagtaaatcacagtgaaggtacatcagatggagaagcagttgctattccctcatgccccggtaatagtgtccatgatgtgtttgaagtcccacaaacaagtcaaaagcataaagcaagtggacatgggaagagaagacttgagagatggagttcagaagcagataacagattgacaaaaccggattcggtgtctgaggaagccgccaaattgcatgttaaacatgacatggacaagcttaagagcatgcttagagggaatcgtgagatcaaaatacctagcaccaaagatatgaagaccattgtttggcagaaaaagaagggatggaaggggattgcaatgctcatgctgagtttcaaagttgcatcagagaaatga

SEQ ID NO: 19370 - DNA, 1455 bp, Glycine max
  Peptide Sequence Number=SeqID_136148
atggatgtatgtgagtcagagcaagcattaaggaaacacagaactagaacaagacaacccttggttcctgctgaaaaaaacaatgcaatcaccaccaccagacgctcagggacaagggaaattacttcacggtataggtcgccttcgcctactccggcaactccatccggtcctcgtcgatgtccctctccaagcctcacaagggcaacgacacctgcatcatccaaattgttacccaaaagagctcaatcagcagagaggaagaggcctgcgactccaccttccccaccaagtccttccacacctgtccaagactcatcaatagatgtgcatttatcatccagaagggtgtctggtagcagaatgccagaggccctttggccttccacgatgcgaagtttgagtgtttcttttcagtcagacactatttccatacctgttatcaagaaggagaagccagtgactagtgcttctgatcgtacactgcggcccaattcaaacgtggctcacaagcaggttgaaacaccaaatgtaagaaaggctactccagagagaaagaggagtcctctcaaagggaagaatgcctctgatcataccgagaattcgaaacccgttgatggtttgcattctcgattgatagatcagcatagatggccaagcagaataggtgggaaggtatgttctagtgcatcaaatagaggtattgatcatgctgataagacaaccagaatgttgaactcttctgttctgggaactggtgtgtcttcactgcgaagattgtctttaccaggtgaagcaagaaggcccttgcagaaagcttctagtaatggtgcaaggctaatgttgcttgttgaaagtggtagaatagtatgcgaggcgaaaccggttgatgacagttttcaagtactaagacctcacaaatttgttccagcaataacattggataaaacaggattagcagcagctggagttagatctcagtccttgtcaaatccaggatcacggctaccatcacccagtaagacctcagtgttgtcctctagtagttcaagaggtgttagtccattgcggtcaaggccttcaactcctcctagaggggctagtccatctcgaataaggccagccaattcatccaaccaatccaacaacgcaatttcagttctcagctttattgctgattttaaaaaaggaaaaaagggtgcagccttcatagaagatgctcaccaattacgacttctctacaacaggtacttgcaatggagatttgtcaatgcgcaagcagaggatgtattttacatccaaaatgtaactgcggagaagattgtgtatagcaaatcattttacaagaacttgttcaatggttcagaaatcactgtacaacgtatggcacactactttgtctatatgggaatcaattatcaggaagaggatcaatctccagcaactgcagcttga

SEQ ID NO: 19371 - DNA, 460 bp, Glycine max
  Peptide Sequence Number=SeqID_136149
atacaacatagatgaacatgattattcagtgcgtttgaaagctgcacagaaatttttgaaagatggcaacaaggttaaggtcatagtaaacctcaagggtcgtgaaaatgaattccggaatatggctattgcgcttattacacgttttcagaatgatgttggggagcttggaatagaggagacaaaaaacttccgtgacagaaatatcttcataattttggttccaaataaagttgctgtgcagaaaactcaagaaccaccaaagaaaagagacaagtcagctgcagatgaagtctccttgacagcaatatttgcatacttctatttcaatccagtgcatgtcaagttggtgactggtagaagggtccattatccataccttgatcaagacaagaagcacatggtcctaacaaaggttttggaaggaaacccgtcaattctcctgattatgcctgcctaa

SEQ ID NO: 19372 - DNA, 1848 bp, Glycine max
  Peptide Sequence Number=SeqID_136150
atgccggatagagacaccgtgttgtggaacaccatgattactgggttggtgaggaattgttgttatgatgattctgttcaagtgtttaaggacatggtggcgcaaggggttcggttggattccaccacggtggcgaccgtgcttcccgcggttgccgagatgcaagaggtgaaggttgggatggggattcagtgtttggctttgaaacttggatttcattttgatgactatgttttgacgggtttgatttcggttttttcgaaatgtgaggatgttgacacggcgaggttgttgtttgggatgattaggaagccggatttggtttcttacaatgccttgatttctgggtttagttgtaatggtgagactgagtgtgcggtgaagtattttagagaattgcttgtttccgggcagagagtgagttctagcactatggttgggttgattccggtatcttctccatttgggcatttgcatttggcttgctgtattcaagggttttgtgtgaagtctggtactattttgcaaccctctgtttcaactgcactcacgactatttacagcaggctcaatgaaattgatttggcaaggcagttatttgatgaatcgtcggagaaaactgtggctgcttggaatgcgatgatctcaggttatgcacagagtggtttaacagagatggctatctctctttttcaggaaatgatgacgactgaatttactccaaatccagttacgatcacgagtattctttcagcttgtgctcaactaggagcactgagttttggtaaatcggttcatcagttgattaaaagcaaaaatctggagcaaaacatttatgtttcaactgctctgattgacatgtatgccaagtgtgggaatatttcagaggcttcgcaattgtttgacttgacgagtgaaaagaacactgtcacttggaatactatgatttttggttatgggctccatggatatggggatgaagcacttaaacttttcaatgagatgttgcatttggggtttcaaccttctagcgttacttttctttcagttttatatgcttgcagccatgctggcctggtaagagaaggagatgaaattttccatgctatggtcaataaatacaggattgagcccttagctgaacactatgcatgcatggtagacattctgggacgagctggacagttagaaaaggccttggaatttataagaaaaatgcctgttgagcctggtcctgcagtgtggggtacattacttggtgcttgcatgattcacaaggacacgaacttagcccgtgtggcttcagaaaggctatttgaactggatccagggaatgtaggatactatgtcttactatctaatatatactctgtggagagaaacttcccaaaggctgcttcagtacgggaagcagttaagaaaagaaatttgtcaaagactccggggtgcactctaattgaggttaatgggaccccacatgtctttgtatgcggtgatcgttctcattctcaaacaacatctatctatgcaaagctagaggagttaacaggcaagatgagggagatggggtatcagtcagagacagtcactgccttgcatgatgtggaagaagaagaaaaggaactcatgtttaatgttcatagtgagaagctagctattgcttttggccttattactactgaacctggtactgagatcaggatcatcaagaatcttcgagtttgtttagattgtcatgctgcaactaagtttatttcaaagatcacggaaagagtaattgtagtgagggatgctaacagattccaccatttcaaagatgggatctgttcttgtggcgattattggtga

SEQ ID NO: 19373 - DNA, 411 bp, Glycine max
  Peptide Sequence Number=SeqID_136151
atgcgcgtgcagacacatgccaaggttgtcgtcgggggaagcgctgatggcgaaggcataggtgaagttgtcgggggagagtgtcgtgtttttgaggagatgggtgtagaaggaaatggaggaggcgtcgggggaaaaggagaagcctttgatgagtacgttgaagaggaagatgtcgggtttgggaacggagaagaagagtgcacgtgcgtggcgcgtggcgccgacgtcgaagagcttctgggtgagcttggtgacggtggcgaggtcgtgctggtaaccgttgcggatgagctgcgcgtgggtttcggcaaggtgagggaaggtgcacgctttgctgatgagggcgaggagcgtgttgcggctaatgtccccacgaatcatctgcaagcacctcaacaccttagttag

SEQ ID NO: 19374 - DNA, 237 bp, Glycine max
  Peptide Sequence Number=SeqID_136152
atggctgaggggattaggaaaatagcaaaaaagactcttggagagtcaagaggttggggatctaacaataaaaaatcttggtgtaatgaaagggtgcaaaataaagttaaggaccttaaggctaaaatgcaagtgttagctgggaaagaaaccaaaaaagtggtgagcaaggtgaaagttagagctcttgaagggttataccaatccttagacaccaaagatggtaagaggaactaa

SEQ ID NO: 19375 - DNA, 564 bp, Glycine max
  Peptide Sequence Number=SeqID_136153
atggctggcatcaccacctcccccttcaaactctctcactttccgactctcttctcttcttctgattccaaactcttcggccttcccctctccaatccctattccctcaaattcgacccttcttctctctccactacctctctctcctacgtcaaagcccgctactacggcggcggcggcggccctccccgctcccccaacgactcccgcttccgcaagtcctccgattccgacgacgacgataaagctctcgacctctccactctcaggtcagataccgtgaggcttattgatcagagccagaatatggtcggagtagtgtcaattgatgacgccattcaaatggctgaagatgtcgaacttgacttggtaatattatccccagatgcagatcctcctgttgttagaataatggattacagtatcaacatactggtggttgatggctgtataaagtggtcgaataagggtgtgcatatatctgtgtcgaacagtcatttttgggcatccattgataatttagcagttaatgacctgcccgcatacatgttcaacaataattga

SEQ ID NO: 19376 - DNA, 276 bp, Glycine max
  Peptide Sequence Number=SeqID_136154
atgaaaacacgcaacaatatgaacaaatatgtaggatcaaggggttgcacaatgttgcaacggcgtggtggtcgagagtggcacatgccattgttggaatgttgctacaacaacattggggtcgctagttcaaatatggacagaggaggtgacggtgatggcgtcgttggtgcagtggtgatgggttgggtgggctttatggtcaagtttgagtttgagtttcaaattatgcttgtattgaatcaatttgtcgggaaaattatgagactaacttaa

SEQ ID NO: 19377 - DNA, 601 bp, Glycine max
  Peptide Sequence Number=SeqID_136155
atggaattccaataccgtgatggccaaaaccaaaggacaccattagcaatgcctttttccggtgtcgcctacttttctggaaacccattagaagggtatgagtttatgccaggtggttttcccgacaatgttccaacgcccaacgttttcccaacaacaatgttgatcaatgctgaggaagcattccgacaagagttggtgaaaaaacagatacgacgggagcgggaggaggaggaaatcaggaaaaagataatttcccgtgagacgacattggcacatcgtcgagaactggaggaggaggtgaagagagaaatgatgtcagagagaatggggggaatccccatgcaaagaacagaggggttcttgtttccagatcgagtttatgtcaatttggagtcttcatatcaaagaatgatgaatcatgttaatcacattaacatatttggtaggccacaaccccaactacctggccaagttgataccaggcaaccttatacactgaccaatactgaaaaggacaaagttatcatattggctaagccaaatgttgacgattatggtgcaaagcgcaaagcaatggcacctcttgcagttgatgaaa

SEQ ID NO: 19378 - DNA, 1017 bp, Glycine max
  Peptide Sequence Number=SeqID_136156
atggcagagaacgaagatgcaagaaggagcgatgaatcgctgaagcttgcgttggcgatatcgcttctgcgatcaaaggttttgaaaagcgtaaaggagtccagtgcgctatctccttcgcaatctgacgctcttctccgttggaagcgaaaggctaaggaaagaaagcaagagatcctgaggctcagagaagatctcaaagacgctcaagatgcttcgcactgcgatctcttccctgagagtgctgctttgcgatttaaggaaaggaggagaagggtaggttcttcttcttcttcaagtcagcagcggaattctttaggtttaattgaggaggatgaaacagagcagcttagggcctccgttgattttctcgtggaaatctgtgactctgtatcatcggtggatgattccaagtttgcaaatctggcacatcaagctgtggactttatattggttacattgaagaatcttttatctatgggaaggaacctggaacttgttgaaggaattatcaacagcctagttacacgtttgatcaggcagatgtgctcgtccttgtcagaaaatgggtctcaacacacgggaaccaatgctcaattttgtattcaacatttgatccgtaaacttggaagtaagccttatattggtcagcgggcaattcttgcagtttgtcaaagaattttggtactagctgagcgtttgcttttctctgatccttttgatgatggctttcctcacatgcatgaaagtatgttcataatgatccagcttatcgagttcttggtgacggattacttattagagtggtcaaaagctgaagattttgacaacatgctccttgaagattgggtgacatcaattgtccaggcaagaaaagcattagaacttctggaaagcagaaatggactatatgcgctttatatggaccgagtcacaggtgaattggcaaaacaacttggcggtgtctcatcgtttctgaagcttaaaccggatatcattaattgcctctttcgctaa

SEQ ID NO: 19379 - DNA, 399 bp, Glycine max
  Peptide Sequence Number=SeqID_136157
atggtgaatccgaatccgattctggacccttcaagccctttctacgtgcattcaaacgaaaatcctggagcattattggtttcttctccccgtgttggagataaccaccattcttcttggtcaatagccttgactatggctttgaagtcaaagaacgagctgccttttggtgatggaactcttccttccaggaggaagaaattggaccttagagctagaaaattcattttttctggtttcaagtcaggcacaaaaggaagttctaatgcttttcttgcctggacaattgatgtcacccaatcttcaaggagcactgtaagtatcattgtaaccactcagttagcaagaataattgattggtacgacagaaatggaacaaaaatatacagtagtagttga

SEQ ID NO: 19380 - DNA, 474 bp, Glycine max
  Peptide Sequence Number=SeqID_136158
atggaattcaaatatcgtgctgcccaagatcgaaggacatcatcaccacagccgtaccctctttccaccggcacctacgtctccgatcgcccattacgagggtgtgagttttcgtcaggtggttatcccggcaatgttccggctcctagagttttccgaacgccggtgccagtcaatgccggagaagcgttccggcgagagttggagaaaaagcaaatcaggagagaaatacttgcccgcgagatgacgcgacgacgagaactggaggaggaagtcaggagggaaatagcactagagagagtgttgggaatcccgtttcgagaacgagcttgggtgtctttgaatcaggatcaaggaatgaacaacccggttaataacaacatatttggtgggtcacaaccttcactgtcccctcaaattgatatcagcagacaacagacgaacaaggataaagtgatcatactatttagttag

SEQ ID NO: 19381 - DNA, 216 bp, Glycine max
  Peptide Sequence Number=SeqID_136159
atggatgtgaaggagatggtgatgtacctaaatccaaacgacaacatttttggttgggttttgtttgttcaagcaatcaaatctgtagggatggtggattttttggttgggttgctgccacatggaaaagaagggaaaccaaactccccaatcaaacggctagacaacttccagggcatgctgccattgtatggcagaccttgtgcttctgaataa

SEQ ID NO: 19382 - DNA, 910 bp, Glycine max
  Peptide Sequence Number=SeqID_136160
atggagttcaaatatcgtgatggtcaaatccaaaggacaccatcacctttgcggcaccctcttccttccaacacctacgtctccaatcgcctattacaaggtggctttccccgaaatgtttcagtgcctagagttttcctaatggccatgccgatcaatgtcaatgaagtgttccaacgagagttggagaaagagaaaatatggcgagagctagagaaggaaggaatcaggagagaaatcattgctcacgagatggcatttgcacaacgacgagaactggaagatgaagtgagaaaggaaatagaattggagagaacattcagaatctcgatgcaaagatcagatgtgatcagatttcgagaaccaatttcagtgccttttaatcacagtatgggtccgttgaatgacattaccatgtttggagggctaccattccatttactgtcacaagcttctaagcaaattaacaaggataaagtgattatactgccagatgatcattgtggtgaaaagcgcaaagcaatgacacttgcaattgatgacaatgagagtctacagaagaaatccaagaaggagtggagttgcgagttgtgtcaaatttctgcaacaagtttgaaaggcttgaatgatcatattcaagggaaaaaacataaggctaacaaagaatccactagaactcaaaaaatagggctggattcaagaccagaaagtgaaacacttcatccttgtttaacacccgcggacacatgcaaactggaatctaaagaaaagggccaggttgtccaaaagagcaaaggtttagggctggattcaagaccagaaagtgaaacacttcatccttgtttaacacccgcggacacatgcaaactggaatctaaagaaaagggccaggttgtccaaaagagcaaag

SEQ ID NO: 19383 - DNA, 496 bp, Glycine max
  Peptide Sequence Number=SeqID_136161
atgtccgctcagatacctgccacagattattcaggcgcagagaaacagcgcttgtcagaaacacgttctattgattacatcccgctcagcgagcgtcacgggcatccgtttagccagttcacgttgtggtttggtggcaatttgcagatcactgccattgttaccggtgcgctggcggtggtactgggcggcgatgtggtgtggtcgattgtcggtttactggtgggacagatcgtcggcgcggccatcatgtcgttgcacgcgattcagggcccacggcttggcctgccgcagatgatcaccagccgtatgcagtttggcgtgtttggcgcggtgatcccgctggtgctggtgtgcattatgtatgtgggcttctcggccagcggcacggtactggccggccaggcgcttggcgaagctggtcaacgtcagcaatgcagccgtgctgatcatcttcagcgccatcatcatcgtgattgcggtgctcggctatcgg

SEQ ID NO: 19384 - DNA, 588 bp, Glycine max
  Peptide Sequence Number=SeqID_136162
atgaggttacatgctgaccggtcattggaaattgtgatgacgctggcaatgttgtccgttaatgtcaggagcctggccggacaacccggggagggaatcatgcaggcagtgattgaaacagaacgcttacgactggaaccctttgcgctaagccacctcgccggcttgcgcgcgatggatgatgacccggaaatcatgcgttatatcaatgagggacaggtgaagagtgaggacgagacgctggcgaccattgagcgcgtgcagcaacgctggcagcgctatgcatctggcccatcaggaacaggcgccgctggaaattggctggcgactgttgcgcagcagtcaggggaaagggtatgccaccgaagccgctacggcgattgtgcagtttgctaccgggcagatcggcgtggattatctggtggcggtggcacatccggaaaaccttgcatcccatcgggtgatgcagcggctggggcgcgcacctctggtagcggcgcgatttatcacgcaataaattgcgccgctatcaaacatgcacccggtaagggtgcgctcaataccctggtacgtgcgcggcttccatga

SEQ ID NO: 19385 - DNA, 396 bp, Glycine max
  Peptide Sequence Number=SeqID_136163
atgacggcaatcgagcggcttaacgcgtttgacaggcaggggcgctatgtctttgctgtgcgtgatttagccaaagtcttttatgacgacagtgacaaggctttcaatgctggcctgaaccgtctggtgaaggacggcatcctgcagcgcgccagccgtggcgtctatgtttacgcctatgcgagaagtaaagacgcttacacgctggaaagaatcgtccagacgttgcgcagaggagaatacagttacctgagcctggaatcggcgttatcggcttacggtgtaatttcacaaatcccgatgaggcgtcttaccgttatgaccacgggccgttctgaagaacacattacgcctttatggcgtgatcgaattcacgcataccaaacgatcgcctga

SEQ ID NO: 19386 - DNA, 1218 bp, Glycine max
  Peptide Sequence Number=SeqID_136164
atgaatcagaaagtcagtttcactgaactggtcgctaaggccatggcttcagcgcaactcgagggtatgcgtaacgtagtggaaaaagagcttttacactacgacatcctttactgtctggataaagcgggtctgctgcaaaatctgacgttccagggcggtacctctttgcggctatgttatgacggcaatcggtttagcgaggatctggatttcgccggcggcatcaacttttccggtgcagatttaaaaaacatgaaggtctgtatcgaagactatctcggcacgcgttacggtttagaagttacggtcaaagagccggcagaacttcgccgccagcccggctatgaagagattagggtcgataaatggcaggtctccgtgacgacagcacccgaaaaacgcgatatgcctaagcaacccatcaaagtcgaagttgctaatattcccgcttacagtcgcaaaccgttgccgctgagccgcaattatccggtgttgccggatggctacagcgatacgctggtgatgtgtgaaagtctcgacgaaatcatgagtgataagcttatttctctggttgcgaccaccaaatatcttcgttatcgcgatgtctgggatttaccgtggctgatgcagcaaggcgctgcgtatgatgtgggctggattcggcaaaaaatcgaggattaccggattcctgactatgaaaagttattaaaacaacgactggctgatttgtctgcgtttgtcgggacgcatttcgtttatacctatgataatggctggaaatatgagtggtacgcgcgcaacgcgacaacctgtgattatcgtatccatcagggattggttggtggccgttgggtgaccaatcaaagcatgaatgcggtgcagttcgcaccgggcatttataaagtcgactggcacgagccgaccggcacctgcgtcagtctgctgtttgatattaaccgcaaggtgattcacggcaccatctttttcccgcagtggattgccggcgaaggacagcatccggaaaaaaccatctgctatcagaatgaatttatcgaagatatgcatcgtttccgtgatgaagggccagcgtatccgtacgtggtgattcctgagtttgccaaagtgacctacatgaagaatgaaggtccggataatgatgccgtaatcaacatgccgccgggacaaatgccggaagattattttaaagataaatga

SEQ ID NO: 19387 - DNA, 990 bp, Glycine max
  Peptide Sequence Number=SeqID_136165
atggataagcgacagctaaaagcttttatctgcgtgtttgaggagcgcaacatcacgcgcgccgcacaattactcaatctgacgcagcccgcgctctcggccacgatcaagctactggaagaggagctggccaccacgctttttatccgcaggccgcgcggcgtggaggtcacggaggacgctcgtgtcctttatccgcaggcgcgcaagatgctcagcgatatgcaggcgctggtcacacgctttcggcagccgtcggattgcctgccgctgaagattggcgtcgaaggggatgtcgcccccgcccagctggcgcaactgctgacggccatccggcaacattttcccacggtgctgcttagcgtcgagcccggttgcgtgggcgatatccggctggcgtgtgaaagcctgcgctgcgaagacgagctgtttatgccgctgtttgaagagcattacgtgctggcgtatcccgccagtcatgcgctaaatcagctggaaacgctgacccatgaccagttgcatccgctgccgtgggtgatggtgccgactgatgagtcacatcagcggctgctgccgttttacggtacgggtgcggccgcggccaacgccggcagctacgcgctggcgctggatctggcggaagccggctttggcgtcaccattgcgccggcgccgctggttgccgcgcggcatcgcctggcctggcgcgctttacccggtcagccgctgatgcggcgtgtcggcatttgctatgcggttcaggcacaggccaatccggcgacccggtgcgctgccgggcgcaccggatcaaagcggattagcgcgggttcatcatgtcaaatatggcgtcaaaattgccgtcgcgttcggcccagcgccgcgcatggtcgcgctccagcagcagttcgccgcgcgcgaccgggccattttccagcatctgcagaatctgcgcgatatagtcgtccagcggcatggcgcggggatcgctga

SEQ ID NO: 19388 - DNA, 210 bp, Glycine max
  Peptide Sequence Number=SeqID_136166
aagaaatggagtgtgaaatggatgaaaaggagagaaaggggaataggtgaaaaaaaagcgagtagacaaggggaaggtgtggttatcaaaatgcagcttctcctttggaagagtagggatagggacaggtctaatggcggtgctgaagaagtttgtttgttcaacaattaccttaacaccaaattgatcttcggtctgggttgcaattga

SEQ ID NO: 19389 - DNA, 552 bp, Glycine max
  Peptide Sequence Number=SeqID_136167
atgtcattcatgtttctgacatataggatgctattattgaagatatatttgtcagtgtctaatacagtttcaagaaaaattgcgccaactaaatttgattacgaacccgcttttaacttcgataaaattgatcatatagatgcagaagttgattcattcatctcaatcaagtttgaagaaaatggagtggcctcatgggagaagagcaacaccaccgccatctcaaatatgtccaagaaggtgcgtgtagagagccaggtcctagacaaggacgccaaggagagcaagagcgtggtagagcatggcaagtcaaataacgcgtttagatggcgaaagcgtatgggccgtttggtccacttcatcccatggaagaggtccaataagggtggtggtgtgggccacgttgaaggagtgaagtttgatgttgccatagttatggaaggtcattttcgtaggaccattaaagttgctacattaggatcaacagtggaagggatcaatagagaaaagcttcaccgactacacgagattgactatacagacacgaagtaa

SEQ ID NO: 19390 - DNA, 501 bp, Glycine max
  Peptide Sequence Number=SeqID_136168
atgaagtcaagtgagaggtcctcccatggacgagaagggactggtagggggcaaaaccatgtgaaattttcactacttcgagctaaagttttcgttactctcatatggcctctcgtcggtgatgaatggaactcggaccaagtcttgaatgatagcacaatcagggtgatcctgaggattatttgcaatggcctgttagaatttaatgaattcttggtgtatgaggtgctccgggaaggatttgttgtaaatgagaatgtcatcaaagaagacgatgatgaattttcacaaatgaggggcacagatgctattcatcatctcctggaaagtggagggagtaaggtcaagcttcgagaaccaggaagcgcctcaaagctcatcttgcagcttctctatagtggggataggaaaccggcccttgaccgtgattgcgttcaatacttgatagtcaacacaaaacctccacgacccatcgtgtttcttaaccaggagcgcaagtaa

SEQ ID NO: 19391 - DNA, 246 bp, Glycine max
  Peptide Sequence Number=SeqID_136169
atgtacgaggtcaggtacacgaagggggacaccttttttgtcgctcaaactgcagcaaaaaatgctattcgaacagtatcagatcaaggcatgcaacgagcaaaagtcatgataaaaggtcctagtctcaaaagagatgcgacattaagagctattcgtagaagtggtatactattaaattttatacgagttgtaactcctatgccacataatggatgtagatctcctaaaaaaagacgtgtgtaa

SEQ ID NO: 19392 - DNA, 330 bp, Glycine max
  Peptide Sequence Number=SeqID_136170
atggtggtgcaatggtggtttaggcaagtagatctagtgaaagggaggttggtggtgggaggtattggtgtttcagtggtggtttggacaaacaaatatggtgaatgggaagttggtggtggcccgggggtggttttggagagtcgatctggtgaagaggaggctagtggtgctgcggtggtggtttgggcgagcaaatctgatgaacaggaggctggtggtggtgtagtggtagtatacgtgaacatatcagctaaatgggaggttggtggtggcacaatggtggttttggtgagtggatctaatgaagggagaagtgtgagagtgtaa

SEQ ID NO: 19393 - DNA, 444 bp, Glycine max
  Peptide Sequence Number=SeqID_136171
atggccgctactatgaaggctttagcttttgttgctttgcttgttaccattaatgcaatagtgtgtgaaagtagagtggcgagaaaggaccttggattggaccttggtggggtgggaattggggtgggtgctggggttggactaggccttggtggtgggggtggtgctggttctggtgcaggtgcaggctctggctctggctctggctcttcgtcatattcaagttctggctcctcttcttcttcatcagggtcaggctctggagcaggttctgaagctggttcctatgcaggatctcatgctggctcaggctcctctagagcgggttctgaagcaggttcatacgcagggtctcatgcaggatcaggatcatacggtggtaatggaaagaatcgtgcttctccctgtgtccaatatgcaatagtttccttgaaaggtggttga

SEQ ID NO: 19394 - DNA, 222 bp, Glycine max
  Peptide Sequence Number=SeqID_136172
atggcggaggaagcgaaaggagcgccgtcgcgaagcgccgcggaagaaggtgaagcggccatgcgagaaaccctagtgaaagtcgctgcggaagattttgtggaaacttcacacttggtggtagtaaaaggatgcggagatgtgaaacgcccaattagggaggaaattttcaggaccattaattttaaaatcaacggtaaaattaaatcaaaaacattttaa

SEQ ID NO: 19395 - DNA, 393 bp, Glycine max
  Peptide Sequence Number=SeqID_136173
atggctattgttcatgacattgcagagggtatgctaatgcttgctttgtgttatttgtctgtgcctgcaattgttggggacataactccattggatggagtttctaaagcagaaaagaatcaacgagaacaggcagcactagatcatatgtgtaaagtacttggaggaggatctacagcaatggaaatagcagagttgtggatggagtatgaagcaaattcttccccagaagctaaatttgtcaaggaccttgacaaggtggagatgatactccaagctttggaatatgaagttgtccttgtagagttgcttgtcaattcttcaaacaatacatattacaatattgattgtcaaggaatttatgcaagtgatgctaaatttaacgcatgttaa

SEQ ID NO: 19396 - DNA, 789 bp, Glycine max
  Peptide Sequence Number=SeqID_136174
atggcctcccttcgtattcgtaaccttctccgtttctccatacacgggacgctgctttcatcttctccacttcgaccagggttttcgggaagctctcgaagctacagcgtcgttgaatcttcgaaacattttctattgaagtccgacgatgaggagatattcgctctccgtcgcaaattcgaagctgccaaacagagttttctcagtattcccgatgcgctccgggaaatgcccaaaatgaatcctaaaggcatatatgtgaataagaacgtgagattggaccaattgcaagtttatgggttcgactatgattacacattggcgcattactcgtctgatttacagactttgatatatgaccttgccaaggagtacttggttaatgaggttagctctgacaacacagtcctgctttatgactatggttcctttccttactcatcttgttgctcctttcagcttaggtatccggaggtttgcacgagttttaaatatgatccaactttccccattagaggcctatactatgataagtcaaaagggtgcctcatgaagctggatttctttggttcaattgagccggatggatgcttctttggaagacgcaggctaagccatacagaaatacgtgacatatatggcacgcggcatattggtcgtgatcatgctcgatcacttgttggtttgatggatttcttctgcttcagtgaggttagttccctgttgtcctgtcattcaataataacttctgcttttgtgatgtgcaacgttggagctttgcctcagtga

SEQ ID NO: 19397 - DNA, 414 bp, Glycine max
  Peptide Sequence Number=SeqID_136175
gcatgccttcttgcagatatagttcagtactttgttgatgctaagctagaatttgatgcttcctacatttatgaagatgttattcgtgcaattgaccatgtccatcgaagtggcctggttcatagaggaattctatctgacccacacagatacttagtgaaaaatggaaagatattacgttatcttaagatgctaagggagcgggggaagaagcttttcctgttgactaattctccttattattttgtggatggagggatgcgttttatgttggaggattctctggattgtagagactcttggacggaactgtttgatgttgtgattgctaaggccaataaaccacagttttatacatctgagcatccattccgaattatagtgatgaaaggggaaacggaggatacaatctag

SEQ ID NO: 19398 - DNA, 1164 bp, Glycine max
  Peptide Sequence Number=SeqID_136176
atggatttgaaactttctcaagaaattgtagtcatggcaacaccacttgtttatagacttgtttcattgcctttcatatttcatttcaccttaaccactgccaccatcataacctcatctattaacccagtgtttctcatacactatgagtcaacactatcactctacaattcaaaagacaccacttgggatcattactcgcataaaatgcttaagcaaacttctagtaatgaatatatctccaatcttgttcctagccctagaaatgttgtgttcttaattaatttctccataggtgaaccacctgttccatcacttgctgtcatggacactggtagcagctttacatgggttatgtgtcatccttgttcatcttgttcgcagcaatctgttccaatatttgacctctcaaaatcttccacatatgctttgacattcagtgaatgtaacaaatgtgatgtggtgaattgtgagtgtccatgcagtgtggagtatgttgggagtggttcatcaaaagggatctatgcaagggagcaattaacttcagaaaccatagatgaaaacgcattcaaagttcctagtttgatatttggatgtggtcgtgagtttagtacatcatcaaatggttacccctaccaaggaatcaatggggtgtttggacttggtagcggaaggttctcgttgctacctagctttggtaacttaagaaatattaatcataagtttaacatattggtcttgggggacaaagccaatatgcaaggtgacttaactaatttgaatgtgatcaatggtttgtattatgttaatctagaagctataagcataggagggagaaagcttgatatcaatccaaccgtctttgaagttgagaatcttcttgaaggggttttggttttggcccaacaagataagcacaatccttatactttatgctatagtggtgtgggtgctgttttggacttggatgtaacaagtatgtttatccagaccacagagaatgaattttgcatggctgtgcttccaggggactattttagagatgactatgaaagcttttctcctattggaatgttggctcaacagaattataatgtgggttatgacttgaatgggatgcgtgtgtactttcagaggtttgactgtgaacttcttgatgggtga

SEQ ID NO: 19399 - DNA, 1372 bp, Glycine max
  Peptide Sequence Number=SeqID_136177
atgagaaacgtgcttcgttctttgcgacaattgcgaccagcctttcagaggcaagattgtgttttgatcattgttaatgttgcagaagaacctccatgtcacattggaaagagctgtcatattcattcttcagcttttagatttgttgatcatgctgagaccaactttaaaaaccatttgtttacaacaaccacgagacctctctcaactgatgccgcaaaacttacaaatagagaaacaagcaaagctgggcctcttgttgagtatgaacgaaggattactaatggtgaacttgtagaaggtgatgcttgccaggtagacactctgacagaacttcagagactgtatgatgagcttgttgagtctgctgacatctgccaattggatcggaactctgaaaaacctgtaaggagtgggtggctgtggtctcgtctcttgtctcatccctcttactcacctgtaaaaggtttatatctttatggaggagtgggtaccgataacctatatgagggtggattgcagagggatctctttctacccttcattgcagcattgaaggaaagatgtgtagtacatgagattggttcatcaattgactaccgcaaaatgacatcgggtgagcaaggattctatttggttggcactgatttatctggctttcttaaggagaagtttcaacagttgattggagaaggaacagctactcctactccccaagaagtagaagtagtaatgggaaggacactgcatgttccattgggagctaacggatgtgcctattttccttttgaggaaatttgtgatagacctcttggggctgcagactattttgggttattcaagaagtttcatacgctagtcttggatggcattccaatttttgggcttcacaataaatcagctgcacataggtttgtcactttagttgatgtgatgtatgagaacaaggccagactattatgtactgccgaagggagccctaaagatctctttgaaaaaatagtaacagtatctgaggctaaaaatttggcacccagaacctcttcaagatcacggaaaaatgatgattctaacctttgtgtggacaatgaattggggtttgccaaagaccgcaccattagtagagaacctagcatgccgtttagtgacattaactactatgaagaaatggattaccttcacatgatgaggcatgatcttgacatcaaatggaacatgaagccatgcttcaggaatgttgctccaaaagatctattaaacatcatcttcatcttgcttcgtgctttttgtctctcctcattaagttcttcaagaagtgaattgaaagctgtagttcttgaactactagatgcagttgcatgcaatttaccaa

SEQ ID NO: 19400 - DNA, 552 bp, Glycine max
  Peptide Sequence Number=SeqID_136178
atggatgagttgaattttatattaattgaatatacagtgaatatagttgctatctgtaaacctaaccctctggtccccccctcctcccaaaaaaatgctactctgagtgttggggagttggttgatacttggcaggtggtctacctgctagttaggaaaatactacatgaaaagagggttgcagtgttggtggacaaagagcttggagacaattatgatagaatagaggtgggggagatgctgcaagttgctttactgtgtactcaatatttgacagcccaccgccctaaaatgtccgaagtggttcgaatgcttgaaggtgatgggcttgctgagaagtgggcatcatcacataattacggtaatcaagacatgaactccagtcacagtcacagcaacagcaacaatagcaatacttcatcccgccctacctctgcttccaaacatgatgatgatgttaatgaccgttccagcatgcttggcatgacaatggatgatgatgatgaacagtctttggaatcctatgccatggaactctctggtcctagataa

SEQ ID NO: 19401 - DNA, 363 bp, Glycine max
  Peptide Sequence Number=SeqID_136179
ttatatcatcttgtgttgattaccacgcactttggctttttgatgttgccaaagggggagagaaatggggtggaattaaattgtcatcatcaaaaagggggagattgtagaagcaaagactttgcctttgaggttttgatgatgccatatgtttgtgatattttgatgccttatgaaaatgcgcttctcaagtttaattcaagacaaaaatccaagaatacaagatacaacattaaaaagatctctagtgttttaggaagggaattccaaattgaaactgtaaaaggtttgaccaagaaatttaagcaaaaatgtcttattcaagagatttactctctggtaatcgattaccagaggatgtaa

SEQ ID NO: 19402 - DNA, 2001 bp, Glycine max
  Peptide Sequence Number=SeqID_136180
atgggagagagtctgagagacagagaggtcgcccaagactcagagaccaacaggggaggacttctgacaggcactctgttggagcaaaacacaaagatgatgatactcaaagaaggaacgacatcaatctacaggagggtcaatggattcaggtctgtggcaggaggaaggctcgagcagaggcaagaaacgtcaatagaggggattagcgaagaaagaacgagtctaaacatgacaaaagtagagaaagtttcagaccatcaacatggagaagaatggggaaaggtgtgggaggtctttatacccaaaacgaagaataaacaaggtctcagatacggttttgtccgcttcaaaggggacgacaacacccatgcaggaatagtcaatagaacagagctgaagataatggagcgtagggagcttcaaaatagaaggcgcgaacctatcccataccccaggctaaaatcgtacgtggaagtggtgaaggacaatcatttgaaggatggaaaaatatcaaaagagctaatgtctggggaggtggacacggaagttaaaaaagacttggtcactattcagacatcaaagacgaacacgagctggctggacaatatatgggtggggcgtctgaaaaacaaagccatatttgaaaaggtggatgaggaagtacagggggtgtttggaatggagatgaagtcaacttattggggggatgacttgatactccttcacgatttggatgacgacaaagctcaggagcttattcgccgagaaagagaaagtggaggaacgcctttaatctctatccagagatggtcgccggacttacagccgtctcaccgtctaacctggctttatatctggggtgttccactgaaggcatgggacgtggagcacttcgcgactctggtatcgggatgtggtgagttcatcgagctcgacgaggaaacaaaggagagaaagaggatggatgtagcgcgtgtgctagttcgaacgacagagaaaccgaacatagcccgatccttgcttgctatcgtcgacggaatgtcacggatggcagtaacagagacattcccgccgtcgcctttcaccacggccttggtggattccgacgaagacccaactacccgcatctccgatgctctcaacctctggagcacggaaaacgaacacccgacagatgatgacgtgtcatctaatcattgcggcacgtctctatctcaccctgcgggtctgacagttgacggtatgaataaagacgaatgcaacggtcctcctttccctcacttgcatgcaaatggaatggttgaccctaggaatttctgccctagccaaacctatgacagtactgaggaaatacctcttgaagataatgacaaagcagccacagaaaagctgaattgctttcaggccaatcaaattaactctacagataatacccttcagtcctttgatgtggtcaacagggattcaaacttcatgccttcaaatgacagggatgcaggcattagagaccagacttcggtggaggataaagtggaccagaagttgggcctcgttcccaaaggcccatttccaaaggggggtgtagcagaaattgtgaaagtttatgccaggagaaaggagggtgccatggaaaaatacaaggcccaaacaagctcggacccaacctcatgtgccatcagagaagccaccaaaccaagtaaagtagacctcggggatgactctatagcccacactgttgttgatgctcaactccaaccaaacacagctactttggacacatatctatttcaacctcagctcaattccagcctttcaaacaacccaaataaaaaatgtgaggagaatcaggaggaggctttttgggatgtagccagagatttaggcctgacttttgatgacaactcaggcaacatagtaaagctgaagaatgtttcgaaacaggcagacacaccaacagcacttcaacctgtgaagggaaaggatcaacttgacccatga

SEQ ID NO: 19403 - DNA, 330 bp, Glycine max
  Peptide Sequence Number=SeqID_136181
atgtttaagcaagacgaggagaaaattgcgttcatgaccgacacaagtaactactattattcgattatgccattcggactcaagaatgttggagccatgtaccaaaggctgatggacaagatatttaccaatctgttagggagaaacttggaggtctatgtggataacatgaaggtcaaaagaagaagctccatttcccatccagatgacctggtagaaattttggtcgagacaagaaaacacaacatgaggctaaatcccgaaaaaatgcatattcaaagtaaaaggcaagaaattcttgggctttatgctgactcacaggggaattga

SEQ ID NO: 19404 - DNA, 477 bp, Glycine max
  Peptide Sequence Number=SeqID_136182
atggagaacctctggaaggaaagcactgccttgagggagcaatatcaaaggcttcaacatgatcatcagacgctctcaatctccacagctgttgtgcatcagaaccacgaaggggcaacactctattggtatacttgcctaccaaaaaacttgatagattcttttgggacactcatcaagcgatttagagcacaatatgcaacaagtagaccatatcaccttattgcaatagctcttgcaaatattcagcaggaagaaagcaggcctcttcataatttcatggaaaggttctcctcaatctcaatttggattaggggcttgagcttggaagtagctctgacatcaatgatcataggcctaaagtcaggacctttctcaaacagcttatgcaaaaaacctcctacaacaatggacgaattaagggaaagggttgtcggcttcatacatatggaagaaatgactgcattttgggaataa

SEQ ID NO: 19405 - DNA, 402 bp, Glycine max
  Peptide Sequence Number=SeqID_136183
atggagaggaagcccactaaaagcatgtcacccatcattttaatagatgaggactttagagatatcgatcgatgccacaatgatctcatggttgtcaaaatagaggtagctaacttcctagtatgtaaagtcttactcgaccaatggaagctttacagacgtcctctattggtcggatatgcccacctactgactacttttagggataagaaaggatcaaaatctatcatgatcaaatacctcttagtcaatccatgcacatcgtataatgcactcacagggcgtcctttgttcaatgagctagaagctatcatctcaacaccccacatcactatgaagtttccaagtgagaacgaaaggattattgtcattcgagccaaccagatgataataagagagtga

SEQ ID NO: 19406 - DNA, 126 bp, Glycine max
  Peptide Sequence Number=SeqID_136184
atgtgtttcacacagaaaggcacatatgaaagtacgttcactttcctgacaagactcgataaagataatattcgagcgatcgacatgaccaaatttgaccaactcaaggaactcgacaatggactt

SEQ ID NO: 19407 - DNA, 423 bp, Glycine max
  Peptide Sequence Number=SeqID_136185
atggactcgaatttatgcccatttactttacttgacaggaaggctcacgccgagaaggctgagaaggttcctacggagaaggacaaatggaagcaaaaagaaaatccccaagatgattgggtgcctcctcctcttcccgttacaatcggtatcattatctgggaaggtcatgggccttctggtgggggtcctttgaagaagaaaaggttggagtctatcctgatggttgttccttttgccatagagagccatcttgcctttttattaatgaaagagggggtctcttatccatgggggaagaactacaaccccaaggctcgtattcaagcttccatgcttagccagtccaaccaagatatgctaagggaggttggtcatcgtgtgccaatggattccattgctcgcttcactgcaaggtcttag

SEQ ID NO: 19408 - DNA, 429 bp, Glycine max
  Peptide Sequence Number=SeqID_136186
atggaggtcgtttgtgccgatgagacattgttgaagttggttgaggaatctcgagaatctcttgcccatattgagaccaaattaaaagagcttgagacccgagaggaggcactgaagatcaggtttactactaatgagaattcgactaaggctcttcacgaagagatcgagcatcttaataaggagttcagtctttttaaggcagctattaagaagatggaagaaaaattaaagaccaatcttggtgaagtcgaagccgagattctaaagactcatgaagccaagttcaacaaggctcttcgtcaagttaaatatttttttaaagatgctagcacttctcttttaaatgttgacaaggacaccactagtcaaggggagttagtcgatgaagttgatatacttgcggaggaagtgcctaacttgtcttaa

SEQ ID NO: 19409 - DNA, 189 bp, Glycine max
  Peptide Sequence Number=SeqID_136187
atggagactttaccaactccttcagaggtgactttggtgccatttgctagggtgaccagatgtggaaattttggaggagacatagagattgagaaatgcaagttgttgaagtactggagcctgaagatgattgagcttgactgttggacttcaattgaaggtattcttaatactcttcaaaaaacttag

SEQ ID NO: 19410 - DNA, 1389 bp, Glycine max
  Peptide Sequence Number=SeqID_136188
atgttgcaagttggaattctatgcacccttaatttgtcatgccctgctaacctgagcaacatgaggaagcaggttggaactcaagaaagtatgcgtagtgtcggtgttattggactttccctactttcaaattgtgattctgatgatgatgatgcatcactttatgatatttattgtaggatgaaatggcggtttgacttgttagagatggttcttgagatagcttttgaaaaattagcaagtaattttgagaaacagttgcaagtgtgtgcgcttagagaatccctgtacaagatgaatggtttaccaatctgttgctggcagtcctcctctatctctgtccttgtcaatggaagtcccacagaggaatttgtgtctcaaaaaggtattcgccaaggggatcctcttgcaccatttctcttcttggtgttggcggaaggattaagtgggttgattagagaaccaaagataaaggattctttcctggacatgaaggaatccatcactttgaaagcaattctttggagctttgagttggcattggggttaaaagtgaacttctccaaaagtagtttgatggtgggggcggatgcaaggaagcttagcacatggcaaccggtaattgaaaaggtgaggaagaaattgacaccttggcgaaggagacatctctcctttggaggaaggatttgcttggtttcaaagaaattttttgtgggggcgagaggtgaggaaaagaaagtggcttgggtcaagtgggatgtgggggttgttgtgataagaggggttcccaatggtgattttgggatgctaagtgggttggagaggaagctttgtgtaccaccttcaatagactttactcaacaaaaaaatagtaatattgttgatatgggattttggtgtgggaaagagtggagatgggacctcttatggaggagaccgtggtttacatgggaacaatctttagtgcaaaaactaatgggtgttattggggaatttgggccatacaaaaatgagatgctggagaggatcgaagtttctataaacaactatggagactacctattccctcaaagtatttggtcaagatgctatgcttggcttggtgacatgagggcactgccatctgaatgcaagcaacacctttggcaacatgcgtggaacgttagaggacccaactctaatctggtttggtgggctgtatgggcctcagtagtttgggagatttggaagcaaagaaacaatatcatcttcaaccagggacactgggatttggactcggttatggatgctattcagtacagggtctggagctgctgtaagagtggatcctgtgagctgtttgcaacaattgaggtagctattgaccagggccaaggcgtgatactgtga

SEQ ID NO: 19411 - DNA, 348 bp, Glycine max
  Peptide Sequence Number=SeqID_136189
atgtctttttctgaggaaggttctgcttgctccgatgatggccgaatgttgtcgccagaggtccgccctataggggagagctccaatgatgaccacacccaccctcatggtggttctgacgttgctagcaaccaagtctccgacatttgcattggtgatgttgttagtggcattgtgattcctcttgacgttggtcctgccatccctataggtggtgttgccactaggaaagggccacatccctatttcggtgtgcgtcttactcttatggaggatgaggccgaatcccctcggccaaatcctcctcagaatgttatagatttagacttggagaccacaattattcaa

SEQ ID NO: 19412 - DNA, 882 bp, Glycine max
  Peptide Sequence Number=SeqID_136190
atggaaagatgtgattgtcaccaatttagtttgaagaatttggctgaatcactaaaaacactaggtaacaaggcaatgcaatctaagaaatactctgatgcaattgagttgtataattgtgccattgcagtccatgaaaagagtgctgtttactactgcaacagggcagctgcttacactcagattaacaaatatacagaagcaatccaagattgtcttagatccattgagattgatccaaactataccaaggcatacagtcgtctgggtttggtttattatgcacaaggaaattacagagatgctattcataaaggctttagaaaagtagaaatcgtctggagaatgttggctttattgttgttatatactgttacttttaaagccttgcagttggatcccaataatgagtctgtcaaagaaaatatacgggtggctgagcgtaaattactagaagagcaacaccgtgcatatcccaaccagctaaacatttttttcctctttcattctctaaagaatacaagatcatctcaagaattcccaaaccaatctgcacaaggaggatcaagaagccatggcgagccacctccattttcctctatgccgtttaacccccgtgatattgcaagcatgttcatgaacttcacgaacgctacaaatgcacagcagcaggggtcacattctcaggaaaggcaagaagatagcaatggtagtggagctagtgagcctgaaataagaattgggggaaatattagtgtaaacatggaggacatgccagaggatataacaggggcctttcaatctatgatggaaatgttatctggggctgcaccccccgggcaaccgcaagatcaaatgaatggaagagcagcaccaaactaa

SEQ ID NO: 19413 - DNA, 276 bp, Glycine max
  Peptide Sequence Number=SeqID_136191
atggcctctagaacttcttctgttggtcgcacggtttctttctctgggacacctgtcataacctcagtgaagttgagtgtctgtggagccaaatatcttaggaactcacttgagcattctgaagcttcagcaatggtgtctactagaggaatgcgaggttgtgggaatcatggaggacatggtggtggtggtggtggtggtggaaacacgaattcagaccttcgatgctcatattgtaagaagcgggccatacccaagacaaatgctactacataa

SEQ ID NO: 19414 - DNA, 2112 bp, Glycine max
  Peptide Sequence Number=SeqID_136192
atggctcacaatcacatcgccaccgattcacctctctctcggcgcatagttcgtgccttcctctacttcctcaactctggaatagttgaaccgggtcctggggttgatgctgagggcattgaggttgctagggagtgtttggcagaggcttttaagcttaattcatctcctgtggctggtgatgatgtgaaatctgattcattgattgacatattcaagtctcttgaagctaacaagcaatgtgaaactagtaagtcagacgttggtccactgccggattctgcggatgcttcaagttcattcttgggtgagaatcctgctcgtgggaagaatcattctgaggcgtcgaaatctacggttaattcacttcacacttatcttcttatggcccttgcattaggccaggctgagagagcgatagtgtcagagagggataaggaccaagagtggatcacggtgaggcgagggagagcaaatattactacgttctacttcacaaggttccatgactacttaacagagaaggacctatgggctcagttcaagagatggggggacagagacaacattgttctggggggacttaagatgtatgtcaatgtcccaaggtatgggagacgaaagaagaggatcgaagagcaaatagtcaaacatggtatcatgcaggaagggcacagcaaagcagcgactgaagggcgtcttgcaagaacgcgattcagaaatccctccatgacctatgcgaaggtggtgttcgccagtaataacgacgtagaagtgcgtaggaactaccaacctccacatctcagagctacggagtcccactcgtcgatccatctcgaagtatcagaaggggaaaggggaaaatacacagatacatgggtaggccggttaaaaaacctgggaagtttcgagagagttgatgaagatctcccatgggagttaggtgtgaacgttgcgccgaaatatataggcgacgacatggttctcctcctcggactctcggactccaaggcagaggagattacaacggcagaactccaacacggcacgactcccttctactcgttacaaaaatggaacctgacgatgaggtcgggccatagacttgtctgggtccagtgctggggtgtcccccttgaagtctgggacattgggcatctgcgaaaattggtggcggcattcggagacctcattgaggtagatgatgatgtagaagagctaagaagaatggatagggcgcgtatccttatcaaaacaccatggaaaccttttctccagcactccgtcgcagcccacatcggaggagaaactcacctggtgcagatcgtagaagaagggtcgagtggcaatggaacacgtgcccccggccgcagatgtgtcaccgactcatcggaggagatagactctgatgatgatgtaagcgaaacttggcgcacggcggtggagtcatccgcctattcccaactcgcaccgaacgacattgacggagaccggcctgtcgataacgacgacaaccagctcaatctgctacctgacgatccgtgtcatgtggtttacccagcgggtattacccatgacagtagggcctacctaccaagcctcgatacccgcgtgaagccgcaaaaggaaattggaaagaagcaggatcctatggtacagcccgaaatcgactcagaggtgcatgttggggaaggcaacacatgcgagtcaccaaagaggaaagatatgggtagcagagtgcccaagggaggttcaggaatcacggataaggaaggtgccgttgctcaaaagggagaagctcccgacatccttgaaggggcaaatatatccccaaatgggcctaacaataagtttaattttgaaagtggcccaacaacggatgtgggctctcctaaccacaccacaccctcaacaccacacccattcctccacacacactcaacatcagtccaccttctcacggggtgtataaagaagagggcccgcagtgtaaaaaagcatatcatacaagatgttggcaattccctcattcaccaacatcccatatcgggggatgtgtcagcagcaatggatccgggacacccacacatggatatcaacaacactaactag

SEQ ID NO: 19415 - DNA, 729 bp, Glycine max
  Peptide Sequence Number=SeqID_136193
atgttaacgaactcggtttttaaaaatatatattgcctccgtaccctaattcacttattctcttgcgcctcttcctcttcgtctcagctcctccactctattcgtctccgtcttcgtcgccgtcttagctatgctctcacgcctattcctctccattctcgcttcctctcggtctccacttcgttggtgccgccatatctcgcaggagtgtcgtgtctccggcaggtgcaagaagtctttgacattgttgccagggccagatatgggcagagtgacaaaagtttcacttcactgcttcaggtagtgcaggatatgcttccagaggaaaacgcgttgccaaaaagttattatcaggcgaagaagatattgtgtctaatggatggaagaaattgcaatggaatgctccgccatcaagttgattcctcccagtggaagaaaattaatcgtttgtatccaaatttcgacaaaaaggcaagaaatcttaggcttggacttgtcactgatggaatgaatccctatggtagtttaagcattcaacatagttcgtggcctattttgctagtaatttacaacttgcctccttggttgtgcatgaagcaaaaatacgtgatgttgtctatgatgatatcgggcacaagacaactaggaaatgacatcaatgtttatctcaaccccatgattgcagacttgataaagttgtgggacgagagggccgtttatcgtgtttga

SEQ ID NO: 19416 - DNA, 390 bp, Glycine max
  Peptide Sequence Number=SeqID_136194
atggcagataacaacaacaacaacaataagttcattgttgggggagcatccctcaccaagccaccaggcatcacaagagaaaactattcttactggaaggaaagagtggagatagtccatgaagtccatcttcagaatcaagatcatccacaaaagaaagattttgatgccctcaagtctagagagactaactacacaagagaagaaaaaaatagctttttgaaagctcttaaagtgaaaatggttgagtctaatggctcagacaatagtcttggagattccacagatgatgaagtagatctcatgtctagaaagtttaaatcgatgatgaaaaagaaaggaaagttccaacattcctccaaaagaaatgaaacaagattcaaaaagtag

SEQ ID NO: 19417 - DNA, 645 bp, Glycine max
  Peptide Sequence Number=SeqID_136195
atgactaaagctaatgagtatatcattgatgtttcacaatctactataatggatgaggacagacttaagcatgtgggagaggcttatgaggattcccctgggatagatcccttcaactatccctatagttatactaaggaagtgtatcctgatgaaggaaaaggtagatgctctagggccaacaacaataaaggtctcatttgtgcccttaatgttgttcttcattgggatcgtactacgtttagtgagacctttcagattgagaacattgatctggaggcacctgaggaaagtccaagcttcattgattgggagcagacaaactatggccctaagctcagaatgaagttgtctgcttacaaggaagaaatcagatcaatacaagcttcattcagaaggattgaaagggatctttatcatgcgcttaaggctctaaagaagaagactaagcttacaagtatggattggtctgctgtgaagaggttcttcaaactcaagggtcattgctctggtctagagcctgatgagaagcccttggctaatgaagcacttgctcaggcttatgaagatagtgattatgctgagaaaggacctatgaagtggcatcttattggggactactgttacaaaaagaccattggatga

SEQ ID NO: 19418 - DNA, 306 bp, Glycine max
  Peptide Sequence Number=SeqID_136196
atgacaaagccatatttctttcctcccaaacataacattctcgttggtccaagcatatccatgtgcaactattgtaatggtctggaagtggaaacaacatctttagattcaaaagaggacatgatcaagagcaagggcaaggatccacttgaaggacttggagggcctatgacaagggctagagcaaggaaagccaaggaagctcttcaacaagttctgtccatactatttgaatacaagcccaagtttcaaggagaaaagtccaaggttgtgagttgtatcatggcccaaatggaggaggactaa

SEQ ID NO: 19419 - DNA, 483 bp, Glycine max
  Peptide Sequence Number=SeqID_136197
atggtgggcagtgtgaggacttgtatgcctaaattattgaagtttacctgccaaataacatcatacagtagtccatttatatctgcagtttcatgccaatgctgtgaacctgatgaagattcttctctcggtagtataaaaactactgttacaagacacctagctgccaatgagggaacaccacttaataaagaaaatacaaatgtaaatgaaaggggaaaaagtacagagacatcagcttcagaagttgtcaatacaaattcatgtgttgttagtggggtctgcttgcatgtgggtgttgaaaatgtgagggtggtgggaaaagtgagtttggagttggtgaggaagaagaagaaagcgactatgagggtggtggagagggaggtgggggatcggggtggcggtgcggcaaaagagggcgaagttgttggtgtcgagaggggagaggtgggggaagatatagaggagggagaggaagagtga

SEQ ID NO: 19420 - DNA, 360 bp, Glycine max
  Peptide Sequence Number=SeqID_136198
atggtttttcctcatagtatggtcacaatagctttggtgctaatgttagcttcatatgtcaaagctcatgttggcctttttgatataagaaaatatggtgcaatacctaatggagatacgaccatggatttgcagaatgcttggagggatgcatgtgtatcaatgactccaagcaaagttgtagttcctagtgcaccactcattgagttggtgaggaatcatgttccttcatgggaagatgcccaggaaatgggtgttgaggaaaaaagctcagagtatcaagaacctcgggatttgaggtcaaatccttttcaagggggagggaatgatgcaatcctaccccgcaagggcattggatag

SEQ ID NO: 19421 - DNA, 293 bp, Glycine max
  Peptide Sequence Number=SeqID_136199
atgtcattgcctagcgatgttcatgtgtcctccattatcaagcgcggagcctctggtgactgggaaatatgttcttctgttgttttccggatcggttccttcgccaaacatgtcaaaaaagaaggagtagagacaagaatcgtcatcacggaaagggcaggatggacgaaatctgtgtcttatctttgctttcctcttatctccgatgagagattcttcctccagaaggctgttgcttctagaggaagcaaccttgctcgcctgggcgagctgagctcgcctgggcgagctgg

SEQ ID NO: 19422 - DNA, 201 bp, Glycine max
  Peptide Sequence Number=SeqID_136200
atggctcacaaaggtgggtggctcacgattcaggaaaggtggtggcttatggaggctcaagtgcaagtcatgacgggaggcgcaggggtttgggtcactatcagaggtgggtggttcgcgagatgggttgttggggttgaaggatgtgcggggctcgaggtcattattggaggtggggtcggggttgttggggttcgttga

SEQ ID NO: 19423 - DNA, 588 bp, Glycine max
  Peptide Sequence Number=SeqID_136201
atggactcttttgagaatctgttagatgaaaatttcaaggttgatgttaaagtaaatgagaataatattctagctaatgatgttgaagaaaatgaaattgatgatgagtgcaaaaggccaaatagaaggtttgggaatctttcatctagcgtttggaattttttgacaaatctgttagccatcctgatgggaaatcgagggccaaatgcaagtattactttactactaagttatgagaaagtaaagaatagaaacaataacttagacaaaagtaaagcggaaataaaaagtacacaacggaaaagtaaagagtgtagggaagaagaaagcaaacacaagttttatactggttcgacaacgacccgtgtctacatccagtcctcaagcaacctcttgagatttcctttccttgtaaaaatcctttacaagcaaagagccacaaaggatgtatcctcccttgttctctttgaacaaccaagtagatgtaccctctacttgaagcgaaccacaaaggatgtaccctcccttgtgttcactattacaaccaagaagctactcgcttcttacacagaattctcagacgattag

SEQ ID NO: 19424 - DNA, 1431 bp, Glycine max
  misc_feature (1375)..(1375): n is a, c, g, or t
  Peptide Sequence Number=SeqID_136202
ctgcgcgccggtcgcgatgtgatcggcgcggatgtcaccgcgctcaacaccagcggtaccgatatcagcgggatcgaagcgggccgggacatcatccgcagcaacctgacggttgccggccccggcaacgtcgaagtgagtgcgggccggcagctgcgccaggaagaggccggaagcatcgtgagcctgggcggcgtcgtgcaaggcgatgcccgtcccggcgccagcatcgcagtgactgccggcaaccagggcattgatttcgatgcactgcgcacgcactacctggatccggccaacctcgccgattcctcgcagtcgttggctgcgcagccgggcaaggcggtgaagatctacgacaaggagttgagggagtggctgcagcagcgcttcggtctggcggttgatggcgccgaggccctggcagcattcgaccggctgccgaaggaacagcagcgcatcttcctgcgccaggtctactacgccgaactgcgtgaaggtggccgcgagtacaccgatgccgaaggtccgcgtttcggttcttacctgcgcggccgcgaggccatcgccacgctgatgccggacaaggatgcgacgggggcgacgatccagcgcaccggcgacatcctgatgtacggaggctccggcgtgcgtaccgaagccggcggcaacatcgagctgatggcgccgggcggacagatcgtggtgggtgtgcagggcgtggtgccgccggccagtgccgggctggtgacccaggggcagggtgacatccgtctgttcagccaggacagcgttctgctggggctgtctcgggtgatgacaacgttcggcggagacatcctggcctggtcggagcagggtgacatcaacgccggtcgtggttcgcagaccacgttgttgtacacgccaccgcgtcgcgtctatgacggctggggcaacgtgatcctgtcgccgcaggccccggccagtggtgcaggtatcgcaacgttgaaccccattgccgaagtacgaccgggcgacgtcgacctgatcgcgccgctgggcaccatcgatgcgggcgaggctggcatccgcgtctcgggcaacatcaacctggccgcgctgcaggtgctcaatgccgccaacatccaggtacagggtgaaagcaagggcctgcccgtgctggccacggtgaacgtcaacgcgctggcctcggccagtgcagcagccaacagcgccagccaagcggcacaggatgtgatgcgcaagagccaggatgatgcgcggcgcaaccagccttcggtgatcagtgtgcagatcctcggcttcggcagcggcaccagcagcatcaacccgccggcgcgtggcaatactgccaacgctggctatgacgccnacagtgccttccagttcccgcaggcaagtcgcgacgagggcacgcagcgccggtag

SEQ ID NO: 19425 - DNA, 594 bp, Glycine max
  Peptide Sequence Number=SeqID_136203
atgggtagtgagcttaaagaatattactatgaaattttctctaaagttttccagtgtgcacctcagatgcttcttgctgtcatcccaagcttaactaaaggattatcggctgctgaggttgatgttcggataaaagctgtaaatttggtggggaagctttttgctcttcaacatcctgttgttcagaagtatcatgagcttttcgtggagtttttgaaaagattttctgataaatctgtggatataactgttagaaagagtgccttgcaaaagttgataaagatatatcgagattactgcaagaaatgttatgaaggcagcatgacaattagtgatcactttgaagagattccatgtaaaattatgatgctgtgctatgataaagattgtaaggagttccagaacatggaatttgttcttgctaatgatctattccctgaggatctttcggttgaggaaaggacaaaacattggatgcacatgttttctcttttcagttttcctcatgaaaaggcattggataatattttgactcaaaagagaaggttccaaaatgaaatgaaaagctatttggctatgcggaagaaattgaag

SEQ ID NO: 19426 - DNA, 345 bp, Glycine max
  Peptide Sequence Number=SeqID_136204
atggacgaatcctcgctgcaactcgtctccgaaattggaagacgcctcgctcaccgaactcgtcccaacaaggacttcatagtcaaatccctcgcaaaagctgcaaatgctttgtctttgataaagcagtcttctcaaccgcgaacggccaaagaagtacaagctgctaagaaacaggaagatactttaaagcccctggcaaatgctgtggtttgtggtggtctgcttcaacatgcagataaggaagttaggcttctggttgccgtgtgtgtcactgacctttttagaatcatggcacctgtaccgccttttgaagacaagcatttgaggtatgtaggtccttga

SEQ ID NO: 19427 - DNA, 426 bp, Glycine max
  Peptide Sequence Number=SeqID_136205
atgcatcaaagagcagcgtcaggcaacttgcaggatatatcacacttttacagtgttggatctatgagcattttccttctattgcttcgtctattgctgctgaagattgtcatgagaggaaaccacgtgcctgccgttggaagtttgggaaggcattaccagtgtcaacgtatcatatgtgttgcacctggacagtgtgcagcagactacatgcagtggttctacatgatttctaatcccttcatgagttcggcacaggctagggatcctcctagacatccacgcgtgttgcgcgatgacatatttattgaactagatattcctcagcaccaggtggcggcaacagctatggacaaagcacctgcagattcacctgctcatgtagagcaacctcgacatgcagtggtaaaatatattttcaattaa

SEQ ID NO: 19428 - DNA, 186 bp, Glycine max
  Peptide Sequence Number=SeqID_136206
atgcctatttttccagagaaggcaagtcctacagatgaccaaggaggagggtttgttatgtattcatcctcatctggtctaccttctccttggtcatctgcaagacccacatcctccaaaaaaataggtctacccccaggccatgcaatggtcactctaaactgctttagggtgggccaaggatag

SEQ ID NO: 19429 - DNA, 279 bp, Glycine max
  Peptide Sequence Number=SeqID_136207
atgacgaagggattgacaacgaggtttcacggcacgatggcagagctctcaaattcaaggagtctgataaacagtagcagcaatgcgataaagagggaggttgaaggagatgtgttttttaaatttttttatagaagaacatttttgccacttcacataacttgttgggtgcaccagcaattctgctgggtgcacaaagaaaaacccatcattgatacaaaactattggaccctgatcttgatgttcttgggtataaccttcagcttgaaggagattaa

SEQ ID NO: 19430 - DNA, 609 bp, Glycine max
  Peptide Sequence Number=SeqID_136208
atgaagtctgaatttgacatgactgatttgggtcttttcagtagatttatgaaggatcctaagcaatcacatctatttgcaaccaagagaattttgagatacttgaagggaacttcagattatggagttttatttcctaaaaaaagaaccaatgcagagttgagctgtttggatactcagattttgattggtgtggagataagattttgtggtgcaccaatttcatggtgttcaaagaagcaagatgtaatagctttatcttcatgtgaagctgagtgcataacttcttgtcatgcagcatgtcaagctttgtggcttagatctttgcttggcaaaatgcatttgggacttaagagtgctatgcaattgttggtggaaaataaatcaacaattaacttagctaagaatccaattgctcatgggaggagcaaacatattgaaaccaaacatcattttcttcgtgatctagttaataaagggagattagagttgtgtttctacaagtttgaacaacaagctggagatatcctaacaaaacctatgaagattggaagatttaaaaagttaaccaaaatgttgaatgtggtacctttagaaacttttaattaa

SEQ ID NO: 19431 - DNA, 213 bp, Glycine max
  Peptide Sequence Number=SeqID_136209
atggtcccttatgacagagatgcaattaaccagtttttggggaatccaatgatcttggaggaaggacaacaatgcaaatatacttcgaggagagaaagagccacaggaaaatcagtaagcaacttggagggggtgaacttatcaattgggggtgcactcaggaatcttcctcaagaagcctctgggcagcaaccacctccatttctcctataa

SEQ ID NO: 19432 - DNA, 945 bp, Glycine max
  Peptide Sequence Number=SeqID_136210
atgtgggttacaaaaatgcaatccaaatttgaaggcgatccaacggttatcgagtctgggatcgcggtgttattgaagttccaagttgcgttggacattatgatgtctggctgtgaaaaagtaagtgaaggttcttcagttgtagagatagcaacccacacaaagaatgagaagaaggactatgagactttgttcttattgcaccaaagtgtggacacaaccaacatcgacaagataacaactacaaccattgtgaaggaggcatggaaaatcttggagaagtgtcatgagggtgctaaaaaggtgaagatggaaaatgatgagaagataacggattattttgcaatagtaatcaacctcactaactctatgaaaggttattgtgaaaacattccaaaggtgaagattgtagagaaagtttttcaaactcttcccctaagtttgatcatattggctattgtggacgaccttaaggatcttgattccgtgaagagatcaactgatcaagagtttgtggctcaagtcttaagaaagggtggtgctgataaaagaagcaagcaagaatggttgactaacttcgatgataataagaagtgcaaggtcaaattcacagacaacaaaacattgtgtgctgaaggagtgggaaatgtgatgattaaaaggaaagatgtggttagtgattcatggctatggcacttgagattcgatcacttgaattttaagagcctaagcttgttgaagtctaaagaaatgcttcttggagtagtgcattcggatgtgcgtggaccatttgagaattccaagttacttgtcgacaagcaatatgaaaaacaaattaagatacttagggatgatgatggaggtgagtatacctctaaagagtttgaagattattgcaagggagttggcattcaacatgaagtgactgcaccttatgctcattag

SEQ ID NO: 19433 - DNA, 951 bp, Glycine max
  Peptide Sequence Number=SeqID_136211
ggatatcatatcaacaagtatttgttctacaccaaatcactagacgataaaagtgcgatgcaaaatagtggggttgatcttagggctgaatcccaacactttgctactatacatgatgacaatccccgtcaggcatccatgccttactttggagtcattgaagaaatctgggaactttattatgttaaattcattgtgtgtgctttcaagtgtaagtgggttgatagcaatatgggtgtgcgaaccaatgattttgaatttacgttggtagatctgaagaagctagcttatcaaaatgagcctttcatcatggcaaaacaagctaaacagatgttttacgttcaagatccatgtgatgaaaggtggtcaatggctctacacagaaaaaacattggtcttaatcttgaagatgatgattcaacccttgatacttgcctcactcctttctccacacaaatgcctaacatcaacggagaagaagaagttgacgatgatgtgttgattgttgccattggacgactagagcactttggccatgcccgtgctgctggagccggtggactcctattgcctcctaagcctgaggttagtccttctagtgcccatttcagcataaagggaagtagtgtcaaactttcagggcagaacccagacacaggtgaatcagacaaatgtgggttgtatgttgataacaattctccccgcttggttgcccttggaagagtttatgtggggtcaacaactatccacaacattcctttgggcaatgatcaagtgaaggtcgatgttgatgtagttccatatgctaatgctcgcgtccctatacccactcaagtggataaacataaagctgaaggaccaatgaaacctgtagaaaggctagaacctaatgatgatcccttataccagatggcattgacgatcccagagcttttcctcaaacctatgtag

SEQ ID NO: 19434 - DNA, 264 bp, Glycine max
  Peptide Sequence Number=SeqID_136212
atggctatgtcacacgtggggagacgccctaatgtccccaccgtttcttcttgctccccggaaatagaaggggggagaatcattgtgaccaagataggctccctggatagggaagtaataaaaggtcgcaccctcttacagaggcaagaggtgcctccaccattacgacatgaaacccttaacttatccaaggaagaggattcgctatcggaggcaccatggcgagtatactctgtggaggaaccgctaatggaaatgagataa

SEQ ID NO: 19435 - DNA, 627 bp, Glycine max
  Peptide Sequence Number=SeqID_136213
atgaagttgactggcaagattggttgggtctccttgaacagcatgcccaagaagctgattgagttcaacccaaacgtctttcaccacttcaaggattatttcttcgaggtcctagctattcatgtcatggctgatggaattatgggtgactttgcttggagactccttgtgaagcagggcggacctgctagtgggactgtgccaccatccactgtcgcccctactgctagagaaaggggtcaacctactaatgaggaggttactcgtgctactagagttgatgcaccaactacttcagccggttctgttgcagtgtcttcatccaccgctgccatacccttgagtgttggtgtggcgaccaatgctcctatgatgtcacctcctcctgctttggctccattggttccatcctttgtcgtgttggttactgcattgccttcctcatcttctcatccccatatctcttttggtcacttgtacaccccgagcgatgttgattcactatggggagcgaattacaaaccagagcagaagaacccgataggctttgtgtcaacctttgataagaaccttattcggtcagctggggtgcagaatgctacggactctgccaaagtcttcctctag

SEQ ID NO: 19436 - DNA, 501 bp, Glycine max
  Peptide Sequence Number=SeqID_136214
atgaagtctaagaaatggccaggatcagggaagaggcttccaagctctgaggagcatggacataaaatacaaaggtttaaccacgaacctttcaacctgatgacctcatatggcgagttcgaggccaagctagcaaagacccttaaacaggtacatccgtggttgcagctccacatgcttgtcaaacccaaggtccacccttggcttatgcacaccgtctccaatacgtgccactccatgaatgacagtctcctcaaaatccaagacggacgtgtctctggtcgattctccaaaggctcatcaaacccaaggtccacccttggtgagttacacaggcttgtcaaaacccaaggcaaacatgaccctggtccaaggctcactaaacccaaggttcatccttggaacacccttggtagaaactcctacaaaaacccaaggtttacccttggtaaccactcatacaaaaacccaaggcaccccattggtcagcttactccttaa

SEQ ID NO: 19437 - DNA, 925 bp, Glycine max
  Peptide Sequence Number=SeqID_136215
atgggagctcagactatggagattgtcaagaggggtggcaaaaatgactgcaaactcttgacattgcctgcatttctttgtgaagtaaggctttcagacttcctagatgctagtaggacagtgcatctccaaaatagcagtgcatttgttgaggtgcatgtcgtatttgtagagctcttcgaagacctctttcagatctgccacgaccaaaggcatagccctatagcagaagttgacattttaagtgatggatgccgttttctcctcatttggagtgtgcatccagatctggttatatccaaagacatcaacgatatgtctatgctcatggttggtgaggtccctgttgagctgtgttcactacctaggtttagtgtcatcgcgtggatctacatcgaattcaacgtcaaggctgtcttggtagacaatcaaggctcggactggagacccttcgtgaacactcatgacctgagtaatgccatccgttgtggggtgaggtttggcaggctccctagtgggaggataaggtgccaccttcaatctttttgcgtagcactatcgtgcttgcttttgatctaccttaacaatcatgatctctcccatcaagctcctgaagagttggcgttgaacgaaggtggtcataaggtcgatgtagcctctggtctctactcgttcccctgcgaaggcgaggaatgggccgatgtgagactagatgatgttggtggatctatcctagttgatgaggaccttggacaccatgaagttggcgattatgatggagataaccatgcggtcatcttagttgatagggttgatacccttgaagtctctatcagtgaaattgatgtcgatgtcttggatggcgtggaggtggcacttgtgagactggctagactgtcctccataggagaatcagcttgcaatg

SEQ ID NO: 19438 - DNA, 103 bp, Glycine max
  Peptide Sequence Number=SeqID_136216
gcatagggggacacatagaattgcacacgccagtcaggggagcagccatccctacccatcacgcggtggaggtgctcgccgatgcgaagggtctggatcatga

SEQ ID NO: 19439 - DNA, 195 bp, Glycine max
  Peptide Sequence Number=SeqID_136217
atggatcgttcaacgtgccttaatggatttcggcttagtgcgtgcttttctcgctcagcggatggactgaagtgccaaaggagtgttgcactcagcggatggctcgctaagccagaagattggcttagcgagcggatgaaaatcagcacttcacaaactttcctaattaacctgaaattgagaggaaatggttag

SEQ ID NO: 19440 - DNA, 584 bp, Glycine max
  Peptide Sequence Number=SeqID_136218
gagtgcaaaaagctaagtgtgatgtctctttcatggagaagttagaacatcacattacaggggtgcactgggcctggcccaacagaggctacgcatggccaagtgaagcgcttattggacatagcccaagtgaggaccttcttccaccttcaactccaagataccaccaacctatcaaacactaccaccaccctacctcttctaaaactcgggacaacacatggcaattttgcatcaattatcgggcctcaaacaccattaccgtcaaggataggttccctttgcctaccattgacgaactcttaaaaaatttgggtcatgccacttggttttctaaggtggaccttgcacaaggtttccatcaaattcggatggtggaatccgacatctccaaaatggtgttccgcacccatcaagggcattacaagttcgttggagagttttacctcaaacttccccagtgtacttttggccaacgccgtatagactacctaggccacatcgtgtcaacaaatggagttgagcctgagccatcaaagatagaagtgatgccggattggcctattcccacttccctcacatga

SEQ ID NO: 19441 - DNA, 1155 bp, Glycine max
  Peptide Sequence Number=SeqID_136219
atgtctggaccagtgtcttctggctgccatgctgatccggtagaagtttctctgaataatgagctgacaccgttcactttcagtgtttgtcagtccttagacaaattgccacaaaattctgattcattggtaaatactgaaattccggaatctttttcaaaagccgcagtgcaaaatctcagagatgggaacacggaaacctcaactgtgtgtaatgtaatagatgagtgcggccatgctgattttaaatggaaatcaaagtttgctgagtccagtccatctatggcgatggatatggtacatttgtggaggaaacatcgtatttgtcaaaaggatttaggacagcatgacaacccagaactgggtgttattcaagttgttaaacttactagtggactgaccaatctaatttctgaagctgacttactgtttcatggtcaccaacaaaaacaatgtggtattatggagcctctgatgtccctttccgatgaagccatatatagttggtattatgaacaaatgatgatgtctactgttgctgtacatggtttttgtttttatgccaaacgtatatcagatgtgggatctaagtttggttttatgaatgaggtagatctaacttcagagatgttggcttgcactactaatgttatggcactgggaaacttgtctagacaggaccaaacaaaaagcacaagtatccatgccaaaaagcaattagagacttacttcagcaatttaatgaaaaacagaacatgtttgtccaacgcgatccggtctatcattcctgcaagatcgtcattatcaatgaaaggtcttgcgttcaatgaatatatatcttcactacgccaaatttcattttcagaaggtttccgcatttcacatggttctgaaaatatgagaaaacgaaggcgggttgctccacattatttgagcagaggtagaatggcgttgtcccctgaaattatatcattgattgagtatgtcatcgtagtgacaatgaactcagcatcaccagtgggacggcctcacgacaccaaggatcccttcttccacgagctttactaccttcttattcttcttctccttctctttctctttctccttctcaaagttggagaacaaattagaatcaagaaactagcatcagcttag

SEQ ID NO: 19442 - DNA, 357 bp, Glycine max
  Peptide Sequence Number=SeqID_136220
atgaaggctacgacgaatcaccttaataagcgaggctgtcccaacgatggtcaaatctgcatcgatggagggctagctccaccacgagagattttctccaactcgatctctcctccaataacttcactgctcatcgatggtgttctacgagttcattggtcctctccccaagttgttgttgaaactttagagtttggaattactagatttttttatattaatccaatgaccgaacttggatcccatgtcgcccgactaccacgtggctaccgatcgataatgatgaagaaggaatgcacaacgagcaaagtggagattttgagctcgaagaggttggttgaggcggtagaggtgtga

SEQ ID NO: 19443 - DNA, 510 bp, Glycine max
  Peptide Sequence Number=SeqID_136221
atggctgaccacaattggcaaaagacgatgctggcagaaatggctatgctggatgccaacaacacatgggagcttgttcccttgcctcctaacaaatccactgttgggtgttgttgggtctataaggtgaagatcacactagatggcactattgatcactataaagctcgcctggtggccaagggatattctcagatttttggtcttgattatgaagaggtgtacatggatcagccatctggctttttgtctccggtgactcctcccttgttcgtaagctttgtctcactctatggcttgaagcaatctccccgtgcctggtttggtcgtttcagctccgctgtgcttgaatttggtatgactcactgtgaagttgatcactcagtaatattccttcattctaagtctggtttgtgcttctatctcgtatatgttgatgacatcgtcatcactggtgatgactccacagggatcctccacctcaagtctcaccttcataggcagttttag

SEQ ID NO: 19444 - DNA, 381 bp, Glycine max
  Peptide Sequence Number=SeqID_136222
atgagagaggccatcagaaattcattgaaaaggtgccaaatagggggttgggaaggtatgtcggaggtaggcgagtttgatggaggggttgccggcgagttagtacgccagatagtggatcacgtgccgatttatgatcaaatcacatcttcaacaaaggaaaagaaatgtaaaaaccttaacagatatttggcagaaaaactacctttacctccatacccaaaggatcaaccgccgttatccccattgaatcaagaagttattttggatcacccaaatcacttgcattttccaaaggtcttcctcatccatggcccttttcactttgaccaaaaagtttcagcttttcaatatctggacaaggaagaatttcctttctag

SEQ ID NO: 19445 - DNA, 324 bp, Glycine max
  Peptide Sequence Number=SeqID_136223
atggaagcaattccatccgagattacatggctcaggcaacttttccaagagctaaaatttggagacactcaggatactagactgctatgcgacaatcaagttgttctccacattgcatcaaagtcgatcttccatgagcagactaaacacatcgaaattaactgtcactttgtgagagagaaggtgctctcaggagaaatcatcactaactttgtcagctccggtgatcaacttgcagacatgtttactaaatacctcaaaggttctcgtgttgacaacatatgtaacaagcttggttcatatgacatatatgctcatgcttga

SEQ ID NO: 19446 - DNA, 348 bp, Glycine max
  Peptide Sequence Number=SeqID_136224
atgccctttactactaatgtaacaactttttacaaacaatgcggacagttcttcatagtggttgctcttgctggactcacatcagaccttgacgcaattcgcaatcagatattatcgagtcctacggttcccacctatgacttagttcaggagcagttgctgtgtctctccattccacataccttcggacccttttccacttctactggggattcctctgcctttgtctctcactcctctcatcatggaggacgtggtgatggtcgaggtattcactgccactactgcaagaactgggttcatgttgaagaagactgtcacatcaaagcaagacaattgtctcgatga

SEQ ID NO: 19447 - DNA, 381 bp, Glycine max
  Peptide Sequence Number=SeqID_136225
atggagaggaaccgaatgaaggtcctatttaggattcaagatggaataagaaatctgattattgaaaaccaatggaggcatgcagttaatcatatgaaaagcagtaaaagaagcacccccccaaaaacgaagtgggacattatagtgaagaagggtaaggcaaggtgtttgaaaaagtcaaggaagagaaaagagattggttacctgtcatatgatcagaggcactggaatcaagaatctaaggtccaagagaggaggactaagaaacaaaggctacaggattaccagactgagccagaggtaacatgtgatgcaagttttgttggctgctcgaagctagagaagctcattatactcagcaacagagatagtaatctctga

SEQ ID NO: 19448 - DNA, 770 bp, Glycine max
  Peptide Sequence Number=SeqID_136226
atgggtttaaggaatcaagttactcactgtaagaaccctttctgtcaatctgttctgtggttattggatcacactgagagtccacataagaaaactgtgaagttgcttccaagtccagctttgcctaatggtatagaagctgaggagatgggtgatggggtgattgaactgataaccatttccgatgatgaagcctgtagtcttggtggaacctctccaaggttacgtggcaaaagtaatgtatttacatgtggtagtgtccaaactctaattctagttgaggatgtggacatcctttttcctgaagatcgtggatgtattgctgccatacaacacatttctgagacagcaaaagggccaattatattgaccagcaatagtaataatggtggcctaccagatagttttgcaagactacatgtttctttctcattgccattgccagatgagttactttgccatatgtacatggtttgtgtcacagaagaagtcaacatcaatcctcttttactgaaaaattttatccagtcttgtgatggagatattcgtaaaaccattatgcaacttcagttctggttccagagtaaaaaatataaaaaagacaggaaagtgcagaaggtgtatggctcacttccttttgatcttgaggcttgtcatcagataataccaaagatgctaccctgtgattatccctcagagttatccaaactaattgagaaggaaattgctaactcaataaccataatggaggacaactcatgctcgcaggg

SEQ ID NO: 19449 - DNA, 525 bp, Glycine max
  Peptide Sequence Number=SeqID_136227
atgggacttgggttttcccaatactccccctcatgcccaacatttttgagcttgaagatattacaaaaagctgctcacaggagtgtggggatacatcccgcatctgtttctcaaatacttcctattggaaagaaaggatactgctgggctgttaagaaagtaggtgaagggcgaaggcatatgcctcttgttattggtcctctaatttgtgaaaggaatcagtggtgtttggtggagatgcacattggcatatgggaagtgctttgctttggcagttacaaacttacaacatctggtcacatcagcaatgctgacaatcaacatagttcccaaagagagtttggcaaaggtcagagttctgatgggaaagagataaatgctgaagcattttctacagttatggtacagaggtgggccggcagagtttatatgataaagatgatcttgattccttttatgaagacaatgaagaaagggcaagaggttaattttgaagatgtaaatgtctacttctggatggcttaa

SEQ ID NO: 19450 - DNA, 198 bp, Glycine max
  Peptide Sequence Number=SeqID_136228
atgccacttaaaatagttttagggaggtctacagcagaagccatttatcttatccggaagttgatgaaaaagtacggaagtaaggaaagagacttacatatggtttttgttgacttggaaaaagcttatgaccatgtctcaagagatgtgttgtggaagacttcggagaaaaaaggcatgcacatggctcatatctga

SEQ ID NO: 19451 - DNA, 420 bp, Glycine max
  Peptide Sequence Number=SeqID_136229
atgttggatggtgcttcaccccttgactggagtgactggacatttttggataagaccaccgttgcagattttggtacagaaagttcaaatttatttgttatggagggttctattgaatccttaaattttgataacttacctagttctataagaccctcaagtgcttcaagttctcacaatgccatgtcttgctcaagtcaactttctatacagccagatagtatgctggaaatatcaccaccaaactcagctgtgctagctaatgagcaagcaatatggcctttgaagccagaagatgccaaagtggacctggacttggaggtgaatgaaaatactttttcagggcatcagggcattttcagaaagtcagatactgagccactgagtaaatttcttcaagaaaggttaacccaagcatga

SEQ ID NO: 19452 - DNA, 405 bp, Glycine max
  Peptide Sequence Number=SeqID_136230
atgaagggttcctgcgatctcggcacgccgaagcgccgaaaagcagagccagaagagcaatgttcccctgcggccgagaacaccaagaagaggaagtcctccgcaaaactcactccaagaaaaagagcctccaagaatagcaccccgaagaagaatagcacgccgaagaaaaatggatcggcagtcggttcgcctgattcggcttggaagatcgatttgcggttggaagcaaaattgtcagcagaggaagattcaaggatgtttgcgggacggaaaatacatccgtttttttcgttgtggaaggtggagaagcaaaatcagggacaggaacatgctttatctgcagttaagagggaagggagaggaattacatgtggtcctattcatatatttgaaaatgttcag

SEQ ID NO: 19453 - DNA, 369 bp, Glycine max
  Peptide Sequence Number=SeqID_136231
atgactaatgcaaactatccgcaagaatcattgcattcagtctcaaacgaaaatctaaggtgtgcctgtgtgtttgtctttgtgtgtgatgaggggttagggaggacagagttaaggtttccaaaagttatgcctctgtggtgggaattcaactcctgggttagggaggacagagttcttcattgtaggcccatggataatttcttccagcactcctccatagcagcctcgaagccttcggaccagcaagtccagcagttgaagaaaattcaagctgaactttgggaaaaggctaatctccatgaatctatcatgagacagaagtctagaaccaaatggattaaagagggagacagaaacagcttgtaa

SEQ ID NO: 19454 - DNA, 138 bp, Glycine max
  Peptide Sequence Number=SeqID_136232
atggatacctcagagccctacactggggcaatgaaaggcaccatgcataaacctcaagtgaacctaaggatcatgacgaaagacaatgattggtacctcaaagccttacactggggcaatgaggggcatcgtgcatga

SEQ ID NO: 19455 - DNA, 252 bp, Glycine max
  Peptide Sequence Number=SeqID_136233
atgtggcgtctccaatcatctttcttccatttacattccgttgccattgatcttcaagatgcaaaggactccattgatgaagaagatacaaggccaacaagctccacatggagctacatcactagtagccacatggatcacacaaagataaaacaagatcataaattaaagagattcacgctaaaatcagtactaaatgatagttgtttctctcaaaatttaaggatcacactctcaccaggatacggttaa

SEQ ID NO: 19456 - DNA, 333 bp, Glycine max
  Peptide Sequence Number=SeqID_136234
atggagatgtacatcaaatccactcaatatagactttggctaattattacaaatggacacaaacccattcccagaccagaagtagaatgggcatatactaaccttgttataatggaactgaatacaaaagcttgttatactttgacatgcacattttccataaacaagaataacaagaacaaagatcatatgccaaagagagatttcactgctctaaaatctagagaaaccatctccaaaaaagaagaaaaaagagatcctctaaagctcttaaagttcttatggttgagtttgatgagtccgaaaatagttgtaaagaatcccaagcaatga

SEQ ID NO: 19457 - DNA, 498 bp, Glycine max
  Peptide Sequence Number=SeqID_136235
atggagttgtgtggtggaatctatgaggaaattgctggaaagtcgagtcaacattattttgcgggaaattgctggtattccaaattggttagtcatgctccagaaggggaatattcagagatgtctccatttcgcatgttgagtttttacattgagttcgctggtcgtaaaggtcattttcctgagcctacccatgatcctgtaatccaagatttaattcatgaagtggacccagatattattattggatacaacatctgcaaatttcacttgccatatgttattaagagagttgtgaacctgaagatagcagaatttccaattttgggtcgtattaggaacagtagagttcgagtgaaggatacaactttctcatcaagggaaagtaaagaagttacagtagaagggagacttcagtttgatttactccagcttctatccatattgttttgctttaactaccttgtgcttcggcacactgagtttattgctcaatag

SEQ ID NO: 19458 - DNA, 1098 bp, Glycine max
  Peptide Sequence Number=SeqID_136236
atcgtgggacatttgggtgcctttgatgttgagcttcatggatgcgtccctgaacaaaagcacacgcgagcacagagtcaaattgaaagcttagtcaagcacatcgtcgacaatgttgagaacttcattacagaagagttacgggttcagattaagagcaccaaaaatggtctcactctcactctcatactgcgtgggattcagaatcggcggcacgaacaacagagctctggcggaggaggcggcaacgcggcggaggagcatgacattctccggccgaggatgatggtgattcttctttgcgacatcctttctatttttgtttccgcttcttggtaccgtttgagagatggtgattcttcaaatggtaccatcttctcctccaccttcgcgggattggggcttaagggcgattacgaagcacattgcctgagcaaagaggagggtcatgtatgcgccatcgcagagatcatgagctccatggtggacctctttcacaaaggccagaacatggacctaaacgcgctcaagtccatggcatgctgcaagtaccggctctcacgcgtgcccaagctcgtggagatgatcgtggcgctccccgacgccgagcgcgagacgctcttccccaagctcctttccaagcccgtccgcaccgcctctggaatcgtcgtcgtcaccgtcaggtcaaagccacaccagtgcccacacttcgccaccaccaggaacatctgcgtctactgccccggggaacctgacttgactccgagttcgagtacagtacccaatcttacaccgattatgaaccaaccagcatgcgtgcaattcgtgcgaggactaaccgccagagaactttgtcttaacacattagagggtacatcctttgtggtacaagtagagggtacatctacttgggttgttgtaactgagaacaagagagggtacatctcttatggatcagttcaagtggagggtacatccacttggttgttcaaagagaacaaacaagggtgcatcccttgtggatctttgcttgtaaaggcttttacaaggttgaaaagaaatctcaaggaccgcaggtcgcttagggactggatgtag

SEQ ID NO: 19459 - DNA, 576 bp, Glycine max
  Peptide Sequence Number=SeqID_136237
atgcggctgcggctgtggctgtggctgcaaggcccaagaccaagccaaagtctcgacgttatcttcgatgtgactaaggttttcgttctccctaacaccgatgctgatgaacccaccaataactttgctttagtgtctcatcctcagactgagagttccaaagatgatcaacatgctccaccacaaatgaacatgtcatggtcaagagtacaaccccaactagaagtggatctggtggtggcacttgggatggacttattagaatacccattttgctcttgtgtgctgagtgccacctcagctcacaatttacctagaccgactttagtagtatgcaatttgatggagcaggtaattggtgaatgccattctggacaaattggtgatgaagttgatgcaaatggtggattccctcctgggcttttagtagctcaagtcaatcatgttatggggaaacaacaattacaaagtaatggaattttactaagaaagttaggtattttgaatgtcattcaagctatggaacttgcccctgagcttgcttatcctttatatattgctgcctctgtagattag

SEQ ID NO: 19460 - DNA, 2971 bp, Glycine max
  Peptide Sequence Number=SeqID_136238
tgatcatggtggtgtcaagtctgtgttttctggagacaaaatttttgatgaaccaaattggggaacctttgacacaaatgatgatattgattcagtttggggattcaatgctagtagcttcactaaggaggagagagatcttgatagagctgggaacaactatttctttgattctggggaactgggcttaaaccccatcaaaacaggttcaccacaggctggtgatttcttccagaggagcagtggattcggttttgatgattctgttccaagcacaccactttacagctcaagtagctctccgcaaaggccaaaagagtggttggaaactgcttttgatttctcaagatttgattccttcagaacacatgatagtgtatctttgcctgctcgggagacgacagaacaatatgattcagtacgcaacagtgtggattttgaccatgcttatgggtttccagcttttgatgactcggatccctttggctctggcccgtttaggacttcatcggataatcaaactccaagacgaggatctgataattggaactttccgactgttgcctctggtggagtgggttgtcagtcttgctatctggaacctgttacgtgtaattcaaaatggcccttgctgttcagactcagacaccgtcccacttactgtgttggactggacgtggccctctgcccgcgtgacgtgaacctccactccacctccgggtttctgctttcattgtctcccgctacaatcaaaggacatgatgatgtcgtcaaaatcggtgccatattcacattaaaaaccataaacggacgagtttccaaaattgccatccaagctgctgagaaagatgtgaattccgatcctcgcatccttgggggtcgtaaattgtccataaccatccatgattccaacttcagtggttttcttggctttattggggccctcaagttcttggtgaccgacacagtagctataattggtccacaaagttcagtaatggcccatgtgctttcgcatcttgcaaatgagctccatgttcccctactctcctccacggctctggaccccaccctaacacctctccagtatccttattttctacaaacagcaccctccgatcacttccacatgaatgccgttgccgacctcattagctatttcggttggagagaagtcatagcagtgttcagcgacgatgatcagagtcggaatgggataacggttttgggggataaacttgctgagagacgctgtaagttgtcttacaaagcagcactgcctcctgatccgaccgccactccatcccatgttactggtcagttagtgaagatcaagagtatggagtctcgagttatcgtcttaaacaccttcgcgcaaactggtctcttggtttttgaggtggctcaaaagctaggaatgatgtccaaagggtatgtctggatagctactgcttggttatcaactgttttagactcaactacttcactaccttcaaatacttgtaactcaattcaaggagttattacctttcgccctcacacccctcattccagaaaaaaacaggcatttatctcaaggtggaaacacatcagtaatggctcaattgggttaaatccatacggcctctatgcatatgattctgtttggatgattgctgaggcactcaaattgttttttgatcggaatggtaccatttccttctctaacaatacaaatttaagtggtacgagggaagagactctggatttcggtgctttgagcgtttttgatggagggaaggagttacttgataacatattgcgcattaacatgactggattgactggacctattcaatttggttcagatagatctcctctaaatccatcatatgacattcttaatgtaattgctactggttataggagagtcggctactggtctaattactctggcctctctgtaataacccctgagaaacttcacgcagagcctgccaatcgttcaatttcaagccagcatctaaaccgtgtcatatggcctggaaatacaacagaaaagcctcgtggatgggttttcccaaataatgggaggcaactgagaattggaattcccaacagagttagctatcaagacatggtctcccaaataaatggcaccaatgcagttcaaggatattgcatagatatattcctagctgccattaaattgcttccctatgcagttcaatacaagttcattctgtttggagatggacacaataacccaagctactacaatcttgtcaacatgattacttctgatgtttttgatgctgctgtaggtgacattgcgattgtcactgaccgaacaaagattgtggattttactcaaccatatatagagtcggggctagttgtggttgctccagtaaaaaaattgaagtcaaatgcttgggctttcttgcgaccatttactccacagatgtggggtgtcactgcattttttttcctttttgttggagcagtggtgtggattcttgaacatagaacaaacgatgagtttcgggggtttagtttctcaaccatgttctttgcgcacagagaaaacacagttagtccacttggtcgagtggtgttgataatctggctttttgtggttctgataatcaattcaagctacactgcaagcttgacatcaattctcactgtgcaacagctgtcctcacccataacaggaattgatagcttgatatccagcagtgatcgtataggattccaagtaggctcatttgctgcaaactatctcactgagcaactcaacatccccaaacatagacttgttcctcttggctcaccagaagaatatgctgttgcccttgaaagcggaactgttgcagctgtggtggatgaacgaccctatgtagaactcttcctttcaaaccactgccaattctcaattaggggccaagagttcaccaaaagtggatggggatttgtgagtgttttttag

SEQ ID NO: 19461 - DNA, 2397 bp, Glycine max
  Peptide Sequence Number=SeqID_136239
atgctctcctccaaacccccgcgccggaaagtggttccggcgaacggcgatgactccgccgacaaactcgaccagctccttctctcctccgccatttgcaacaacgaggacctaggtccgttcatccgcaagaccttcgcctccggcaagccggagaccctccaccaccaccttcgccacttcgcgaggtcgaaagagtcggagatcgaagaggtgtgcaaggctcactaccaggacttcatcctcgccgtcgacgacctccgatctctcctctccgacgtcgattcgctcaagtcctccctctccgactccaactcgcgcctccagcacgtcgcgtgcccgctcctctcctcgctcgacgccttcgtcgagacgcgcaacgtctccaagaatgtcaacctcgccatcgactccgtccgcacgtgcgtgaagctcatggaggtctgcacacgcgcgaaccgccacctcgccgacgacaacttctacatggcgctcaagtgcgtcgacgcgatcgagcgcgagtacttggaccaaacggcgtcgtccacgctgaggcggatgctggagaagaagattccggagattcggtcctacatcgagaggaaggtgaacaaggagttcggtgactggttggtggagatccgtgtcgtgagtcgcaatttaggtcaattggcgataggtcaagcctcggcagcaaggcagagagaagaggatctaagaattaagcagcgccaagcggaggaacagagtaggctcagcgtgagggactgtatctatgcgttggaggaagaggaagaagacggaatcgtcgccggcgggatcggagaagacggcggtggagccgccgggtttgatttgacttctctgtatagagcatatcatattcatcagactttagggttagaggatcggtttaagcagtattattttgagaaccggaagcttcagttgacttcggactttcaggtttcgtctatgactccttttctggagtcgcatcaaacgttctttgcgcagattgcagggttcttcgtggtggaggatcgtgtgttgaggaccgggggtgggttgatttcgaaaatggaagttgagaacctttgggatattgctgttagtaaaatgtgttctgtcttggaggatcagttctccagaatgcaaactgctaatcatttattgcttattaaggattatgtgagtctgttaggagtgactctgcggagatatgggtaccccattgatgcgttgcttgatgttttgagcaaacatagggataagtaccatgagctgcttttgtctgactgtaggaagcagattgcggaggcggttgtggctgataaatttgagcagatgttgatgaagaaggagtatgagtattccatgcatgtgctttctttccagatacagacctcagatatcataccagcttttccctatgtggcgccattttcatccactgtgccggattgttgtcgcattgtgcggtctttcattgaggattctgtgagtttcatgtcgtatggcgggcagcttgagttctatgaagttgtcaagaaatacttagataggcttttgagtgaggttttggacgaagctttagtgaagcttatcaatacttcgataaatggggtttcccaggcaatgcaaatggcagcgaatatggttgtcttggagcgtgcttgtgattttttctttcgccatgctgcacaactttcaggtgttcccttgagaatggtggagagaagcagaaggcagttccctcttagaaaagcccgtgatgctgcagaagacatgctctctgggctactcaaagccaaggttgatggattcatgacattgatcgaaaatgtaaattggatgtgtgacgaggcacctcagagtggaaatgaatatgtaaacgaggtcataatttatttggaaattttggtttcaactgctcaacagatattgccatctcaagtccttaagagagttttacaggaggtttttgctcacatatcggagaagatagttgggactttagttagtgattctgttaagaggtttaatgtgaatgctattaatggaattgaagtagacatccggctcttagagtcattttctgataatcaggcttcccttttctctgatggggatgttgatgttctgaaagcatcacttgccagctcaaaacaactgattaatttgctgttaagcaatcatccggagaatttcttgaatccagtgatcagggagaggagctacaatactttggaccacaagaaagtggtgattgtttcagaaaagttgagggatccttccgatcggctctttggaacctttggtagtcgtggggccaggcagaatccaaaaaggaaatcactggatacattgataaaaagacttagggatgttagctga

SEQ ID NO: 19462 - DNA, 1593 bp, Glycine max
  Peptide Sequence Number=SeqID_136240
atgcgtagcaccccctgcatccaccattccccaatcctttatccctacgtcggctcggattcatggaacgaagcgtgtggtgatgatgcgttgcgaggtgccgaggagacggatctcatagaggagctcgacaccgccggtgttgaaggcggcgaggaggtcagggccggccttggagtggacgagggagccaccaacctatgtgccgacgatgaggcggttttgcttgacgctgaggccgaggcggttggtgaggatgttgattcggccgctgatgtccagggtgccgaattgcaaggggaagggttggtggatttgatgctgcgacgactgagggtgcaaggtacagcttcgatgggaaattgctggggttctccacctcacaacccaaccccaacaactaccggtaaccttagtacaggtacgacggggacatctcaggcgatcagcagcggtagctatactactactactacgacgactactacttcttctggaagtgggagcagctccataaatagcaagttctcagtgtcaagcggtggtcagccttatccaaatggacagatcttacctacctctaatttgaggatcttcacttttgccgagttgaaggctgcgactagaaatttcagagctgatacagtgcttggggagggaggttttggaaaagtttacaagggttggcttgaagaaaaggccacctcaaagactggaagcggaacagttattgccgttaaaaaactcaactctgaaagcttacaaggacttgaagagtggcagtccgaagtaaattttctagggcgtctttctcatcctaatcttgttaagctgttaggatactgtttggaggaatcggagcttcttctggtctatgaattcatgcaaaagggcagtttggaaaaccatctatttggaaggggttctgctgttcaaccacttccttgggacatcaggcttaagatagcaattggagcagctcgtggcctcgcattcttgcatacatccgagaaagtaatttacagagacttcaaggcctccaatatattgcttgatgggtcctataacgcaaagatatcagattttggcttggcaaaactgggtccttcagctagtcaatcccatgtgacaacaagggtgatgggcacacacggctatgcagctcctgaatatgtggccacagggcatctatacgtaaagagtgatgtatacgggtttggagttgttttggtggaaatactaacaggcctacgagcacttgatagcaaccgtccaagtgggcaacacaaactaacagagtgggtgaaaccctacctgcatgacagaagaaaattgaagggcattatggattctcgattagaaggaaaatttccatccaaagctgcattccgtatagctcagctttctatgaaatgtcttgcatctgagcccaaacatcggccatcaatgaaggacgttttggagaatttggagcgaattcaagctgccaatgagaaacctgtggagcctaaattccgttctactcatgccgccagccgtcaaggtcaccaggctgtgcaccatcgttctccacgtcaggatggtagtaattag

SEQ ID NO: 19463 - DNA, 1041 bp, Glycine max
  Peptide Sequence Number=SeqID_136241
atgaagcaaagctacctaatccctgaacatatctgcaagggagatctcccctcccttaaaaagaccatggagcaattaagataccactacttcctaagatgcactgaggctgagtacagaagccttgcagctgctacagctgacattttgtggattcagactcttcttggtgagcttgcagtcccacacctcactcctatgctcataatagcgacaatccctgaatctaagcatggcaaaccgccaagtattataacagaagaaaatattgaattgcttttcgaaatacaggaaaaggttgatggaattcgtgcaaattattctggtttgttagtatcactgagtgacatttgcttgaagcctttaggcgacgactgtgcctctcaaagcattttgcagtattttcaaatggaccctgacaattatgacaactacggaggtgttgaacatgctgagtattgttttcagcattacacttctactgaaacatgctttagtgcattcaaggctccccttgagccaactactgccttgggagggttttctggaaataattattctgaggcttctgcatttgttatcacgtaccctgtcaataatgcaattacaaaagtcggagatgagaatgggaaggcaatagcttgggaaaaagcattcatccagttggctaagcctttacagatcagtttaagcaaaaagaaaaatagaccgaatgactctaggaaagaaaaacctggggtctccgtgtttgttaccctagcatgttctagtgaagaggaattgctgccaatggtgcaatctagcaatcttaccttgtcattttcaactgaaagttcaattgaggaagaactaaagagagaaagcactgcagatgtcataacaatacttgtgagctatattgtaatgtttgcttatatatcggtgaccttgggagatagaccacctcatccgtcttctttgttcctctcgtccaagaaatttgctctaatgttctatcctgctctattgagaaaccctgctctaatgttggaagaccagtaa

SEQ ID NO: 19464 - DNA, 411 bp, Glycine max
  Peptide Sequence Number=SeqID_136242
atgaaggacgttttggagaatttggagcgaattcaagctgccaatgagaaacctgtggagcctaaattccgttctactcatgccgccaaccgtcaagatttgtacggcaaaagcatgactaatgaatgtggtgctaggccagaaggaggtttagattgctttgccaacatgatttctgatgccaatgccgttccagacgctaacactatttactaccgtgactcacccaacaacgaacgcaagaaactagcaccgacgagaaagtctgttgtggcgaccatccccttgaagaatcccttcttcttcaataatgttgatttgcttctacaacttggctgtggctgtagtccttcttggaggagcgcacagaaaaggagtggcgcgagtgcggtggagaagcaacggggctga

SEQ ID NO: 19465 - DNA, 1077 bp, Glycine max
  Peptide Sequence Number=SeqID_136243
atggctgacttgtacataactacacttatatctagagcatcattagtgccaacatcaagctacatagccaaaccagctgcctcatggcttgatgattttcttgtatggatatcacctgaagcttttagttgctgtcgaaaattcacaaatgactcttattgtccacctgatgatcagtgtttccgccactcggatttggttaatgatcgtccatctacggcacagttcagagagaagcttccctggtttcttgatgcactgccatcagctgattgtgccaagggtggtcatggagcttacaccaacagtgtagatctgaatggttatgagggtggtgtcatccaagcttctgagttccgtacttatcacacaccagttaatagacaaggtgactatgttaatgcaatacgagctgcaagggacttttcggcaagaatttcttcatctttaaagatggatatttttccgtactcagtgttttatatcttctttgaacaatacctggatatatggaagttagccctgatcaacatttccatagcactaggttggtgctatttttgttgtctgtctgatcatcacatccagggcgtaatggcaattttgggtattcaactgaatgcggtgtctgttgtaaaccttattatgtcaataggaattgctgtggagttctgtgtgcatatagtacatgcttttacggtaagcttgggggataggagccaacgagcaaagacagcattgtgtaccatgggggcttccgtattcaggttgactatatgtattatgacatttggaaagatcatggattgtgcatttgtatttgtgcgtgacatcttattatcaatctcaaaatacattgtttgccatgatttgttcttacctcttttcctcgtcttaaccctaaaggtgtattacttccaaatgtatctggccttggttctcattggcttcttacacggtcttgtgtttctacctgtggttttgagcttgtttggtcctccattaagatatacagtcattaaggagcagctagaagacatgccttctgcttcatcagaacagcctctaattagatga

SEQ ID NO: 19466 - DNA, 565 bp, Glycine max
  Peptide Sequence Number=SeqID_136244
atgacggaagggtgtggtgaagggttttgccttgcaaaccttcccggtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 19467 - DNA, 161 bp, Glycine max
  Peptide Sequence Number=SeqID_136245
atggatgggattctcatttctagtgtggtgtcgttggctgattcacgattcactcgaccggatatgggttttcacccaacaaaactcaatttcgtgcctagcgatgcggatgaggcgccactcgatgtttccatttgcctgcatgcctttggtatcgtggg

SEQ ID NO: 19468 - DNA, 243 bp, Glycine max
  Peptide Sequence Number=SeqID_136246
atgcggaagggaccactgaaagaaggaggaactgaagccattgacagtgttggaacactcagaacttgtttgaaaatttatttgtggcccagcccaacagtggtgctaagcgcgcatcaggcgctaagcgagcaaccaaatgcaggcgctaagcgtggcgttaagcacgaaggagcagaaaccgttacgcgcgctaagcctggctacgtgcccactgcgcgatccaacagaagcacaggctaa

SEQ ID NO: 19469 - DNA, 144 bp, Glycine max
  Peptide Sequence Number=SeqID_136247
atggtggggtatttcatgtgtctcccccatggcttgaaggatatgtgcatgatcagcttggggttgtgggctctcaatgggtatgggtgcagagttgtcgacatcctcattgggaaggtaaatgcaaaggtcatgcatgagtga

SEQ ID NO: 19470 - DNA, 105 bp, Glycine max
  Peptide Sequence Number=SeqID_136248
atgaagacaaaaagggtgtgtcatatagcatcaggttgtgagaaaggggcttcatgggaggcacctctaacggtagcaaatgagaggatattaccatatccttga

SEQ ID NO: 19471 - DNA, 1278 bp, Glycine max
  Peptide Sequence Number=SeqID_136249
ggaggtggtattaacaggtttaaggctcacttggctagaaaaaaaggccaagtagaggcttgcaagaaggttcttgctaatgtccaacatgaaatgaagcaactacttgaacagattgaaaaaagcaagaaaagaaaagtgcagcaggaacaatctaatgaaagtaatacatttgaaatggatgaaaatcctgtgagaataattgaggaattaagaggaactccaaaaccaatttcttccaagtctcaaaaggggaagaacactccttatgtagatgattatttcatgcctagaacaattcctgaagctcaacctagcttgaagagtgtcttgcacaataagcaaattatagaaaagtgtgacaaagccattgcaaaatggatgatagatgctttagtgtcatttaatgcaattaacttggcatattatcaacctatgattgatgctattagtagcatgagtccagggtataaggccacaaatttttatagaattcgtggtcctttgttaaatatgtgggttgatgaagtgagaaagcttgttgaaagttacaaagaagtttggaaggaaactagatgtactttgatggctaatgggtggactgaccgctctagaagaactctcattaattttcttgtttattttcctaaaggcactattttcttaaggtctgttgatgtttcttatgcatctaaaattgctgaaatgttgtttaagcttttcaaggagatggtgttatatgttggagcagaaaatgttgttcatattgtgaccgataatgctgcaaattatgttgccactgatagcatattggtccaaaaggatgcattaagggccatggtgacatctagggattggataggctcaacttatgccaaagactctaaggctaaaaaatttgtggagcaaatcttggactctagctattataaggacagagaggagatggttaggaggtttcatagatataaaaggaaagtggagccctatttggaggtccttgataggcgttgggattcacaactttgcaaagatctacatgttgttggttattggttaaatccagcttgtagattcaatgctgaagaatttgagaagtataggaacacacaatctagcattttggaagtcattgatagcgaggcacatagcccgcttagcgaggaacttagcccgcttagcgcgttgggaaaccctagaagaggattagtcaaaaggttccgcgctcagtgtgccaccaactcacccagcttggagtttgtcccttctctcgcttag

SEQ ID NO: 19472 - DNA, 480 bp, Glycine max
  Peptide Sequence Number=SeqID_136250
atgataaacaagcatcaaattgattgcctaacaaaaatattaaagcctaaacctgaattttttggagctgatgtagatgcttcagaattacaatggtgcattaaaagctgttggagaactactctcacattttatcagaccaagtaccgcggctctgagagtcctaaatgtacaaaactcagttgtagggtcaacattagaggttaccttccaaatgtggatagtaccttccttcccttagcacgtgctggactactccaagactttgaaggcgaagccaattgccatccacaagctgtcgttcctggcctttgtgccacccacgatgtcgcggtcatagaccaggaaggcacctctaaagtgcaagaagtttccccattgcccgaccacatcgacttatacagcgaggtctccactgtcgctcgactcagcgacgacgccctcctccttctcgatgccatcgagggcgtcaagatctag

SEQ ID NO: 19473 - DNA, 375 bp, Glycine max
  Peptide Sequence Number=SeqID_136251
atggagaacgggaagcggtggggtagtgaacttggcttaggattgactaaaagtaagggaacggtgaaaaagttgcaacaaaaccttgacaagcatgtcgcctatatgtccagtaagactaaggaaaacaaggccttgagtggccgagttgttgacctagagcagcaagtgaaggtcataggcaagaagatgaaggatctaaccttggagaagaagatgactaaggaggagttagggaccgcaagggacgagatggctgagatgaaggaagctcttgcaaaaatggagagcgagttacgggagaaggaaaaggttgagtctaccttgaaggctaaattggatgaggccaaaaggttgattggattcaacctttaa

SEQ ID NO: 19474 - DNA, 267 bp, Glycine max
  Peptide Sequence Number=SeqID_136252
atgaatactatcaatgatgaggcaaacaacaaaatgataagggtctttgttcaggagttacaagagcaacatgctgctgattctaagtcacttaatgtaatgagatttttaggtgaaaagataaagaataagaaggttgaagaaactagtgtctcactaagcgaggcatatgcgcttagcgaggaccatccgctaagtgaggcactcagctcgcttagcgggttgagaggatctaggagaaaatatgtcattcatgcacgcgcctag

SEQ ID NO: 19475 - DNA, 396 bp, Glycine max
  Peptide Sequence Number=SeqID_136253
atggatgagtttggggaactcgtgctcactgcaaggatctttgtttgtttctgttgcaaggatttggtttgtggaactcgtgctcgttgcaaggatttggtttgtggaactcgtgctcgttgcaaggatttgtccgtttggggtgcttactcgtgctcgcagggtctcattttgagtgagctaggtaaccacccaccaagcttcctaagctcaatggagagtttgagaaacttggaccttagcttaagtgggttcatgggattaatccctcatcaactaggaaaactctcaaacctgcaacaccttaatcttggatacaattatgctcttcagatagataaccttaattggatatcaaggctatcttccttagagtaccttgatttgagtggttaa

SEQ ID NO: 19476 - DNA, 885 bp, Glycine max
  Peptide Sequence Number=SeqID_136254
atgttcataacccttcaattagtctcaactaatagaatcattttagctttgaaactctcatatcttgtatttctcttttcttcaattccaaaagccaaaggctacactactagagctcatatcttcatctatgctggctgctctcaagaaaaataccaaccaaacacaccctttgaagccaaccttaattcctttctgtcttcagtttctggctcttcttctgacacttcttacaatagctttgccattggaaatggaagctcatcaccaccagaagggtccatatatggtttataccaatgcagggctgatttgaggccaaatgagtgctcaaaatgtgttaaaagttgtgttgaccaaataggcttgatttgtcccttggcttttggagcatctttgcaacttgaaggctgttacataagatatgagcatgttgatttccttggcaagcctgacacaagtctttggtacaagaggtgcagtaaagcagtggcaaatgatgccgagttcttccggcgaagagatgatgttcttgctgatttgcaagtagctaatggatttggagtcagcacttcaggttttgttgaagggtttgcactgtgtttgggggacttgtctatggctgattgctcctcttgccttcaagaagccgtgggaaagcttaggagtatatgtggatcagcagcttcagctgatgtgttcttggcacagtgttatgctcggtattgggaagctggctactatgatgaagcagaatcttccaaagacgatgatcaagtggggaaatcagttgccattattgtgggaatactagcaggtctagccattcttgttgttattctctcaatctgcaaaagagcaatgggtaaccatttaatttcttaa

SEQ ID NO: 19477 - DNA, 504 bp, Glycine max
  Peptide Sequence Number=SeqID_136255
atgacgtcgtttctacaatctccttcttcctcttttcgacaacctctccatgcaccacaaccaccattaaacaatgacctacacccagaacatcccttcttctccgatcgcaaacacaaacctagaacatctaacctcctcgcaactccacctggatttcctcaacaaattcgaaaacctctcagattttcaaaccatagcatccaaaacctaggaagatggtgggcgtcgcgcttgcggcatgagggagtgggaggcaacaagaaatttaggtcttcaggagtcaagaagtcattgaataacttgaaacctatgagttcaagttacatcaaagctaagagtccaccttcacctgatcaagcattgttcaccacatctattgaggcttctctcggtcgccaagcactttcagataatttctcgaatacaactaaaacaaggtggctaagacagttggtggaaggtagtgtaagatgcaaatcagagtgtggaattgagagaaag

SEQ ID NO: 19478 - DNA, 315 bp, Glycine max
  Peptide Sequence Number=SeqID_136256
atggcttgcttttcaggtccgccagataacaatcacaataagtcatctaacaatcatatgatattttctcacaggacaataataaacggcttgtgctaccttgctacatttgtctacggcatcaactctgtcggtttatttctttattctggccagcttgccatagacaccacggggagagggtcaagtggaaaggaaactgaaagcaaaatcactcagcagccaggcttatcaaatgcatctgttgataataataataataataataaattgagcagcacaaaggaagatcaaagttcaaataattcactgtaa

SEQ ID NO: 19479 - DNA, 507 bp, Glycine max
  Peptide Sequence Number=SeqID_136257
atggctcaacggcaaccaacgaaggcccgcagtggcgacaggggacatcttgaggcagagggagagaggaccagtgtaaggcttgccgaagatgcatcacgtgtcaaaaaggatagtgtgcatgaacttgaagcgctggaaaagggccctgtgttggggcattggaaagttttcccaacaagggcagagcatcaacgtggtattgttcactgcgaagaggggctgcttgataaagaaaaacaaaggcagaaacaaaagggcgttagggtgaccactgtgttgaaagttgctgtcggaaccggagccagatgtgccgacacgtgctggttgaaggtgctgtttggcaaagtaaggtgtgtgaaagaggacacgcatgaggatacgtcagaggtcttttggggaaacacagactggatttggacagatcagcggctgtcaagtctgtctatggtgttgccaaccagaaacgaccccgtcatgccggtttcaatctttaataacgaataa

SEQ ID NO: 19480 - DNA, 849 bp, Glycine max
  Peptide Sequence Number=SeqID_136258
atggatccggggttactcagactattgaatagtgggaaactgctctatctcaccgtggccaggccagggttctccaggaaaggacatgcagacattgttggttatgtggatgtagactgggcaagttctgctaatcactcattcatggaagtgctggtacgatttgctggttttggacctgaggaagatgagtggattaacattcgaaagcatgtcaggccacgctctttgccttgtgaatcatcagaatgcgttgtagtcatccctggcgatctcatactttgttttcaggaaggtaaggagcaagccctttactttgatgcccatgtccttgatgctcaaagacgaaggcatgatgtacgaggctgccgttgtagatttctggttcgttatgatcatgatcagtcagaggaaatcgtgccgcttaggaagatttgtcgccggcccgaaaccgattatcgattacagcaacttcatgctgtgaatgaggcagcacctatggatcagcagaaaactgggatggatccagcagcaaatgttaatgccgtaagggctactactactgaaacagcagcaaatgttaatgccgtaagggccactactactgaaacagtgccgaagcagctgattgcagcaaacattcatatggagacagttccagttgtgcaaacaaatgttcctcaacctccacaaagtatggatatgggtgtggatcaaaagaaagctgaaacaaatactgatgttcaagcaggaaattccatcatcaccccaggcagtgtccttactaacatcattactacaagcggtgttcctaaagtctctagtcagactcagaacatggttgaatga

SEQ ID NO: 19481 - DNA, 369 bp, Glycine max
  Peptide Sequence Number=SeqID_136259
atggctaagattgtcgaagccatcgaccaccaccttgttgtcaagctcaaaatcaatgttctgtgctgcatcaatgttgcacttaatgcgcccatgggaaggtttctgtcatgtcgagttgtattgatcgaggtgggaagagatagtgctggttcggtgaaagcaagcttgttgccactcagaaaggtattggaaagcttgttgaattgtgattgttgctggcttgtactgattgttccatatcttacggtttcgctgcttccagaagctccaaagaatggtggcgaatttgataccaaaattctcctgcttgtgacatgtaaagcgattgataccaaaattcaaccgtttggctcttgttcgatctga

SEQ ID NO: 19482 - DNA, 444 bp, Glycine max
  Peptide Sequence Number=SeqID_136260
atggaggaaggagaagacatacaatgtatgtttagtaactttcaagccatattaaacgagctaaggtctctaggtagaacttttaataactatgatcatattgacaaaatcttgagaagtttgtttagaaaagggagattgcaggatgaaggacttaagaaatggaagtctctagctcttagcatccaaaagaccaagaaagtatcatcgtccaaggagtcatcttcaaaatcaacgtctagaagctcgtccagagctttaagtgtagaaaattcctttgatgaagaatctgaggacaagtttgatgaagatggtgagcatgctttcatctcaagaaagatccagaaaatgtggaagaacaaaagtggatctaagtggaagaacatctccaaggtgttaggtcttgacattttgatgtataagtggacaggatccttatgctaa

SEQ ID NO: 19483 - DNA, 975 bp, Glycine max
  Peptide Sequence Number=SeqID_136261
atgtctagtgcaataaaatgttatccagatgcaaccacattggcaactacttatccacctaggttgctcatctcaaaggccaacaatatcaaggttgttgtagacaaggtatgccctcgactaccaattttggatgctactaagaggaaaggattcaagctctacttttatgaagaaattcctacaagacagatgaaagtggacatggtaaactattccaaaaactggagttccatttttagtgggaaaaagctggttcaagctctagatgcttatgacactaaaaccttctggaatcaaattgtgtggcatgacacattaaaatcctcctcatctggttatgatggaagtgccaatgataaccaccaagacttcattcaagtgctacatctagccaagacgtatcatttcgataatgcttgtgtgtactacaccaaagatgctaacaactactccatcatcaactgtttgaggaaccttctcaccatttttcatgagacaacttatgatctctccatgatggatgaacaagactttttagatcatgtgactaagctctgtgatgcccaaaaagaagaagagcagtgttatggaagaaaccccaagcttatgagtttgtccaccaagcagtccacaacctcaaatgaagctacatcaagggagaaggatgcacctaacattgtaattgtctactccaccagttcaagtcctactccatttaattatgctctccccactgttgtgactagagatcaagttcaggagatgataggtcaagctatctatgcaaaatgccattacaacgcaattctccaaccttggagtcgtgttactcaaaaacttgcaacaaacccaaatgtctatgttgggtgttgtttcttctttacacctattgttgctgccccaactctagtacaagatatcatccaacaatcaccacttgttgaaccaccaccaccaccaccacctatgtag

SEQ ID NO: 19484 - DNA, 758 bp, Glycine max
  Peptide Sequence Number=SeqID_136262
atggctccgaagaaaatttctgctaaaagagctaggaaggccgctacaggggaagggtccagtgcagctccacaagtggaaattgagtttgatggatgtcactttcgaagcaaggagcatcaatgctgttttgaggtgattaaggattggtcttttctcaaagaaagacgggtccagatactagatggagagtctgcggaattccatgccaaagtttccaggaggcattggacacaggtgatagagcctatggcgaagtatgatcctgaagtagtcatggagttttacgcaaacgcctggcccactaaagaaggagtcatggacaagcactccggggtgcggggccaatggatcccatatgacatagatgctatcaaccaattcttagggcatccactgatcttagaagagggacaacgatgcaaatacactgagagaagaagccaattttcaggttttgatgaagaggccatagatcagctactttgctccccgggacatgattttgcgcggagcatagtagggaggcaggtgcggatcatgcacactagcatgaccactctaactcaaatctgcatgacacttctactcagcaacatccttcctagtgaccataactctgatctcacactacccaaatgccagttggtctacagcatcatgacccagatcagtgttcatatggcgcagcttatctcagatgccatccaccagttcgtagatattacacctccgagatacccagtggacccagagaa

SEQ ID NO: 19485 - DNA, 180 bp, Glycine max
  Peptide Sequence Number=SeqID_136263
atgatccagagggaatggaggaaggaattggcgtttcctgtgactcgaaatgtcgttgactccgactcgaagtgccctttcgcttcttcaaaggtgcagggacgcgttgtaatcgattacacaaatatggtaatcgattaccagatagcaacattgctagaaataactgcttgtaattga

SEQ ID NO: 19486 - DNA, 717 bp, Glycine max
  Peptide Sequence Number=SeqID_136264
atggcagacaacaccagaatgaaagagctcgccaccgacgtgaagaaaaacgccgacgatatcaagaagttgtacgatgaagttcagatccagtttgagcgttttggtgctgtgacggatgctcgatttcaaaccatggaggatctgcaatcgtccactgatgggaaactggataaaatcaacgaagctcttttgatgttattacgcaactcctctcagacctcttcccatggtgttacgaactcaaacaaagctccgtttcaggtaagaaatgtcaagctcgatttcccccgttttgatggcaaaaatgtaatggaatggatttttagagctgagcaatttttcgattattatgaaacccctgataaggatcgattgactatcacatctgttcatcttgatcaagatgtggtaccttggtttcaaatgatacagagaacacatccttttaattcctgggctgagttcactcgtgccttagaattggattttggaccttcaatctatgattgtcctagagctaccttgtttaagcttagccaaactgggactgtgagtgattattatcggcaatttactgctttagcaaacagggtctatggattaagcactgatgctcttgttgattgttttataagtggcttaaaccccgatattaggagagatgtgatggttcacactcctattaacattgtgaaagctgtgtccctagcaaaa

SEQ ID NO: 19487 - DNA, 141 bp, Glycine max
  Peptide Sequence Number=SeqID_136265
atggcgtggtcaacgacatggagggttacctcgactacgactctgtctgggacactaaaccctcttgggaatgcgcaaaagcaccagagcacgcaaggccaacaaccaattgaaggatttcgttacttcttgagtagttaa

SEQ ID NO: 19488 - DNA, 186 bp, Glycine max
  Peptide Sequence Number=SeqID_136266
atggatgggcaaactaagatgcaaagaaatgagaaactcggtccaagattcaatgggccctatcaagcaatccaagagaacggggagattgcttacatgctgcaattacctgccacaagaagacttcaacctatattccatgacatttggctgaagaaggctgtatcaggctcctacagtgcttga

SEQ ID NO: 19489 - DNA, 882 bp, Glycine max
  Peptide Sequence Number=SeqID_136267
atggcaagtattgacatggacatcatggctgatcataaagtttcaaagtactccatgaatcccaaaaatcccctgaaccttttgaaagtccttaaacatgaagaaaatggaactcagatcagtttaacttcccatgttgagctgaggcaaacattaatgtcagttagtgcaaactgccacttgatagagcgtttgttttttgagtcttctaaaacaggtagagatgacagcttgaaagcgcaaacctgttttgagctggtaaacaattgtcctcatctaacttctttatcccttagagggtttaagctacacgattgcaaagttcgcgtcctggttaagggatttaggaaactgaaatatgttgatttttcaacatcctattcaatcactggtaacttcttaagaaaccttggaagctgcaatggtgggaacttacttgaggtcttaattttaagggattgcatgcatctcaaagagatggaagtcgctaagctactgactgcaattcttgcaggagatttcaaattgcttgacatatccaatagggaaggcttagcatctgaggctgactggtatcacaggtgctacaactctagtattatgcctataaaacaggttttggaagcaagacctgatatgtgtctggtggctgaatatccatcagcagaaggaagttacatcgagacattcgatgctgatatgaacagcgagataagtttgccatcacaattgagcagccacacgtcagatggatcaatttttatgagtacatctgaaagcagctacaatagtgatcaaggaagtggcaatgaggatggtcaagatgccaactatgtgatatatgaggaaagctcagatgagattgactttttgtccctctag

SEQ ID NO: 19490 - DNA, 357 bp, Glycine max
  Peptide Sequence Number=SeqID_136268
atgggcatatttgggcagtctatcctccatgccaaggtgttatccttgagcttggcggtggatagaccattgatgaaatccatggagacatcactccacatttgggtcagagtaggcaatggctgcaggagactggtgagggactggagatattgttcgtataattctgaagatattctaattataggagatattgttcgcattaggaggatgaccactgcgctggaagtcgatgtcaaaactggcgccagatgcgctggttcaaggcgctgtttgcctaagtcaggcacaaaaaagaggatgcacgtgagggcatgtcagatcttcgatgtggccaccatcaccaccgttgtgtag

SEQ ID NO: 19491 - DNA, 1293 bp, Glycine max
  Peptide Sequence Number=SeqID_136269
aagcgccaatcccgggcgcaagacaccggcggcaagaaattcttcaagcgctccgagatccagcagaaggaaatccaaaaactccgccagcaagagaagcgcgaattggaagccaagtcactaaagcgcctcgcaacatcctccgacaccgccgccaccgccccgtcctcttcatccaccgcctcctcctcggcctcgtccactatcgcctccgcctccgcctccctcaccgacgagcaaaacatcgacaacctcgtgctcccgaaacccgaggtcatccgccgcctccgcttcctgaagcagccggtcacgctcttcggagaagacgatgacgccaggctggaccgcctcaagtacgtcctcaaggccggcgtcttcgaggtcgacagcgacatgacggaggggcagaccaacgatttcctgcgagatattgcggagctgaggaagcgccagaagaccgggatcctcggcgagaggaagcgccagaaggccgacgacggtgccgctcaggaccgtgagggtggagccggagatgatgacttgagcgactgcggcagctccgaaggtgccgaagcggacaaggacttgaagcggatgaaggcgaatttcgaggagctttgcgatgaggataagattctggtgtttttcaagaagctgttgaatgagtggaagcaggagttgcgcgagatgcctgaggcggagaagcgcacggccaaggggaagtccatggttgccacgtttaagcagtgtgcgcgttacttgaatccgctgtttaagttttgcaggaagaaggttcttccggatgacattcgccaggcgctattgctgatggttgaatgctgtatgaagagagattatctagctgcaatggaccattatatcaagctggccattgggaatgcaccctggcctattggtgtcactatggttggtattcacgaaagatctgcccgtgaaaagatctacaccaacagtgttgctcacatcatgaatgatgagaccactcgcaagtacttgcaatctgtgaagagattaatgacattttgccaacgccgttatccgacattgccttctaaagctgttgagttcaatagtttggcaaatggcagtgatttgcattcacttctagcagaagagagatttagtgggggcaatcaggcttctgaagagaggcttaggataatgcctgctccaagagacatctatgaggtgagccatgtgatggtccacgtggcgctaaggcgagaagcaccggcactgaaacgcataggatctatctgcagcggtacatag

SEQ ID NO: 19492 - DNA, 525 bp, Glycine max
  Peptide Sequence Number=SeqID_136270
atggcaaacaaaaacgttgcgttgttgttgttggtgtgccttgtagtcgctgccggggttgaggcgaggaggccctacgccgttgtccgagatgaatgcttcggttattgctggcatggttgcatattcccctcatcatactgcaattggtggtgtgataaagtgtgcaaatacccaatagacttcggtgacgatggcctgaatcatgtagatagtgttggtcatggtggtggtcatcggtatcctgtaccaactgaggaagactacgaacaccgcccggccgccctatcacctgagagcccgctctcgagcagggctggcagggtgactttagctcaatcaatgttggcctatatcctctcatttgtcatgcaaaactatcttcttccaaagggtacttgcaaagctattgatacttcgggcaagggagcaaaatatcttcctcctgggcaagcttgcgtgggctctcatgaacgaattcaacaagttatgggttcaaatcttatcctcaaactaccttcatga

SEQ ID NO: 19493 - DNA, 231 bp, Glycine max
  Peptide Sequence Number=SeqID_136271
atgtatgctgtaagagctcatcgtgagcgtggaatgtatctgcccatagaattagaaagttgtttggggagcgcaccctggatgaccattgacccggccaatcatcctccgctactgcggcaccgcctccatgatcctcgccgagttaatgggctccatcatcacctcagcgtcgccctctgcatctccgattgcctccgctgtctcctcctccccccaaactcaaactag

SEQ ID NO: 19494 - DNA, 330 bp, Glycine max
  Peptide Sequence Number=SeqID_136272
atgtcgcgctgctttccatttccaccaccaggatatacaaacaagggatatgaaaaagaaggctacaacagaggacgtggaattactgacaaagcattggcggagaaagttagattggtgctcaatgagtatccacaactcaggctaacccaagggagaaaagtgctagagatctgtctaaccattaaatgggacaatggcaaggctcttgaatttttgttagaatcattggggtacgagaattcgaatgatgtatttccaatctatattggtgatgatcgaactgatgaggatgcttttagggtaacaaatgctgccacgcctagttag

SEQ ID NO: 19495 - DNA, 114 bp, Glycine max
  Peptide Sequence Number=SeqID_136273
atggtcgagattgacggcggcaaagcgaagaagatcgttgcagcaaaacctgcgaatcgtcgtcatcttcacaaaccctcgctcgcagatcaggtgtcgcgtgtcagatattaa

SEQ ID NO: 19496 - DNA, 498 bp, Glycine max
  Peptide Sequence Number=SeqID_136274
atgacctatcttgcaagatggcccggctatttccacgttgccgaaggccctggaaatcgaatcatgggttacattatgggtaaagttgaggggcaaggagaatcttggcatggccatgtaactgcggtgaccgttgctccagagtatcgaaggcagcagttagctaaaaaacttatgaatctgctggaagacatcagtgacaatattaaacctcggtgtacattatccctcccccatggtgcagcggtaaagttgtgccttggtgacttgttggtcatgggttcgaatccggaaacagcctctttgcatatgcaaggattctcagccacgtaccaccacatgcaggcatgcagccacagtatctgtcctgacagacttgtgaaagttgtgttctgccttcccgccgtggttccttctcatattggattgccgttgtgcctcttccagaatttctattggcctctattggaccttttatgggtcacacttctcacataa

SEQ ID NO: 19497 - DNA, 114 bp, Glycine max
  Peptide Sequence Number=SeqID_136275
atggatcatctaccgcctgtatgtttcctgattacccaacaggaatcagtttgccgacaggggccttactcggttttagcagaatgtcttatgagaaagatatacgtggtctaa

SEQ ID NO: 19498 - DNA, 126 bp, Glycine max
  Peptide Sequence Number=SeqID_136276
atgataatatgggaaggagcttgtggcgaagatggggtgtgggacaagttcagggagataggtggggaactgagcatggaagagtttaatcggagacgatatggtgggcactggctgtgctattaa

SEQ ID NO: 19499 - DNA, 405 bp, Glycine max
  Peptide Sequence Number=SeqID_136277
atggactatgctgccttaaagcacatttgcaaagatccagagatgtttgatactttgaaaaccgatggagaattcaaacatttcaagttagggaatgatgaaaaaataaaggttgaaggcatagagaatatttgtaccttctgtcgttatcaatatgatttctatgagggagatgacatcacaagggtacaaatatgttggttcaaagtgggatgcaaagtgtataaggggagatacttggtgttgcgaggacagaaaaataaaggtgacctttgttatttggatggtcaagccttgaagaggaaccatgatagcaaagtgaagaagaaaatgaagttttctaatgttgtggaagtgttaggagatgcttctgttagaggcggagtttgtttactttcaaattga

SEQ ID NO: 19500 - DNA, 1083 bp, Glycine max
  Peptide Sequence Number=SeqID_136278
atgagcgtacttctggaacccttcggttacgagtacatgctgaacgcgatgtgggtttcggcgatggtgggcgggctgtgcgcgtttctctcgtgctatctgatgctaaaaggctggtcgctgattggcgatgcgctctcgcactccatcgtaccgggcgtggcgggagcctacatgctcgggctgccgttttcgctgggggcgttcctgtcgggcgggctggcggcgggcagcatgctgtttctcaaccagcgcagccgcctgaaagaggacgccatcatcgggctgatcttctcctcctttttcggcctcgggctgtttatggtctcactcaacccgacctcggtgaatattcagactatcgtcctcgggaatatcctcgccattgccccggaagacatcgtccagctggcgattatcggcgtggtgtcgatgcttgttctgctgttcaaatggaaagatttgatggtgaccttttttgatgagaaccacgcccgcgccatcggtctgcgtcctgaacgtctgaagatccttttctttaccctgctggcggtttccaccgtggctgcgctgcaaaccgtcggcgcatttctgcattaccagcttccttggcgcatgggcgagctattatctcgacggcgcgaccggcggcattatcgtggtcgcccagacgctgctgttcctgctggcgttcgtctttgcgccgaagcacgggctgctcgccagccgccgccgggcgcgtcaggcgcaagagatccacccatgatcgcgctgctccttgaacccttccagtttgcgtttatgaacaacgcgctgttgatttcactgctggtcgccgtgccctgcgcgctgctgtcggtttttctggtgctcaaaggctgggcgctgatgggcgacgccatgagccatgcggtgtttcccggcgtcgtactggcctggatgatggggctgccgctggcgctgggcgcattcgttgccggtctgttctgcgcggtcgccaccggatacctgaaagacaatagccgcatcaagcagatactgatatggggatcgtcttttccggcatgttcggtaccgggatga

SEQ ID NO: 19501 - DNA, 756 bp, Glycine max
  Peptide Sequence Number=SeqID_136279
atggaagtagccaatgtttgtagtggtacaccgggaacttatacacttccttactacttcacaacacctacagtaatctattgtccgatgaaatccggaagctcagcatctgaatatatttcaaaagttacggtaaaaccaagcggtaaaccgactatggagagcagtacagatgccactacgtattcagactttacagctgatacatccaaatttattcagttgattcagggatctacaggaaatacatataatgaaggtattgctgtatggattgattttgacagaaacggaagctttgatatcaatgagagaattcttgtgtcttcacctaatacgacaacacctattacaggaacgttcagtgtgccttctgatgcgtttatcagtacgacagattataagtatgttgtaatgagagttgccatgcagagagatggtatccctgtaaattgtacaggatttgccaacggagaagttgaggattatacagtaagaatctctaaaaatccggtgcctaatgcaaccaaccaaacggaaatattgatttatcctaacccggtacatacaatattgaatgtgaaaaatattagcaaaagagctaattataagatatacaatgcggcgggtcagcttgtgacaagcgggatcattttaaataacaagatagatgtaagcagcctgatccacggagtatatgttatcgatattgatgatactcagggtacagcccaaaagaaatttatcaaggaataa

SEQ ID NO: 19502 - DNA, 807 bp, Glycine max
  Peptide Sequence Number=SeqID_136280
gggcgcgccgcgacaactgacatcctgcgcctgaaaatcgtcgccgacagcagcgcgtttagccagcttgcgcaggctgcagggcaggttcagcgtaccgatctggcgcttgcgctggtcgcgctgtggctgggccgtttgaccgggcgtctggactacgccgccgggtttatctttatgcgccgcatgggctccgtcgcgctgaccgcaaccggaccggtgctcaacgtcctgccgctggcggtgaatatcgatccgcaggagagcctgcctgggctggcgctgcgtctggcgagccagctgaaaaaaatgcgccgccatcagcgctacgacgcggagcaaattctccgcgacagcggtaaggcggcgggtaatgaagccctgtttggcccggtgctgaacgttaaggtgttcgattatcaactggaactcgacggcgtagaggccatcacccacacgctggcgaccggaccggtgaacgatctcgagctggccttgttcccggacgagcagggcggattaagcattgaaattctcgccagcaaacagcgttacgatgaaacaacgctgaagggccacgtcgcgcgcctgaacgcgatgctggtgcagtttgccgctaacccggacctgcgctccgggcgacagcgtggcggtggccctcccgcgttcggtattcctgacgctggccctgcacggcattgtggaagccggcgccgcgtggttaccgctggacaccggttacccggacgaccgcctgcggatgatgctggaggacgcaaagccgtccctgctgattaccaccgatga

SEQ ID NO: 19503 - DNA, 327 bp, Glycine max
  Peptide Sequence Number=SeqID_136281
atggatcgtgagcgaattgttgatagtagtatgttgcaaggagaaataccaattgtcaagatattaaaagagaattttgatgactcaagccaaattactttcaagttagactcatcagatttgttccataaaaccttgaagatgtggagtgcaatattgagaggactagtattcacctcttttggggagcacagaggtggtgcggcgccagagtgtgtgatcggaggttcactggttcgctggagggaggagtgcgttgaagtcttgaaagggggagtgcaacgcagggtattttgggaaaaagaacagaaaataggagtgtattaa

SEQ ID NO: 19504 - DNA, 363 bp, Glycine max
  Peptide Sequence Number=SeqID_136282
ctatttttggcaagccgggagaagttccatgctgaagctgacaaaaattactggaagacaatcggtgaactcattccgcacgaagtgcctgcgatagagaagagagggaaaaaggacaaagtgaagaagccttctattgctgtaatccagggcccaaaaccagggaagccaactgatctttcaagaatgcgccatatattattgaagctcaaacataatctcccttcacatatgaagcccaagcctccaccatcagaaaccaaaaaggatgccaaaactggacctcttgatggagctagcacaagttctaatcctcccaaggttgtgcttgtggcaattcctgaggctgttgctgcagcttga

SEQ ID NO: 19505 - DNA, 809 bp, Glycine max
  Peptide Sequence Number=SeqID_136283
aaatttggcgtcaccgtcgccacggtgacgctgttctttacccggaagacgtgagtctagtcgcgggcgctgtagattttgctgctcgagtagatgaaatacagtgcaatccccaggcagataaccgcgcccagacggctcggcgaaaagggaatagcgggattacccaaccagccaaagttatctatcaacatgctcatggtgagctggccgaatatcaccgccaccgtggcgacggcggtgccgatgcgctgtacggcaagcaccataatcacgatatagggcacgccaaacatcgcgccgaggagctgccatttgggtacgtccagcagcgtgaccgcatgcttaggctcaaagaaaaatatgagcagggcggtcaccagtgcgccgacggaaaaggtcagaaacgcgcttttgaatacccccacgctgctgccgagctgtccgttaatcgcggcctgaatgctcagcgtagcgccgccgcaaacggcgagaagaatcataatcagtgtcatacgttacccctgtgcgaccagaaccagtgccgcaatgatgaaccccagtgcaataatgcgcttcgcatttatctttctgtgcggcgagcccagcagaccgtagtggtcaatgatcaggcttttaaagacctgaccggccaaaatcccaatcatggtcattgcgatgccgatggcgggtgtcgcaacggtcaggatgaccacgtacaccgggccgagcacgccgccgagcaactgccagccgggctgggcaaaaaacgaggggctgttacgcgggctaaaaaacagcatcagtaa

SEQ ID NO: 19506 - DNA, 374 bp, Glycine max
  Peptide Sequence Number=SeqID_136284
atgttcgatgccagtaatatcaacgtccgcgcgctgctgatctttattgaggtctatgaagcgcagaatttctccgttgtcgcgcggcggcaggggatatcagcctcacagatatcgcgcgttattcaccagcttgaggatgccctcggtcagcagctgttctaccgcaatacgcgcgcggtgatccccacagaaagtggtcatctgtttatccgctatgcccgggcgatggtcgaaaacgtcgaagaggcgcggcgtgagctggatgaacgttcgtcggaaccatccggcacaattcgcattaatgggccggtattttttgggcagaggcatgttgcgccaggcctggcggagctgaccgagcgttatccgcg

SEQ ID NO: 19507 - DNA, 225 bp, Glycine max
  Peptide Sequence Number=SeqID_136285
atgggttgcttaaaagaatatgaagatgtgaagatggaaaagactcatgtaggcgggccttatgcggagcgggccagcccgcttacccaattcactgtcaatgcagacttatgcaaacgggccttacaagggactggacagcccacttatccacccctatttgaaacacatcaacactcccacgcgtatccgtacacgcaaccacacccactcacatgggtgtga

SEQ ID NO: 19508 - DNA, 153 bp, Glycine max
  Peptide Sequence Number=SeqID_136286
atggcagcatcggaatgctattctgttggaggatggaggaaaattaaggtggttgggctcgattactccctatacgtttggagggttgacggcttgacgctgccagttgcatggaaaaactctcacattcattataactacaaaccgcattaa

SEQ ID NO: 19509 - DNA, 264 bp, Glycine max
  Peptide Sequence Number=SeqID_136287
atggctaacgaaaaaataaaaagggggaggggtgaaatcagatttcaccccatcttcccccattctcttcaaaactccccaaaagctccacaaggacctactgggcctccatttttgcagcaacttcaagatttttctgcacctttgtgtcatttgttgcattcctttcatcccactcaagcgatggctttaaagaagctttatgttaaaagggctaggaaggccatcgcaggggagggatccagtgcagccccgcaagcgtaa

SEQ ID NO: 19510 - DNA, 519 bp, Glycine max
  Peptide Sequence Number=SeqID_136288
atggctgatgtggaggcggtggtggtgcgtctgctgctagtcttgccccggctgctgtgcctgccttggcatacaatacttctcaatgaaagacctgttgatggagggctgaatgagctttgtaggcgtgatcggtaccccatagaactggcagaggcctgtgatcaatgttttaaattccagtgccatatcagacttttatgggtccactgggtgtctcagaggtgcaatacctataaattggtagatgacattcgggataagctatgctacatgaacaatgatctgggcagcaggagatcaaaattatggtcactgggaaggatgttgctgagcagaagcgtcattcaaatttggttcaaagtggtcatgctagtgcgcatgatctacacccgcctctcgataaccttccgtgcaaaatcctgtctcgaggaacacagtagctggcctatggcctcttcatcaaaacctgatgatggaagcttgcttgtggggcttctatggaggctggatctttga

SEQ ID NO: 19511 - DNA, 231 bp, Glycine max
  Peptide Sequence Number=SeqID_136289
atggagaccatagatgcacatttttcatcttcttattggagaatgtacaattacactggaggatgtagcactgcatcttggcataagggtggacggcggtatagttgcggctctgcttgtctagcaacgctgtatagggaaatgtgtagggccattgaccctgatgccaaaaccatgggcggtgtgcgtcattgttgcaatcttgggcatgatggagtggcagtggattaa

SEQ ID NO: 19512 - DNA, 132 bp, Glycine max
  Peptide Sequence Number=SeqID_136290
atgactgctataattgacaaatgtattatgttccaagacattactactctattgctttctattgttgcaggtattatgttccaagacattactactctattgcttgatcctaagcatttaaggacacaatag

SEQ ID NO: 19513 - DNA, 192 bp, Glycine max
  Peptide Sequence Number=SeqID_136291
atggcggtgctgaaggtgacgacgctttgcccatgcaagggttgcaacaatagaattcacatgccggtgttgaagaataaaggagttaatgacatgggtatagatagagggaagggcatggtgatagtgaagggcacgatggacgttgcagctttggcaaagaagttgtcggagaagttaagaggaagatag

SEQ ID NO: 19514 - DNA, 1179 bp, Glycine max
  Peptide Sequence Number=SeqID_136292
atgaaagccctcacaagctcttgttccaagaccgtcgtcgacaccctaggacccttttctcccagagtttgccttcgtgtttcttatagacccgaattctgcttcacccttcgttccaaaaatgagaaaaagagttgcaattcattgctcctgaaactggttcggaacaagggtgttgtttacccggttcatgcagtgccaccaaagaaccaggtggacttggatactgcggagcctcaagctcaacaaagtgaacaaacaaatgaatcaaagtttgttcgtgtatcttttcagttagaaaagaattgtaacttcggtgaacagtttcttatcgttggagatgatcctgtgcttggttcatgggaccctttagaagcattacccatgacatggtttgaaggacatgtatgggccgtggagctggatatgcctgctggaaagtcattccagttcaagttcatactgaaaggaaaagggggggatattatttggcagccagggttggatcgaatgatccacacttgggaaactatgaacagaataattgttcttgaagattgggagaatgcagaacttcagaaaataatagaggaagatcaacttgctgagccaaatgaggaaccccaggtcgacttagaagtgccgactttagctgaaactttggagaatcctcaagaggaactggattccaatgcatccgaaatatcagctgttgaagatacccaaattcatgcagaggagaaaccacttgctgaaccagtcatgcaacaaaacactgatactatttcttcctctatcgaaaagccaatggctattgttgcagaaaatataagttcttcggaagatctcatcaacagtacaagccaaaaaagtaataaaaagaatataatacttcaaccaaaagaagaatctgcagatagtccaggaaacgatgatataatacatgatcttggacacaatggaaatgctgcgtcactcgaaaatcaggaaaagacaattgtggaaagcagcttatttgatcttgaaggaggtcctgttcttgtacctggcttaataatagaaccaactgagccaactgatcaagcgggtcaaagtgaagttcaagagatgactaacacggacacttcagttggagcttttgaaactcaggatcagaacatacccgaggtaaacgcttga

SEQ ID NO: 19515 - DNA, 456 bp, Glycine max
  Peptide Sequence Number=SeqID_136293
atggtgcttcaatctcccactagtagtggaaaaatatcatttttgctagctggagtgaagcttcccaaagattgtgaaaagaatgagagtaagaaaaaaaggagtcagattgaggtagtgaagtgtaatggggatttgaaaacaaagagtcagttagctaaggaaaagaagaacatggtagtgaatcctcttgtcagggatcttccatatccatatgctcccacaaagaaggacaaaaaaagacaatatgtaaggtttctagagattttcaaaagattgcaagatttgtcaccaaaacttcaagatctgggtagcttcaccattccaataactattggagatctcaaggtggggagagctttacttgaccttggagctaccattaatgttatgcctcacttttacttggcaaatattggtgatcctgatgtcaagcccacccgaatgactctttaa

SEQ ID NO: 19516 - DNA, 288 bp, Glycine max
  Peptide Sequence Number=SeqID_136294
atggcaagttacgcactaagcgtgagattaccgccatacttgctaagcacggcaatcgcacttagcgtgaagatcacattcaatgtgtttgaatctatgaatcaaccaaaagatgaagaatcttgttcttgggtggatgtgcttgatgaagttgttgtggacactaggaagaaattgcatatctcttgtcctttcgagaaggttcttattgatgcattagaagctctcaatgatgaagatgaaaaggtgattgaagaatgtatgccaagtcttgatgtgttgaaatag

SEQ ID NO: 19517 - DNA, 201 bp, Glycine max
  Peptide Sequence Number=SeqID_136295
atggatttagctgatttagagtgttatggagttgaaaatcctaacgcacgattgtcttgttttgtcaacaaggcttttgcagatgttggtagtgacatggcaaagcttgtccttggttgtgtttcgatagaagtggatgtgcggcttgcttatgacacacatgccattatcaggaaggtatttgattatatgcttcattga

SEQ ID NO: 19518 - DNA, 297 bp, Glycine max
  Peptide Sequence Number=SeqID_136296
atgttcagctccatgaaccagatcgtcttcgccgaagagactaacgaccccgtctccgaccaccgcatccattacagttcccacaccatcgaagacgatggcattgctgtcaaagatgtttccgctgttccaggccttgaaatctctatcaacgattctagccagctcatgctctcgtttcacggccaagttcaagcaatgttgttgcttctaggaggaaatgaactaactttgggttcgcaatgtgtagagctatcacctccttcaagtagtgttattgcatctcgtgaattctag

SEQ ID NO: 19519 - DNA, 444 bp, Glycine max
  Peptide Sequence Number=SeqID_136297
atggcggcgctttggccggctactccctctccaacttcgacgcggtcaaggactccaccggtgactcctccccgattatcggtggcgcgccgtacaatgccggtggagacttcgtctccgcctccgatctactccgtcgccgcgttctcgccggagcagaatgggaagggtgtggatggtggtttcggtgcctcagatggcccgatcttgccgcctccgacgaatatggttgcgaaggaagggtttgctttgagagaatggagaatgcaaaacgcgattcaattggaggaaaaggagaagaaggagaaggagatgcggtcgcagatcatagaggaagctgaagagtacaaaattgagttctacagaaagcgtgaggttaatgctgagaaaaacaaggcttctaacagggaaagagagaaggttgaaattcacttctttgattga

SEQ ID NO: 19520 - DNA, 246 bp, Glycine max
  Peptide Sequence Number=SeqID_136298
atgttcaccaagaattcctctgcttgctttgacttgttagttgcactctccggttatcttgggatcacctctcaaaatccaaagatcatgaaggactcaaattcagcatatgattttagcgaaattaatgggttttccaccaaaccgagtatcctttaccactctggcgaggtcctggttgctgcttcacgtcttcttcctgcttgttatgaggttcatattgtcgaggctttggctctcaggtag

SEQ ID NO: 19521 - DNA, 294 bp, Glycine max
  Peptide Sequence Number=SeqID_136299
atggaagcaaaagcgcaaaaatggtggcctaggggtgaaaatctgcaaaacccgtgggtgttgcattttttgaatgagggaggggagttctgggtggagagaaactccccctcccctcgtttttatgtttccaggtgcaagggtgctcgccaaggcaagctaacccccccccccccattttttttagggaagacacaggttgcctcccagctgcgcttcccgcttgtccgaagctgggcatgggacgatgatccatcgatcatgggcgtagcctccactcccatttgtccctaa

SEQ ID NO: 19522 - DNA, 530 bp, Glycine max
  Peptide Sequence Number=SeqID_136300
atggattcgttctcaaatccatccagtggttcgtcgcaccaattatctgcgcacgatctcaaaaatcagttgaagaatcaacttgccattgagtatgctcaacaatttcttgaggagaaaggagaagacatcggtgggtggaaggaggaaatagtaatgggaattgggatatccggcatgggaactgtgggaagaaagtgttttgagaagtgtgttacaaaaccaggttcaagcctcggtgggagtgaaagcagttgcatctctagatgcgttgatcgatatattgaagccacaggcataattagcaaagctaaagacttgggtggggtccaaggactgcagcaatctaacccataccaccatgtggataccaaatggcacgttggacaaatcaattgggtaaaagctattactgacggatccgttacgcagaaaggaaaacaagtggcttgtgctggtgttttcagagatatgcattgtagcgctccacatggtatggccaagtggcattcgcaagttaacagtggaaa

SEQ ID NO: 19523 - DNA, 1131 bp, Glycine max
  Peptide Sequence Number=SeqID_136301
atgtttttttttgctgaatcccctaatgatatattgaaaccgcgccgcaacatagagccctctctctctctctccctccctctctcttccctctctctctgggaagaacaaagtagaagaagcaacagaaaacagaaccaccgaacccactcagaaccaccagtgcttcgaagtagcggcgcaaaaaaccgctctgcaacccgcaccgctccgccgcgacccaaaactgcgccgctacacatgtgcccgtcgcggatgggtgccactctgctccgccctgctgctatagcggccgcaacggctgctattgacaactatgttaacaccacttattctgattgttcagacttcagtgactattcccttgcattgaatttagttcttcggttctgtcaagcaaaaaagcaataccatcactccgcttttaatggcagttccgttgaacagcctttaaagtgtaatcctacgcatccccgttcaacagtttctcttctcaattttcgtgactgccgactatcatttgataacggatcctttgaaggaacaagcagaataaaggtaggatctggtaaagggagaaaagtgtgcctgacggtgacaggtgttgtgattgcaattgtattgctaattgtgatactagcgttgacagtgttcaaagccaagcatcctgttaccatagtggactcaacgaagctagaggactttcacgtgagcttggatccagtaaaactaagggtagatttgaatgtgaccttgggagtggatgtctcagtgaagaacccgaacaaggtgggattccagtattcagacagcgctgcccacctcaattacagagggcagctgataggtgaagtcccgatctctgccggagagatttcatccggtgagaccaaaggattcaatctcacccacaccattatggccgaccgtttgctctccaattctcagcttttatctgatgtcacatctggtacattgcccctaagcactttcgtgaggatgtctgggaaagtcagcatcttaggctttatcaaagtccatgtggtttcctccacttcttgtgatgttgcaattaatctttctaatggaactgttgggaaccaagagtgccaatacaagacaaaactttga

SEQ ID NO: 19524 - DNA, 333 bp, Glycine max
  Peptide Sequence Number=SeqID_136302
atggcagagttgggtcaatgcgaaccaggtgatgcgggacaggaaggtgaggatggcaacaaacaacgattcagatattacgagggggttagacaaaaatctaaggatctatccatttgcagcactatacaacaagacctaatagaggatgggactatggccttcagatatttctgcaccacaaatatttcaatccaacatcatcatcatcatgcttatgctaaaaatcttgtttcctttttcaactcacgcatgcaaagtcccaccccaatgagaaacaacaagaacaagtgtgcaactgagaacctatttgtggatttgacagaaaaatag

SEQ ID NO: 19525 - DNA, 192 bp, Glycine max
  Peptide Sequence Number=SeqID_136303
atggcggtaccatccacgtcaccacgtctcgccagtggaaatggcggtatcgtccatgtcacgtcctgtaacgccaatggcaatggcgggtcaagctttatcgccagcaccatcagcgacttccatgcaaaacaaaccccctccgtaattacttttaaaagagacccctttagtaaatctgatggtggctaa

SEQ ID NO: 19526 - DNA, 846 bp, Glycine max
  Peptide Sequence Number=SeqID_136304
atgaggttgttatcaagtgcttccgggcagcccaacaatcaagagctcaaacaattttctgattggctactcgacataggtgatggcaaagttggacaagataatgatggattttttgaaatcaccatcccaaatgagttccttataacggactatacagatcctatccacgctattgttgcagccacatatccaaatttgatacataactatagcaatatagattacttgcaaaatggtgttgttcttgcctctaaaaaagatattattgacaaaataaatgattatgtcttatcactgatacccaatgacgaaaaggagtattgtagtgcagatagtattgataaattagatgaactactcaattctgcttttggattattgacacttgaatttatgaattcattgcaaacatcaggcatacctaatcataaattaaaacttaaggttggtactccaatcatgctgatacagaatttggaccaggctgatggattgtgcaatggaactaggcttattatcaccaaacttggttctaatgtggttgagtccaaacgttcatccgattgcttagccaccatcagatttactgcaccattacatgttcaaaagggggtttgttttgcatggaagtcgctgatggtgctggcgataaagcttgacccgccattgccattggcgttacaggacgtgacatggacgataccgccatttccactggcgagacgtggtgacgtggatggtctcgccttctctagtagcgagatacgtggtgcatcacgtgatgaagctcagcccagggtcacagatttgcagtgtttagggttacagctttgcagtgtttag

SEQ ID NO: 19527 - DNA, 609 bp, Glycine max
  Peptide Sequence Number=SeqID_136305
atgggcagaatattacaagaatatgtggctatgaaaacggatgctgttgttgctagtttaatcgattccgatatacaagagctcaaggttgcagccaagaagctcctccacgatgccaccatgctaggaggcaaaggctttggcacttctttttttaaatggattgcttcctttgctgccatttatttactgatactggatagcacaaactggaggacaaatatgctgacagcgttattagtgccttacatattcttcagttttcccgagtcattgttccacttcttaagaggagaagttggaaaatggattgcattcatcgcagtcgtgctgaggcttttcttccctagacattttcctgattggttggaaatacctggatcaatgattcttattttgacagtggccccagacatctttgctcacagattaaggaataactggattggattagcgattgatcttttcattggttcttacctactacaacaacatatcagggctaccggtggattcaaaaattctttcacacagaaacatggaatatcaaatactcttggcatcctcttcctcatagtctatcctatttgtgcattcattattcattaa

SEQ ID NO: 19528 - DNA, 567 bp, Glycine max
  Peptide Sequence Number=SeqID_136306
atggcctcgatcagctggggagcaccattagaatcatcaccatcctctttccccagacctctgccaataaccctatctaaggcacgagctaatcctctagttttaaccatgatctgcaaatgtctaccacaaattccatcattaagctacacaatttcaaaggaatgcgttccaaataacatatatcttgtggatatgggtaatgaatattcttttggggtgagaaattgttttcgtactgactacaagcttgcaatagtaaaagtagctctagggcaaaaaggagaaaaattggaaggtgcagtagctggtgtctcgctaagcctgggacatgcgcttagcaagtatcatccgctaagcaaggcatcaactcgcttagcgaggaagaggaatctagaagggaatctgccatgcaagtacgcgctcagcacgtcatcagctcacccaacgagtcatctatcccttctggcacttagcgcgcttgactcgttaagccaaagttcacttactcgcgctaagcacgaaaatggcgctaagcgcgcctttgaggacaaaaagcccttttaa

SEQ ID NO: 19529 - DNA, 348 bp, Glycine max
  Peptide Sequence Number=SeqID_136307
atgagacatcttaggtcagttttcatattgacgatactctctacacctcctcttcctctcaatttcgttttcccttctcctcctcccaaaaccctctctttttcccgcataccaccaaacctgtctcagaaaaacaatgatctcggacttattcaccgttggattgtcgtgaaatttgagcaccagagagacaaatactcatttcacatagacagtggaatgaaggcttcaatcccttctcctctctctaacgctaggaaaccttatcagaacaatcaaaagaaaagcttgaggaatctcaggaaaactattagagatgccgctatcactgtcagaatacacacgtga

SEQ ID NO: 19530 - DNA, 669 bp, Glycine max
  Peptide Sequence Number=SeqID_136308
atgggtcggcttaatctcctacttgtgtggtcactctctttaacacttttccttaattatctacacccaacctctgcccagctcagtccaaaccactatgctaacatatgccccaaccttgaaagcatcgttagacaagccgttactaataagttccaacaaacctttgtcaccgtcccagccacccttcgcctattctttcacgattgctttgtccagggttgtgatgcttccgttttgattgcatccaccggaaataaccaggcagagaaggatcaccaagacaacctgtctttggcgggtgatgggtttgacacagtgatcaaagcaaaggctgcagtagatgccgtccctcagtgcagaaacaaagtctcgtgtgcagatattctggccttggccacccgtgatgttattgcactgtctggtggaccttcttacacggttgaattgggaagatttgatgggctagtttcgagagcttcggatgtgaatgggaggcttccacagccaacgaacaatttgaaccagctgaactcactgtttgcggcaaacgggcttacccaaactgacatgattgctctctcaggtaatcctcgtgcaactgtttacaaatgggtcccattagcgtttgtgcacgccattaggcttgttagagtagttgatatttga

SEQ ID NO: 19531 - DNA, 384 bp, Glycine max
  Peptide Sequence Number=SeqID_136309
atggcattaggggtcacggcagctcgcccaggcgagttgttgcttcaacctgaagtaaccttgctcgcacatgggagttcagctcgcccagaaaacaaccaaagagtacaaggaaattcgcccaggcgagctgcagctcacccaggtgatttgtggcttaatgctaaagtaaccagctcgcttgaagctagatcactagcccagggcaaccaaatcccatttgaacatgttcaaacaagtaagagaacaataagggtaacaaggccaacgagtaccacacgagcggtgacagagaggcgacgacacgatgacacagtggcggagagtaagagagtggcagtgacgcgatggcacagtggtggagaagaagagaatatgtggtga

SEQ ID NO: 19532 - DNA, 1323 bp, Glycine max
  Peptide Sequence Number=SeqID_136310
atggtttcaatagaggtttcatcgagggagactgaaggggttggttctgaggttcgagggttcgatgaggaggtgctggaggaggtgggtttccctaacccttctgttgaggtggtgacacagaaacatcgacatgtgttgacaaagaagaagatggttcggtcagacgccactcctccactcgagtttgtatttatgaataaggagttggagaacaaggtttttttatatgtacgaatgcatgttccgagatctgcatcagtgataagttggggaagcattatgccagcagtgcggtatttttctcctgaagaaaccatagagcaaaagttacaaattgaaaggaggcttggtagtgtgaaaacgtgcaagtactttaatcttctggagagatttctgagtttcaaaataagcaaacgtgagtttgataggatctgcatagcaactattgggagagaaaatgtccctcttcataatcattttctcaagtcaatcttgagaaaagcatgtctctccaagacagccggaccaagagaaagcaaattagaaagttcttggaatgtgaaaacgccaaatggatgtagcaaccttcagatgctgtgcaaggattttcctcaatctcctcgaaaaggcaggactccaaatttacgtgatcggaaatccagggaccgtccctgcccttttggtcctcatgggaagaacaacagcattggatttgaggattcaatcccaaaaattcatgagcagcaaagtattgtcaatctgcaatctgcaggtagtagacttgctctctctgtggaagatggggaggagattgatcaggattatgaaatcctgaaccttttcaaaaagagtcccattcaagcacctcttgctattcccacttacaatagaagaccaccgcaaaaacatttatcccaaggattatcatctggtactgtaagtgatacctgtcaaagcattgctcagctacctgatacatgttctttgatgaaaaggttggagcagaaattggaaatagaaggacttaagatctcaacggatgctgccagcttgttaaacaatgcacttgatgtttacctcaaaagattgataaagccctgtttggatttagctgcttcaaagttggtaaataagttcagtggtccaatacaacctggtctgaatgaactaccaatgagacgatgtgtgcaaaagtcaattggatctccttctgtatctatatctgactttagaacagcagtagagttgaatcctactatattaggggaagattggtcactaaatttggagaaggtttgtctacatgcattagaagactga

SEQ ID NO: 19533 - DNA, 720 bp, Glycine max
  Peptide Sequence Number=SeqID_136311
atgaatctaactaccctttgcaaatccccccgcactaaaattgcaacttgtgttgttgtttacctccaaaacatgcactgtttgcgactttacatgatcaaccaaagccttaacttaaagcacagaacaatcggtacgaattttcccatttcttgcagtcttaactccaacgcgacccaatttggtcatagcagccacaaagttggagttgaaaacgttggtactggaagcaaaggaattaacggtgttcctagaccttgggtccgtgaagaggatttggtccgaggtgaagaggccctttccttgttgaaggttttggtaataaacattgtcgaatttacgaggagttgttgggtccatgttgatggcaatcctaggatccacgtttcttgggcacatttgttgcaattgggctacgtattgcttgttcagtgttgggtccactggggtgctgtatattctactggcgaacttgctgcagtgggagaatccaaggatctgaacacgagggttcgttttctggctgctgctttggccgtgcaacttgcatccaagctcacatgcgtcaagctcggttttctatgttgtttgattgagtggcttctgatgcataaatggttgtgttttattatatttaatacacgaatcttttattaccctcttcatcccaaaatgattgaaggccatgattggttgttgaataaagaaaggaaaatatga

SEQ ID NO: 19534 - DNA, 799 bp, Glycine max
  Peptide Sequence Number=SeqID_136312
gggcgatgggcttcccggaaacgctactgcttttgacggcggcggccagcctcggctgctgggtgagctacatccagggacgctggctgggcaatacgcggatcgtgcaaaactggctatcgcatttaccgtcgcattatcaccagcgagcccatcacctgttccacaagcacgggttatcagcgctgctaattggccgctttatcgccttcgtacgtaccctactgccaacgattgccgatcagctgatgtcgtgcctgatgctgctgccggttgcgctgctggtcttcggtctgatcggctccctggttgtactgtggaagaaaaaacacagcagtcggagctgagcatggtcatcaaacgtccttcctggcgccagctgcggtggatgctgggcggctcactgctgctttgcgccagcgtctggctgtggctgaccgtcagtcagcatgagtccactctggccatccgtcccgtcagccagggcgtcgctatgccggacggtttttccgtctggcatcatcttgacgccaacggcatccgttttaagagcatcaccccgcaaaaagacggcctgctgatcaaattcgactccaacgcccaaggcgccgcggcaaaagaagtattgggccgagctctgcctcacggttatattattgctctggtggatgaagaaaattctgccaccgcctggttatcccgcctgcgcgatgctccgcgccactgcgggaaccgcctggctcgtattgttgactggattgggtatatcaccgatatcccctcacacaatggaaggtag

SEQ ID NO: 19535 - DNA, 873 bp, Glycine max
  Peptide Sequence Number=SeqID_136313
atggaggaagccattgctaaactcgcctccaaccaacttcatgttaccagcaaactcgatgacctcatccaacgcatcactatgttggaatccaaccaacatcattcgcccgcaccctcatcctcttcagccaacccccaaacaccatccagatcctctagctttcctcgtatgaaactcgaggttccccgttttgatggctccgatccttcggggtggaccttcaaaataaatcagttcttcgactgtcactcaacccctgagcccgaacgccttgttgtttcctcctttgccatggaaggccttgccttggcctggttccaatggctcattcgtagtggtcaggtatcctcttggatcggtctccttcatgccctcgaggcccgcttcgctccttcccaatatgaggatcccacggggtccctgtgcaaattgacacaacaaggttcagtgagtgcttacctcagccaatttgaaatgctagctaatcgaatcatcggcttactggcaccgtttctcctcagctgcttcatgtcaggattggctccagaaatcaggcgagaggttcaagcccttcaccctttgaccttggtccaggcaatgggtctggcgcgtctccaggaagaaaagttagcagaccaacaccgtggtgcctacgacggtccctgtacatgcaaccccaaccccatttccactctgctactaccactgcctcctacctctccgctacttccctcccgcgctaaaccaccaccaccgcacgttcgccgtctctcgtcggaagaaatcaccatgcgcagagagaaaggtctttgcttcaaatgcgatgaaaagtttactcgagggcacaaatgctcctctcgcagaccctga

SEQ ID NO: 19536 - DNA, 594 bp, Glycine max
  Peptide Sequence Number=SeqID_136314
atgggactcaccaagaccttgagccgcattggtcagaacttcatttggccgggaatgaagaaggatgcacaagactttgtgctagtatgccttcagtgccagcaaactaagtatgatcaccagaagagcccgggactgctatactttatcggaggacttccagcttccagaggttacacagtcatcctagtaatggttgaccgattctcaaaaggggtccacttgggtgtgcttcgacccaattacataacttccacagtctcaatcctcttcatggagatagtggggaagctccatggtatgccgcgaagcttggtctccgactgtgatcctctatttgtgagtcgcttctggcaggagttgttcaagctttcagggaccaagctaaggatgagctccgcgtatcatcctcagtctgacaaacaaactgaagtgatgaacatggatgttttgaagcagcctatacagagcacagaccaaaaccaagaaatatcagacaaagaagcatcagccatgcattcaaggagcaaaaggcaaatcaccaggccacattacctgaaggatttcataactaactctaacaagggttgctaa

SEQ ID NO: 19537 - DNA, 405 bp, Glycine max
  Peptide Sequence Number=SeqID_136315
atgattgtcgacaactcccatgccgacgccggaaacgtccgtctcaatgatgaatggttgagagaagtccgacaagctcagaactggggctgtgcaaattgcttccttgagtttgtcaaaagcaagctaggcctccatcgaccactgaaactggtctttgaccaagaggcgagtcaaaggcgctacaatagaggcataacctttaatgaagcaacgatagaaaccagagagacccaggaatccgtgcaaggctcgtgtcgtccgaggaacagtccacgcttgaatcgcttctaccttggtgggaacaagttcaacacctcatcgagaaactatatggcccaagtattcaacctgttgctggacgaaggaacacttcgtgagtttgaggaagaagcgtcattctaa

SEQ ID NO: 19538 - DNA, 360 bp, Glycine max
  Peptide Sequence Number=SeqID_136316
atgaggggccaagacatttatagtagccaagataaggctactactttaccttcctctagtgaatgtgaagaagcaaaaggggcagaatctagtgaagaaatctacccccaagaagaaggactaccattagtggttaaagagaagtgtaaggaggcactgagcgaaatccaacttgctaagcgcaccgtcttcaccttcaggctgagcgacttttttggctgtggagagactgagaaagagctgagcttgacgaggaagccatcttgtggagcttttgatgagattttgagaggttgtgaggaagcttccctgctatggagagctaaatcctcagttggttcttcctacggggtacttgat

SEQ ID NO: 19539 - DNA, 324 bp, Glycine max
  Peptide Sequence Number=SeqID_136317
atggcgggtacgaaaattggtgctatcactattagactaagtacagtcaaggaggagagaggaaaatatcatgttcactattacatttttggattagctttaaaaaatatttctactacaccattggcaaaaactgctatagcaaagctaacagctattgaaatgtcaaagcaatgtctagagtctactgcaacctctcttacttttattaaattgttaccttgggtcgtatatgaaaatattgtgtttgatttttctggaccttctctgaaaattggtaaccctctcattgttgaagaggatgaatgggatgcaaaaggttag

SEQ ID NO: 19540 - DNA, 1968 bp, Glycine max
  Peptide Sequence Number=SeqID_136318
atgtcatcggcagaaaaacccagctccaaaggacaagcatggttctgcacaacgggattgccaagcgacattgtggtggaagttgatgacatgacattccatctccacaagtttcctctcatgtcaaaaagccgaaagctccaccttctaattacgcagcaagaggcggcgactcattcctctgcagcacagcagcagcaagaaaacgaagatgaagacgaaatcgtggaagagcagtgtcacgtgaccttcacgggcttcccgggaggctctgaggcgttcgagatggctgcgaaattctgttacggcgtcaagatcgacctgacgccgtccaatgtggcggcgctccggtgcgccggggagtttctcgaaatgaccgaggattactccgaggacaacctcgtttcaaagacggagaggtttctatcgcagcacgtgctcaagagcctcaaggactctgtcaagacgctaaaatcgtgtgactccttgatgcctatggcggaaaatctcggaatcacgcagaggtgcgttgattccgtggtttccagaacttcgtcttcggatcctgcattgttcggttggccggtcagcgacgcttcttctgcgtccaaacaggtcatctggaatggactcgatggtgccggaagaagaaaggcaagcgccggtgccggagagtcttggtttgaagatctggcgcttctacggttgcctctgtttaaacgattgattctggcgatgagaactgcggagctgagtcctgagattattgagacgtgtgtgatgtattatgctaagaagtacattcctggagtttcgagatcgaatcggaaaccgttaccgtcgtcatcttcttcttcatccgttgcgacggaggcggagcagaaggagattctggagacgttggtttcgaatcttccgctggagaagagttcgaaggcagcgacggcgacgaggtttcttttcggattgttgcgaacgacgaacatactgaacgcttccgaagcctgcagagacgcgctggagaagaagatagggctgcagctcgaagaagccacgcttgacgaccttctcgtgccgagctactcgtacctgaacgaaacgctttacgacgtcgattgcgtggagaggattttgagtcagttcttggaaggtttagaagcgagaaccgccgcggaaacgacggaagacgcggcggcgacgaggtcgccggcgcttatgctcgtcggaaaactcatcgacggttacctctccgagatagcttccgacgcgaatctcaagccggagaagttctacaatttcgccatctcgcttcccgacgaggccagactcttcgacgacggtctctaccgcgccgtcgatgtgtatctcaaggcacatccgtgggtttcggaagaggagagagagaaaatttgcggattgttagactgtcagaagctgacgctggaggcgtgcacgcacgcggcgcaaaacgagaggcttccgctgcgcgcggtggttcaggtgctgttcttcgagcagcttcagctacgacacgccatcgccggaacgctgatggcggcggaggcagccgcggagcctgggcggcagtcggcggcgctggaacgggaagcggagggcggcggacgagaaggattagggttagacttagagcacgtgcaggaacggaacggcacgtggcgcgtggcggtgagggagaatcaggtgctgcgcttggacatggatagcatgaggacgcgagtgcatcaactggaacgcgagtgttcctctatgaagagagtcatcgccaagtttgacaagtccgacggcggcgccgccggtggttggagggcgtcgctgggccggaaattcggttgcaagtttaagactcaggtttgtgattcgcacgagtcaacggctgttgatacccgcaaaggacgccatcaccagcagcagcagccgcagcagcagcagcatccccatcatgtatag

SEQ ID NO: 19541 - DNA, 279 bp, Glycine max
  Peptide Sequence Number=SeqID_136319
atggatccttcctcttccacttcttctcatcactctgattcagattggcccattgccatcaggaaagaactcgatctactcgccatgattgatgaaatgcatactattaaaaataatgatgggtctatactattaaggtctggcccaatggtgaggttcatcgccaaaaccaatgtcacttccaccatcaccgtcactatgatcaccattggtatctttgtcgtcgtcactcttgctaacatcaccacgatcatcattatcacacaaaaacactcttaa

SEQ ID NO: 19542 - DNA, 1218 bp, Glycine max
  Peptide Sequence Number=SeqID_136320
atgtccgtgttcggtggatggagtcagaatgctatccaaacaacaaattcgtggcttagagaaggattaaggtcccgttgtattacaagggatctaaagtggggggtttctgttccacatgaaaaatacagcgacaaggttttctatgtttggtttgatgctcctattggatatgtctcaattacttcgtgctacacacgtgattgggagaaatggtggaaaaatccagagaatgtggagttgtatcaatttatgggcaaggacaatgtgccattccatacagtgatgtttccatctactctacttgcaaccggtgaaaattggactttaatgaagactattagcgttactgaatacttgaattatgaagcagggaagttttctaagagcaaaggtatcggggtatttggtaatgatgtgaaagatactagcattccagttgaagtatggagatattacttactcacaaataggcccgaggtatcagatacattatttacatggcctgacttgcaagctaaattaaactgtgagttgctgaataatttgggcaacttcattcaccgggttttgagctttattgccaagcctgcaggtcgaggatatgattctgttattccctctattcctgatgatgtaagtggcgaatcccatattcagaccaaaatatttgctgataaagttgtggcatatatagaccaatacatagaagcaatggagaaggttaaacttaagcaaggattgaaaactgcaatgagcatatccagcgaaggaaatgcatatctgcaggaagctgaattctggcgcctttacaaggaaaatagacctctttgctcccttgtcatgaaaactgcagttgggattgtgtatcttcttgcttgtttgttagaaccttttatcccatctttcactcgtgaagtatttaagcagctaaatttgcctgcggtgacacatgtctcactttgtcaagacaaaggagatattgatagggtaaaaagaccctgggatatcataagtgctggtcataaaattggaacacccgagccattgttcagggaacttaaagatgaagaagtggagttctataggaagaagtttgcaggaagtcaagctgataggactgtgcgggcagaggccgaagctgaaaatgttgctgggcagttgaagaaaacgaaactttcaataattggaaaagaggaaattagtcttaacccctag

SEQ ID NO: 19543 - DNA, 315 bp, Glycine max
  Peptide Sequence Number=SeqID_136321
atggcggagaatgtgaaaggatcgaagcttcccatggaaggaaagcgtaacatccttatcacaagtgccttgccttacgttaataatgttcctcacctcggcaatatcatcggatgtgtgttaagtgctgatgtgtttgctcggtactgtcgacttcggggttacaatgctatttacatttgtggcactgatgagtatggaacagccacagaaactaaagccatggaagaaaattgctcccccaaagaaatttgtgacaagtatataccatgctattcacaaggaggtctacaattggttcaatataagttttga

SEQ ID NO: 19544 - DNA, 363 bp, Glycine max
  Peptide Sequence Number=SeqID_136322
atgcaaatttacattgttaaccagatcacaagtcaatgtcagttcattcagacttacttcaagggatcttcctccacaagagacccacataacataatatggtctgcacctatttctcctttcgtcaagttgaatattgatggaagttctttgggtaacccagggtcattgggttttggaggtatagtgcgagactctcggggattttggttctctgggttctatggtcactttgatcacactacgaacatacatgtggagctccttgccatcctcaatgggatgcgtcatgcatggaataatgggtttagacatatcatcatagagacagactccttagttgctatccacctgattgagtag

SEQ ID NO: 19545 - DNA, 786 bp, Glycine max
  Peptide Sequence Number=SeqID_136323
atggctgacgaaattaaaataaaaacatggtgggaggaccttatcgcgggtcatgaaagttctcatggtgtgctttacagtggcgatgaggatactggctcaacctttttatctggtgatgtaatcggcgccggaattaactactccacgaatgaattctttttctgcaaaaatggtgaacttgtccactcagttcccaataacttgagtaaccgcggcctttatccaacgattgccgtccttagccagcacgaagagatgcatgttaactttgggcagaaaccatttgcttttaacctaaaagatttcgaagcacgagaaagaaggaagcaacaacagaaaatagaggaaatttccctgtcaccacaggtcacttacagccttattcgctcctacctgctacactctggctatgaagatacatttaattcatttgatgttgttccttcttcacccataactgatgagcagacaaacacgttaaatcacagatccacactacggcagctaatcatgaatgggaacgttgatggtgcatttgctaaagtgcatgaatggtatccacagattgttgaggactgcattgctttgagggcatatgaaatgcctctcgaagttttagccaatgcagtaaatgcgttcgtgttgtctacagatcctcacatggaagaagcaaaggattgcttgcactcacctcttgagaggttacttaagcagctcactgcctgcaaacgatatgagggagaagatttcctagtcgagaaagagtttagcaagagagattag

SEQ ID NO: 19546 - DNA, 402 bp, Glycine max
  Peptide Sequence Number=SeqID_136324
tgtgcgtttggggctgcaacagcttgtgcgtggatgagatctatcatttctggaaaatctgcacttaaagatctaaaagatacagacattgtgtccgacatcgtggatcctgcacactctgttaaagatataacagatttatgtgtccagtatattcgagccggatgtcaggacatcgtatccgacatcgtacgagcagttatgcaagtgggatcagcaactttcattatcagagtaatcaagcacagcggtatctgtagtggtaacagcaaaattctgcaagttgcaagtcgtttccaggatgtcaagacatctcacgtgacatcagctttctgctccccctgtctccatgctcctactgctgtgaagcagttcactgcagcatcttctatcagctactag

SEQ ID NO: 19547 - DNA, 672 bp, Glycine max
  Peptide Sequence Number=SeqID_136325
atgagtgccaaatacctcgaagtggtcaaacgagggtcgcatcccaacaaaggatggtccctggacgaaattaggattgtatgtagtacaccaatagtagtacaaagcagaatgattctatttggatcccaactcaagattcaaaatcatcctcccctgcctcatgcaacaatatctcctaaatctgcttttgggtgtgccaattcaacttttgaaacctctaaatctctaagagttttctatgctagtgaaatggagctttcagaggactacacttggagttttctctgcttttggttgattaatatttgtggcagtgggtttcatagtaagtcaagacggggaagcaacattgtagatgattgggatgaaaagcatcacatagttaaagaactgaaggccatgttgatgcagaggaaggaagtttctacaataaagagggacaagaccttatcccaagccttttcccaacaggttttgatcctctttaaatttggaggaatggtaggacatcatcaattggaaatgaagatgagttggaagagagaccaaaatggctacatcggtggatggccacaaagccataggagaatagaggaagggcttcaactgatcaaagagaccccattaagactgtggaaattgacacatctcagccttattcatatctag

SEQ ID NO: 19548 - DNA, 219 bp, Glycine max
  Peptide Sequence Number=SeqID_136326
atgaagaataagaaggttaaagcagctggtgtctcgctaagcgaggcatatgcgctaagcgagtttcggaagaaagcaataaaggaatacgtgagagacgcaacagaggaaaaacaaggcaagaaagcaccaaagatctcagctttcaagaagattctatgttttagagtgatttctaggttcctagaggctaaagctcttgttgggaaattctgctga

SEQ ID NO: 19549 - DNA, 159 bp, Glycine max
  Peptide Sequence Number=SeqID_136327
atgcctctgccttcagcttcgagtcagatcactgcccagggcagaaaatgtgcaagatctatgtcgcatcgattcttcactgtgacggatgaggcttcatgggtgggccctttcattggtgatgagtgtgtggatggtgagggagggtggattaaataa

SEQ ID NO: 19550 - DNA, 1191 bp, Glycine max
  Peptide Sequence Number=SeqID_136328
atgaggcttaactgccttgggcagtttctcttgtgcaaactttttatcactctccatcatctgcattctcgcactccctgcactgtgctcacatttcttcctctgcttattttgcttcctttgcctcattacttagcaatccaagagccttacgacactaccatatttatttctgaggctgcctgggagatgcattcccagaatgttcactcccggaacatccttccggagaggaacgtcactctttatgtcacagaatatgatgagttccgccgggagctcgagaggcgaggctggcataaagccttgaccaggcagatggatgggcacatagatatagccctggtcaaggagttttatgcgaatttgtatgatcctgaagaaaaatcccccaggcaggtcagagtgtgggggaagctgatcaactttgatgccacctctcttaatgccttcctggagatgccatcagttcttcagctaggggagcagggcgccctagaagctcctgaggaaggagttgactactctggcgcagacctggagtgtcctgcctattctaacctcgcccccacctttcacacgcccgatctgaatatggatcgggcgaggccagatctcacagatggcccagtcaaactcctctcggctcggcttcccagccctcatcaccgccttgtgtgtggccagaggagtcatatccgactccctcaccttcgagtctctcaaccctggacctacaaggctcgagctcgaggatttgagggcccttcttcttctgctccccctgctcctgcttctacttctactccttttgcaccagctccatcagcagctccagcttcagttcctacacctgccagcacctccgctcagagctcagatcttacaagtgttcataacctggctcagcatcgacccatcatcagtatggaagagtttacatcccaggtggcttggctaggagtccagccttctcctttgggggaaggtgaggcttctacaacccatgagcctcagccacagttggaggttactccagaggtcacactagaggccactccacgaacttcaccggttactacaccacttgtggaggtcgctgatgaggaggatggcgctacagacacagattatgcaactgacatggcagcagcacagagcacctgggacccctggcccacaacagcttag

SEQ ID NO: 19551 - DNA, 348 bp, Glycine max
  Peptide Sequence Number=SeqID_136329
atgacgattctaaaaatcaaggagaagaagagtgtgtcatcaagaagaagaggcaaaagacgtcaatcgtttgaaatgactttaatgatattgaaatttctggaggtgaaaagaaggtactctaatgagaaaatgaggaaaatcattactattgctattatgatacatgagctgccttttagcattgttgaagatgaagtttggttgttgtctttccgatatgcaaattctgattttcaaaaagtgaaattctacatatcaaatgctatcaactacattgaacttcaagattgtcttttcaacctatgcagaaagagaagcacattatacttatgctccttcaactga

SEQ ID NO: 19552 - DNA, 204 bp, Glycine max
  Peptide Sequence Number=SeqID_136330
atgattttcacctctttttactttgtaactacgcaggcacaaacaagcagcggaaaacagaatgcgagtttgagtattaatgttgtgcctgcgcctgttgagccacatcatgttgacttggcggaagatgtaagggaagaggttttgaaaagaagctttgcagattctccgcgttttgttgaggagtcaatattgccctgctaa

SEQ ID NO: 19553 - DNA, 138 bp, Glycine max
  Peptide Sequence Number=SeqID_136331
atgaacccgcttgccaatcatggagggggagcggttaatgccgtcgagtcgggtaggccgcgcaggcaatccgtgaagttccgcgacatgtcgggagtcgaaaggaagcgtcaatgcgcaatccgtaaagttctgtaa

SEQ ID NO: 19554 - DNA, 981 bp, Glycine max
  Peptide Sequence Number=SeqID_136332
atgagcgtttcacatttcgcggttctatcgtcgtgttgttgtccacgcttggccccttctctgtcgcgtgcttcaacccttcgttctcgcatccggtgttgtactactctcactgctacttcttcagagactcccactccaaccttcgtgaagaaacgagtagtgtcgggggttcagcccacgggctcaattcacctcggaaactattttggcgccatcaagaattgggttgcccttcagaatgtgtatgatacacttttcttcattgtggacctgcacgcggtcagagatgtacaggctatgaagcatggacactggaaatcacatggacacagacaatataacactgtcccaattacattaccatatgacacccaacaattatctaaggctacaaggtcaactgctgctatttacctagcatgtggagtggatccttcaaaggcttcagtatttgtacagtctcatgttcgggcacatgtagaattgatgtggctgctaagttccacaacaccaattggttggctgaacaaaatgatacaatttaaagagaaatctcgcaaggcgggagatgaagaagttggggttgcccttttgacttatcctgttctgatggcttctgatatacttctatatcagtctgattttgtccctgttggtgaagatcaaaagcagcacttggagttgactcgtgacttggctgaacgggttccagagccccttatacctccagccggagcccggataatgtccctaactgatggcctgtccaagatgtcaaagtctgcaccttctgatcaatccagaatcaatattcttgatcctaaagatttgaaagaaactttagaggttaaccagtacagtgacttgagatgcaaaggactgaggcagtatgctggctatgatgattggtggggttgtgcttggctcagtggagatgtggttctgactatacagatctgtttattcttggtttcatag

SEQ ID NO: 19555 - DNA, 870 bp, Glycine max
  Peptide Sequence Number=SeqID_136333
atggagagggagagattgcaaatccaggtcattcgccagctcgatctcgaggacctcgaagtcgaagaagtcgatcactccgacgaagacgacaccgacgacgaacccgacgaggagtatgcgcttttcccttcgcaatacaattcggatacttctcctcctcctccctcatccgccgaattcaatttcgatacctatattgcgccttcgcacacctatctcggtgatgtcgaagacacgcgccacaggattgctttcttggacggtggagccatattgaaccttccactcttttgtctccgaggagttgtactctttcctggggctactcttccccttagagttattgaacctcgtttggtggctgctgttgagagagctttaactcaagatgatattccttataccattggtgtggtagatatgtggaagagaatggttgggatgcctgacatggatagtctcattaagaagcctgacgttttatcatttcacatagccagtaaaatacctgtgtctgagtctacaaggcaggaatttttggatattgatagcattgcatataggctgcgtagggaaattgaattactagagagcattgatcttatccggtgtaaaagctgtgagactataattgcaaaaagaagtgatatgttgatcatgtcaagtgagggtcctcttagtgcatatgtgaattcaggtggttatgtgcatgagataatgactctatacaaggcaaatggtttagctctcactggatcagcagtagcagatcacagttggtttcccggagacattctccacctgttatctaggttttgggagaagaaaggaggtgaaagtgctgttagtttatgttttagttcctga

SEQ ID NO: 19556 - DNA, 321 bp, Glycine max
  Peptide Sequence Number=SeqID_136334
atgataactaaatttctagctttaccaaaaagtagacatgaaaaggggttccttgatgagcaattcattcagttagaggaattgcaagacgatgttaatcccaattttgcggaagaaattgtgacccttttctacagcgactctgtaagactgatctacaacatagaacgagcactgatgagtaaccctccgaatttcaccaagctagatggttacatgcttcaattcaagggtagttgctcaagcatcggagcaaagaaggtgaaaaatgaatgtaccagattcagtgaatattgcgcagcagaaaactttgaggggtaa

SEQ ID NO: 19557 - DNA, 1662 bp, Glycine max
  Peptide Sequence Number=SeqID_136335
atgacagaggattactcagttggaaatttggtgggaagggctgattcttacttgaatgaagtggcactcaagactatttcaggggctgtgtcaatcttacacatgtcggaacgcttccttccgattgcagagaaggcaaaactggtgagtagatgcatagatgctattgcattcatagcctccaaggagactcaattctgttcacctatgagaggtgacattattggtactgatggcatggcttctcaccaaaggccagtggttcattggtgggctgaggatctcacagttctcagaattgacatctttcaaagagttctgattgcaatgatggccagagggtttaaacagtttgctcttggccccatcattatgctctatgcacagaaatctctgcgaggtttggagatatttggaaagggtaggaagaagattgaagttgaagcacaagaagagcatgaaaagagggttgttttagagacactagtgagccttctgccaagggagaagaatgcaatgtcagtgagctttctttctatgttgctaagggcagcaatatatcttgagacaacggttgcttgcagacttgatttggaaaagaggatggccctgcagttaggacaagctgttttagatgatcttctaattccttcttattctttcactggggacacattgtttgatgtagatacggtgcagcgaatcatgatgaatttcctacaatctgaaaaggaagatcgttcaccatataatgcagatgatgaatgtttttctcctccccaaagtgatgtttatagggttggaaagttgatggagaactaccttgctgagatagccacagacagaaatttagctgtttcaaaattcatcactgtcgctgaactaattcctgaacaatcaagaccaacagaagatgggatgtatagagccatagacatctatcttaaggaactacaaccacgttttagtattttgcaaaacaacgttagatttctgtcttctacaatgcacatacactcaggcttcaccacatttgaattagctttagattttgatttcatctcagttgatttgccagggttatctaacttaacccaagtaaaaactggattaaacaaccccaaggctcatcctgttctaagcgacatggagaaaaagaaagtgtgcagcgtgatggactgccagaagttatcacgagaggcgtgtgcacatgctgctcaaaatgacaggcttccagttcaaatggttgttcaagttctctactacgaacagcaacgtcttcgcgattccatggatggcaatgcaggctgggattctcctaacttccgcgacaaggtaaattcatctcccaacgagcttaatctggtgtccaacgagctctccatcttgcgaagagaaaacgaagacctgaaactagagatagtgaaattgaaaatgaaactaaaagagattgagagaacttccattagatcagcatcaagtagtcctgtgatatttgcttcgccctccgctgataagcctcctctgcctagaaaatcattcataaactctgtgtccaaaaagcttggtcgtctttctcctttttcacgtggcaatgctgccacaactcttctcaaaggtcacgtaaaacccgataagaatcgacgccattccatatcctaa

SEQ ID NO: 19558 - DNA, 627 bp, Glycine max
  Peptide Sequence Number=SeqID_136336
atggagaagcttgtaaggtcctgtgacaaagaatatatgaggatggccatgttaaaacacgaagaaactttcaaagagcaggtatatgagcttcatcgtttgtaccaaattcagaagatactgatgcaaaacatggatgccagaagaggaattgaagtgaccaaagaagaatggtacttcaagaatgcgatcggtttaacttgcaaaggggcacaagaaaagcctcaaatgaaaatcgacctcgaaaggcctgcagaggagcacattgcagaatcagaagatggggtgctagaggtcatagatgagactgagattgagctgacattagccccctcaagttacaaccgtaggaagaaagtcgagacaccgctaacttcagattcaggacacagcttgtcttcttcttctagtggatccagccatgtaaacaagacaagatgtcatggcactcacacaacaagagaaaactcaagtggaagcataattcgcctcgtcgaggtgccgggttctaccccagcataccaaagtggaattagaaacagttttgatattgaagaacaattaagacaagagagattaaaacagtcaccttggcttttccaagtgttgaatctgaacatgacttga

SEQ ID NO: 19559 - DNA, 965 bp, Glycine max
  Peptide Sequence Number=SeqID_136337
tagcagcagcaggagcaatgagttctggttcagtcaccaaagcaccaccaccctcttcttcttcatcacccaactcttcctctgagtcccttgatggcttgaagtttggccagaaaatctactttgaggatgtgagtgttgcagcaacaacaacaactcaaggggcctacaaaacaagtcgtgtggtttcttccccttcttctgcttcaaagaagggaaggggtggttctttgcaacctcctaggtgtcaggttgagggctgcaaagtagatctgagtggtgctaaggcttactattctaggcacaaagtttgtaccatgcactccaagttccctactgttattgttgctgataacagtggccgagccggtggctttctgatggaatttgcttcatacccaaaggttacattgcgaaatacactgccaacacaaagatcagccgagccggctctcggtaaccatgctgcaacacttacctggcaaggaagctcagacacaccatctgaatttttcctgcaagaatcagggagtggtggaacaagcttccttggttccaaacatcccttactggaaagttacactggagtgactgactcaaactgtgctctctctcttctgtcaagacaaacctggggttccagaaacacagccccagcaacaagtgttgagctgaacaacaacttgttgaatttcaatgggacatccatgacacaattttccgcggcttcttcacaaactgcagccatccatcaacttccaaatgccacctcatggttgtacctaaagggagttggttctggtgattgttcgcctgagggtgtccccgatcttggtctaggtcaaatttcgccgcctcttgatagccatcttcatggtgagcttaatgtgtcacagcagggcaggaggcattacatggatctaggggaatccagggcatgtgagtcttctcactggtctctttga

SEQ ID NO: 19560 - DNA, 204 bp, Glycine max
  Peptide Sequence Number=SeqID_136338
atggatcacctaagggttaacgagtggcgtaacatccctaactttttacttctttgcggctctcacactatgacacttcatgcggtgacacttcactcaacatccttgctggtcagaatccttcactgtgttagaccttgtggcctcaataatcttaagagggataggcttagaatgcagaagaagcaacaacaatcaatttaa

SEQ ID NO: 19561 - DNA, 156 bp, Glycine max
  Peptide Sequence Number=SeqID_136339
atgaagagagcaagtgaatgggcttactctcatgagattctaagtgatgtcaccgttcaagttggcgaagtttccttttcgttacataaggatcattcaatggagagtaacgatttctatttcttggcaattgtcaagcaactgttacttgcttaa

SEQ ID NO: 19562 - DNA, 207 bp, Glycine max
  Peptide Sequence Number=SeqID_136340
atgacatatgaccgtttagcgccagaagagccagtgttgacagggtggattgctggacttttcattctcaccgatactgtagttttgtctctcatttgtgctattctattcaaccttataattacaaccaaaaagtatcaaaatgataatgataaagataaacattccaccaccactagtgcagttcaccaaagtcggattcaatga

SEQ ID NO: 19563 - DNA, 870 bp, Glycine max
  Peptide Sequence Number=SeqID_136341
atggttagcactcgatttggcatcagaagcgagacccctcttgcagactcacatcctcatccggcaactatgatagacgcacacactctacaacaactccaaaaccgcaatgcggagatggagcaatgccatgaggaagagttgacaaagctagaggctcatgtcagatgtcctaggggcgacgagcaatccgcccacaccttggctaaatgcacccaaggggaatcacaccccagacacacaggcaacactgcagacgacctaagtccctcctacatgcaccatcaagcaacatggactgttcgttggcatccttttatcaaccatattatggaggtagacatacctttggggtggaagccactcaacctcgagcggtacgatgggacaatagatccatacgagcatttggatgccttcctgacacaggcgaacctttacaccaacgatgatgcaattctatgttgtgtcttcctttcatctctcaagggagcaacattaacctggtatggtggactcccacctaggtccataggcagctttgacaccctcgtcgaactattcaatgcgcagtacgccactagcaggtctcaccgcatgacctcatccaccttggccaatctgcgacaagcaaacaatgagtccctccaaaagttcatggacagatttaggtgcacgaccctccagatccaaaatctaaatctcgaggtagcgttacattccatgctcctcgccttacctggaaagttcgtacacaatctgtgcagaaaaccacccggtagcatgggcgaactgttcgaacgagccaagagctacatccagatggaacaaatgtcccaatttctgagtgaagtccgccaaaccgaatag

SEQ ID NO: 19564 - DNA, 231 bp, Glycine max
  Peptide Sequence Number=SeqID_136342
atgccacagaaacagcatgttgaagctaatagccctggtggttccaaatatattgacggaataatagaaaactctggacaagctacgaaagaaagtgctttccaaatcgaaatgaaagaagatgaaaaacaaagcaagaagtttgctcccaaagggaatgacaaggcaccccttggggcatggaattggagtgttatcatagttgggatatcaatctctacttttccttga

SEQ ID NO: 19565 - DNA, 1167 bp, Glycine max
  Peptide Sequence Number=SeqID_136343
atggtatcgaatcccaagtctcacttccactctaatgttcatacctcaccaatggaactctcttcttccttcacacactcccacaacttgttctctttctcatcatccctcactcccactcttcgacgtcaaaccctccgcgtctccgcagtaaccatagacccaccgcaagagcttcccaagaacagcccccagcgtctccttaaggagctcgccgagcgcaagcgcccctccccgcgaaccccacgcgctcccccgcgaagattcatcctcacgcgcccgctagacgacaaaagagtcgcggacaggttcctcaacagcccccagctggcgctcaacacgtttcccttgctaagctcctgcctccccttctcccctctggatcacctggacaagtcatggatggagaatcacttgatggaagccaagcaggcgctggggtaccctctggagccctccctcaccctcggggacgatagcggccccgccatggagctggacacgctgctctacttggcgtttcagcatgaatcgtgtgagcggagccgggcgcggcacgtgcgcttcggccactccaggctgttttttcttggccagtatgtgctggagctggctttggcggagtattttttgcagaggtatccgagggagtcgccggcgccgatgagggagcgggtgttcgagttgattgggaagaggagcctgcccaggtggattaagggtgctgctttgcacaatttggttttcccctatgatgatatggacaagttggttagaaaggaaagggaggctactgtaaagtctgtattttgggccttgtttggggcaatctatctttgttttggtatgccagaagtgtatcgtgttctttttgaagtctttggaatggatccagatgctgaggattgccagcccaaattgcgtaggcaacttgaagatatagatcatcctcctgcagatgccttgtttgcacatccacggctgttcagagcttgtgttcctccaggcatgcatcggtttagaggaaatttatgggattatgattgcagaccccagattatgcgagtccttggatatccattaaaaatgacagatagaattcccgaaattactaaagccaggaacatagagcttgatcttgggttgcaggctatcacattgacttga

SEQ ID NO: 19566 - DNA, 495 bp, Glycine max
  Peptide Sequence Number=SeqID_136344
atgaagtcagtagatcagcttggatgttccctagctcctgttctgttctgttctgagtttgatgctatcgaatttcttgttgattttcagctatgtttcttgcatccgtcaaagtacaaatttgatcatcctcgattttgctatgagagattagaataccttggccaaaagatacaggatttggtaatggctgaaagattgttgatgaaacatttagatgctccagggctatggttacaaaataggcaccgcaggtttcttatgaacaagtattgtggaagatatttgagggccaaaaatctccaccattttattatatataacgaaaaggttcaagatgcatatcagcgcgcctatagactgaaatacccagtcactacatctgttcaacaggcccttcacggactttcatatgctgtttatgggaaacgtgatgtcagacgtctgatgtttgaggtctttgactttgagcaaacccagcctgaagcaatgtaa

SEQ ID NO: 19567 - DNA, 870 bp, Glycine max
  Peptide Sequence Number=SeqID_136345
atgccaccgaatagcggtggcatggcgggttgcgaatggcggcgccatggcggtcatgacggttatggcggcatggcggaaaatagcggatttttaggttttattttcgcggtaggagttgggttgacccgacccaaccctacccgctattttgttcaaaagcgcagccctaccacgatggacagcacagaacgcagcccctcccacgcgacccagccacgaccccgcacccagccgcaaccccgcagcgacgaccccgtgttccccccgcacgacccagcaacgacaactcgacgagcaccagcgcaccatgcacacggcgaacggcgacggcgacggcgacggcaacggtgctacagtctgcaaaggacagcaacgtgttcttgtgagatttttgtcttaccttctgagatcttcaacatcattttgcagattaaaagagagataaaaatacttcagaacctttgtggtggcccaaatattgtcaagcttcttgatattgtcagagatcagcactctaaaactcctagcttaatatttgagtatgtcaacagtacagattttaaagttttgtatccaaccttgactgattatgacatacgctattacatatatgagcttcttaaggccatagattactgccattctcaaggcataatgcatagagatgtcaagcctcataatgttatgatagatcatgaattacggaaactccgcttgatagattggggtcttgctgaattttatcatcctggaaaggaatacaatgggatgatggaggtgctagcctatggtggtggtcatagtgatagcgacaatgatggtagtggaaaccaatggtggttgtggcagcagcagcagtgcggatga

SEQ ID NO: 19568 - DNA, 664 bp, Glycine max
  Peptide Sequence Number=SeqID_136346
gggggcggagcctatggaaaacgccagcaacgcggcctttgtacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttgattacaatgaatttagagtgcttgtctttaagtgtaaatgggttgatggaaataccgttgtgcatcaagatgaattgggatttactttagtagaccttaataaggtagattacatggatgaagctttcattatggcagaacaagccagacaggtgttttacgtccaagatccatttgattcaagattgtcagtggttttacaaggaagaacaagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19569 - DNA, 192 bp, Glycine max
  Peptide Sequence Number=SeqID_136347
atgggaggaggcaatgcccagaagtcaaagatggctcgcgagaagaatctcgagaagcagaaagcagcggctaaggggagccagttggattcaaacaagaaagctatgtctattcagtgtaaggtgtgcatgcaaacatttatatgcaccacatcagaagtgaagtgggtagtgagagacgagaggggataa

SEQ ID NO: 19570 - DNA, 264 bp, Glycine max
  Peptide Sequence Number=SeqID_136348
atggaaaatcattcatggtgttatgcagcttgcatccagtgtaacaagaaaactaatatagacaatactcccttcacatgtgcatgcggcaaatataatcaacaagctatgttgaggtataggcttgaggtcatggtttaccacaaggaagaatgcacaaaatttttgctctcaaaccgtgaatgcacagacctaattggtcagtcagttgatgaagttaataggttaaagatagcaggaatacatatggaagctacaggctga

SEQ ID NO: 19571 - DNA, 460 bp, Glycine max
  Peptide Sequence Number=SeqID_136349
atgggagttttagtgtttaatgggtttcgaaatgagacttttcatttttgtgcaatgcttttttgtaccattaatgactttctaggatatgagaatttgagcggttacagtgttaagggccatcgtgcatgctccatctgtgaaaaagacacaagctacatacaacttaaacatggtcttccagcgggttcaacaactgaatactatatttggaaagacccaaaagaaggaaaaaataagagttgcatatggaagaaaaggtcaattttgtttgaccttccgtactgggttgatctagatgttaaacattgtattgatgttatgtatgtggagaaaaatgtatgtgatggtgtcattgggatgctccttaacattcaaggcaagacgaaagatgctttgattacacgtcaagatctagctaagatgggtatacgagcgtcattacatccaatgtctgatg

SEQ ID NO: 19572 - DNA, 207 bp, Glycine max
  Peptide Sequence Number=SeqID_136350
atgacttttgtcatcccaatcaaacagatcaaatgcttgcaaattatgatggtttgggaaatcaacatgaagatcctgagaatgggttggacattgaccccccaaccttattaccctgacttttccaatcattttacgattaataaggttgtgaaaacagaggaagttagaagaaaaacaaagatagttagtttgaaagagcactga

SEQ ID NO: 19573 - DNA, 267 bp, Glycine max
  Peptide Sequence Number=SeqID_136351
atgacggaagggtgtgatgaagggttttgccttgcaaaccttcccggtgatgcttttagtccatggggaaacttctttgaggcaaagaaacaaatgatggctgatgccaaggtcggcggtgctgggttatggccccgtgcgaagtttcggattggttggccccctcctcccccccgtgatcagttttgccaggattttgccaactttggcttgcgctgcgccccgttggctaagtctgtgcctcagtggtggatcatcatgtcataa

SEQ ID NO: 19574 - DNA, 270 bp, Glycine max
  Peptide Sequence Number=SeqID_136352
atgcagatggcgtcatttttgctatatttaactgatgttgaggaaggtggggaaactatgtttccatttgagaatggcttgaacatggatggtaactatgggtatgaggactgcattggtttaaaagtaaagccacgccaaggggatggtcttctattttattcattgctcactaatggtacaattgatccgaacatactttgtgtcgaagctataaaacagcaggtttcacagttttacctaagatcatccaacagtcatcatggttaa

SEQ ID NO: 19575 - DNA, 512 bp, Glycine max
  Peptide Sequence Number=SeqID_136353
atgaaagccaaaacggtgaaaggaaattggagcttgaggacgaacaagctcagcttcccttacgtcttcctcgtctgcatcttcttcttcctcgctggattcttcggtttcactctcttctctcactctcaggtctttcttctaagttttaattacttcgctgtttcagattttcttgttttttgttttttgctggaaaatattgatataatatcgatcgctgagaattcgcagggcgatggagatggcttgaggccgaggcagaggctgcttgaaccggggaacgaggcggagtacaatttgatgcctgttagagatcttggcgatgattccattacatcgattccttttcaggttttgagctggagacctcgagcactatattttcctaattttgcaactgcagaacaatgtgaaaacattattgatgtggcaaaggatggcctcaaaccatcaaccttggcgttacgccagggagaaacagaggagaataccaagggaattagaacaag

SEQ ID NO: 19576 - DNA, 306 bp, Glycine max
  Peptide Sequence Number=SeqID_136354
atggtggtgagcttgttcttgactcatctttttcttgaagtggcgtctcaatcacctttcctccttctccatttcgctgccattgatcttcaagtagcaaagactccattgatgaagaagatccaaggcctacaagctctacatggaactacatcatgtaagaccatgagagggccaccttttgatggtcattgcatttgtaggagatgggtgactcactccatacacccttttgtttttcagaggaacatgagcgatttgatgccaacaatgaagatcaaatggaaaaactgcgccgagcactaa

SEQ ID NO: 19577 - DNA, 219 bp, Glycine max
  Peptide Sequence Number=SeqID_136355
atggatgtgtatcgccatgtatgttggcgacacatacaggcggtgacaggtggaatgggtgtcaccagtggaagctgcgaaatggcagagtggccatctcgccaaagccaggagcgaaacatgtgcgggtacaaggttgaaagttatgtgcagggccatttcgccaaagccaagagcgaaacatgtgcgggtacaagctttcttttcttccactggtaa

SEQ ID NO: 19578 - DNA, 114 bp, Glycine max
  Peptide Sequence Number=SeqID_136356
atggcagtgctctcctgcaaaggaggttgcatggaatctcctgtcattatttacagcatctgctcacaaaatcatcaaccagagtattggcaattttgcagagaaggaaagtag

SEQ ID NO: 19579 - DNA, 372 bp, Glycine max
  Peptide Sequence Number=SeqID_136357
aaaaactgttggaaccttgatgacccctcgatcacttttcggggaccccgaaagacaaggggcaagaggtctgaggctccttcatcctatgctctcccaatctatgctccttccacatctacactagcttcattgactcccgcactagcttcagctcccactccttcaggaccttccacaagccttcataaaggtcagatcatcatcatgcagagcctacagagctcaggtctgcagcctatcatgagcatggacgagttcattagtcaggtggcttggccaggagttcagccttctcctttgggagggagtgaggccttcgcaacccaagagcctgtgccagaggaggatgagcccatccctcctgagtga

SEQ ID NO: 19580 - DNA, 1086 bp, Glycine max
  Peptide Sequence Number=SeqID_136358
atgatccttagaaaagtcaaggatacaggattttgtcagtatattgacgggcctgatcaatctgtatcaagtaagattgttcgacgcctgacaattgcaaccgatgattttagtggaagtataggaagctcacccattcggtcaattcttatcatgacaggaaagtatgaaaaattatctcaagacttggtaaacaaattccctacaaattacatggtactgaaggtacttgattttgaaggttctggtttacgttatgttcctgaaaatttggggaatttatgctacttgaagtatttaagcttccggtatacatggataacaagtctaccaaaatccattggcaagctccagaatttggagaccttggatataagagacacaagggtgtctaagatgccagaggagattcgtaagcttactaagctacgtcagcttctgtcttattatacgggtttaattcaatggaaggatattggaggcatgacatccctacaagagatacctccagtgattatagatgatgatggagtggtcattggagagatgccactcttggagaaactacatatttatacagctgattggagtgaagtaattgacttgtacattacgtcacctatgtctacacttaggcagcttgtcctatgggggacgttaacaaggttgccaaattggattttacagttcccaaatcttgtgcaactgtctttggtgggctccaagttgactaatgatgcattcaattcactaaaaaatatgccaaggttgttgttcctggatttaagttacaatgcttatgaaggtgaaactttgaattttcaaggtggagggtttcagaaactaaagcgactgcaactcagatatttggatcaattgaagtgcatccttatcgacagaggagcactgtgttctgtggaagaaattgttttacaagacctctcccaactcaaaacagttccctcgggaattcaacacttggagaagcttaaagatctctatatcaactacatgccaactgaattggtgcagcgcattgctcctgatggaggagaagaccactggatcatccaagatttgccccat

SEQ ID NO: 19581 - DNA, 165 bp, Glycine max
  Peptide Sequence Number=SeqID_136359
atggactttaccttctcatcaatgaacttgacccataaacgagctaaggctcttcaagcaaagatggggttcccttttcaaagttggctcttgtgctccaaattatcttcaaggatattggacacccttcaatttcagtgcaaggtgcaccctggaaacaaatga

SEQ ID NO: 19582 - DNA, 177 bp, Glycine max
  Peptide Sequence Number=SeqID_136360
atgggtgagaaagaagtctacccaaacctgaaatttcgaagtcccacacgtagagatgcgtttcatgactccgaaaatgccctcctttcgcgatttggagcagaaatggtcaccaaaggttggagctttgttggacaacaatggtggatgagagaaaagaagaagaaagctgtgtga

SEQ ID NO: 19583 - DNA, 231 bp, Glycine max
  Peptide Sequence Number=SeqID_136361
atggccaaagcgccagtgcaggtggcgataccactggtgtcgccagtggcagaagcgacacagccacgtgtcacgtgcgagcgggacgtgccaatcatgctggcgttttgcatgaaatttccatgcagggcggcgacaggtggaatgggtgtcgccagtggaagctgcgaaatggcagagtgtatgtcgccagtcaaactggcgacactgtgcagagctgtagcgaaatag

SEQ ID NO: 19584 - DNA, 375 bp, Glycine max
  Peptide Sequence Number=SeqID_136362
atgtctgagtggaatttctcattcgttgttgagcttccaaactccatgttcaccttcattcatcccgtacaatccatcattgaagaggtgaattttgatgatgaggcccctgttgttgttgctaatgtggccatggaaggtagggctcatgctaaaattgaagccaaaagatggaaaatccttggagagcacctttttaagaagtatgttgatgctttcttggatagttcatctgataatgaatctcggataagttcttttgcaagcttgaagaggaagaagaagctgccaaacagaaggggaagaagaagtaaaaagatgaagaatgcagccatagtaaaagatgcacaagctaagggggagtgcattatctgg

SEQ ID NO: 19585 - DNA, 360 bp, Glycine max
  Peptide Sequence Number=SeqID_136363
atggtggcgttggagggggactacggtgcgagggagcggattgagatgacactagattgggagtcacgggtgaggttcatggagtcaaagttgtcgatggtgctatcattgagtgggggagggagcggaggtcggaccaggagaggaactagagaggacgtggtagcaaaggatgtcagcaagggtggccagggagaggtggtcgttggcggcaaggtaggcattgtgggcagcgagaatggagagagaggagcagtccaaaagatccgtggcgaggggcgtggcggaggcaaggagggaggtgatttgggagagcttcgacacgatggagaggaggaaggtgatttgggagagctctaa

SEQ ID NO: 19586 - DNA, 357 bp, Glycine max
  Peptide Sequence Number=SeqID_136364
atgggtccacgatatacatggttcaggattattatgtgtaatatatcattaccagcattaattcctgaccattttcatgtctcatcctctaatattttactaatagattcaattggggaatacattttgcgaggagcattagcagttgttttgtcagatgcgatatttgataaagatgcaattgcacaacatgatttagataagatacaaaaacttgcacattctgctgccttggaacaaatcaatttggttgaagtcaagtatccactggaactctttaaggatgctttgcctgttcaatttgattatgctgaatctaatggtgtttcatcatatgcatacagtcttatgtcttaa

SEQ ID NO: 19587 - DNA, 489 bp, Glycine max
  Peptide Sequence Number=SeqID_136365
atgcatcgtgatgtgaaaccacataatgtaatgattgatcatgagcagcgtaagcttcgccttatagattgggggcttgcagagttctatcatcctgggaaagaatataatgttcgcgtggcatcaagatacttcttgagcaatgtgtccaagccccatgaatacaaaattttaagttacatgatattccgtaaggagccattcttttatggacatgataactatgatcaactggtcaaaatagctaaggtacttgggacagacggattaagtgcatatttagataagtatcgaatagagttggacccacatcttgcagcacttatcgggaggcatagccgcaagccatgggcaaagttcattaatgtagaaaatcatcacatggctgttcctgaggctgttgactttgttgacaagttattacgctatgatcaccaagaacgtcccacagcaaaagaagccatggcttctgatgtgatttcgctttga

SEQ ID NO: 19588 - DNA, 321 bp, Glycine max
  Peptide Sequence Number=SeqID_136366
atggtggtgacaactaattgtggtggtaatggtggtggtggtggtagtagcgacgatgttagtattggtggtgacaaagatggtattagtgatggtgacaacgatgacggtgataacagtaatgtcgatagtgtcgatggtaatggcgatgatagtggtggtagtagtgttggtggtattagtattagttgtggtgatgacaataacaatactagtgggggtggtgatggtgataacggcattgatagtagtgatgataatgatggtggtgatgatgatggtaacgatgacagcaataaaaagtgtgatcatcaaatgtga

SEQ ID NO: 19589 - DNA, 1443 bp, Glycine max
  Peptide Sequence Number=SeqID_136367
atggtctacttaacagggatttcccaacatgcagtttcagaagaaggctcacctctctttcattcactggaaaaatggaacccgagagtgcgagtgggagatagactaacctgggtttacgtttggggagttcctcttcaagcgtggagttcgaaacacttgcggaagatcacggcggccgtgggggagttcgtcgacatggacgacgaggcggaggatagacggcgactagatcgagcccgggtgcttattaagacttcgtggatgccgcaaatacaacataccatcgatgtcgccattggtgaggagacttttaaggtgaccgtaacggaggaatgcgggggcggtgatcgtagcaagtatggctcgaatacgagcgtggggggatcatcggaggaaattgactccgacgagtcctaccttgatggcaccaatttggttgctgcgaggctgaacaatctcgaaaccacgctggagaacctgccggagtttgtgcctctcgaagaccacggggttcttgctttacccagcggccaatatactagcgaagacccactgggtaatgaagaggataggacctgttgtagcgcttttgaccaccagatacatggcaaaaggatggatatcccagaaaaggctccaacggtcactgacaaaggccacagagcagagaacagcaggcactatcagggtaaaggctcccctatcataagtgtagagcctcagaatgttaacaaaaatggtaatggagacaggggggagggaagagaagttagtagccttggggatggggtccatgagttacgaatagatgacatctggtcaccacatggctgtaattccactaattgtcaagctgttgattttttggtgaatgggtcatgcttgggacagaactgcggggcttttaaaggcccaactaacggattgggcctcagtgaaggaaacaatcaatttatacagcacacctccaaagaatttgatggtaacacgggccttttttcacagaataataaagctataacagaaagtgggtgggtggtgtattctagaaaaaggaggggtaaaaagaaattcatggtgggtcagcctgtgcctttacctacgtctgaaatcactcaacctaacctactggatcaagacacacaacaaggtgtgctgcagaagaaattacagtgctctcaacaaggggttcagacctatgaggcagatttcgtggactcaagtcatgacagtgatgtaaatcaaaacaatgaagagggagggaccaatccagagccccataatcagcaataccaacaggctttggatatatggtgcaaggcaaggcaattgggagtctcaggaatggaggaccagcaagtaatcattgatcaattgatgaagatggaagaaagagatggtctagaggcacagaagaggggtgtcagcactatgctttaa

SEQ ID NO: 19590 - DNA, 741 bp, Glycine max
  Peptide Sequence Number=SeqID_136368
atgtccaatattaaagctttcacaagtgaaattcaagctttggcaaaaattcgacatcgtaacattgtgaagttatatggcttttgttctcattcacgagtctcatttttggtgtatgagttcttggaaaagggaagcatgaataagattttaaaagatgatgaacaagcaattgcatttaattggaataggaggatgaatgccataaaagatgtagcaaatgcattgtgctatatgcatcatgattgttctcctccaattgttcatcgagatatatcaagcaaaaatgttcttttggatttggaatatgtggctcatgtctcagattttggaacagccaagcttcttaatcctgattcaaccaattggacctcacttgctggcacttttggatatgctgctccagaacttgcatacacaatggaagtgaatgataaaagcgatgtgtatagctttggggtattagcattggaaattgtttttggagagcaccctgtagattttataaattcttcattatggacatcttcatccaatgtcatggacttaacatttgacattccttccttaatgattaagttagaccaacgtctcccttatcctacaaatcttgctgctaaggatatagctttgattgtaaaaatagcaaatgcttgcttggctgaaagtccttctttgcgccctaccatgaagcaagttgccaaggagcttgcaatgtcaaagtcatcttcaatccattaa

SEQ ID NO: 19591 - DNA, 342 bp, Glycine max
  Peptide Sequence Number=SeqID_136369
atgcggaaaagggttgggtgtatgcaggaaaagagaaagcttagtgcgagggacatttctttcatcacagacattatcttgaaaatcccaatggtggagaggaacccattattgattgaggaaggtgattttactttcggttcttttggagttgtcggtggttggttttgtagtgttgcagaaatgaaagattctactatgaagaatttggccatcacggagaagaaggtgcagcaacataagcctggtgattatgttggcattttctttcagctcattgattggaagaggaaactttacaagaagaagctcttctcgaagaagctttttcctcccggttag

SEQ ID NO: 19592 - DNA, 327 bp, Glycine max
  Peptide Sequence Number=SeqID_136370
atgtgggataactcttgctataatcgatgtttcctttgcacaagaagtgaatggccaattttggattgcccaaagaggatgaagatagcaattggctccacaaggggcctgacatatctccatgatggctaccaaacactgcttcctcaaaacaaaatacccaacaatggaattcagcacacccacatgagttataatatgagagataaaatagaaacaatgaaaagtgagaaaaagggaacttacagagaggcaggaggaagaggaagaggtggggcatggtgcagaaaaggaaaagaagcattcatggagagaacaaaaaggtga

SEQ ID NO: 19593 - DNA, 288 bp, Glycine max
  Peptide Sequence Number=SeqID_136371
atgaatttgagaaacgtgagtggcatgtttggtttgaaccttcatcatctgaatttaagtgttttcatgttaaaggtggaccagaattggtgtggaaactcatacaaactcaatgattttcggggatgtgataaaaatttgaggtactcgtcattgatggagtatttcaaggaaggaagtgtcatggtagctgaaacctttgatgactatgatgatcaaaggcataaacttataaatgaacgtgatatgttgtgggtgaagaagttttcaattgatggagatgtttag

SEQ ID NO: 19594 - DNA, 1861 bp, Glycine max
  Peptide Sequence Number=SeqID_136372
atggtgttcatatttccaacgtttcattccatgaagctcctatcattttggttgcttctaatagtaatgcggtttggtgcattcattatggccacttctctccttgctactgcatcctctgcctcactcacactacaacacagtgaagcaaatgctttgttgaagtggaaagccagccttgacaaccaaagtcaggctttgttatcttcatggggtggcaatagtccttgcagcaattggcttggaattgcttgtgaccactccaaatctgtctccaacataactcttagaggtattgggttaacgggtacgcttcaaactctcaacttttcatcacttccaaacatcctcattctagatatgagtcataactcattgaatggaagtattcctccccaaattggggttctgtcacaacttactcatcttggtttaggtgtgaataatctctctggaccaattccttccactataggaaacttgacaaagctcaccaaactcagtctgcgctcaaataaactctcagggccaattccttccactattggaaacttgacaaagctcagcacacttgccttattctcaaataagcttagtggaaacattccaatagaattgaacaagcttagcaacctgaaaattttgtctttttcttacaataatttcataggtcctttgcctcacaacatttgcattagtggaaagttgatgaactttactgctaatgataactttttcacgggcccactaccaaagagtttgaagaattgttccagccttgtaaggttgaggcttgatcaaaatcaactgactggaaatatagcagatgattttggtgtctatccaaatttggattatattgacctaagtgaaaataaattgtatggtcatctttcccaaaactggggaaagtgctataaactcacaagccttaaaatctccaataacaatttatctggcagcatccctgtagaactaagccaggcaaccaatttacatgtacttcacctaacttcaaaccatttcacaggaggcattccagaagatttaggtaaattgacctacttgtttgatctctctctcgataacaataatctttcaaggaatgtccctatacaaatagcatcattgaaaaatcttaaaaccttgaaacttggagcaaataatttcattggcttgattccaaatcatcttggcaatttggtcaacttattacacttaaatttgagccaaaataaattcagggcaagtattccatctgagtttggtaaactaaaatatcttcgaagtcttgatcttagcaagaactttctgagtggaacaatagcaccattgcttcgagagttgaaaagcttagaaacattgaatctctctcataataatctttcaggggatctctctagccttgaagagatggtaagcttgatatcagttgatatatcgtacaaccaattacagggttcacttccaaacattccagccttcaataatgcttcaatggaggaattgagaaataataaaggcttgtgtggcaacgtctcaagcttggaaccatgcccaacatcaagtaacagatctccaaataataagactaacaaagtcatattggtattactacccattggtttgggtactttattactattatttgcctttggagtctcatatcatctttttcgaagctcaaacatacaagaacactgtgatgcagaatcaccaagcaaaaatctatttgtgatatggagtttggatggaaaaatggcgtatgagaacatagtcaaagccacagaagagtttgacaataaacatctcatcggggttggaggacaaggtagtgtttataaagcagaaatgcacacag

SEQ ID NO: 19595 - DNA, 225 bp, Glycine max
  Peptide Sequence Number=SeqID_136373
atgactttaagtcctatgaaagataaaggcgaggactttgagtcccatgaaatcataaagcaaaggacgttgagtcctatgaaacaagctagtaccaaagggctcaaccttatgagaaaacaagagattgactctttgagagggcctctcatcctaaacttaaaagataggacattagatatgggaaattggtatataaagagaaatctatgcacttatagctaa

SEQ ID NO: 19596 - DNA, 1161 bp, Glycine max
  Peptide Sequence Number=SeqID_136374
atgccaaccgcaccacaggccagggcaagtaacccgatgccgaactggatcgaccgcctgcgccgctgggcgctgcctgccttggccgcattggccgtggccggctgcgcccgtaccgatccgggcaccaccaccgtacgtttctgggcgatgggccgcgaggcggaggtggtcagcgagctgatccatgagttcgaggccgagaatccggggatcaaggtggatgtgcagaacatcccgtggacggccgcgcacgagaagctgctgaccgcgttcgccgccgacggcctgccggacgtgtgccagctgggcaacacctgggtaccggagttcgccgagcttgatgcgctgacgccgctgcagccgttcgtgcagcgctcggccgtggtcgacccgaaggactacttccaaggcatctgggataccaatgtgatccacggcgagctggtgggcgtgccgtggtatgtcgatacgcgcctgatcttctaccgcaaggatctgctggccaaggccggttacgaccacccgccgcgcacgtggcaggagtgggacgaacagatggcggcgatcaagcgcatgcagggcccgaaccgctatgcggtgctgatgccgatcaacgagttcgagcagcagctgtcgctggcgctgcagcagcccgatccgctgctgcgcgacgatgacacccgcggcaatttcgccagcccggggttccgccgcacgctggccttctacgccaacatgttcgagcagggctgggcgccgaagatgtccgagacgcagatctccaacgtctgggacgagtttttccgtggcttcaatgtgttctacatctccggcccctggaacatccgcgagttcaagaagctgcagcccaaggagctggaagggcagtggggctcggccgcgttgccgggtccggacggtccgggcgccggtattcccggtggcaccagcctggtgatcttccgcaagtcgcagcagaaggaagcctcctggaggctgatcgagttcctgtcgcgcccggaaatccaggcccgcttccattccatcatcggcgaccttccgccgcgtcgaagtacctggaacgctccgtcgctggccaatgatcctctggccgctgcgttccgtgaccagctggagcgggtcaagccgacgccgaag

SEQ ID NO: 19597 - DNA, 744 bp, Glycine max
  Peptide Sequence Number=SeqID_136375
atgcagagccccaaccccaacgatgatgatgatttgtttactctctctctctcttggaatcaaccaacgagagcatcaaactttcctaccctaatcatgcaaccgcaaccgcaaccgcaaaatccattcattaaccctaggttggcaccctacactgcttctaaccacaacaacatgaatgctgctgttgatcgcgtgcaagcaaatgctcctgtaccctcttctttgtcgcgttctcgccgccgcgatggaaggagcgaaaccatcgttccacccttcccctgggccacgaaccggcgcgccacggtccagacccgaaagtacctcttggagaacaagattctgaaaatcaggggggacatggagtgcaggatgtgcaagagaaagtacttgatggttcttgatctggagagcaagttttccgaattgtggagcttcattcagaaggaaaaggagagcatgcatgatagggcacccagcgtttggctgaaacctgtgcttccaagatgctatcactgcggacaagaaaacagcgtccaaccctcccttgcagggactaagaaaaaggccattaattggttgttcttgctgctaggtcaaatgctcggttgctgcactctcaatcatctcaaatatttcctcaagcacaccaaccgtcatcgaactggagccaaggatcgaaatctttattctacctacatgggcctctgccagcagctagttcctgagttcttcagttcttga

SEQ ID NO: 19598 - DNA, 936 bp, Glycine max
  Peptide Sequence Number=SeqID_136376
atgaggaaacctgatctgatggccaacaaggacaaagtgaacaacaacataaagagcaagttgagaaaagggttgtggtcaccagatgaagatgagaggctcataaggtacatgctcacaaatggacaagggtgttggagtgacattgctaggaatgctggtcttcaaaggtgtggcaaaagttgccgtcttcgttggatcaattacttgagacctgacctcaagcgtggtgcattttcgccccaagaggaagatctcatcgttcatttgcactccattcttggcaataggtggtctcagattgcagcacatctccctggccgcacagacaatgagattaagaatttctggaactccacattgaagaaaaggttgaaagcaaacacttctactccctcactaaacaacagcacaggctcatcagagtctaataaggatgttttgagtgggatcatgccctttagtgaacatgacatcatgaccatgtgcatggattcctcttcttccatatcatccatgcaagcaacggttttgcctgaccaatttgaccctttttccatgttggcaaataatcagtgtgacatgactaatgtttcagcagattttcccaacttgactcaaattggcatggtagaggggcatgaagggaattatgggatattggagccaaataaaatggggttaggaagagatttctcccttccttcactagaaagtagaagcattgaaagcaatagtgtcccaattgatgtgaaaagccataacaaccacttcaattatggttccttcaatcacactgataaaattcagggctccaaagtagaggacttaattgagtttggaaatcatggccaaggggaggatttaaaaatgggagagtgggatttggagaatttgatgcaagacataacctcttttcctttccttgagttttaa

SEQ ID NO: 19599 - DNA, 234 bp, Glycine max
  Peptide Sequence Number=SeqID_136377
atgcctccctacgtcgcgcctcctcccctacaagccatgcctcctcgtgctgcgcctccacaaccacatcagtgccacctcgagtccttaaccttgcaggcccgcacgaccgcaccaccctgcattttcttctctcttcattcactatctatcgagttggcgaggagaaatgctaaagaactcaagattagaatgcagatggggatgagaaaggtgaatgtgctctcgcactaa

SEQ ID NO: 19600 - DNA, 381 bp, Glycine max
  Peptide Sequence Number=SeqID_136378
atgacggtgccctcaaattttaggggagcaagtgatgcgaatggcgatggaattaggagttatcaaaagacccatattggactcctttctctcaggcttatgcccagattaacagtcagcaatttttgcgggtatccctatgagttttttgtgattgtttctgcaattgtggattgccatggttatccgtttgacccaactctaatgtcttcattagctgtgtacccttacgaggacccttatgccagaaatggttatggggttggccatcgtacaagtgaagttcatttaggggcacaaagtcaaattgcaaatatgtattttgttggtttccttaaggtggaaagttatatagtgttttgggtggatccatcattttga

SEQ ID NO: 19601 - DNA, 357 bp, Glycine max
  Peptide Sequence Number=SeqID_136379
atggacatgtttgttgattctaaacctagtgaagctttgaataagctgcctccttctccaataaactatgtatgcaattcttttctaagtgcacattcttactctcctaagatgctttatagatgtgaaggtcaatatgaaagtcaaggaaccaggcactattgtgaagatccaaaagtattggctgctcaagctaaggagcagtatgataaggtcaacattgtctggctccatgaggataatatgtatacatgtgatgcatgggtaaggttgcttggaaaaatatgtataaacactattagaaaaaggtgcttttacgataggaattctatgacggttactttagaaccgccttag

SEQ ID NO: 19602 - DNA, 360 bp, Glycine max
  Peptide Sequence Number=SeqID_136380
atggagggaagagatgaggatgtaagagtaggagccaataggtatggagagaggcaaccaataggaacagctgcacagacacaagatgccaaagactacagagaggcaccaccagctccattgtttgagcctagagagttaacatcatggtctttctacagagcaggcatagcagaatttgtggccactttcttgtttctttatgtcactgttttgactgtgatgggtgttgcaaaatctcccagcaagtgctccactgttggtgtccaaggcattgcttggtcatttggtggaatgatctttgcccttgtctattgtactgctgaaatgggaaacacaattcagggagcggtgatttga

SEQ ID NO: 19603 - DNA, 231 bp, Glycine max
  Peptide Sequence Number=SeqID_136381
atgatgcaagggaaaaccaatcaagggatgggcacgagcttggagggcacaagggttccacaagcttgcaaaaagatagagaagacgacgcaacacaatcaagggaatgagggtgcacaacacaacagagaaaagaaggcaatgggatatgccaagagttatgaaaagaaatattttatagttgcactcttttgccttcatctgattactacaaaggtagatcgatcttag

SEQ ID NO: 19604 - DNA, 252 bp, Glycine max
  Peptide Sequence Number=SeqID_136382
atgcaatcccaacaaccacattcagttaagccaaatgtagctttttccgatgcccgtgtgagcacaaaggaaaactatgttgatgcttcgaggctagatccagacactgatatcttagataggtgtgggttgtatgttgatgtcattcctccccatctagttgcctttgggagagtttatgaggggtcatcaatcgtaccccacatgcctttggccaatgatatggtgaatgtgggtgttgaagaagtttga

SEQ ID NO: 19605 - DNA, 228 bp, Glycine max
  Peptide Sequence Number=SeqID_136383
atggtttgcaaatcaatctcagagtcatcatcagattctgaggcaacatctgtccaagttttccttggaagtttggtggatgacccagcctgggttggtgacccagataaagaagaactctttttgacggttggctctagtagagtcaacttaaatccttttcatgtgctccatcctccccttaaggaggtgtttgatgccttaggtggcatgagaacttgtctataa

SEQ ID NO: 19606 - DNA, 231 bp, Glycine max
  Peptide Sequence Number=SeqID_136384
atgtggaagccacagaagttcaagtacatatacttgctggccactttgtatgttttcactctaacgattccttctgctgctgccgtttactgggcttttggtgatgaacttctcaatcattccaatgcattctctctcctccccaaaaatcgatttcgtgatgctgctgtaatcctcatgctcattcaccaggagtattttagaaatgacataacaccatgggaaccatga

SEQ ID NO: 19607 - DNA, 783 bp, Glycine max
  Peptide Sequence Number=SeqID_136385
atggaaacaatgttgcctcagaaccaagcagaggaagcaatagtcacaacaagccttaacgagacagagagtgaagttggtatgagggaagaagagaaggagttgcaacaacaagaccactccatgttcaacatcaagagcttcctctggcatggaggctctgtttgggacgcatggttcagctgtgcttcaaatcaagtggctcaagtgcttttgacactgccctattctttctctcaactgggcatgctatcaggaatcttgcttcagattttctatggaatcttgggaagttggacagcgtatctaatcagtgtcctctacatggagtaccgtaccagaaaggaaaaagaaaatgtcagtttcaagaaccatgtcattcagtggtttgaagtgcttgatgggttgctgggtccgtattggaaagcagtgggcttagccttcaactgtactttcctcctctttggatctgtgattcagcttatagcatgtgcaagtaacatctactacataaatgaccacttggataaacgaacttggacttatatctttggagcttgctgtgccacctctgtgttcataccctcctttcacaattaccgtatttggtcttttctgggacttggaatgaccacttacactgcttggtacttggctattgcagctcttattcatggccaggcagaaaatgtgacacacacgggtccaacgaagctagtgctgtactttacaggagccaccaacatactgtacacgtttggtggacatgcagttactgtgtaa

SEQ ID NO: 19608 - DNA, 507 bp, Glycine max
  Peptide Sequence Number=SeqID_136386
atggggacgagggtttgtataaattataatcccgtccttgccataagacaacttggctaccccatgagagggtcgccatcggaagaaagtaccacgcccttcatcacacggggtttcagtgaccccaatgcaaggatatttcaaagggtccgaaaggcatggagtgcggtgcaaagaaaggataaggaatttaggggaagcagcaatgggatagttggcggatatcacaagtggctgaaggctcgaacacaagagttagattggctcccgaagctgaaggtctcaagtgaggaagaggctgaaacccccgacgagagtgaggaggtgcaagccttaaaggtggaacttgaaagggcgcaagcggtcaaggaaaaattcaagacgacagccatgatggtccgaaaggagtgtgacgaactaggagacatcaatgtggccacagccgaagcattggaatgggaaataaagagggtccgaaaggaagaatgggcccgaaacaagttctga

SEQ ID NO: 19609 - DNA, 765 bp, Glycine max
  Peptide Sequence Number=SeqID_136387
atgctggtggcgactccgtgcatattcctttcttggaagatgcacccagggctacatgtcctcacctttagaggactgcacatccaaaccttcaaagggctacaagcccttgccttcatagggctacacgccccaaccttcagaggactacacgccctcacattcagtggactacacgtcctcgcgttcagaaggctacatgtcctcaccattgaaggactacacatcctccccttcagagggcaacaagccctcaccttcgtagagttacacgaccttgccttcagagggctgcacgtcctcgcctttagagggatgcacgcccttgccttcagagggctacacatccacatcttcaaagggctgcatgccctcgcctttagagggctacacgccttcaacttcagagggcaacacctcctcgtctttagaggactattcgtcctcgcctttagaggactgcacgtcctcgtcattagaggagtgcatatcttcccctttagaggacatcacgtccacatcttcagagggctgcatgccctcgcctttagagggttgcacgccctcgccttcagagggctacacgtcctcgccttcagagaactacaactcctcaccttaagagggcagcacgtcctcaccttcaaaggactacacgccctcactttcagaggactacacgtcctctccttcagagggatacacgtcctcacctttagaggactacacgtcctcccctttagagggctacaagccctcaccttt

SEQ ID NO: 19610 - DNA, 231 bp, Glycine max
  Peptide Sequence Number=SeqID_136388
atggagcaagttagcataggacaccgaaatttggggatggcctttgtggataactgggtggtggataaggagaatggttgttattggttgagtaatgacattgttggattggtgggaaacttggccatatccgcttcgaccctttccccggcgaagaccaaatccgcaaagcttgaaggaaggcaaccattaggtccttccatgaatggactcaggaaggttccaagctag

SEQ ID NO: 19611 - DNA, 291 bp, Glycine max
  Peptide Sequence Number=SeqID_136389
atgggaagagcccctcctgctatggttgaaaagggaaagttggatcatatagaggaatggctcaaggacattgaaggaggcaaagattgtgcctttgctaacctagaagagtttttcctagtacccgaacatggtcattcccatgggactacttgccccaagaaccatctaaagacgtattatcggaagataggggcatacgcaaaagatgagaaattgctgatacattccttccaagaaagtcttactggggtagttgttacctggtacactagcttggaaccttcctga

SEQ ID NO: 19612 - DNA, 441 bp, Glycine max
  Peptide Sequence Number=SeqID_136390
atggcttttgtatctatgattgaacctaaaaatataaaagaagccataatagatgataattggataattgatatgcaagaagaactaaatcaatttgaaagaaacaatgtgaataagttagatgaacatggcataatcattagaaataaggctagattagttgcaaaaggatataatcaagaagaaggtatagattatgaagaaacatatgctccaattgctagattagaagccattagaatgctcttagcgtatggatccataatgaattttaagctttatcaaatggatgttaaaagtgcttttctaaatgacttaattcaagaagaagtatatgttgaacaaccaccaggttttgaaatgttggataagctaaatcatgtctataaattgaaaaaggctttatatggcttgaaacaagcccctagggcttggtactag

SEQ ID NO: 19613 - DNA, 804 bp, Glycine max
  Peptide Sequence Number=SeqID_136391
atggaatgtgtattggctgatgtacttagagatcaaaggaatttgggcaacaagggtgacagaggttgggaaaggtcagcattgaatgctgcagccgcagtgttatctacaagcttcaatgttaatgtcacatcagataatgtcaaaaatcgtatcaaattatggagatcatggtatggtattgtaagtgacatccttggccagagtggatttgattgggatggcactaagcacatgatcacagttgagaatgaaaatgcttggaatgaatattgcagttcgcataaatcggctaaaccgtttcgattcaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaaccaagctctaatataaaaggaaaaagacaaggttcgatttcttctggcacacatcctcacaagagaaagatgagagtaaaagaaggaataacagcttctttggataaaatggcgaactcttttaaccgaatggtggaaaaaatggatggtaaagttgatgatgaagatattcaagaagtattacgtgaggcagctttgataccagatattaatagacaacaatgggctaaagctattaaatggttagctgacgatccaaagcagttagctattgtgaaagcccttccaattcaccaaaagacagattatgctttaacacatcttggagaatga

SEQ ID NO: 19614 - DNA, 189 bp, Glycine max
  Peptide Sequence Number=SeqID_136392
atggccttaggggtctcttcttccttcaatgctgaacttgttgctgctatgaagattattgacattgcatgggataggcaatggcattcgttatggttggaaactgactcttctttgatgattagtagtcctctagatgccaacttagttaggatgtttggggctgcttttttgttcttgctcacctag

SEQ ID NO: 19615 - DNA, 522 bp, Glycine max
  Peptide Sequence Number=SeqID_136393
atgcaagaagagaatggaggagttggtaacataaatcatgtggtactagttgctccacttaatgccactgaagaagagagaattggttggtttagagggaagcttcgagagttcaagattctcaattcagatgaattgagaaggcaattccatgctcgagttctaggatttttcgttcccaggtgcgagtctcaaattttcatggcttgggagtcctctgtaggctcatttggagcaagagaattgttgtccatagagagtcttttcaaggtgcatcccgaggcatgcttggtgattctatcaaggactttggactcaatccatggctataggatcctgaagccaattcttgatgggggggggggggtagtggttgagagactaggggaaaggcctggcttcaacttcacaatcttgcctcctatggccatttatccagaagattggaaaaagattggcggtctctttatgaagcccaaaactagaggtgaatcaaaatgggttgaagccaaactgctttag

SEQ ID NO: 19616 - DNA, 552 bp, Glycine max
  Peptide Sequence Number=SeqID_136394
atggctaagaatgtgataagagagaatatagatatcttggcacgtgatacaagcttaggaagttctgctacatcaattggtatcatcgagcctgttccttccttggtgatcaagcaatggcaaagaacacgcgcagtcaagcttccctttgtgaaatggaagaatgtctcagtagtagaatggaatcaagatttgtcgagctcgttgcttccatgcaacaaacaatacacgaaatgtttcagcagaggcaacaagattctccagcagcaagcaatccacctagaggtgaaagatccaacccttattcttgtggcactcgattggctaggttggaatttccaagattcaatgaatttggcttcttggaatgaatatcagatcgtgttacttgatcgttttggagatgtttatgaagatcccatggcggatttaatgaagctcaggcagacaggatccatcatagagtatcatgaggagtttggctcaattgtgtcaagagtggatctttctgatgagcatcaacttagctgctttttaggaggattaaaataa

SEQ ID NO: 19617 - DNA, 1338 bp, Glycine max
  Peptide Sequence Number=SeqID_136395
atggatgtgcttcctcctttcatcaactccaacaaagtgcttgatttgtgggatgaggagaaggatgatgaggatgcagctgaagatgacaaagaagatgatggcctatatagagatttttgggatgagaacaaccaagtacaagtcgctatgatcctcaaacgcttccttgacccgccaccatctcccaccaccaccgttaaccccttccgcgtttccgcttcatcactatgcgacgctgtttccctctttcacgaccccaattcaccgccctccgaaccagcttgcagcaccctcatcgacaacctgcgaaaatacgacgtcgtcgtgtcggtttaccgcaagatggtcgccgcgtgcgtctcgcccaggttctcctatctcagcgccttaaccgaaagcttcgtcatcacccaccacccaagtttcgctctttcggtcctgagcctcatgacaaagcgcggtttcggggtcaacggtggggatttcagacctaacttggtgacttatagtgttttgattgattgttattgcaagagtggtgaagtgggtgaggggttcagtttgttggaggagatggagagggagggtttgaaagctgatgtatttgtgcatagttctctcattagcgcgttttgtggggagggtgatgtcgagaagggaagggagctttttgatgagatgttgatgaggaaggagggggaggagccgggtactttgacatacaatgttgttgtgaatgggctttgtaaggaggatcgggtggatgatgcacttagggttgtggaaatgatggcgaagaaggggaagaaacccgatgtggttacgtataatacgttattgaaagggctgtgtggagctgctaaaattgatgaggcgatggaactttggaagctgttgttgagtgagaagttccatgtgaagctggatgtcttcacgtttaataatttaattcagggactttgcaaggaaggtcgtgttcatgatgctgcaatgatccattattcgatggttgaaatgtggctccaagatgttgatgttgtcttctttaatataataattgatggaaccctcaaagcagggatgttaaatctgccaaggttttccaaacttggaatgctgtatgaggccatggcgctctatgagaaaatggtctcgtgtggtcatgttccggatgttgttgtatttgactctttgctaaagggctatggtttaaaaggagagacagaaaaaatcatttccttgcttcatcaaatggctgataaggatgttgtcctggactcaaaattaacttctaccatcttagcttgcctttgccacatgtcaagagatcttgat

SEQ ID NO: 19618 - DNA, 1848 bp, Glycine max
  Peptide Sequence Number=SeqID_136396
atggaggaccacctttctcatttatatcaggttcttcttactatgagaactcactgcttgtatgctaagaaatccaaatgctactttgctattgacaaggtagaatatttgggccattttattactaaagaaggagtttccacgaatcgttcaaaaattacaacagtacaagattgggctctaccacaaaacttgaagcaattaaggagcttcttgggtcttgcaagttattacagaagatttgtaagtcaatatagtgctattgcaaaacccttgactgatatgttgaaaaaggataattttagttggtcttctacagcaaaagaagcatttcaggaattgaagcaaaggctagtagcatcaccagttttggccttaccagatttttctaaggaatttgtggtggaggtggatgcttctggcctaggcttaggtgctgtgttaatgcagaatcaccacccaattgccttcatcaatagaagtttgaaaacacaacaaaaatccttgtcaacatgtgagaaagaactattggcagttatgtttgtagtccaaaaatggaggcactacttactccccaagaagttcatcattagaactggtcatagaagtttgaagtacatcctagagcagagattgtccatagcattccagcaaaagtggttggtaaagttgatggcatttgatttcaacatagagtatagagagggtcgagaaaatgtggcggcagatgctttatctagacttgattcccttaagatcatggccttacaggttcatcagcctgattctagcatgctctctaggatccaacagtcctggcagaaagatcctatcttacaacaacttgttagtgacttaaaaaacaattcctcttctcacaaacattatacttggatccggaatgagctaaggaggaaaggcatattagtcattggctcacacccccaactaagacaaggcattctctcttggttttatgcttcgacttgtggtggccattcaggtagagatgctaccttgcaaaagatgaaaaatgtgatttattggagaggcatgtccaaggctgtaaaggtttttgtgtttcaatgtgccatttgccaaaggagtaaatatgacacagctgcatctccaggcctgcttcagcccttacctattcctgagcatgtatggcagcacatcaccatggacttcattgaagggattcaggtacaactttctacagcttatcacccacaaactgatggtcaatcagaaatgtggtccaagtggttgcctcttgctgaatggtggtacaattccacttaccacaacactattaaagcaagcctttatgagattgtgtatggccaagctcctcctgttcatttaacttatcttccgagggaatctaagattactttggttgatagaagtttgcagaaacgcgaggaaatgttaaagttactcaaattccacatgaagagagcccatgaaagaataaagcaacttgcagatagaggcagatctgataagagtttccagattggtgacttggtttatgccagaaccaatgcaaagttggcccctaagtactatggcccatttccagtagaagacaagattggtgatgttgaatacaagcttaaattgcctcttggatcaatggttcataatgtcttccatgtttctcagttaaagaagtttaatggtactactattgctgggaactttagtccttcacctttattggatacttctcagaaggaacctgcagctatcattgacagaatgacagtcaagagaagtaatcgtgctacaaccaaagttttggttcaatggaagcatcagctatctgaagatgcaacttga

SEQ ID NO: 19619 - DNA, 273 bp, Glycine max
  Peptide Sequence Number=SeqID_136397
atgcagagactaacgtcgtcttctgcaccttttgtcatccagggacaacgagtcaggtggcaggcggagataccttatggtcgtccgcacctttcgtcgaccaaggcgaacgagttcgacagtatcaggatgatgttggtttttacactcgtcttctggagacattcaagcccgatgatgcatgagattcttctctgttgggcggggatgatcaagttcgatagtgtatggaaacgtcgtggttatcccattttatcgctttcaagacactga

SEQ ID NO: 19620 - DNA, 306 bp, Glycine max
  Peptide Sequence Number=SeqID_136398
atgaacaaaaacgaaaaagaaattagcaagaaaaaagcaaaggactccattgatgaagaagatccaaggcctagaagctccacatggagctacatcaccatccccatgccacaaggagtgaaaaatgaacaagtcacatacattggtgatgttgatgttgattatgatcaaatagacaaagagatttcaaacattgatgtatctcgtagtgctcctatcgactttgctacatacctacaaaaaggacagtatatgcatacaagaggaattcatcaacttcaagtagacttgatgaatcatatttga

SEQ ID NO: 19621 - DNA, 492 bp, Glycine max
  Peptide Sequence Number=SeqID_136399
atggtcattactgcgccttttgtcatccagaggcggtgggcccgagggcatgcggagacaaattatggtcattccgttcaccttttcgccattcagacacaatcgtgtccgatggcacgcagagacaaattatggagcagcgagtcgagtgataaacgcgcaaagacaaattatggtcattctggatcagcgagtcgagtgataaacgcgcagagacaaattatggtcattttgcgccctttgtcattcaggagcagtgagtcgagtggtgggcggagacaaattatggtcattccacacaccttttcatcatccaaaggcgattgtgtccaatggcacgcagagacaaattatggtaattctgcgcctttccatccaggcccgatcgtgtccgatggcgcgcaaagaaaaattatggtcattctgcgccttgtgtcaaccaagaggaacgaattcggcagtatctggatgatgttggtcattcggtgctga

SEQ ID NO: 19622 - DNA, 345 bp, Glycine max
  Peptide Sequence Number=SeqID_136400
atgtcggcgttgatggcgaccacgaagaagccaagacgggtgagggagaggctgatgttggcggtggtggtggtcttgcccacgccacccttgctggaggtgatgacggcgacgcggggggtggagctggagagctcaggcttgcgattccactggaggagggtagaggggggtttgggatttttgggggttagggttttggaggggaagaggggagaatgggggcgatggtggcgccgggaagaaggtggagagatgacattgggaaggggagagagggagagggagagggagaagaagaagatgaatgatgatgaagaagaagcacaatggtggagtgaatga

SEQ ID NO: 19623 - DNA, 210 bp, Glycine max
  Peptide Sequence Number=SeqID_136401
atggcggaacctatggggatggttttcgccaatactgttggcggaacctatgctggatggtgcctcgatgcatggcatggccatggggatgctgctgacatgcatagttgttgttgcaatggtgttatgcaattggagttggcgatatgcatgtcacgcaagcagtgtgtttcgccagtggtgatggtgaaacacacttggcacacgtga

SEQ ID NO: 19624 - DNA, 951 bp, Glycine max
  Peptide Sequence Number=SeqID_136402
atggggattggcttaatatattttagtgtagcggaacctatgcagcattactcctctgaagtttttggtaataaccattatgtaaacagggcgaaacaggcacagctttataccttttttcattggggaatccacgcgtgggctatttatgggattgtaggattatcactttcttattttgcttatcgataccggttgccactatctctgagaagttgtttttatcctttgcttaaagatagaatcaatggaaaatggggaaatgttattgatatttttgccctttgctgtaccttctttggaattaccacaacattaggttttggggtcgtccagattaattccggcttacacatattgggagcaatcccggaaaataaattcatataccagatcattattgttttcattctcatttctctggcggtcttttcggcgatcagcggggtaaacaaaggtgttaagatattgagtaatatcaatgtcatcagtgtaattgttcttctgttgtttgtactgatattaggaccaaccgtttacttgatcggaagctttaccgaaggtttgggaaattatatcaataattttttcgatcttacttttagtacccatgtttacgaaaaagatacactgccatggttttatgactggacgattttatattgggcatggtggatttcatggtccccttatgtaggattgtttattgcgagaatctcaaaaggaagaaccattaaagaatttattctggctgttttaatactgcctacattatttaattttatatggatgtccgttttcgggaacagtgccatttggtttgatttcaatatcgcgcatggaggcctgaaagcactccagagtatgacattaatcacagccctgccattttcaattattgtacttttattcattttccctggtccggtgaattctggaaagaacgtttga

SEQ ID NO: 19625 - DNA, 391 bp, Glycine max
  Peptide Sequence Number=SeqID_136403
atggccaccgctgatgccttggaacgagaaaccaagaaggcccaaaaggaagaacacgacgagctaaaggcttaccttaggtcgaaaagaaatttgtcccaacagttaagcgagactgaagggaatatgtgggccatcatcgatgagtgcaaagagaagctaaatctagcggcgactcacgagcaaaggctagaggatgagtacgccaagatatcagcagaaagcgaagcaagggagagggtaattgattcatggcaccaagaggcaacaatgtggacggaccgatttgctcttactttgaacaggagtcaagaacttccccgattgatagccaaggccaaagcaatggcggacacctacttcgcccccaagaagatccacagacttctca

SEQ ID NO: 19626 - DNA, 143 bp, Glycine max
  Peptide Sequence Number=SeqID_136404
atgaaaagaggaagagaaagtagtaagaggaatagcgacagcagcatgcaagtcaaagatggaggcgtggtgggagagaggatattcggcgttggagaaggcggttatgtcggtggcgaaacagggcttggctgttgccaagg

SEQ ID NO: 19627 - DNA, 111 bp, Glycine max
  Peptide Sequence Number=SeqID_136405
atggcacgatcaccagtgactagagtgctccaggaagggggtatagatgtggtgctaggagggctacgggtccaagaaggggatgtggagggttcatggcttgtgttgtaa

SEQ ID NO: 19628 - DNA, 897 bp, Glycine max
  Peptide Sequence Number=SeqID_136406
atgatggaggcccagtcccaacacattaaaggcgtgtgcttgtccttggaagaagaacccaaagaggagttcaaagtcaccacaacccactactgcaactgggacagtactgccaccagtacttatcaggcacatgaccaggtcgtgtttggggaagaatctcacactcacacatttggtgggaagcgtggcagaaaaccaggcgagaagagacgaaccaaggccgagaagactatcagcttgccagttctaagacagtactttgcaggaagcctaaaagatgcggcaaagagcattggcgtgtgtcccacgactctgaaaaggatatgcagacagcacggcataacgaggtggccttcaaggaaaatcaagaaggtgggccactctttgaagaaacttcaacttgtaatcgattcagtgcagggtgccgagggtgccatacagatcggctccttctacaacagttttccggagttgagttctcaatcatccaagtccaacaacaacaacaactcatcctctcctacagcagcagcagcagcagcacaaagccctcaacaacccttgagagtgaaggctacttttgcggatgaaaaaatccgttttagcttgcaaccacattgggggttcacagaattgcagctggaaatcgcaaggcgcttcaacctaaacgatgtgagcaacggctacttggttctaaagtatttggatgatgacggggagtgggttgttttagcctgcgatggtgatcttgaggagtgtaaagacttgcatacaacatctcagagccgcacaattagactcgccctatttcaagcttctcctcttaataatctaccaaatacatatacttttgccgcggctaccccttcttccagcctcgccgtctctctttag

SEQ ID NO: 19629 - DNA, 309 bp, Glycine max
  Peptide Sequence Number=SeqID_136407
atggtgattttccatcatggagatgcagcggaagataaaggagaagagaaaaagcttcaccaccaagagagtgccttgaataagaagcttaaaaaggaagcttcaatggaggaaaagaaagagagagagaaagagaaaggggggcaacataaaattgaaggaggaaaagagggagagaagttgaactttgaagtgtgtctcacaagactctcattcatcaaagttacaacaagtgttacacatgcttctatttatagcctaggtagcttccttgagaaacttccttcagaagcttccttgagaagctag

SEQ ID NO: 19630 - DNA, 1254 bp, Glycine max
  Peptide Sequence Number=SeqID_136408
atgacattggcatcttcattccccactccacaggttcacgccttcgacaatcccgccagacgaagaagaagaagccactttcacattattaaccgcaacaagccccaccgaaccctccactttctcttaatcccaacctctccctctccctcctcttcgctcctcttctcttgctcctccttccccctcacccactccgacccaatcctccagttccgccaccaccacctcctctccaccgacggcaacttcatcgttgaagacctaagcgctgcggtcgaggaggacgtgtctccggctacgacggcaaggatctttgtccaggagccgccgtggctgttcctgaagggtttgttaatgcaggaggaggagatgagacagaaggacaaggagagggagaagtacaatttgctgcgaaggaggcagattgaggcggagacagaggcctgggagaagatggtggaggagtacagggaattggagagggaaatgcgggagaagatgttggcgcccaatttgccgcatgtcaagtcgctcctcttgggctggttcgagccgttcagggccgccgtggaggccgagcagacggcccaccgcgcccgccccaagaagcagcaggactccattgccccccacgtcgacgacttgcctgccgataaggtggccgtcattgtgatgcataagatgatggccatggtgatggagaatgaggaaggctgtgttcagcttgttcatgctgctgttcatattggcatggctctagaacaggaggtaatggccctattttggtctcaaattgttattacaagaatggggttaattgactggctacatcatggatgccgatgcagaatagtagaactagataagcctctaatgcttaagttgtttaaaaccggattggattttatggttaggattcataagttcgttgaaggaaataaaagtagccagagtaagaagacagagggtgatgctgaagacagtttggatagtgataaagaaaaacaaagaaattatttaaacagtttgcttaaaaaaaatagactgagggaagtgcagatgattttgagaaaagaagaatgtagtccttggagccgggacacgcaggctaagctgggaagtcgattagtagaattattaattgatacagcatatgtacactctccggttaaccagtctgccgatactccacctgatattcgaccagctttcaggcatggttttaaggctgtaccatggcatccagggtga

SEQ ID NO: 19631 - DNA, 2604 bp, Glycine max
  Peptide Sequence Number=SeqID_136409
atgttcttatttctaacaaggcaaaagttttcgaagaagtatggcattatacaatgtgatcccttggtcctagttgggcttgaaaaatgtgctaaacatatgttaataccttacatgccaatgttaatacctcccaaaaaatggaaaggatatgacaagggtggacacttattcttaccatcttatatcatgcgtactcatggatctaagaagcagcaagatgtaatgaagaatgtcgacggagcacaaatgcaaaaagtttttgaggccttggatattcttggcaacaccaaatggcgagtaaatagaagagtgcttggagttgtagagtcaatttgggctggaggaggtaacattgcaggactggttgattgtaaagatgacagcagtttattagagaaacagattgagagagagaggcgagaaaggaaagtgagagaaagaggacgctctcaggtacgtgatcatcgcggaggaacaactaacagagatagcagctggcgtgttctcggagaaagacgaagcagggacgacgacaatgattattcgcttgtcgcggatgaccacagacgccacttcaacgatcatcgggatgaacaacgaggtcactgtgacaacctccaggagggagagtggattcaagtgaagagtaggaggagaaggtccctttccaagcgcgaaccagctcacggaaagggcatagctgttaaggaaaagtcacttcaggtcaccttccgggggaaaaagtcatcatcgacatggagagaaagggcggatattacctctttctatttctcccattttcctgatggggaggtatttgtatcgaagaagaggaacaaacaaggtcaccgttatggctttgtgcgtttcaaaggagtagaagatgaagatggtatggaaagaaggctcgacaaccgcatttacatacaaggaatgaagctgtttgtcaacaagcccaaattccagagggacgggaacaaggtaacagagccactcacagcttcgaaccatagaatgtccaagaagaacacggagcatggcgcgtacaaacaggagttacgtcaagcccctacgttcaataaactcaaatcttatgctgaggtggtgaccaatcgaaccaacgacaggatagaagcacaggagccgcggattaagatccaaacgtcgcaggagaagaccaaatggcttgataatgcttgggtgggtcatttgaaaaacaaagccatgtttgatagggtggatgaggaggttagggggatgtttggacaggaggtcaaagtgtcgtactggggagatgatttgatcatccttcatggtttaacggaggtagaagctactgattttaaccgcaaggagcacacacatggcgggactcctctatctctgttacagagatggacgccgatgttgacgccatcctatcgtctaacttggctgtgtatctggggggtaccccttacggtttgggacgcagatacatttgcatgcattgtgtcggtatgtggtgaactagtagaaatggatgaggtgacggaggagaaatccagagtagatttggcgcgggtcttgattcgaacgtcggagaaaccgttcatagagaggacgatgctgatcctcgtcgacggagtccaatactctctggacttgcgtgaggaaatgggagttgggtggggtagaactctgagagaagcggcggtgacgcaactccctccatcgccgttctccacggctatagcgaattccgacgaggagccaaacacccccttcatgcacggtttttcagctgagcgtgtttccggtagtctggtcggcggctcctctgcctgttcgtcgctttctatggaggaccatcgtcggagacgccggactgaggggccttacccaactcgcaggggcaacgataccgcgataggtgcttacatgtcttccctcctctgtcacgagcagctgccagctgatgccgccctgacaccttctgtcgcgggccaatgggaatgcattgatccaaattgtttggacatgcatcctgttgacatggcagaacctatgtctttctgccctagccaacaacagaccccaattcaggaaggagacgttgaagatatacctctgcctgctttcaaaaactcttatatccacagggtaaagcaggatgaaccattggtcaatatccatgattctacacctctggtcaactctgattcaaatttaatgcccccttatcaaaaggaagctgcagctgaggagggggtaggtttaaatcactctgtgggcctgtctaaaagcccaaataaagaggggaataagctttctccaaatctcagggtgtatgttagaagaaaggagtggggagcattaaatcatgaggcctatgtccaacatagcccactttcttgcctcaatggaaaaaaccttgtctcgcggaagccctttaatgaaatcagtaagactcaagtttatgaagggagggacattcatagctcagacccagaggggatgatccctaacctgcaccatccaccccacagttctgttcccgatgatagcgttagcaaggagtacgtaggtgatgaggaagctttccaacatggagatggttag

SEQ ID NO: 19632 - DNA, 966 bp, Glycine max
  Peptide Sequence Number=SeqID_136410
atgaaagatgaggaaggcttttattatccacacaatcttgacttccgtggcagagcatatcctatgcatcctcatttgaatcatttaggttctgatctgtgtcgaggactacttgaatttgctgaagggcggccattgggaaagtctggactaaggtggctgaagatacatctagcaaatttgtatgctggtggtattgagaagcagtcttatgatgggcgcctaggatttatagaggatcatattcatgatatatttgattctgctgatcaccctattaacggaaatcgttggtggttaacagcggaggatcctttccagtgccttgctgcttgtattaatctatcagaggccttaagaagctcatcaccaaattcttttatctcacatcttccaattcatcaggctgctgcagttaacttggttgctaaagagaaacctgctgatgtttacacagagattgctgttagggtttatgatataatgagacaagacagcaacaaagacccggatacctttccaaatgctttgttagcaaaggtgttgattgatcagattgataggaaactggtcaaacagacagtaatgacttctgtttatggtgttacttatattggggcacgggagcaaattaagagaagattaggggagaaaggtttcgtcactgatgatagacttttatatgctgcatcttgctatgcagctaaggtgacattggctgcccttggagaagtttttgaagctgcacgtggcattatgggttggcttggagattgtgcaaagggtggttctgaaacatttctacaggtgattgcttgtgaaaaccaggctgtttgctggaccactcctcttggtcttcctgttgtacaaccatactgtaaaactgaacgttatcagcgggagaggacatcaaccgacagtggcaaagcagagctggaagtgactggaaaaaggggaaattgctga

SEQ ID NO: 19633 - DNA, 153 bp, Glycine max
  Peptide Sequence Number=SeqID_136411
atggttatcgaatcagggatgaggactttactgaggtgggccacttgggatggtgtgcttatgcctgggcttgtggaaatgggatatttgttttgcgccatcgccagatcgccacctagtaccacatatgacgggtgccccataacccaataa

SEQ ID NO: 19634 - DNA, 1377 bp, Glycine max
  Peptide Sequence Number=SeqID_136412
atggaaaccgcctacattggtcgacttggcaccgttgaattggcttctgccggcgtttccatatccatctttaacatcatttctaagctttttaatatcccccttctaagtgttgctacttcctttgttgccgaggacattgccaagtcttcctccgctgcagatgccaaaacaaaacaacaactctcctctgtctccactgctctgctattggcactcgcccttggcttttttgaggctttagctttatacctgggagctggagcttttctccatttaattggtgttcctacagtatgttttcaccctctactttatgcgttttatttcttgtatcctcttccaagcattggtaacttttcagctgtcttcttatttcccttacttatgtattactttcggctgggtgtaactggtgcggccatttccaccgtcatctctcaatatattgggaccatgttgatgatctggtgtctgaataagcgagctgagttactacctccaaagatgggagacctgcaatttggcagttatattaaatctggtggtttccttcttggaagaacacttgctgttctttcaaccatgacattggggacatcaatagctgctcgacatggtccagtagctatggctgcacatcagatatgtatgcaagtgtggttggctgtttcccttcttacagatgcattggctgcatctggtcaggcccttattgcaagttctgtatccagacatgaatacaaagttgtgaaggaagttactagttttgtattaaggattgggctggtaatgggtatttgcttgactgcaattctgggtgcatcgtttggatctttagccactatttttactcaggactctgaagtcttgcaggtggtcaaaactctggcgttgtttgtcagtgcttctcaaccatttaatgcactggcatatatttttgatggtctccattatggtgtttctgatttccgatatgctgctttctccatgatgttcgtgggagcagtctcctctgcattcttggtatttgcacctccactttttggccttcagggcgtatggctgggcttagttctcttcatggctcttcgtgcggcagctggtgctgtcagattactctcaaagaatggtccttggtggtttctacacagagatttacaaattgcagagatgctagtagaaggtgtaagcaagctagtagtgttttggaggtggaaagcatggttcaagataatgggatctatcttacgaagtgatgagaaatttattgcagagattgaagggtggtctcgtgagtctttagatggagaatatggatgcaacactggatgtgacattttgaagaggattctctccgttggatattatatttag

SEQ ID NO: 19635 - DNA, 450 bp, Glycine max
  Peptide Sequence Number=SeqID_136413
atgaagagggagtgtggcgaagcgagttcttgttcacgcaagaagcagaagcggttaatggaggatgcaggagcacgtccctgcacggagtgcggcaagaagttctggtcgtggaaggcactcttcggccacatgagatgccacccagagcgtcactggagagggatcaatcctccggccaatgtggtcaggagacaacaagaacaagaacaaatgagccaggaagaccacgaggtcgctgcctctctgctcctgcttgccaactccaacgttctggagagtgatgggcacaagtgcagcatttgcctcagggttttctctactggtcaggctcttggtggccacaagcgctgtcactgggactcttcttcttccaagtctctctctgtcctcgacttcgacttgaatttccctccccccctcactctcgatttgaggttgggtctctag

SEQ ID NO: 19636 - DNA, 375 bp, Glycine max
  Peptide Sequence Number=SeqID_136414
atgaagagaaagaagcatcacactgagaaatccagaataatcggactcctggttgtgagtttccttcgaagtcggctcctccaccgcactctcatcatcgccatctccgcctcccttcttctgctattcgccctattctctctgttcgctccgtccccggtaaatgaaatcaatcttcagacacagaacaatgaccaagtcagatcacggttcgaggttccggccggtggaggaagatgcaggcgtgatttatggagttcaatacactcacgcctcttctatggctgcagtaatgccggtgtcaattttgcaagtaaagctaatccctatcatcccatctcgcaacccatttatgaatttaatttcggactttaa

SEQ ID NO: 19637 - DNA, 288 bp, Glycine max
  Peptide Sequence Number=SeqID_136415
atggagctactaaacctgccggattgtctctgcagcaagcttttcagcagcttcgatcaagaatggaacacacaccacaaacggccaaatatacttccaccgcaattcaacatggtcgaagcctccaaccaaattcatgaaacaacaagtttggtgttgctgcttgtatccgtgatgatgaaggaatatttgctgctggctgctgctgctgcaacttcttggttccaaggtcagccaactccacaagaggctgaatctatggctctcctatttactagagccctttaa

SEQ ID NO: 19638 - DNA, 1326 bp, Glycine max
  Peptide Sequence Number=SeqID_136416
atggggtgtggcagctccaagctggaggatctaccagcagtggccctttgcagggagcggtgtggtttccttgacgaagcaattcaccagcgctacgcactggccgcagctcacatggcctacatcaactccctcaaggcaattggtcactccttacaccttttcattcagcaagacatggatgctcctccctctccctctccctccccctccccttctccccctcacaaaccctccaaacacgcctcttcttctcactccgactccgccggctcccacctccacttccactccgactccgactccgaccacctcccctccctccaccattcccctgatccatcctctcctctgcctcaccatcttcatatgaattacatgaagaataaagccgctccttcaattgtctacgagcagaggcctctgagtccccaaaccatgtacttgggagagtcctcctcttcctcctccttttacccttaccagtatcccccttacccctacccctacgatccctattcggccgtaggttcttcctcgccgcagctccatgccgtttccaagcctcccccgcctcctccctctcctcctcgctcctccacctgggactttctcaacttcttcgataacagcgacgacaagtactatccccaaactcattaccctgccacggccacccccagccgcgattccagggaggttcgagaggaggaggggatccccgatttggaagatgaggattaccaccacgaagttgtcaagcaggtccatggggatcagaagctcgtccagccaactatgcacgaacccccagcctcctcccgccaccacgacgaagatgacgatgatgacgatgatgatgatgatgatgatgatgaggtagaatatgaggtgcacgtggtagataagaaagtggttgatggagataataatgatgggaacaaggccaaggagcacgccgcattccgtacccggagacctggttcccggaatccacttgaggttgctaaagagattcagattctatttcagagggcttccgattctggtgcccaaatcgccaagattcttgaggtcggcaagcttccccacaatcgaaagcacgcagcttatcaagcttcttccaagatgttacaagttgttgctccctctttgtcccttgtctcctcccaaccttctacttccaaagatgctgaatccgcctccgctgctaacatggattttaatgttgatctaacaaccggggcacgcaatctttcctctacgcttcagaagctccttctttgggagaagaaactctttaatgaagttaaggtttccaaatag

SEQ ID NO: 19639 - DNA, 2715 bp, Glycine max
  Peptide Sequence Number=SeqID_136417
atgaaactttcttcacctggttttagtcctccaccccaggaaggagaaaagcgagttctagattcagaactttggcatgcttgtgctggtcctcttgtttctttaccagctgttggaagccgagtggtatactttccgcaaggtcacagtgaacaggttgctgtgtctaccaacagggaagtggatggccatatacctaactatccaagcttaccaccgcagcttatttgtcaacttcataatctgactatgcatgcagatactgagacagatgaagtatatgctcagatgaccttgcaacctcttaatcctcaagagcagaagggagcataccttccagctgagttgggcactccgagtaaacagccaacaaactacttctgcaaaattttgacagccagtgacactagcactcatgggggattctctgttcctcgcagggcagctgaaaaagtttttcctccattggacttttcacaacagcctccttgtcaagagttaattgctagggatttgcatggtaatgagtggaaatttagacatatcttccgtggccagcccaaaaggcatctacttacaacaggatggagtgtgtttgtgagtgctaaaagacttgttgccggtgattcagtgctgtttatctggaatgaaaagaatcaattgcttcttggaattcggcgtgctaatcgacctcaacctgtgatgccttcatcagtgttgtcaagtgatagcatgcacttggggcttcttgctgctgcagctcatgcagctgcaactaatagtcgtttcaccatcttttataacccacgtgctagcccatcagaatttgtcatacctttagcaaagtatgttaaagctgtatatcatactcgagtttcagttggtatgcgcttcaggatgctgtttgaaacagaggaatctagtgtgcgtcgatacatgggcacaataactggcattagtgacttggattctattcggtggccaaattcccattggcgctcagtcaaggttggctgggatgaatccacagcaggagagaggcaacctcgagtgtctttatgggaaattgagccattaacaacatttccaatgtatccatctccatttccccttaggcttaagagaccgtggcctccaggactgcctttgttccatggcttgaaggatgatgattttggaataaattcttcactaatgtggcttcgagacacagacagaggtcttccatctcttaattttcagggtattggtgttagtccttggatgcagccaaggcttgatccctcaatggtgaattatcaatcagatatgtaccaagctatggctgccgctgcacttcaggatatgtggacttcaaatccttccaaacagcatcctacttcctcaattcagtttcagcaaccgcagaacttccccaaccagacttctcccttaatgcaaactcaattgttgcagcagtctccatctcagcaggcttttccaaatagtcaagaaaatccacatccgtctccatctcaatctcaggctcaaactcaaacacactttcagcagcatctacagcatcagcactcattcaataatcagaatcagcatcatcttctgccgcagcagcagcaacaaccacaacaaccgcagttgcaacagcaacaagtggtagatcatcaacagatttcaagtgttgtctctacaatgtctcagtttgtttcagcagctcagtctcaatcaccacccatgcaagctatctcttcacttggccatcagcaaagcttttctgattcaaatggaaaccccacgactactgctattgtttctcccctgcatagtatattggattcatttcctcaggatgacacatctcaccttctcagccttcctagatccacttcttgggttcctgttcaacattcgactgcatggccaccctccaagcgtgttgtggtggatcctctcctttcttctggagcatctcaatgtgttctgcctcaagtggagcagttagggcagccacatagtaccatggctcaaaatggcattgcattgccagcctttcctggtagggagtgtacaatagaaggaagcaatgatccacaaaatcatcttttgtttggtgtcaatatagagccctcgtcacttctaatgcataatgggatgtcaagtcttaagggagttagcagcaacagtgactcacccacaataccttttcaatcttctaattacctgaacaccacaggacctgattcctcattgaatcctggaatgacacacaatattggtgaaacgggcttcctgcaaactccagaaaatggggggcaaggaaacccatccaacaaaacctttgtgaaggtttacaagtcagggtcctttggaagatccttggacatcactaaattcaccagctaccctgagctacgcagcgagcttgctcgtatgtttggccttgaaggtgagttggaggaccctgtgagatcaggctggcagcttgtattcgttgaccaagagaatgacgttctgctccttggtgatggcccgtggccggaatttgtaaatagtgtagggtatatcaagatactttcccctcaggaagtgcagcagatgggcaacaatgaacttgagcttcttaactcggtccccattcagaggctctctaacggtgtctgtgaggacccaagaaatttaagcactgggataacaactgtggggtctttaaactactga

SEQ ID NO: 19640 - DNA, 171 bp, Glycine max
  Peptide Sequence Number=SeqID_136418
atggcaaagtacactgctgctttgttgcttttggttctccttgttgtggcaattctgaatggttctgacgcttcaaggagaagactcccagagaaagatgatcttgtgcccaaagatcatcatgttagtgctgaaattgaaaacctaagcattgccccgactaatccatga

SEQ ID NO: 19641 - DNA, 216 bp, Glycine max
  Peptide Sequence Number=SeqID_136419
atgcccaacattgtgaatgtttcaacttcaatttcaatagctggtgtcttgctaagcgaggcctgtgcacttagtgtgagtcatgtgctaagcgaggcactcagcccgcttagcgggttgggagaatctgagaagcacatgtgcgctcaacgcgtcatcagctcgcttagcgaggcatttgtctcttcatgtgctaagcgcgcccagctcgcttag

SEQ ID NO: 19642 - DNA, 441 bp, Glycine max
  Peptide Sequence Number=SeqID_136420
atggatgattgcaagtttttgcaaactaagtttgaaaatttcaaaaaggatcattatgttgaatgtatgaaattgcaagctgagctttcctattttaaagatctgtttggaaaattaaataaaggaaagagtgatcttaatcacatgctcagtgtgcgaaagaatactacagataagaccagcttggggtataacaagcaaacctcattttcaaagaaaaatcagtttgcatcctcaaaaggggcgaacccaaacaaggtgtgcctaaaagcaagggattcaatgtggtatttggatagtggctgctttgggcacatgatggataacaagtccaaactcgctaactttgtgtcaaaagatggaggatgcgtcacatttggagacaataacaaaggaaaaataatgggagaaggaaatatagggaatcaacacaaaacttag

SEQ ID NO: 19643 - DNA, 363 bp, Glycine max
  Peptide Sequence Number=SeqID_136421
atgagtctcttctctgttggtgggggtcaggagacatcttatcctagtaagaacatttggcactcatcatgggatcgaggaaaatttcctttggtcatagaagtatacggtaacaaccaaaagcttgacaatcagatcaacatagatggaaaaagctttcgtaatccaaagttttcaagagccattagaagctctccaaaagaggaacgcaaaagaaatggttgcgctgagatagaaacaagaagccaacctcaaggcactgcgggaggaaaacgacgccatctgagctcaattgcaagcataggaggccaacacagatccaactcaatcaagggtaaccgagttggaacattccttgtatga

SEQ ID NO: 19644 - DNA, 1494 bp, Glycine max
  Peptide Sequence Number=SeqID_136422
atggcactttccacggtgagacataaccactttctggccacccacgaacccggtttgaaccggttcaacatggttcgagcccaacaccatcatgtgcttcttgatcaccccaaaaccaagacccccaatagagctacacgtttagctgaatccctttcacatgtccttcaccttcacattgaccccacttcacacaaaaacttggacttgctaagtgttcatgaagagaagcactcaactccaaccatgtctccaagagagaacatatcacaaaaatggcgtgaaattcaagggtatcacaattgggaggacattttagaccctcttcagccgtggttacgtagagaaattgtcaagtatggagaatttgcacaagcaacctacgatgcctttgactatgattctttctcggaatattgtggaagttgtcgttacaaccaaaacaagttatttgagaaattgggtctcactagaaacagttacaccgtgactaggtacatatatgccatgtcacacatagagctaccacgttggctcgagaggtcacatgttgctgacacgtggagcaaagactctaattggatcggttttgtggcggttagtgacgatgacgagacacgtaggattgggaggagggacattgtggtggcgtggcgtggcaccgtggcaccgtgtgagtggtacgaggattttcaaaggaagttggacccaattgggcatggggatgccaaagttgaacatggatttcttagcatttataaatccaagagtgagactacaaggtacaacaaatcaagtgcctcagatcaagtcatgaaggaagtgacaaaattggtgaatttttataagggaaaaaaaggtgaggaagttagccttacaatcacagggcatagcctaggaggtgctttggcattgattaatgcttacgaggtagcaactacttttcttgaccttccagtaagtgtgatttcttttggggcaccaagagttggaaacattgccttcaaagatgaattgcatcaaatgggggtgaaattgttgcgtgtggtggtgaaacaagattgggtaccaaaaatgcctgggcttttgttcaatgagaagctaaaaatgtttgatgagattacggggttggaatgggtttacacacacgttggggctgaattggcgcttgatgttcattcatctccttatcttaaaggtggaatgaacttgtcagggtttcatagcttggagacttaccttcatcttattgatgggtacttgagtcatgagacaccgtttaggtcagaagctaggagggatattgcactagttaacaagtcatgtgatatgttagttgatgagcttagaatcccacattgttggtaccaattggccaacaaaggattggtttgtaatgctcatggaagatgggttaagcccaaaagagacaatgatgatattccttcacatgctagcgaagtattcaatgctggtcttggagttgtaatgtga

SEQ ID NO: 19645 - DNA, 759 bp, Glycine max
  Peptide Sequence Number=SeqID_136423
atgtgtcaggcagccttacccgttcgtggagagaggttgtttcttggacttgaatgtgacttcaaaggaagacaacaatgttacagtttttcaaggcttgctctccatgaagcattggctgagcccggtgttacttttaagtttgcatttacttgcagtttgaaaaatcttaagctatatgatatgattttcatgcattgtagaaaactagagaagggattaaaggttcgttctcatatcatgcttggaattccaaagcatgaggaagctccatcaaccccacaacgtcctctttcagcaatgggtgaggcttgttcaagaatggacctaactgcaatacatcagatcttggttgcgacacactacagagacgatgaaggaactaatgagttgtcttttcaagagtggactcaacagatgagagatatgctggaagcaaggaagcgcggagaccatgcattccgtgacaaggactttaggacagccattgataactattcccagtttattgatgttggaacaatggtctccccaactgtgtttgcaaggcgcagtctatgctatctgttatgtgatcaaccagatcctgcgctacgagatgcaatgcaagcacagtgcgtttatccagactggcccacggctttctacatgcaatcagttgctcttgcaaaactggacatgcacaaggatgcggctgatatgttaaatgaggcagctgcattggaagagaagaggcaaagaggagcgagaggatcatag

SEQ ID NO: 19646 - DNA, 2076 bp, Glycine max
  Peptide Sequence Number=SeqID_136424
atgaagagaacgaaaagtgatcctcccaactcgaggaggtttagattgtctcattttttgtttggcattggggtgttgtacttgttgtttgtgtcatgtaagtttccacagtttttgagaattgtatcaacgttaagtggggatgggagtgaagataggttggagggggcagctgttggggactctgaagattcagatttgagtaaatcttttgtgagttctgtttataaagatgcatttcacaggagattggaagataatagggaccaggagggtgcccccttgagaccaaacacggagccaaagaaggaggaagagcgtcttccggaatctccgaagcagattccactgcgatatggtaggataactgggaagataatgcgggaatataagaggaccaatgatttgtctgtgcttgagaggatggcggatgaggcgtggatattgggattgaaggcttggaaggaagtagataaggttgatgagaagggttcgatgaaaaactcggtccttgatggaaagcccgagtcatgcccttcttgggtgtcaatgaatggggatgagttgattaaaggagatagtttgatgtttcttccctgtgggcttgcagctggttcttcaatcactgtggtggggacaccccatcatgctcataaggagtatgttccccagcttgccaagatgaagagaggtggagggttggttttagtttcacaattcatggttgaattgcaagggctgaagtcagtggatggggaggatcctccgaagattcttcacttgaatcctcgaataaggggggattggagcagacagccagtaattgagcataatacctgttacagaatgcactggggaacctctcaaagatgtgatggtctaccgtctggggatgaagaagaaatgcttgttgatggatacagacggtgtgagaaatggttgcggaatgatattatagattctaaagagtccaagacgacatcctggtttaagcggtttatagggcgtgagcaaaagccagaaatgacctggccatttcctttagttgagggcagaatgtttgtccttacattgcgtgctggtgttgatggataccatattaatattgggggccgccatgtaacttcatttccatatcggactttttccccgtctaatcttcaggggtttacacttgaggatgctacaggattggcaattaaaggggatgtggatgttcattcaatttatgctacttctcttcctacttcccatccaagtttctcacctcaaagagtactggaaatgtcagagacctggaaagcctcacctttacctaaacatcctattaaactttttattggagttctttcagcttcaaatcactttgcagaacgtatggcagttagaaagacatggatgcaatcagctgcaatcaagtcttcagatgtagtagcacggttctttgttgcactgaatccaagggcggaagtaaatgcagtgctgaagaaggaggctgcttactttggtgatattgtcattttgccctttatggaccgctatgagcttgttgtgcttaaaactgtgggcattagtgagtttgggattcagaatgtgactgctgcatatgttatgaaatgtgatgatgatacatttattagggttgatactgtcttggaagaaattgagaaggtaccccagggaaaatccctttatatgggcaatctcaatcttcggcatcggcctctgaggaatggcaaatgggcagtcacttatgaggaatggccagaagaagtatatcctccttatgcaaatgggcctgcatatgtaatttctagtgatattgttactttcatccgatctcaacacaaggataggaaactaaggctgtttaaaatggaggatgtaagcatgggaatgtgggttgagcgatataacaataccattgcagcagtccagtactcccacaattggaagttttgtcagtatggatgcatggagggctacttcactgcacattaccaatcaccaaggcagatgatctgtctttgggacaaattgtcaagaggtcgagctcgttgctgcaacttcagatga

SEQ ID NO: 19647 - DNA, 930 bp, Glycine max
  Peptide Sequence Number=SeqID_136425
atgggttgttgccaatcatcgacgttgctgagagtgggagagagggagactcaccctgaaaaggaaaaggaaaaagaccaccagaggctctctgaggccgagaaagagggctttgatttctccttctctgagttctcgctggctgagctgaaggcggccaccaacaatttcagctctgactatatcgtgtctgagagtggggagaaggcacccaaccttgtttacaagggtcgcctccagaaccatagccgctggattgccgtcaagaagttcagcaagtctgcttggcctgatcccaagcaattcgtcgaagaggcttccggcgtcggcaagttgcgccatccaaggctcgctattttgatcggtttctgctgcgacggcgatgagaggcttctcgttgccgagtacatgcctaatgatactcttgccaagcatcttttccactgggaaactcagactattgagtgggctatgcggttgcgagtcgctctttacatcgcccaggctttgcattattgcagctctgagggtcgtcccttgtaccatgacttgaatgcttaccgtgttctcttcgaccaggaaggcgatccccgtctctcttgctttggttttatgaagaacagcagggatggaagggtcacgcctgaaagtgtcatttacagctttggaaccgttcttctagacctcctcagtggcaagcacatccctcccagtcaagcacttgatatgatacaggggaaaaacaatatgctcttaatggattcacatttagaggggaagttttcaacagaagaggcaacggtagttgttaatcttgcctctaaatgtttgcaatatgaaccaagggagcggcctgatacaaaggatttggtcacaacacttgccccgttgcatacaaaacccgatgtacagaccccttctctaacttaa

SEQ ID NO: 19648 - DNA, 1158 bp, Glycine max
  Peptide Sequence Number=SeqID_136426
atggaaaatagaggtgagagtgccgatgctgagcttcaacttgacgctgattttgtgccggttcctgcccagacatgtactggaaatgaaaagagtaacaaggcctcccggattcctcagtctagacgacctaatttatcctcactgcaaataccagcatggtcactagatattgcattatctacttttgcaaagactgatggtccttcggtttcacgatcaagtcctggttccacaagaggacttcccccaaggccaaattcagccaaagtcaggtcttcaatgagaggtttacttcctcagaggagcttcaagataaatgcctgttcccaggatattgaaaggacaggtctcatagttcccaacactcccccatcagatgctcctttggacaaaccttccacttcaacttctctgtctcttaataatagggttatctccccatcaacaaaagtttcacattcattaccagttactccatttgcaacttcaagtgcagagaatgaacatggaagacatctagggcgtgattctgatttaagtacaatggaagttcatcagcatatgacacgatcattttcagtcccagttgatggcaaagccactaatttaagggttacagattctaggggcttgattcgtgtaatttcagcaaaacgacatcttgaaactgttggtggaaagtcaactgatggtgctttcgttccagagattgccattgaagatgctactgaggatattccagaggaacaagcagtttgcaggatttgtttggtggagcttggggaaggagggaatacacttaagatggaatgcagttgtaaaggtgatcttgcacttgctcaccaagaatgtgcagtaaagtggtttagtattaagggaaacaggacctgtgatgtctgcaagctggatgtccagaacctcccagtaacactgttgaaaatttataatcctctaactcctgctaggcaggcatcaaatgtgccacaacagtcagaaatagtttattacaggatctggcaggatgtaccagtacttatcttggtcagcatgcttgcgtacttttgttttctagagcaactactgttgttagtaggtaattctgaaagtataacctcatctactgggagtttagcaattttctcagtttacagatga

SEQ ID NO: 19649 - DNA, 342 bp, Glycine max
  Peptide Sequence Number=SeqID_136427
atggagtatacggttaagtctgtgagcaggagtttcgtatgggcttatgcttgcttccagtttgcaactcttatcctgttagctcatctcaattttaatgcaattctctccattctcctttctacgttcactggatttgggattgccatcagtatgaattctctcgttatggaattcatcggatggagaactagcaggcaggttcaatcctcctttgtaaatgttaactggacagagcagcagcatcgtgagcatgtacaagaacagggacaggaagatggaggacaacatcagcgacaaagacaacaagagcatcatctgccgcagcatggcaacagttga

SEQ ID NO: 19650 - DNA, 186 bp, Glycine max
  Peptide Sequence Number=SeqID_136428
atggaccttcgcaacaaggttggcggtgacaaaggacgtgtgcggcatgagggggagagggagggtgatggccatgaaggaggtggcggtgctgcgacatgtaaaaggttggagcaaagggcgatggtagtgttgtggcgtggcggaggtggcgtagcggagttgatgaggaggtgcgaaaagtaa

SEQ ID NO: 19651 - DNA, 213 bp, Glycine max
  Peptide Sequence Number=SeqID_136429
atggaggaaaacactacaggcttgcattctgaagccctattgatacatgtctcgcgaggcctttccataaagaaatcacttgagaatttcctccagaggagaagaaagaaaaggtctcttgaaaagtctagatctgctggtcagagtggtctgctacatttcttgaatgaagaagggctgatcgccaacccaccatcaccacagctttgttaa

SEQ ID NO: 19652 - DNA, 1029 bp, Glycine max
  Peptide Sequence Number=SeqID_136430
atggtagatcaaatgtggcttctcatgggaggaaagcaagcatccgggacttttatgcggcttcttggtagcttggagaagttggacatttgtaagaaaagtcattctagcatagatggtattagttatggcaagaaaatgatggaaggtgatgggaaactaatcaatatcgatctggaaagagaagatgaatgtggcatatgcttagagccttgcaccaaaatggttttgcctaattgctgtcatgccatgtgtatcaaatgctaccgcaagtggaacacaaggtcagaatcttgtcctttttgccgtggtagcttaaggagagttaattctgaggatctatgggtactcacttgtaatgaagatgttgttgatgctgaaacagtttccaaggaagacttgttgcgtttctacctttatatcaacagcctacctaaagatcaccctgatgcacttttcttaatggctttgtttcaccaagggtatttcatcggatctacatccgttgcttgccccttgtcttcaattcgctctgatcgcaacaaagaacttggaggtactcgtgatctcataaatcagtatagactttggccctactatgaattcttctgcaagaagtcactcccagtgtcaatttcagagacacattatcttcacaatgtggtgggtgacacaaaaatcaggaagggagaaggaatggaactggatcagctctgtaaaaacacagacacgagtgagaaaaaagcttgcttatgtccttttgacttggatgtactcagtgaagctttccatatgagggatatgaatccagtccacctttcttctgggctaccaaatgcagtgcccaagttagaaaaccagtctagagatcatgagaggaagaacaaaaaggtaaaagataaaggtgagaagtataggaagcagaagcatagattacatcgagtaaataatggaagttgtatagagaacatcagaattagaccccatgatcctcatcccttgctgcagttgaagaaccaacgaggcaag

SEQ ID NO: 19653 - DNA, 252 bp, Glycine max
  Peptide Sequence Number=SeqID_136431
gttaaatctgttgggaggtttaaggaaacaaaacggaccgaaggaatatccacgtccgatgttataatgaggattgtcaaagattataaccaatatgtgctgcggaacttggatcgtgggtactcaagaaacgagcttggcgaaaagcgactgagggtgaatagaaggttgaaaacattacaagagaaagtgaaggaacatcaagaaaaagttggcgaaaaggagctaagaatgtcaggtaaagtgctttga

SEQ ID NO: 19654 - DNA, 252 bp, Glycine max
  Peptide Sequence Number=SeqID_136432
atgaatcccttccatgataatcacacttatgatttggtgaagtttcctaaaagcaagaaggtagagcaaatgaatgtgaaaattgtgttctttcatgatgatttagaggaagagaattgtatgaagcaacctgatagttttcaggttgaaagaaagaaggactacctatataggttaagcaaatatttgttgtttgcaaataatcaaagtgcactcatcttaagggaccattttacaacttctaataaataa

SEQ ID NO: 19655 - DNA, 1719 bp, Glycine max
  Peptide Sequence Number=SeqID_136433
atgccacttgagactggtatcactgtatcagtaagagatttatatctgtcaagcactcaagctgttcatgaagttggattggattggactatccaaaagcccgagctcaacaaactgaggctacatgccctgaaaaaacttcgtgaaaggaaagaagcatatgacatagtgatcagcgatgtgaacatgcctgacatggatggtttcaaacttctggagcaagtaggacttgagatggatcttcctgttatcatgatgtctgttgatggagaaacaagcagggtgatgaaaggtgttcaacatggagcatgtgattatctccttaagcctataaggatgaaagaactgcgaaacatatggcaacatgtctttagaaaaaggatgcatgaggcaagagattttgaaagccatgagggttttgactttgagggcattcacttaatgagaaatggatcagatcactctgatgatggtaacctgtttgctgtagaagaaactacgtcaattaagaaaagaaaagatgcagataacaaacatgatgacaaagaatttggagatcattttcccacaaagaaagctagagtagtttggtctgtggatcttcatcagaagtttgtcaaagcagtgaatcaaatcggatttgataaagttggtcccaagaaaattctagatctgatgaatgttccatggttgactagagaaaatgttgctagtcacttgcagaaatacaggctctacttgagtaggttgcaaaaggaaaatgatcagaaatcttcatcaagtggaataaagcactcggattcaccttcgaaagatctaggaagttttagttttctgaacactgcaaacaagcaacaaaatgatattgccactgacagcttcagttattcagatggaactttactaattcagatggatgctacaagttatgaaggtgatctcaagggaattgtgtcagagcctacaacagaaaaaagaagagcttccactagtgaaattccggatccaaaggtacaaaaaagttcgcagaagagcctcaacaaaccttttacatctgtagagtcatcagaagcaaaccatgcagtctttgattgcaccataccaacagaatactcttggagtgagtttccaaaaggtccactcaaagaagaacagaagacacctgttcaattagaggatagcctctgccagttgccattgcatggtacacagcatcacattcagattgatcaatcacaatcaattgcctcaattaattccaatccctctataacagaagaagaggttgctgccaaattagagaccaaacctttgtatgctggttacgagagtgattatgtgaatcctgtgagttcaataggatctgcagttgaagcctttcgtagtcagtccaaaagccttatggtgagtgatcaatcttcagagcccactttcacctcgaatttgagcttgaagactcagggattcaatctagattgcatttctgatctggatttttaccaaaggaacctattattgggtggtgaggtagcttctgcacctttggatgaggacctgaatttctttttgctacaaagtgaatgctacaacatgaattttggactgcagaatatagatatgtcagagtattatgatccaaggcttactgctgaagtccctagccacttttatgattcagcagattattcatcggtagatcaaagtctattcattgcatga

SEQ ID NO: 19656 - DNA, 1434 bp, Glycine max
  Peptide Sequence Number=SeqID_136434
atggagttcatatcaagagaaaccatcaaaccctcgaaccccacccctcctcacctcagaatccatcctctctccttcatagatcacatcgtttttcgcaactacatccccttgcttttcttttacaactccccaaaccatgagcaagcatccacaatatcaaaactcaagaaatccttatcccaagttttatcccgatactacccttttgcaggcaagctcagagatcaagtttccatcgactgcaacgaccaaggagtgtcctttctagtcacaaggctgagatgcaacctatcaacgatcctccaaaaccccacagaagaatcgttgaaccctttgttccccgatgaactacagtggaaacctatgagtagcagtagtagttcaagtataatagccatacaaataaactgttttgcatgcggaggaatagcaatgagcgtgtgcatgtgtcacaaagttggagacgcggccacactttcaaatttcatcaacgactgggccacacttaaccgccaaaaagaactagaacaagaaacagcagagttgttattattacccttcccagtacccggggcttcacttttcccgcaagaaaacttgcccgttttcccagaagttttgttcgtggaaaacgacaccgtatgcagaaggtttgtcttcgaggcctccaagatcgactccctcaaatccacggtgtcttcccacaacgtcccgaaccccacgcgcgtagaagtcgtcagcgcgttgatttacaaccgcgcggtttcggctctagggttgatttccaagacgacgtcgttccgcaccgccgtgaaccttcgcacgagaacggttccgccgctcccggagaagagcgtggggaacttggtctggttcctcttcgtgcttagcccttgggaaacggagctgcatgagttggtgctcaaaatgaaacaaggcttaaccgagttttgtgaaacgtatgcgaagaaatttggaggggaggataaggacatgtcgttcatctccgagtgtctgaagcaagctgcttcggttcccgaaccacagcctggtggttcggatgatgaggagagtcaaatagtaactatgttttgttgtgcgagttggtgcaggtttccgatgtatgaagcggattttggttgggggaaaccggtgtggttcaccactagtaagtgtcccgtgaagaatagcattgttttgatggataccagagatgggggtgggattgaagccatcgtgaacatggaggagcaagacatggccaggtttgagcgtgacgtggagcttctgaaatatgcttctcttaatcctgctgttggacatgttgaaattgttgcagcacgtgattcaaccgataaaaataaggattctaatgctttagtgtttgcttgggggtgtattgcgcaatgtaatgtgtacatgaataattaa

SEQ ID NO: 19657 - DNA, 309 bp, Glycine max
  Peptide Sequence Number=SeqID_136435
atggaaacagaaaaaaggattgctggatatcatgttttgatctcaaatatctatgcagaggaaggagagtgggaaaaagttgatagagtgagaaatcagatgaaggaaaaaggtttgcaaaaggaaatgggatgtagttgggttgagattgctgggcatgtgaacttctttgtatccagagatgagaagcacccccaaagtggtgagatatattatatcttggacaaattgactatgggcatgaaggatgctggttataagccacgcaacaattccaatttaaataggattttggaatctagtgactga

SEQ ID NO: 19658 - DNA, 1473 bp, Glycine max
  Peptide Sequence Number=SeqID_136436
atggagaaagttaggccagctaagcgttgggagaaaggaaggaagaccttatcatctccgaatttcattttcagaagcctctttgggaatcaaatccgaagcatgatgcattgtgcgagcattgtctcggctccgtcctacgcgttcccttttctctctggctccgcttccactactccaactgcgatctcgctcactaagcgcagttggaagccacctccgagcatggcaaaaggcccagtcagagccaccgtttctatagagaaagagaccccggaggccaatcgtcccgaaacgtttctcagaggagtggacgaggcccagtcttccacttcggttcgggcccgcttcgagaagatgataagggaggcccaggacaccgtgtgcagtgccctcgaggccgctgatggtggggcccagttcaaggaggacgtttggtccaggcccggtggcggcggtggcattagcagggtccttcaagacggtgccgtttgggagaaggctggggttaatgtctctgttgtttacggtgtcatgccacctgacgcatatcgtgctgccaagggtgttcctaccgatcaaaaacctggtcctgtgcctttcttcgctgctggaatcagctccgttttacacccaaagaacccgtttgcccctaccctacatttcaactatcgctattttgaaaccgatgctcctaaagtcaagctgttgctttctgcagatgctcctggagcacctagacaatggtggtttggtgggggaactgacttgacaccagcttacatttttgaggaggatgttaagcacttccattcagaacggttttggcaaatgcttaaggattctgcaatcaagattcaaaaacaagcctgtgacaagtttgaacctactttttacccccgattcaagaaatggtgtgatgattacttttatatcaaggctctcataattaataagcaagaaacaaatggtggtaaatggataacagcaatgactgtcggtaataatgaaatgatgggaatgggaagaagatatgtgatgcaggggaagcaagatgatgactatgcagttatgatcatggtggtagtagtgcatcgaggtgaaaggagagggcttggaggaatattttttgatgatcttaatgactatgatcaggagatgctcctttcctttgctactgaatgtgcaaattctgttattcctgcttatttacctatcatagagaaaaggaaggatttgcccttcaatgatcatcagaaagcatggcaacaattgcgaaggggacgatatgttgaattcaatttggtatatgataggggtacaacatttggactgaaaactggagggagaatagagagtatacttgtttctctcccactgactgctcggtgggaatacgatcataaaccggaagaaggaagcgaagaatggaaactcttggacgcatgcatcaaccccaaggaatggatctaa

SEQ ID NO: 19659 - DNA, 1915 bp, Glycine max
  Peptide Sequence Number=SeqID_136437
atggcttcttctacggttgttcccgttcctcctgttccagttgagggcggaaagccaagccgcggcattagcattcggtctcgcctaagcaaactgtgccaagaggggcaacctcacttggcacgccatcttctggacactcttccacgcgcctccaccgcggtgtggaacaccgtcatcatcggcttcatctgcaaccacatgcctttggaagccctccagctctacgctgaaatgaagtccaccccctgcaccccttccgattgctacaccttctcttccaccctcaaggcctgctccctaacccaaaacctcatgaccggtaaggcccttcattcccatcttcttcgctcccaatccaactctcgaatcgtctacaactccctcttgaacatgtactcctcctgcttgccccctcaatcccaacacgactacgtcctcaaagttttcgccgttatgcgcaaacgtaacgtcgtcgcttggaacaccttgatttcatggttcgtcaaaacccaccgacaccttcacgcccttcgcgccttcgcaaccctcattaaaacttccattactccatctcccgttactttcgtcaatgtcttccccgctgtccctgatcctaaaaccgctcttatgttttatgccttgcttcttaaatttggtgccgactatgtcaatgacgtctttgctgttagctccgcaatcgttttgttttctgatcttggttgcttagaccatgctaggatggtttttgaccgttgttccaacaaaaatacagaggtttggaacaccatgattggtggttatgttcaaaataactgtcctcttcaaggggttgatgttttcgttcgtgccctggagtcagaggaggccgtgtgcgatgaggtcacttttctgtccgttatctctgctgtttcccagctgcagcaaattaaattggctcatcagctacatgcatttgttctaaaaaatttggcagctactccagttattgttgtcaatgctatcatggttatgtactccagatgcaattttgttgatacttcctttaaggtttttgataacatgtctcaaagggatgctgtttcgtggaatactataatttcttccttcgtacagaatggtttggatgaggaagcactcatgcttgtgtgcgagatgcagaagcagaagtttccgatcgattccgtcaccatgacggcccttctttctgcggcttctaacatgaggagctcttacattggacggcaaacccatgcatacctaattcgccacgggatacagtttgagggtatggagagttatctgattgatatgtatgcgaaatccaggttgattaggacttctgagttgttatttcagcagaattgcccaagtgatagagatctggccacatggaatgctatgattgctggttatacacagaacgagctcagtgacaaagccattctcattcttagagaggcattagttcacaaggtaattccaaatgcagtgaccttagcgtccattctcccagcctgtagttcaatgggaagtacgacctttgctaggcaacttcacggatttgccatacgtcatttcttggatgaaaatgtttttgtgggaactgctttagtggacacgtattccaaatcgggcgcaatcagttatgccgaaaatgtttttatcagaacaccagagaggaattctgttacatacaccacaatgataatgagctatggtcagcatggaatgggtaaggaagctcttgccttgtatgattccatgctgagatgtgggattaagcctgatgcagttacttttgttgccatcttgtctgcttgcagttatagtggtttggttgaagaagacatgttagggagggttgggagggtggtcgaagcctatgagtttgtccagagattgcgtgaggatg

SEQ ID NO: 19660 - DNA, 726 bp, Glycine max
  Peptide Sequence Number=SeqID_136438
atggctccgaaggccaaaccggcgccatcgcagcctgctcctcctcctgccctcgaagatctcttcaccacgctcaaccgccacatccaggcttccgcatacgacaatgccgtcaagctcacagatcagattctcgccattgctcccggcgacgaggacgcgctccgatgcaaggtcgtcgcgctgataaaaaatgaccgcgtcgaggacgcgctctccgccattcattcctctaagaagcagcttgatgattttcatttcctcaaggcacagaaactgaggaagaaggaaccaaagatttgtaggcaacatacctccaatcaaactcaagcatgcaaattgttattaagtcattggaaaatctctgaggcatactgcttatacagacaaaacaagttggatgaagccttggagtctttgaaaagacaagagagcaatgatgaaactatgcttttggaatgtcagatattgtatcgacttgggaaaatggatgcttgcttagatatctaccgcaagttccaaaattccaagattgataacatggaaataaattctgttgctgccctagttatggctggcaggtcatctgaagttcaaggaatgttggattcacttcgggttaaggcaacaagtagctttgaattggcatacaatactgcttgttctttaattgcaaggaataagtactcagatgcagagcaactattattgtcaggccgaaggtga

SEQ ID NO: 19661 - DNA, 1608 bp, Glycine max
  Peptide Sequence Number=SeqID_136439
atggagatgcaacaactcctcagtatgggcttcccggacgagttagccgcccaagccttggctgccaccggcggcaaatccaccgtgaaagccaccgaatggattctctctcacaagcccaactcttccacattccagcccaagctcgatcgcttcttccattcccaatcacaagaacatgacgaaccctccaaacgccccaaaccttctccttctccttctccttctccagcacaaccacaacactggccctctttcttctttaagatcgcagacaagaaacacgccaacacccacattcacgaacccttgtacgagcggttgcgtcccagaacccttgacgacgtcgtcggtcaggagcatctcctcgcccccaactcccttcttcgctccgcaatccaacgcaaccgcctcccctccatcctcctgtggggcccacccggcaccggcaagaccactatcgccaaagccatcgtcaactccaccccttctactaactcttaccgcttcgtctccttatctgccgtcaccagcggcgtcaaagacgtcagggacgccgtcgacgaggccagaaaactcagactcaaatccaaccaaaccaccgttctcttcgtggacgaggttcacaggttcaacaagtcccaacaggactctttcttacccgtcattgaagatggcagcattgtcttccttggggccaccaccgaaaacccttctttccatttgatcacccctctcttgtctcgttgccgcgtactcactcttaaccctctccaaccccatcaccttgccttgcttctgaaccgcgctgtcactcacactgacaaagggttgatgcagagcgtgggggttcatgttgatgtgagcgaggaagttgttgattttataagcaacaactgtgatggggatgctcgggtggccttgaatgccttggagattgcagctgttaccgcagctgcaaggctacaacaagggatggaattggatcttcacacgaacgaggaatgcaaggatgatgttgctgctgctgctgctgttgttgttagtgttgctgatgcaaaggaggcacttcagtgcaagcatgttgcttatgataaagctggggaagagcactataatgtaatcagtgcgttgcacaagtctatgaggggaagtgatgcaaatgcagctatttattggttggcaagaatgttagaggggggtgaagagcctctttacattgcacgcagactcatacggtttgcaagtgaggatgttggtttggctgatccgttggctctgaatcaggccgtctcatgctaccaagcatgccacttcataggaatgccagaatgcaatgtcattcttgctcagtgtgttgcttacttggccttggcacctaagtctgttgctgtttatcgagccataggagccgctcagaaggcagtgagggaatcggctggacacaatgagggtgtgcctctccatttgaggaatgctccaaccaaattaatgaaggacattggatatgggaagggatacatctacactcccgacaatcccaccgcaacacaaacttacttaccaccatcacttctgggtcacaagttcctcgattggcctgagtga

SEQ ID NO: 19662 - DNA, 1986 bp, Glycine max
  Peptide Sequence Number=SeqID_136440
atgggggtgccaacttggagaaaaccagtgatctactgggtttgccttttcgtcattatcaatgcgtttgtacaaattagcaatgcattttatcttccgggaagctacatgcatacttactcaaatggagatccgatatatgccaaggttaattcattaacttctattgagaccgagcttccctacagctactacagtctcccttactgcaagccccttggtaaaataaagaaaagcgctgagaatcttggagagctcctcaggggagatcagattcataactctccctaccttttccacatgaatgttaatcagtcaatctacctctgtattacgaccgccttgaatgagaatgaggtaaagctactgaaacaaagaactcgtgatctgtatcaagtaaatatgatccttgacaatttgcctgttatgaggtttgccaatcaaaatgggattaagatccagtggacggggttccctgttggctacacaccacctgatggtagtgcagattacatcattaaccatctcaaattcacggtcttggttcatgaatatgaaggaaatggtgttgaaatcattgggactggggaggaaggtatgggtgttatttctgaagctgacaagaagaaggtatccggatatgaaattgttggctttcaggttaccccttgcagtgttaagcgcgaccctgaagtcatgacaaaactccacatgtatgacaatatctactcgacaaactgtccatctgagctagacaagtaccaaccgattaaagagcaagagaggatatcatttacatatgaagttgagttcgtgaaaagtgatataagatggccatcgcgttgggatgcttacttaaagatggagggctcccgggtgcattggttctccatcctaaattcattgatggtgatctttttcctagccggtattgtctttgtcattttcttgagaactgtaagaagggacttgactcggtatgaggagttggacaaagaggcacaagctcagatgaatgaggagctttctggatggaagcttgttgtgggtgatgtatttagagagcctgatggttcgaagcttctctgtgtgatggttggggatggggttcagattcttggaatggctgctgtgactattgtttttgcagccctgggtttcatgtcaccagcttccaggggtatgctgcttaccgggatgataattttatatcttttcctgggaattgctgctggatatgtcagtgtacgtctatggaggaccattaagggaacctcggaagggtggagatccatttcctggttatctgcatgcttttttcctggaattgcttttattattctaacaggactgaattttcttctctggggcagcaaaagtactggtgctattcccatttccctgtattttgagttgctcttcctctggttctgcatatcagttccacttaccctcatcggaggatttatggggacaaaagctcagcaaattgaatatcctgtgcgaactaaccagattcctagggagattcctgcacgtaaatatccgtcatggcttcttgttcttggtgcaggaactcttccatttggaacccttttcattgagcttttctttatcctttccagtatctggcttgggaggttctattatgtatttggtttcttgttggttgttcttctattgctggttattgtttgtgctgaagtgtcagtggtcctcacatatatgcatctttgtgtggaagattggcagtggtggtggaagtcattctttgcttcaggctctgttgctctttatgtcttcctgtactccattaactacttggttttcgacctgcagagtttgagtggacctgtctcagctatactttatctcggctattccctgctcatggcaattgcaatcatgttgtcaactggaaccgttggcttccttatgtcattttactttgtgcactacttgttctcatcagtaaagatagattga

SEQ ID NO: 19663 - DNA, 663 bp, Glycine max
  Peptide Sequence Number=SeqID_136441
atgagccagaccaagaacttcaacctgcccgacctgggcgaaggcctgccggacgcgaccatcgtcgagtggttcgtcaaggaaggcgatgtgatcaagctggacgagccgctggtctcgatggagaccgccaaggccgtggtggaagtgccctcgccgttctccggcaaggtgctgaagctgtccggcggcgccggcgacatcatcccgaccggctcggtgctggccagcttcgaactggacccgaacctgccgcagcgtgccgatggccaggacaccggccacagccatggtcacgccgcacctgccgctgcaccgacgccgccgccgctgccggccgctgccgcaccggtcgcggtggaagaagccaagcccgccgcggccgagcgtgatgacgccggtaccgtggtcggcgcgatgcagagctccaatgccgtgcacgcggagcaggcgctggccgtcggtggcgtcaaggccgtgccggccgtgcgtgcgatggcgcgcaagctgggcgtggacctgagccgcgtggccgctaccggcaccgatggcgcggtgacgatggccgacgtcaagcaggccgccgccaacggcaccgccaagcttggcgccgctccggcaccggtcgctgccgcggcgtatgcagcgccggccccggcgcag

SEQ ID NO: 19664 - DNA, 363 bp, Glycine max
  Peptide Sequence Number=SeqID_136442
atgaagcttcaccatctcgccgctttccacatccagctcgcgggcgtcgtagtcgcacagggcttcggcgcgaccctcgtccagcagctgcaaccaggcgatgggcgcccatccagcgcgcccatcgttggtgcgtacccaggcaaacgccggccattcctcgtcacggacacctacttcgacgatctggccggtgtggaaccggagcggattgggatactggctgcggtaagcccccagaaggcgggcccgcatgtcagccggccgccaccgcgcgcttggctgcagccacgatccgctcaacgctcggcaggtacttcatttccaggcggaacagcggaatgtgggtgtcgtagccagtaa

SEQ ID NO: 19665 - DNA, 507 bp, Glycine max
  Peptide Sequence Number=SeqID_136443
atggctgccaaactcactctatcttctcccttttccttcaaaacttcatttctgccaaaatcaccatcattttctctaggtttatactcccccagaactaatgttaccggtgtcaaagttcatgctaaattaggtggtggagatgaacaagccaagaaaggaggaaagaagaaattcataaccagagaggaagaaccacaacagtattggcagacagcaggagaaagggaaggagagaatcccatgaagacccctcttccttacattatcatatttggtatgtcaactccttttgtaatcttggcaattgcttttgcaaatggttggattaagccatcgccaggggaggaattgccatttcacttttatatatctgtcccttattttaaagcatttaaatggctcttaatgtatgttcaagttcaaccatcgaaattacccatgataaaacctgggcatttgccatttggcaattggtcggtttcagaagctgatggcatcatctga

SEQ ID NO: 19666 - DNA, 678 bp, Glycine max
  Peptide Sequence Number=SeqID_136444
atgaagaagatactagtatcaatcaagtttctgctttgtttatctctgctctgtgttttgttcttatcatttcctttactccttcaatccttgaagccatccctcatgcaattcttcagctacatggttgaaaaaagctacatgttccttctctgcaatggcctccttcttgttttaatagccatcaactctgctccaatcaatgcctcttcaccaccaacaactgaacgtgctgctgtagctgttcacatagaagagaaaagtagccagttagaatccaaggaaccagacattgcagttgcagcaccaattgctggtgaggaaactgaatccccacataaagaagaaaagattttggtgagagtagaacaagacaatgtgctatcagatacccaagaagaagaagaagaaaaagaagaagaagaagaagaagaagaagaagaagaagaagaagaagaagaagaagaagaagaagaagaaaaagaagaagaagaagaagaagagggaaatgtccttgtgatcattgatgaagataagcatgacactgaagagttaaataagaaatgtgaagattttattaaaaggatgaaagcaacgttctcttccaataacttggagctaagagctgtcgacagtttttattttgataatcagaaattgccggtggctgttaattaa

SEQ ID NO: 19667 - DNA, 330 bp, Glycine max
  Peptide Sequence Number=SeqID_136445
atgggtttgataagcggaaaccagtttgggccgttaaggaataatgaaaactctaacaagttacaacctaaagcaagattgtggtccccaatgcaccaaatcaaaaattgtattctctccttcccatctgacgagaaacctaaggtcctagaggaaaacaatgatttggttgaggaagaatacaaaaccaacagttcctcagactcatcaattttgctgattaagatattattcacaatcccttttgattatctaacaatcgaaataattattgagcaaaagaacatagcagaatcatccaatggagtcaatggacgacctggtttttaa

SEQ ID NO: 19668 - DNA, 987 bp, Glycine max
  Peptide Sequence Number=SeqID_136446
atgggtagtaacagcagaggaaaggatggtgaaggcacttctggagttaaaaaggatgagtacgaacaagacatcaaatttctgccacctgaagtgctttatggcaatactaatggattcactgatccattggtggttcagttacctccacatggccctggaccatatgagccaccacctcctttgctcatacaaccccagtatatccatgaggggaaagaaagaaatttgatcaaagcaataagaaataagcttcctatcaaggtgggatgcttctcaaccttctctagactgcttttaccgtttaacagtgatttgtggaattggaatggtacaagtaaagtccctgtggctgccatgcaaatgcaaagaccagcagcggtagcgcaatccctgccacaaaatggatatgtagaatctgtgattcatgaaaggctgaaaagtgtgaggataacatggaaccatgcagccacggatgttgctattgcaggatcatgggataactggaagaccacggagcccctgatgagagtagatcaaaattttgtcattgttaaaacactcccgataggtatctatcattaccgtttcattgtagatggctacttgacacatgctccagagttcccatcggcttctgatgattcaggttatggctacaatatattggatttgcaggattatatcccagaaatagttgcaaacttctccgattttgaagatcctccatcaccaccatcgagttatgataacacatacttaaatgaagaggagttcagcaagcccccgccagaattaccacctcaactaccagtggcaataagacatgaggcttcttcatccgcaagtggtagtcgttttgtccctaggcccacgcatttggaactgaatcatctatacatccacaaaactgatagggggaaagatgatgaagcattaagatttttgtctgctattgaacttgcctcgtctaagctgcccttatga

SEQ ID NO: 19669 - DNA, 3036 bp, Glycine max
  Peptide Sequence Number=SeqID_136447
atgatactctgctacaggcgattgttacacaatgcaagtcatgctcgttctacccagttagctttgtcagagcagttgctacatcactgcaactcatctcaccaccacctccattttccacctttgaatttggactataatcgatacagagattcttgcaccgtggaagatgcccatcagcttcatctgcagatctacaaaactgggctcaccagtgatgttttctggtgtaatactcttgtcaacatatttgtcagagctggcaatctggtttccgcacagaaactgtttgatgaaatgccccaaaagaacctcgtttcttggtcttgtttggtttctgggtatgcacaaaatggcatgcctgatgaggcatgtatgttattcagagggatcatttcagctggtctcttaccaaaccactatgctattggtagtgctcttcgagcatgccaggagcttggtccaaatatgcttaaactcgggatggagattcatggcttaatttccaaatctccgtatgcttcagacatggtgttgtctaatgtgctcatgtccatgtattcacattgctcagcttccattgatgatgcccgtcgtgtttttgaagaaataaaaatgaaaacttctgcatcctggaattctatcatttcggtctattgtcgtaggggagatgcaatttctgcttttaagctattttcaagcatgcaaagggaagctacagaacttaactgcaggcctaatgaatataccttctgtagcttagtaactgttgcatgctctctggttgactgtggactgactttgcttgagcagatgctggccaggattgaaaaatctagctttgtaaaagatttgtatgttggtagtgcattggtcagcgggtttgcaaggtatggtttaatagattctgctaaaatgatatttgagcagatggatgatcgtaatgcagtgactatgaatgggttaatggttggactggcaaggcagcaccagggtgaagaagcagctaagatattcaaggaaatgaaagatttagttgaaataaatgcatcatcttatgcagttcttttaagtgcttttactgaattttcaaatttaaaggaagggaagagaaagggtcaagaggttcatgcttatctgattcgcaatgccttggttgatgtctggattttgattggaaatgctctcgtcaatttgtatgcaaaatgcaatgccattgataatgctcggtcaatttttcaactcatgcccagtaaagatactgtttcatggaactctataatctctggccttgaccacaatgagcgatttgaggaagcagttgcatgtttccacacaatgaggagaaatggaatggtgccatcaaaattctcagttattagtactttgagttcatgtgctagtttgggttggatcatgttaggacaacagatacacggtgaagggataaaatgcgggcttgatttggacgtttcagtttcaaatgctcttctaacattatatgctgaaactgattgtatggaggaatatcagaaagttttctttctaatgccagagtatgatcaagtttcttggaattcttttattggtgcactagcaacttcagaggcgtcagttttacaggctataaaatatttcctggagatgatgcaagctggatggaaacccaacagagtaacatttataaatattttatctgcagtttcttctctttctcttcttgaactgggccgtcaaattcatgctttaatcttaaagcactctgtcgctgatgacaatgctattgagaatacacttctagctttctatggaaagtgtgagcagatggaggactgtgaaattatcttttctagaatgtctgagcgaagagatgaagtcagttggaatgccatgatttctggatatatacacaatggcatcctgcataaggccatgggtttggtatggcttatgatgcaaaagggccaaagattggatgatttcacgcttgctactgttcttagtgcctgtgcttcagttgcaacattagagcgtggtatggaagtacatgcatgtgccataagagcttgtttagaagctgaagttgttgttggtagtgcactagttgacatgtatgcaaaatgtggaaagatagattatgcatcaagattctttgaattgatgcctgtgaggaacatatattcttggaattcaatgatttctggttatgcacgccatggacatggaggaaaagctctaaagctttttacacaaatgaaacagcatggccaattgccagatcatgtcacctttgttggggtcctatcagcttgtagtcatgtaggtttagttgatgaaggatttgagcatttcaaatcaatgggtgaagtatatgaactagctcctcgaatagagcacttctcttgtatggtagacctccttgggcgggcaggtgatgttaagaagctggaggaattcatcaaaacaatgccaatgaatcctaatgcccttatttggagaacaattttaggagcatgttgtcgagctaatagccgaaatacagagctagggcgtagggctgccaagatgcttattgagttagagccgctgaacgcagtgaactatgtgcttctttctaacatgcatgctgctggtgggaagtgggaagatgtggaagaggctaggttggcaatgaggaatgcagaagttaagaaggaagctgggtgtagttgggtcaccatgaaggatggagttcatgtgtttgtggctggagatcaaacacacccagaaaaagaaaaaatctatgacaaactcaaggagataatgaacaaaatgagggacctgggatatgtgcctgaaaccaaatatgcactctatgatcttgagcttgaaaacaaagaagagcttctcagctatcatagtgagaaactagcgattgcttttgttctcactcgccaatctgagctacctattaggataattaagaaccttcggattcaaatagatttcaccattttgatggtggcatatgttcttgtcaggattattggtgactga

SEQ ID NO: 19670 - DNA, 666 bp, Glycine max
  Peptide Sequence Number=SeqID_136448
atgtgcagtgatgaaattggagatcgcccacgcccactacctaaaattgatgagttgaagggtgcagttgatgtaactgaaagaaagggtgatccatcatgggattatgatccggagaaggggtgctggttgtggaagaagcctccacccgaaagcaagaaaccagtggacattaaatctgaaaatggaacaacaatcagagttaaacggaaagcagaaaatgtgtccgtgaaagaaaggcttttgaaagagtttggttgtcaaatttgtcgcaaggttatggcttcccctctcactacaccttgtgctcacaacttctgcaaagcctgtttggagggtgccttttctggccaaagtttcatcagaaatagggcatgtggaggtggacgcactttacgagcacagaaaaatgttatgaaatgcccatcttgttcaaatgacattgctgactttctccagaatccacaggttaatagagaaatgctggctgttatagaatcattacaacgccaggctgaagaaaattctgaagagttaagtgataaaaatgatgaaaatctgcatgatccaacagaggtttctaaacccagtgattctactgataaggtcttggaggaaattaaggacaatgagctgaatcagccacacaagcgaaggaaggagtga

SEQ ID NO: 19671 - DNA, 292 bp, Glycine max
  Peptide Sequence Number=SeqID_136449
atgtcagttttagaattatacatagaaaaggatgttgttggtggttctgcgtttcattctgcaaattctgttagatcatgtgaaaataatttatctaataatgagtcggaaccgccaagaaatgtaagcaatttacatgaggatgaagatgaagataataatgattatcttgtgtctaattcatacgttgaagactctttagatgaagatgatagtgttgatggtatatctgatacagatgatgaagtcgccgacatggttcaaccagttacaattgttcaaccaagagaag

SEQ ID NO: 19672 - DNA, 308 bp, Glycine max
  Peptide Sequence Number=SeqID_136450
tgatgataccttattcaaactgcggaagcttcttgatgattacatgctggagaagcaaaaatcccaggcaaaagctggacaatgtgaaatggagcttctgaatgaatcagggttcagcaattcatcaatgcaaccttgcaaagatgcaggcaatgaacaggttgaggaggatgtggacattgttggtgggaatgatcctcctatttccaattatccttcattagagattgaaaatgatgttaccaagagaaacagtaaatgcagtagctcaagcagctctagtagtgaatctggctcttcatccagtg

SEQ ID NO: 19673 - DNA, 168 bp, Glycine max
  Peptide Sequence Number=SeqID_136451
atggtcaaaaagagtactctaatgaagagtacggccatgctctttgggagaacagctgtgcttatctcagtacacccatggtcaagttattatttgcttgtctatgcccatgacggactaattttcacctttcaagggttatcatataatccatttgtgaatccctaa

SEQ ID NO: 19674 - DNA, 1407 bp, Glycine max
  Peptide Sequence Number=SeqID_136452
atggcaatgcagggttgttattgtcactatacgaagttggcaactcaaagaagaacactggaaaatctcagtttttcaggctcaatttcggttaacaaattgtcaaagaatgaaaggaccagaacatgtgatccattatcagcagggaacaatcaatttcataggttactggtgaaaatgcggcagacagaaatgcctgcctcgaagtatggaacaaatggtaaagctgttagaatggtagggacaaatgagttagtgaaaagaaagagaatgttagagaataaggtgttgaatggttcagcaacttcaaaggtagtgagaaaaaatggtatcacaggcttgaacaagacagtgaaatctagaaggtcattggaagagctaaaggttttagccacagatgaaggtttcagttgggccaatgaaaattacagttcctggcagaggtctattgatgtttggtcttttgtggcttctttacgcattcggattatgttggacaatgcaaaatggacatatttcggaggtttcacagaggcaaagcagaaaagcagaaggcggaaaactgcctcgtggttaaggaagtgtgtattgcagcttggtccaactttcattaaacttggtcagttatcatcaacaaggtcagatctatttccacgtgaatttgtggatgagctcgcaaaattacaggacatggttcctgccttctctcctaagaaagcaagaaaattcatcgagagtgaattgggagctcccattaacatattatttgaggagtttgaagatcggccaattgctgctgctagtctcggtcaggttcatcgtgctattctgcataatggggaaaaagtagtcatcaaagttcaaaggcctggtctgaagaagcttttcgacattgatttgaaaaacttaaagttgattgcagagtattttcagagaagtgaaacttttggtggtccacttagagattggattggaatatatgaagaatgtaaaactattttgtatcaagaaattgattatataaatgaaggaaagaatgctgacagattccgccgagattttagaaacataaagtgggttcggatacctctggtatattgggattatactgctttaaaggtgttgaccatggagtatgtaccaggcatcaaaatagaccaggtggatacattaacttcgcgtggttatgatcgattgcgtatctcatcacgtgctacggaggcgtacctgattcagatattgaaaacaggtttctttcatgccgatcctcatcctggaaatcttgctattgatgtggacgaagcaattatttattatgactttggcatgatgggacagatcaaatcttttacccgggagagactgcttgaacttttctatgccatatatgaaaaggattccaaaaag

SEQ ID NO: 19675 - DNA, 492 bp, Glycine max
  Peptide Sequence Number=SeqID_136453
atggagtatgtaccaggcatcaaaatagaccaggtggatacattaacttcgcgtggttatgatcgattgcgtatctcatcacgtgctacggaggcgtacctgattcagatattgaaaacaggtttctttcatgccgatcctcatcctggaaatcttgctattgatgtggacgaagcaattatttattatgactttggcatgatgggacagatcaaatcttttacccgggagagactgcttgaacttttctatgccatatatgaaaaggattccaaaaaggttatgcaacgccttatagatctcggagccctccaacctactggggacttgtcatcagtgaggagatctgtgcagtttttcctggaccatttgctaagccaggcaccagatcaggagcagaccctttctgcaattggggaggataagctgaaggtggagaattattccaaactatctggagaatctagtccagactttattattgactattga

SEQ ID NO: 19676 - DNA, 978 bp, Glycine max
  Peptide Sequence Number=SeqID_136454
atggagggtaatttctcaatggcaacaacaacaacaaccggtgatgttgactttggtgacctttctgaagggaacttgttggagagcatcaacttcgacgacctcttcgtcggcatcgacatcaacggagatgtcttgccggacctggagatgttccatgagttctccgtcgacgtcaacaccggcgaggaatcgtcggagatgaactcatcggcagataacagcaaagttgagaatgatcagaatgtcatgatcaacactggtccaaaaaaagaagaggaagaagataaagcttcttgcaattcttcgggtcaagacttggggtcaatccgaggagaagagattgtgagcaagagagatgaatccgtggtggtgaatccagcaccaaaggatggtggaaaaggaagaaaatcttcatccgctcaatcgaagaataataatagtagtaataatgctcaagggaagagaaaagtcaaggtggattggaccccagaattgcacaggcgattcgtgcaagctgtggaacagctaggagtggataaggcggtgccttcaaggattttggagattatgggaattgattgtctaactcgccataacattgctagtcaccttcaatggccaaaagtgtcaaagaaatatagatctcataggaaacatttgctagcacgtgaagctgaagcagcaagctggagtcaaaggaggcaattgtatgctggtggagggaagagagaggggaatccatggttagcaccaatcatgggtttcccaccaatgaccaccccaatgcaccattttagacctctacatgtatgggggcacccttctatgtccttggtgcacatgtggcctaagcatctttcaaattcaccaccactcttatggccgctatcgccaccagctgtaccaccacaagacccttcattttggcaacaactggttagctctctaaacttaaccaatcaatcaaacctttga

SEQ ID NO: 19677 - DNA, 486 bp, Glycine max
  Peptide Sequence Number=SeqID_136455
ccgtgaagtttggtgacatgcgggggtaccgtatggttatccgcaccattcgtcaaccaggggcaaacgagactgttgatgcgcagagactaacgtcgtcttctgtaccctttgtcaatcaggggcaagcaaactcgttgacacgcggagacttacatcgtcttctgtgcctttgtcgtcctaacccgcggaggtaccgtatggttatcctcatctttcgtcaacaaggggcaaacgagcccgttgatgcgcagagactaacgtcgtcttctgcacgttttgtcatccagggacagggagtcaggtggcaggcggagataccttatggtcgtctgcacctttcgtcaaccaaggcgaacgagttcgacggtatcaggatgatgtcttttactctcatcgtctggagacattcaagcccgatgacgcatgagattcttctctgctgggcggggacaatcaagtttgattgcgtgtggaaacgttgtg

SEQ ID NO: 19678 - DNA, 216 bp, Glycine max
  Peptide Sequence Number=SeqID_136456
atggcttccaacatctcgcccgctgcctttgataaagaacagatatttggaatggctgaaaaggagatggaatatagggttgaattattcaacaagtacaaggagtctgagctaaatatgggtgaaaatagttgcattgaccgctgtgtttcaaaatactggcatgtgactaatctagttggtcagctgcttggttctgggaggtctccaatgtaa

SEQ ID NO: 19679 - DNA, 804 bp, Glycine max
  Peptide Sequence Number=SeqID_136457
aacaacattgaggaagcagttatgggagggaatcagaagcagcaggtagtatctgatgaagaagccttcttgtttggcatggaactagcgggtgcctctgctgtctctatggttctcaagtcagctttggagcttggcatcttagaaactatagccaaggctggtcctggagcttacctttccccttctcacatagctacaacatacttacatactccctccatcaactgcctcatgggattgtctgatatctctagcatcacaatgaagaaaattcttgagacctataatggctttgagggtgttggatctgtggttgatgttggcggtgggactggagctattattaatatggtggcctctaagtatcccaccacaaagtgtgttaattttgacttaccccacgtcatcaaagaagctccagcttatacaggtgtggaacatattagtggagacatgtttgtgagtgttccaaaaggtgacgtcatttttatgaagtgggtatgccatgactggaatgatgagcaatgcttgaaattgttgaagaattgttatgattcccttcctgacgacactggaaaagtgattttggctgaaggcattagtccagaaaccccagattctaacttagctgcaaggtgtgagtttcaaatggatgttatcatgttgtgtcatagcccaaatggaaaagagagaacagagaaagagtacaaggccttggctaaaggagctggattccatggtttccgaatagcatcttgtgttctcaacacacatgttatggaatttcttaaaaaggcttaa

SEQ ID NO: 19680 - DNA, 546 bp, Glycine max
  Peptide Sequence Number=SeqID_136458
atgaagcaaaaagtaaagggaccttctggcgagcaaatacaagattttcgggacaagaccagtgagaagttcgattttgtggctcacaaatccggggtccataaattctgcttcaccaacaagtctccttatcatgaaactgttgattttgatgtacatgttggtcacttctcttactttgagcaacatgcaaaagatgagcatttcacccctttgctggagcagattgggaagttggaggaagctctatacaacattcagtttgaacagcattggttagaggctcagactgaccgccaagcaatagataccataccaaaagagaccaccctgttgagaacattgctccctatctctttgacaatgttcactgttcactgttcactgttcactgttgaggacattgattatgtgaacgatgcaatgagcagaagagcagtacacaaggcaatttttgaatcagcagcactgattggggctagtgcgctgcaagtctaccttctgcagcgattgtttgaacgaaagttgggtacctcgagagtttag

SEQ ID NO: 19681 - DNA, 285 bp, Glycine max
  Peptide Sequence Number=SeqID_136459
atggagttcatccgctttggtgtcgtcagacccaccgccatcggtgccatagtcgatcttctagcacttcctctcattgaaaatctcggtcttcttgcgcttcctcaaatcttcaaggacaccgagaagctgatggtggatcgtgtggatccttgtgtcgaaagtcttattgacaatgtggaagtcgagcggcacatttcaatggcagttgctaaaggcggtgcaagtcgagaccatctaatactcatgaaacaaattgcggggattataccaagcatgaaataa

SEQ ID NO: 19682 - DNA, 288 bp, Glycine max
  Peptide Sequence Number=SeqID_136460
atggtacatgaccaatctgctatcataataggacatgaatgcccatatagcaaagacaataaccctctgaaaccccccaaaaagagagagagagagagagagagaagaaaaacaaaaacaaacaaaaatcaaaacctcattgatgttgtggatgaaagtgctgcctatattgttagaaaaaccaccaatattgttcataattttgctggtggtaaacaacaccaaaggggtgcctatgccatcaccaatggccccaaagagaccaaaaatcatgaggaaccagtctaa

SEQ ID NO: 19683 - DNA, 303 bp, Glycine max
  Peptide Sequence Number=SeqID_136461
atggctttggttggagggagtggctctggaaaatccactgcgatatcacttttgcaaagattttatgacccaattgaggcagagatatttcttgatggtgtggccattcaagaagaggttgtggaggtagcaaaagcttccaatgctcataatttcatttcacagttgccacaaggatatgatactcagcatgaggttcttcatagtcatccacctatttatctgctcccccgaacacaagttcaagatcatcacaggatccaaacacaacaacacacagggagtgagttatcacattcctag

SEQ ID NO: 19684 - DNA, 300 bp, Glycine max
  Peptide Sequence Number=SeqID_136462
atgagaaacggacgtgcaccgcaatccgcacttcaacgctgcgagcctccactcgttcctctttcgcgaatacgaatgagcctccacttcttcgagatggcacacaggtcatggcacaggcgagctcattatgcgtactcacggtgtgagctcaacaatggacgttggagcttcagggagagagagcgaggttttgataacgggtcacaacacgcagatgatgtgcatcagggagagagagcgaggtttgagggagagaggggtttaagatacagagctccagagagaggtttaagctag

SEQ ID NO: 19685 - DNA, 636 bp, Glycine max
  Peptide Sequence Number=SeqID_136463
atggatctacccagaaccttccctggtcacccatggctggacactcctgagggacatgctgctctcaggcgtgttcttgttgcctattcttttcgtgattctgatgttgggtattgtcagggattaaattacgttgcagcattgttgttgcttgtcatgaagacagaagaagatgcattttggatgcttgctgtcttgttggaaaacgtcctgaaatggaaattcaggattgctactcatttggaagctttggaatttgatgtttcccttgttaccactgagtggttcctttgcctcttttcaaaaagcctgccttccgagacaacccttcgtgtgtgggatgttatcttctatgagggtgctaaggttatatttaacgtggccttggcaatctttaagatgaaggaagatgaattagttataacccatcacgttggcgaagtaatcaatattctgcagattaccactcatcacctatttgatccagatgatctattgacagtggcatttgataagataggttccatgacaacaaataccatatcaaagcaaaggaagaagcaagagcctgaagtgatgaaggagcttgatcagaggatcagacggctaaattcccttagaatggaggacaaatag

SEQ ID NO: 19686 - DNA, 336 bp, Glycine max
  Peptide Sequence Number=SeqID_136464
atggtgggttacacaccttcaagctttgcggatttggtcttcaccggtgaaaggatcaaagtgggtttggaaagaggtatatctgatcatcctgctttaataaatgcaaaaactggggcaaatgaagaggatgagaatgagggagaaacccttgctatgactgccattcctacacggtcaaatttcccatcagcccaacaatgtcattactcagccaatatctgtccttctcattacccaccatctagtcatccagaaaggccatccctaaatcaaccacaaagcctgcccgccgcacatctggtgccaaaacaccaaccaaaaggaattttgtag

SEQ ID NO: 19687 - DNA, 147 bp, Glycine max
  Peptide Sequence Number=SeqID_136465
atgacttattacgttgcattgaagcttgggatgagcaaaaccctgctagagagcatcactggccaatatcaaagcatgaaattgctatctcgccaaagttacagcttggtggtaatcccccaaccaaaccagcgcaaaggtcaatga

SEQ ID NO: 19688 - DNA, 397 bp, Glycine max
  Peptide Sequence Number=SeqID_136466
atggccaccgctgatgccttggaacgagaaaccaagaaggcccaaaaggaagaacacgacgagctaaaggcttaccttaggtcgaaaagaaatttgtcccaacagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagggtaattgattcatggcaccaagaggcaacaatgtggacggaccgatttgctcttactttgaacaggagtcaagaacttccccgattgctagccaaggccaaagcaatggcggacacctactccgcccccaagaagatccacggacttctcagctatt

SEQ ID NO: 19689 - DNA, 909 bp, Glycine max
  Peptide Sequence Number=SeqID_136467
atggagttttctatgattttcattgttagcaacattatgctgcttttcagttcagcatttgccaaaactgctagtcctccctctctgagcccaactccagcaccagccccggcaccagacttcgtgaacctcactgagttactcagtgttgctggtccgtttcacaccttccttggataccttgagtccactaaagtgattgacactttccaaaaccaagccaacaacactgaagaaggaattaccatctttgttcctaaggacagtgccttcaatgctataaagaaaactaccctatccaacctcacctctaaccagctaaagcaagtgatcctcttccatgccttgccacatttctattctctggctgagttcacaagccttagccaaaccagctctactcccacattcgccggaggagattacactttgaatttcactgatgattctgggacagtgcacattaattcaggatggtccaagaccagggtgagcagtgctgttcattccacagatcctgttgcaatatatcaagttgacaaggtgctactccctgaggccatttttggcactgatatacctcctgcacctgctcctgcaccaactcctgatattgcccctgctgctgattctccaactgaacacagtgcagatagcaagcatcatctccatcatccactcatgatggctcctcttctcacaagctcatcagctatggaatctgggccaaccttgtcttggcaacttttgtacagtttcactcaggcaggcacaattccaataacagttatagcggagacagaagtgtatattaaggtttttatgaactggatgcatctcagtcaaatgcaaattgggtttggaggttggacctttactgttccagttggactccttgccagaagctga

SEQ ID NO: 19690 - DNA, 1686 bp, Glycine max
  Peptide Sequence Number=SeqID_136468
atgtctagttttgtcggcgtccttgtttctgatcaatggcttcagagccagttcactcaagtcgaacttcgaaccctcaaatccaagtatgtgtcggaaaggactcaatcgggacgtgttactgtcggaaatttgccacctatttttaagaaattaaagggtttctctgaactgttcaccgaggatgagattaaggatgccttggcagagtcatatcagaacatggatgaagagattgattttgagtcgttccttagggcacatttaaatcttcaatcccgagcaatagctaaagatggtggttcaaaaagttcttcttcattcctgaaggcagctacaacaactgttcatcatgcaattaatgaatctgagaaagcgtcttatgttgcacatattaacaactacttggctgaagataaattcatgagtcagtttcttccaattgatccatcaacaaatgcattgtttgatcttgcaaaagatggagtccttctttgcaagcttattaatattgctgttcctgggaccatagatgatcgagctattaacacaaaaagggttcttaatccatgggaaaggaatgagaaccatacccttggcctcaattcggccaaggctattgggtgcacggtggttaatattggtacacaggatttaattgaaggaagaccccatctggtacttggtttgatttcacaagtaatcaagattcaattgttagctgatctcaatctgaagaaaactcctcaacttgtggaattagtggaagatgacaaggatgtggaggagcttatcagtttagcacctgataagctcttattgaaatggatgaatttccacttgaagaaagctggatatgagaaacaagttacaaacttctcttctgacctaaaggatggagaggcttatgcttacttgcttaatgctcttgccccagaagtggcaggtccatctgccctagccacaagtgatccaacagaaagggcaaacatggttcttgagcaggcagagaaattagattgcaagagatacctcactccaaaggacatagtggaggggtcacctaatcttaatcttgcatttgttgctcaaattttccagcataggaatggccttacaacagttgacagccagaaaatgtcctttgctgagatgatgactgatgatgcagagacatctcgggaagaacgatgctttagactatggattaacagtcttggaattgccacttatgtcaataatgtttttgaggatgtcagaaatggatgggttctattagaagttcttgacaaggtttcacctgcatctgtcaattggaagttggccacaaagcctcctataaagatgccgtttcggaaagttgagaactgcaaccaagttataaagattgggaaggaactaaacttttcattagtgaatgttgctggtaatgatattgtacaagggaataagaagctcttattggaaaatgcatcatctgttttattgtgccacgcctccccatcccaccctgttgcccttcgcattgtgaactttgaacaaatcactcacttttccaacctaagtctcaactccacctatccttatccaccaaacttctacttcgaggtcagcaacaagggtgccatttccttttttgtggtggacaccaccaagttcaagttccaaaaggaggacaagatctga

SEQ ID NO: 19691 - DNA, 684 bp, Glycine max
  Peptide Sequence Number=SeqID_136469
atggggttcgatgaaaacaaagaaaccggagagaaaagtgatcatgcaaatgaagaacattataaaagtgaaggcgagcccttgagcaggcacgtgaatgagtcctctatccatgcaactgaagatgaggaggatgaagttggatccaaattacaattgggtcctcagtgcactcttaaagagcaccttgagaaagataaggatgatgagagtttaagaagatggaaggaacaactacttggaagtgtggatgtgaacaatgttgcagaaattctggaccctgaagtgaatattacttgtttgtctatcatctctcctgatagagatgacattgttctttccattcctgagaatgggaatccaaagggtttatggtttactcttaaagaaggttgtcattaccgcttgaaattcaccttccatgtgagcaataatattgtgtctggcttgaaatacaccaatactgtttggaagactggtgtcaaagtggatagctcaaaagagatgcttggaactttcagccctcaggcagagccttacacacatgagatgccagaagaaaccacaccctctgggctatttgcaagaggatcatattctgcaagatcaaagtttcttgatgatgacaacaaatgctacttggagatcaactatacttttgatattaggaaggaatgggcttga

SEQ ID NO: 19692 - DNA, 561 bp, Glycine max
  Peptide Sequence Number=SeqID_136470
atgaatcctagcttggtaaataattcttcaccgactcatcccagatggagaaaagtagcttatggtggtatgcaacctggttatgatgacaatcatacagatgaatctttccttgaaggaatggtcatgaatgccagtgttgtaaaacgggacatgctaaaggtgatgctggactcggtttccatttctgaatatttatgtattgttgctcttgttgtcttggtctggacttgtacacttgcatcaactattgatgaaaattctctccttcttattgatgtaggtcttcttgtttcagtagctgcatcacttctcatacttcacctttttctgcatgactattcagaatccaccgtcaaagccccgggggttctgaagaatcctgcattgaccagttgtatctctgtaaatgcttctgtagtcgcctctgtttttattgcttctcgccttccatcgagactacatgtgtttgctatcatgttattctcattgcaggagtacaagtttgagatcaatggaccttgggatgaggctaaactttgttttgatattacagactaa

SEQ ID NO: 19693 - DNA, 117 bp, Glycine max
  Peptide Sequence Number=SeqID_136471
atgagaatgttgggaactgtgactactagagctattcttgatgttagtgcaaccctcacattaagtgcggttgtcacgcttagtgagtatgacggtaagctcgcgcttagcgtgtga

SEQ ID NO: 19694 - DNA, 1482 bp, Glycine max
  Peptide Sequence Number=SeqID_136472
atggcaactgcagcatcaagaagacctaggtggcgccaccacgctcctcctcctcccacccccaggatccttcacttccctcgccggagaccctcttcccggagggaccttaaatccaatactactaacaggttgtgggctctcattgatcgagaaagacgtgcacgtgttccaatagtggtgttggacaacaacaacaacagttccgagggtgagaggcggagggagagagttgagagcagaagtcagagtccaaaagggtgggctttggaggaagaaaagtggaagtttcaagcggaaatgttgagagcagaatgtaacctgttgaggatggagaaggagattgcggttaagaagttagagaggactcgtgttcagatggagactactctaagatctgcacttcacacacttgtttctgttagtgccccttctctctttcctactccatattctcttattgtcttcatttcaacattgactaaaagatcatacaatatgatcaaagcagtttgtgatgagggaagaatcaagatttgtgaagggaagaatgttgatatggttttggatgaggagattcatgagttgacactgaaacttcagagattgcacaggaggtcgaaagtcaaggatttaggggccaggaagaacagaaattttgacaagcaggtttctgttctgcagaggcgactggagcagattggagggtcatcagatgagatttatttgagggagtttcaagagatggaaaacataagcttgtcaattaaaagaagtagcatagttgatgacaacgttgttgcaagtggaaaactaaatgtggagattttgaggaggaaaatggagggattgtcaaagggcatattattacagagaatggaggaagagtataattcactgctgtccactgctagtagttctcttgctagttctggttcaaattccaaaagacttgaatatcaagattcatcttcggtacgagtacctcatcaggaaaaattgttttgtgaagggaatccatgttctggacattgcaagactgttgtacgaagaattgtagagcaagttagaacagaaactgagcaatggtcacaaatgcaggagatgctaggtaaggtgcaagaatggaaagaaaaagctctttcatctgaaagtaaaacaaatgagcttgaagcagaactctccgtactccgtggtgatctgaggaaggaacagacggcagctaaggggatcaaatgttcacccactcccgtggacacacagaatgagttggagaagcgaatagtggtttgtagttcaaaggaaaaaaataaagttacagaaaatagcaagcataatgatgtttcaagaaaagcacatggtggtagaggtggtgatggattgttagtcccaaaacgatcaccactccgagacattgggaactcatcattgttgattacgcagaatctatcctcatttgttataaatcataaatcactataa

SEQ ID NO: 19695 - DNA, 471 bp, Glycine max
  Peptide Sequence Number=SeqID_136473
atggtatcgttgttttggaactcagcaatgataagaggaagagatgaagtgtatgcggcagcaatgcctctaagggctacaaagagaccaccccagttgcttatgtctgctgcttactccctcaatttctgggatttccagcatttcatggtcatcatcaaaccctcttcaccttctcaggttctgggttttgattttcaaccaaaagatcctgaagatatatatgtggcactagcggctctaaatggtagagcagtgccggggactgttctgccaagaaacaaatgttggcttgttggatattcaaaggcagaggcggatgctgtggaaatagcaagggaattcaacaaagaatgggaaacaaatttgaggattggccttcatgattgtcatgattataccaatactttggtttggcaactcactggtgaaaaagatgtgctgaaacgtctgagaaacattggtagttag

SEQ ID NO: 19696 - DNA, 2703 bp, Glycine max
  Peptide Sequence Number=SeqID_136474
atggaatgtgacgttggaggtgtctctgattcatgcattttgcacacttgcaagagaagaagggtttataaaggctgctttcatccatccattgatatcatgacagaaactgaagcttccctacctatcttgaactcgtccggttattataccaaaccatctttgaaggaattagtggccagggaactcgttgaacctggttattgcagccgtgtccctgatttcactgttggaagatttggttatggatatgtcaggtatctcaatgaaactgatgtcagggggttacgtatagatgaaattgtgaagtttcataggcatgagatagttgtatacagtgatgaaaatgataagcctgctgttggccagggccttaacaaggcagctgaagtagttttggtattagacagtgaaatattgaagtctaaggaggggaaggaagatgttatggttagcaaattaaaacaaattacaaagagacagaaggcacaatttatttcctttgatctagtgactggtgagtggaaattcttagttggacacttcagcagatttgggtttggtgatgatgatgaggaagacattgctatggatgatgctgaggtatatgatgttgagaaagaatcaccatcaaataccaatgaacttgaactttctcattctcttccttctcatcttaggcttgatcctgttaaaatgagagaaatgagattattgatgtttcctgatgaagaagaggtagaggacttaagttgcaaatcatcttctggtaagcagtatgtgcggcctttacaaagttctgctcaggcaatcaaccatcgatccaccccaccagttgctagaaaaactccatttccattacttgagtataaacatgggaattttgattcaaattctcctggaggaattttgatggttcagcagcataagggcatgcctcttaggacgataaaatcacaaggttttaagctagatctcaaacatgaaactccagtatctggaaactatgctcacaatatagttgatgctggtctgtttatgggtaagtcatttcgagttgggtggggaccaaatggcattcttgtacactccggtgcacccgtaggaagcagtggtaatcacaaactgttatcatctgttgtcaatttggagaaagttgctttcgacaatgtggtcagggatgaaaataaaaaagtgactgaggaacttattgatcatgctttggtatctccattaaattttcacaaaggaataaaccatgtgatgaaagaagttgaaattggtccctgcaagttgacacttcaaaagcttgaagctaatcgttcaaccctgtctgagatttctcatcactattgtgatcttattgagcggcaattgagtgttcctgggttatcttccactactcgtttgggtttgacacaccaagtaatgacctgggagttaattagagttcttttttctgacagagaacaaaaaggtcaagtagaatctttgggtgctgacaatgaggaagatatgatgcaggatataaaggaaatttgtcaagatgttgaccgagaagcactccctctaatgaggagggcagagtttagttattggttgcgagagagtgtttcctatcatgttcaaaatcaaataagctctctaaatgattctgattatctgcagcatatatttgtactcctgactgggcggcaactagatgaagcagtgcagctggctgtgtccaaaggagatgtgaggttggcttgtttgttaagtcaggctggtggttctactgtgaatcgctctgatattgcaaggcaacttgatatttggagaaataaaggcctggattttagtttcattgaaaaggacagattgagactctatgaattgcttgcaggaaatattcatgatgcattgcatgacgtcaaaattgactggaggaggttcttaggtttattaatgtggtacaaattaccaccaaacacttcattacccattgcttttcagacttataaacattttgttgatgagggaacagctccatatcctgttcccctttttattgatgaaggaacatcagaggaggctatgtttagtgcattctcttctacccctgatccacttgattatcatatgatttggcatcaacgagcagtcttggaagctgtgggtgttatcaattctaatgatcttcatattctagacatgtcatttgtgtctcagctgttgtgtgtagggaaatgtcattgggccctatatgtggtccttcacttgccccttcgtgaagattatccatatcttcatgtaaatctgattcgggaaatattgttccaatactgtgaaacttggagttcagatgaatctcagcaacagttcattgaggatttaggcattcccacagattggatgcatgaggctttggattctcttgaaagtaaaaatgctgcttgtcaggattttgtcagtcagctaaatgaatccctagctgtttggggttgcagattacctgttgatgcaagggtggtgtattcaagaatggcaggcgagatatgtgatttgctactatcaggtgtaggtgagggtgctacccgtgatgagcagtttaactgctttgacactgctttcagtgctcccattccagaagaccaacgctctggtcacttgcaggatgcagtgtatctttttaccagctatctctcagagattgctacgtaa

SEQ ID NO: 19697 - DNA, 531 bp, Glycine max
  Peptide Sequence Number=SeqID_136475
atggacatgaagttgaatattccagcaattaatgttttattcttattgctagctatttctagtacaactcaatcggttgacattaatataaaaaaatttggcggaggtgcagatataacacaggctttgacaaaagcttgggaagaggcatgcgcagcaacaagtgcaagcaaaattgtgattcctggtgggtcatacaagatggaagcagttgatttaaaaggtccttgcatggctcccattgaaattcagtttgatggcacacttcaagcaccggctgacccgaatgcactcgacggggctgatgaatggctcaaagtacaacatgttaacttttttaccttatcaggtaaaggtgtttttgatggtcaaggtgcaactgcttggaaacaaaatgattgtggaactaacaagaattgcaagaaacgttccaagggtgcaataacttcacatttgatggtttccacgtcagtgctccaaataccagtatcaacactgacgggattcacattggaagatcaactgatgtga

SEQ ID NO: 19698 - DNA, 282 bp, Glycine max
  Peptide Sequence Number=SeqID_136476
atgaagtttttgccagttgtagaaatcctcaaatatcggcctttgtggtttcgcgattgtcaagctgttgatgttctcaatgtgctacccacaacaaatagtggaaccattgagctgctttataaggcatattcaactcatctattttatgttatgccaggggtttcaacgaggcactcaatgggtttactgatgagggatggagctcaagttatattgcccctagcacacacaattgagcatgaggaggtaataaactggccggtactaattatgcaatag

SEQ ID NO: 19699 - DNA, 996 bp, Glycine max
  Peptide Sequence Number=SeqID_136477
atgaagaaagctcttttcaagccaaagcccaaaacaccagtggagctcgtgcgccacgcccgggaactcatcatctttctcgactccaaaacatgcactcgtgaaagtaaacgcgaagagaagctatcagacctaagcaaaacggtactggagataagaactgttctttatggaaacggagaattagagccaaatgctgaggcgtgttctcagatcacacgagagtttttcaaagatgacacatttcgccttttcattctctatctgtcaaatcttaatctcggggcacgccaagatgcgacccacgtgattgcaaatttgcaaaggcagcgaattaattcgcaactaattgcttctcagtacctggaaaaaaatctagatcttgtggacatgctcatagacggtactgtgctggataaatggttaatgaaggttgacttaattagttatgagaaagagggtgacattgctttgtcgtatggtgcggttgcaagggagtgcatacgccaccagagcgtagcaaggcatattttggaatcagagcacatgaagaagttttttgactatattcagctaccaaattttgaaatagcatcagatgctgttgcaacttttaaagagttattgacaaggcacaaatctacagttgctgaatttctttctaaaaattatgactggatattatcagctaaaacgttttactgtgcttgtcagttcttcaaagagtacaactctcaattgcttgaatccaccagttattttactagacggtacgctatcaagctatttgttgcaaatcaaaataagcctcctgagattgtcagcatccttgttacaaacaaacataagcttttgcaatttttggacaactttaatagcgacaaagcggacgagcattttcaagcagataaacaacaagtaataaatgagataataactcttgaacaagaggatcgtccatgcacatctttggacaattgtgaagttccatgttga

SEQ ID NO: 19700 - DNA, 159 bp, Glycine max
  Peptide Sequence Number=SeqID_136478
atgccctacaagctctacatggagaatcttaacctgtgtatgaaggagtcctggtcaatctcgtatttgggcaatagggtgatggagacaggtgtgagccaaatgaagcgatatggagaaaaagatggactaatcgatgggttcactttaaacatatga

SEQ ID NO: 19701 - DNA, 894 bp, Glycine max
  Peptide Sequence Number=SeqID_136479
atgaccggaacacgtgccttaatagctttcccggacccaaactccggccaaatagtgcttctatcatatattcttgaccccacagtgaagcttcaaaaatctccactgctctctcgcccccttgacatccacctcctatcctccaccgccgccatgtacggcggcaaaatggccaccgtgcacaacggcgccgccatccaaatcttcggcacggtgaaactgcaaacgaacaagaccaagattcaccttgtttggaacaggggactttacgttcaggggtactcgcccaccattcatccaactacttccaccgatctggcttccattgcaacctttgacgtgttgtcgggttcatctgctccacagcacacggatctcacgacgttgagagtgatccatggcaccgttaacgccatatcgtggggcattttgttaccaatgggagccatcacggcacgctaccttaggcacattcaagctctcggccctgcatggttctatgctcatgcaggaatacaactgtttggtttcgttctgggaacagtggggtttgtgatcggaatccggctggggcaactgtcgccgggagtggagtataggctccaccggaagcttggaatggcggtgttttgtctgggggctctgcagactctggcgttgttatttaggccaaacaccaggaacaagttcaggaagtactggaagtcttaccaccattttggatttgaagttatgggggccagcagatcttatgccaagttgacttactgcttagggctctctactctcattgggctttgcattgctttggaggtcaactcttgggttgtcttctgtaggaaatccaaggaagacaagatgaggagagagggactcattggaacttcccactaa

SEQ ID NO: 19702 - DNA, 408 bp, Glycine max
  Peptide Sequence Number=SeqID_136480
atgccccatccaacccaccctgaaggtgatatgaagcttccaaaaaagactagttctaaggttgagttgtgggggtggaatgtccatgctatggaggcttgttgggttgggaggttcatgcatttttcaaaggttttcgtggcggtttccacggtgcaatgggatgacaatgcaatgtggggaagggaacacacaagggagaggaaagacaaggtgtatgtgcgtttggtagaaatgggacaatgtgatcgggttttaaaatttgtatctagcggtgggagtagagggcaatatagtatatcaaacgagatattattatgtcgatcgagtgcggctactccttttgattatagtcattgtcttcacgagatacgaaggttgatgtttgcatattgtgcttggctttga

SEQ ID NO: 19703 - DNA, 237 bp, Glycine max
  Peptide Sequence Number=SeqID_136481
atgaatctcaatttctctagtcttggtgaagataatccagtgaagcaggtgaattgtgaattttgcacaccactattgttactgaatttcggttttaagacgcaagatgtttggttttctagagctaactggagtgcctgttttgagggttcagatatagagatagattacaagggaatgttaaggcttgagtttttgagttactgtttaggtttatgggatttgagtgagatgtaa

SEQ ID NO: 19704 - DNA, 448 bp, Glycine max
  Peptide Sequence Number=SeqID_136482
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaacggctcagccggaggtaggtccagcggctggagagcaccgcacgtcgc

SEQ ID NO: 19705 - DNA, 426 bp, Glycine max
  Peptide Sequence Number=SeqID_136483
atgggtcagattctacaggaccaaaccttgtgggagttaaggaatgatggaagaaaagaaataaaaaaaaaatgggacaaaaggattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgtactagtgcgttgtag

SEQ ID NO: 19706 - DNA, 159 bp, Glycine max
  Peptide Sequence Number=SeqID_136484
atgcatatgacacagatgcaatttacgaatacgggagcccgagaaactgtctccttcttagatacaacgtctaggggtagcaaagtgccccaacaggggatcaagacagaacccatgtgtgatgcatatgcgaaaggcgcaacacgggaatgtatatag

SEQ ID NO: 19707 - DNA, 576 bp, Glycine max
  Peptide Sequence Number=SeqID_136485
atggaatatctaagctctgattccgttgataaatcagaaaccaatgaagattcgtatttccaatcaattactactaaattccttaattcattgaacacatccggtttgccaactcattctatcaaacttaaaattggaagtcctataatgctgttaaggaacctcgaccaaaatcaaggtctatgtaatggtattagattagtggtaacaaagatgacaaaacatgtaattgcagctgaaattatctctggtaaaaacattgacctcgccgtttatattccaagaatgtcaatgtcgccttcacaatcaccctggccgtttaaactattgaaaagacaatttccgattatgctatcttatgcaatggcaattaacaagtcacagggactattgctatccatggttggactttatttgccaaaacctgtattcactcatggccaattatatgttgcattgttaagggtcaactcaacaaaaggattaaaaatcctgattcatgatgatgagcagaaaagcatgaattccactaccaatgtagtattcaaagaagtgttcagaaacattaaaagataa

SEQ ID NO: 19708 - DNA, 657 bp, Glycine max
  Peptide Sequence Number=SeqID_136486
atgatagatgttcctcaaaacactaattcagttagaaatgtgacactcaatggtttccgctgggtgttaaacttcatgtggctaaaatttttactgatctggcgctttttccgcttctggtcactgataaacggaattgagactccagagaatatgccaaaatgtattaataattgtcacaacttggaaggcttttggaaaaactggcatgcttccttcaacaagtggcttgtgaggtatatatacattcctcttgggggatctaagaaaaagctactaaatgtgtgggttgttttcacatttgttgcaatctggcatgatttagagtggaagcttctttcatgggcatggttgacgtgtttattcttcatccctgagttggttttaaaatcagcagcaaaagcatttcaggctcaaagttcttttggagaatgcatatttcgtgaactcagtgctgttgctggtgcagtgacaattacttgtcttatggtggctaatctggttggatttgtggttggaccaactggcattaactggttgctttcttctttccttaacaataatggtttgcctgtccttggtggcatgcttatgacattttacgttggaacaaagattatgttccacatagatgaggcaaagcaaaggtcgccctga

SEQ ID NO: 19709 - DNA, 198 bp, Glycine max
  Peptide Sequence Number=SeqID_136487
atgggtctaaattttgaaggaatgcataaattgaacactgatgatagttcaagaggcaatcttggtccgtctgattttggtggcgtcattaaagattgcttggaacgtcacctctttccatcctcatgcttcaattataaagaaaattcaagtcttctagaacttgcggtgggaattacactttcaacactcatttag

SEQ ID NO: 19710 - DNA, 1257 bp, Glycine max
  Peptide Sequence Number=SeqID_136488
atggaggttgtgagtccaaaagattattctgttgcttctagtccttactcttcacctaacattggagccttgctcaagatcaaggtcatcacatggagccaacaaacaggtttacctgtttctgtccgtgttcgagttaaagacaagatattcagcctgcataaatttcctttgacttcaaagagtggatacttcaagaagagattaaacgatgcatctgacgttgagcttccggaaacattccctggaggaccagaaacctttgagatgattgccatgttcgtttatggatcctccacattgattgatccttttaacgttgtggcccttaggtgtgcagcagagtttcttgaaatgactgaagatcactgttcgggcaacctttgtgaacggtttgatctttatctgaatcaagttgtgttgcaaagttgggatgacacccttattgcacttcaaaggtgtcagatgctgcttccttggtctgaagatctgttaatagtgagtcgctgcattgaatctcttgccttcatggcatgcatggaggtgcttgatccagaaaggaggagagacactcctgttgtgacagtggaagagttggcttcccaagattggagctgtgaaataatcaaggatgatgctgtgagccaagacctgtggatgagggatctgattgctctaccctttggctttttcaaaagggttatagggtctttgaggaaacaaggaatgaaggagaagtatgtgagtcccatcattgttttctatgcaaacaaatgggtgctctctaaaaagacacgccaattttgggagagttcctgtgacaagattggggagggtggcatgaatagcaaagcttctgtgattctacaaggtgttgttgatcttcttccagtgggtgataaggctaggaaagtgattccagtggggttttattttgccttgctttctagatctcttgagttggggttgacgactgaaagcaaggcaaagttacaagaccaaattacatcacttttgcacttttctcaagtggagaattttcttcttccagaaagtggagcaaagttaatgtcctctagcatggagttggtgactatggaaagcataatttcagcatatgtagcatctagctcacgtgtaaaccaaaccccagaagccagcaattacagggttgcggagttgtgggatgcatatatattcaatatagctgcagatccagatatggggccaaagagattcatggaactcattgaaagg

SEQ ID NO: 19711 - DNA, 393 bp, Glycine max
  Peptide Sequence Number=SeqID_136489
atggaagaaagaagaggggagaatggtgagttcacctcaaatctgcaggaggcaaaacaatttaacaactttattgaagggatgatgcttgtggaaccaccatttgctggtagaatggtgaatggatttatgcctgttagagggttcaaagactttgttaaggagaggtataatcagggttggcccaagggtcctgtggtgcaagcttggagatcctttgtcttgaaagagaagctcaatagattgaaagcatacataaaggtgtggagcaaagagaattatgatgatctggaggggacgtgcaatgaatgtcgtgctcgaattgaatcgctggacctcaaggcagaacaacaaggtctgtctgaggaggatgtcttggagaagggagtgtag

SEQ ID NO: 19712 - DNA, 1503 bp, Glycine max
  Peptide Sequence Number=SeqID_136490
atgcttcaatctccagggcactcgccgctccacatctcgtcgccgtccccttcaatttcccaggaatcggcgcaaaagcctaacgatccaccatcatcatcgtgtgcgaagcaccctgcggtgctggacgaggacacgtacgttgaggcgttggagaagatcatcgagcgcgactacttccccgacatctccaagctccgcgaccgcctcgattggctcgaagccatcaaaaccggcgaccccgtcgtcattcgcgaggcccaattgaagatcctcgaacgccgcgccggcacagcaaaggtaaccaatcacaatgacacttctagaacaacctcccacacacccggttccacattcgttagaaatttcacacctctcgatgagttcgacggaaaaccctctcaaaccccccgtgcaccggctcccgaggctaaagagggggagaataacgatggtggggttgatacttcgcttggcctcgatcaatttatgaggaggtacacgagtgaggacaatcatagtttttcgaagattctagagaaagtgaataagaagaggaaagaaaggtttgggtatttgaatgaggatgtgcagggtattgaggacgtgaagagggataggattactgatggttatggaacctcatatcagcctccgagtacccttgaagggtggaattacactgccaagaatttgttgatgtatcatcctgctgatcggggtgaggtccctttgaccgaggaggaaagagcgcatagaattaaagccgccacgaaggagatcaatcgcgggaacactaggtttcatggtaaaatgatggattctaggcccaaagatgatggaactgttgaggtgctttatacgccagttggtggtgcaacgccggcgcctatgtctcttagagaaggggataagttaaagaagtatgatttggaggatttgaggaagactccgaatccgttttatttagaatcaaggaagaaagctgagaatggttatagctttgttaagacaccgtcccctgctccgggtgttgatgaatccccgttcattacttggggagaaattgaggggactccgctgaggttggatctggaagatacgccacttgatattggtggtagtgctgatggacctcattataagattccttctgcgccggcaagagattcaaaggcacactctctttcaagggaggctgcacgcaagataagggagaggtcaaaaatgtttcataagcccccgttggcatcaccagttagaggggggagtgccagtccaagcatgcggacactgtctcctgcagctcagaagtttgtgaggaatgcgtttgccaagtcctcgtcttctgttgatgaaacacttcgagcaagttaccgcggttctactcctgctttggctactcctagaagtgttagtagaagtgtgtcaaggtttggtcgtgatgggagcttggcttccaggtctccatctgttagagagggctccaatcctcccttgtga

SEQ ID NO: 19713 - DNA, 1608 bp, Glycine max
  Peptide Sequence Number=SeqID_136491
atggtttctacagacaaaagtgcggatcaaaatatcccttctgatgaattgcagcagagagtgagtcctgatagtgatactacattgtcacaaggtcatgatactaaaaatgatctgtccaaaccagaagaagcaacaagtattctttctattgtagttaaaaatgaagaagggaaggattctgatgctactgcttgtgccttggaatcagatcaagaaggaagcacatgctctttgccacttgggaaacctttgcaaagccctgatactctttcacacgaatttcctcgattgcagtccagtcaggaatgtccctctataatacgtgaaaaggtatcaaaagatggctataactggcgaaaatatggtcagaaacatgttaaggggaatgaatttataaggagctattacaagtgtacacatccaaactgccaggcaaaaaagcaattgcagcagtcaaataatgggcatatcacggactccatttgtatcggtcagcataatcatcccagacctcaattgaactccacagtatcagttgagtgtgttctgcctgttgttgaacaagcaccacacaaaccctctctagccaatgtggaaggtgagcagtacactttgtctgtacttttgtttctatgcctctgtaggaaagatcttaatgtattttttgacatcatacatgaagacaaagcatccgttgagcatggatgtatgcctcaacagatcaagcctttacaatcctttcctcctgcaaaagtttccccagttaatgagttgaaagctgcacatttacaattgactaaggcaaagaatcagctaacctttactgccaaattgataccaagcaggaagaaagacaatagtaatgctgatgtcgctagagttgacatgtcaacacgggaatctcgtgttgttgttgttcagacttcaagtgaggttgatctggtaaatgatgggtatcgctggcgcaaatatgggcagaagctagttaaagggaatacaaacccaagaagttattatcgatgctcgaatcctggatgccctgtcaaaaagcatgtggaaagggcctcttatgattcaaaaactgtaataactacctatgagggacagcatgatcatgaaattccccctggaaggactgtcactcagaatgcagctacaaatactcgcacaacggccactaatggcaaggcaggaaccaaatctgagggtaatactgatgatacaggggagcgaagcggcttgggcttaacaagtagattaacagagcaacaaactggcaagtcgactactaagtcaaaggctggtgatatggttgagtttcgtgtgatcaggctttctaatgagggtcctgaaattaaattaagtgagcaacaacaacaaaaggataactcagctactaaagatgattctgtcagcaatgacgttatatgccattcaagttctggagttctgtgtagatcaaatgaacagctgaaaggtgaggtaaaacctatatcagaaggaagtaaggattgccttaaggtggttgccgttcatgatactcctagtacagaaagtgaatttaacaagcaatccgcagctgatgctgaaccggtccaaagctaa

SEQ ID NO: 19714 - DNA, 894 bp, Glycine max
  Peptide Sequence Number=SeqID_136492
atgcctgcagagaagtccaacagttgcgatagcgaagtggaagcgttcgtggaggttgatccaacggggaggttcgggcgttacagcgatcttcttggttgcggagcagtgaagaaggtatacagtgcgtttgatcaagaggaaggaatcgaggtggcgtggaatcaggttcggctgagaaacttcagcgaagaccctgttctcatcaatcgccttcactctgaagttgagttgctcagaaccctcagcaacaagtacatcatcgtctgttacagcgtgtggaaggacgaggagcgccacaatatcaatttcatcactgaggtctgcacctccgggaacctcagggattaccgcaagaagcaccgccacgtctccattaaggtcttcaagaaatggtccaaacaggtccttgagggattggagtatcttcatacgcatgacccctgcatcattcacagggacctcaattgcagcaacatctttgtcaacggcaacattggccaggtgaaaattggtgatcttggattggctgcaatagtgggacgtaaccatgcagcacattcaatcttagggacaccagagtacatggcacccgaactgtacgaggaagactacactgagatggtggacatatattcttttggaatgtgtttgcttgaaatggtaacaacggaaataccctacagtgaatgtgacagtgtggccaagatatacaaaaaggtcacgatgggaatcaagcctgaggccttgagcaaagtcacagatcctgaggtgaaggaattcattgagaagtgcatagcacagccaagggcaagaccttcagccacagatctccttaaggatcctttcttttatgaactcaacaatgatgaagaatcaacgccaatcaattga

SEQ ID NO: 19715 - DNA, 402 bp, Glycine max
  Peptide Sequence Number=SeqID_136493
atgcagatggtgggaaataagttatcaaaacttgctgaggattttaaggtgctctttgaatttgatgttgtagctatctttgcttgtgatgttcagctacaaaaccttcgagttcaatctcgggtggctctggctgtgaattttgcattcatgctacatcagatgccggatgaaagtgtgattgctgaatctaacacagacattttcgaattctttccacgtttgcctgaaactctggactattattacaaagcaatgtttgagtcaatagatgtgaatgtgactcccagtgttgagcagcattgcttggcaagagacatagttaacaacatagcttgtgaagagtggaaagtgcaaaacttccgtaacgtggatcaaatgggttttcaaacacacccttaa

SEQ ID NO: 19716 - DNA, 3707 bp, Glycine max
  Peptide Sequence Number=SeqID_136494
caaatttgcgagaagatgatggtcactgtgatattgttccactcttgatgcttcttttgggtgttcagtatcataaagcaccaaactttatgtgccctgaggggtggattgctgagaaaatatttgggactgttacgttggtgaatttggcaaggatgtctgtgaatcgaaggcttcctgcttcaaatggtagattgctatcaaatatgaagtcttggaagctgaatgagcctctgaatgggtctaattctcccaggacatggagtgtttggttcatcttgagtttcaatagtaagtatttggtgagcaaggagaatgaagcaatttgtgaagagagagagagagccttgctacaacgttacaatgttagtaggaaacagattcatgctttggcttccttgttctctggatcagatcagaaaacagtggttgttgcagagatgaatatgaatagtaacaaagtggtgctctttgtcctatgtcttactaagtttataatgcagattttatccaactgtattgatgaaagaagacttcaaatgctgttaagcagcggcatggtcagtacaccacagttaatatgtccggagaatcaggagttacaaaaggtgcatacatgtgttgcagacactgtagaacctatagaacaatgcccagttctcaatgattgtgtccagacaaggcttgaattatcattcccattgaaaagttatgtatcattggcctcgcactctgcacttccaactgatttggttagttatttgcaccgtggaaagaacattgtgcaatcatgggaactgagggtatctgcaattcggaatcaaaagcagaagctagttcaggggcatccagctgcacaacaaaagtgtttgaaacattttccaaggggtccttcaaggggtgctgggagagaagaaactctagcaaatatgtgtgatgagagagcccgtatgctgcaagatcagtttaatgtgagcatgaaccatgttcatgctctggctatccttgtatctacctttcaccatggtaaacatccttctgcaattgaccagaaaatttttggagaatatacagagagtacagcatttgaaagaccacttactagtggtgttgcttatgctttgaaagttctccactctgataggatgcattttgagaagcagcatgggtggacaattaagaaaatggaaactgagaatgaggcattagtacaagattgtattccagaaaatttggatccagcacccattcaagatgaatatgcaccagtgatatttgctcaagaaacagtttcccatattgtatctattgacatgatgtcagggaaggaggaccgtgagaatattttgagagcaagggcgtctggaaagggggttctgacatccccttttaaactactaaagtccaatcatctgggtgttgtacttacatttgctgtctataacactaatcttcctttagatgctacactagagcagcgtattgaagctactgtagggtatctgggtgcgtcttatgatgttccatcactggtggacaagcttctacaccaacttgccagtaaacaaaccattgttgtaaatgtttatgacacaactaatgcatctgcaccaatcacaatgtatggtactgatgttgctgacactggcctactatacataagcagcctagattttggggatccgctacgaaaacatgagatgcactgcagcttcaagcagaggcctccattaccttggacagcaatcaatgcatcagtgggggtgtttgttattactttgcttctgggtcatattttttatgcagcaataaatagaatagcaaaagttgaggatgactatcgtcaaatgagagagctgaaagttcgtgctgaagctgcagatgtggcaaaatctcagtttcttgcgacagtttcacacgagatcaggactccaatgaacggtgttttaggtatgctgcaaatgttgatggatactgagcttgatgaaaaccagatggactgtgcccaaaccgctcacaagagtggtaaagatcttatctcagtcataagcgaggttcttgatcaagctaagattgaggctggaaagcttgaacttgaagctgtagcctttgatcctcgagctattctggatgaaattttatcacttttctctgaaaaatctaatgaaaaaggaatagagctggctgtttatgcatccaatcaagtacccaaagttgtcattggcgatcctaaacggttccgacaaataattactaatcttgtcggcaattcacttaagttcactcatgataaagggcatgtatttgtctctgttcatctggcaaatgaagtgaagaacccacttcatattatggatgcagtgctgagagaaggcttaaacttgaaccaggacatatcaaacagaacatatgatacgttaagtgggtttcctgtatgcaacagatggaaaagttgggcaaattttaagcagttaagtggcataaatgagcctgaaattattcaacttctagtaatagttgaggacacaggtataggaattcctacagatgcacaaagccgcatattcacaccttttatgcaggctgacagttccacctcccgaacatatggtggaactggaataggactgagtattagcaaatgtctagttgacctcatgggaggagaaattggatttgtaagtgagcctggaattggaagcactttttcctttaccggaaccttcagaaaaggagaaagcacgtctctggatgcaatgcagcagaataatcattttggttcagagttccaaggattgagaacattagtggtagatagcagaaaaatccgagctgaggtcacaagatatcatctgcagagattgggaatgtccgtggatgtaacttacagtctgaattctgcatgctcttgtttatctaatgtgtgtaacaagagtatgtcgacccaattggccatgattcttatagacaaggatgcttgggataaagaatgtcatatcttatacacaatcaagaaacgtagacagaatggcatcaaaggggatccaatgaatttaccaaagatttttctcctggccacccaccttagctccaatgaacaggatgggctcaagtcagttggtataatagatgatatactgatgaagcctctttggcttagttctttgattcagtgctacagagtatcccttggcactgaaaacaagagagtaaataggaaaaaagtgtccaaactcgggaatttattaattgacaaacaaattttggttgttgatgataatgcagtcaacagaagagttgcaaaaggtgttctacagaaatatggggctaaagttactgctgtggagagtggcagggctgctctgaagatgcttaaactgccacataattttgatgcttgtttcatggatctccaaatgccagaaatggatggttttgaagcaacgaggcaaatccgttgtctcgagagtgaggtaaatgagaaaattgcgtgtgggcaagcatctgcagagatgtttggtagcatctcttattggcacattccaatactggcaatgacagcagattcaactcagtcttccaatgaagagtgcataaagtgtggaatggatgactatgtgtcaaagccatttgaagaagagaagctctacatggcaatggcgcgtttcttcaagggccaagatggaaaaggaatgacagatctttga

SEQ ID NO: 19717 - DNA, 1869 bp, Glycine max
  Peptide Sequence Number=SeqID_136495
atggcatgcaattgcaaatctcccttgacaagctaccaatcaagcgcttggattccattgaagaaaatggagttgaacgattcccgccatgccatttcaaaagatctggattacgatgcgaagaggctatccttaattaggcaaattgacttcgcttgggctgttgagaaggatgaggagaagaagaagcagaagagctcaagagagacctcaacgacatggcaatggcaggacttggtagaaaatttgcagttggctcatcaggagctctctgtcattatagatctcattaacattgtcgaagcaaatgatgcggtaacagtggctagcatgacaagaccaaaactattaccaaatgaagctttatctgaccgggctgtatctgcagccatcaagctgcaatgttaccgccatgttgggaaatatttcaagcaatctgccaaggcttttgaacaacaggttgctcgggaagctaggttttatggtgcccttatcaggttgcagcaaaattggaaggttaaacggcaacgtcaggcagctattgttccagggaatgaaggcttcacctttgatctctttgataactcatacgaccaagcagctattattcgctcattgtctatgtccactgttcgagtcaatcacgatgcagctggaatgctggcaataaatgtgtctcctgatttatgccattctctccaattgggttttgttggtgtacaaacagatgatacacggaggaaatccaatgaaaacaaatcccaattttcaggtgagcataatttgggagaaacaggtgaagagtccttaagtgatgaagagtgtgttaagaaagcacattcactccttcgtgaagtacatgaagctattttcaatgaacagccttacccttgcatatacaaagaggctgtttccggattcgaacccatgaccaacaggtcaccaaggcacaactttaccgctgcaccagggctcgccctcctttctaattccatctgctatgagattgatattcaacagatttttcttgaacatatatttggaaaaggtggcgaaaaaccaatttccgttggaaatcgtttgtctggcgtacaggaaaaggatgggtccagtcttcttggtcattttttaaaatctttggctcacaggatattttcaacaaaagttcttgcagagctggaaaacgtggtatgcaaggtcccatatctacagctaatttctaatcccacatggcattctcgggcttggtcatggacactctacatggaggttcctcaatctattcttcgtggtagccaaaccaaaacatctgattattatgagaaaaatgatggcaagcgtcagttttggactaagctggtggtaaatgatgattgcatcaacgttaaagctgaaggttctccaaatgtcgcaggcctgttcaagggaaagtttgaggaaacccattcaataaacaaatataactgcaacttagctgatcttcctgtgattattatgcagcagataaacaagcttattactgcaattgaaatcatgcaggttgcgagccaaattattaatcggctctatcaggaagctatggtggttgggataaaagcaaatcgagacttcttatgcctatcttttgagctggagcagggtgaaacacttggcctggttgcaagtgttgttgatccagaaaatagtgaagggtgtatatcttggtggttggtcatggaggacagttttgcagaggagcaaaagcttcatatgagcatcacggatggtgcatctgaatataggaaattcctaggtcacttgtctcttgatttgttatacacaacactgatcgacttggttggcttgtgcagtggtggaggtggccaatga

SEQ ID NO: 19718 - DNA, 1104 bp, Glycine max
  Peptide Sequence Number=SeqID_136496
atgatgctcggcaagtgcaggcagcctgaagaggcttctctgctctttgagatcatgttgtctgaaggccttaaacctactgttgatgtctacactgctcttgtaagtgcttatggtcaaagtggtctccttgatcaggctttttctactgttgaagatatgaaatcagttgttgactgcgaaccagatgtatatacttattctattcttatccgttgttgtgcgaaatttcgtcgttttgatctgattgaacatgttctagcagagatgtcgtatctgggcatcaaatgcaactgtgtgacgtataattctatcattgatggatatggtaaggctagcatgtttgaacagatggatgatgcattgaatgatatgattgaaaatggaaactcccacccggatgttttcacgctgaattcttttgttggagcatatggaaatgctgggcaaatcgataagatggagaagtggtatgatgaatttcagctaatggggataaagccagacataacaacgttcaatacgatgataaagtcctatggaaaagctggcatgtatgagaagatgaagactgttatggatttcatggagaagaggtttttcactccaacgatcgtaacatataatactgtcattgaggtgtttggcaaagctggagagattgagaaaatggatcaacactttctgaagatgaagcatctaggagtgaagcctaattctataacttattgctcacttgttagtgcttatagcaaagttgggtgcattgacaaagttgactcaatcatgaggcatgttgaaaattctgatgtagtattggatactcccttctttaattgcataattagtgcctatggtcaggctggcaacttaaaaaaaatgggcgagttattcttggctatgagagaaagaaaatgtgaacctgataacatcactttcgcttgcatgatccagtcatacaacacccaaggcatgactgaggctgttcaaaacttggaaaacatgatgatttctgccaaaagtagcttgggtatgttgtgctatttgttctttgatgccttttctatgttttctatgtttcgcccgtcctattgtgcttggtag

SEQ ID NO: 19719 - DNA, 144 bp, Glycine max
  Peptide Sequence Number=SeqID_136497
atgaggtgtttggtaatgatgccgagaagggcctcatcaaacatcaacataactcagtgggataaagaaggcaatgacaatgagattgtcaacacaagcacaatagatgatatcagcaagaacgatggttttcaagcactatag

SEQ ID NO: 19720 - DNA, 837 bp, Glycine max
  Peptide Sequence Number=SeqID_136498
atgatgcagagactctcttctgccactactactactactactcgctctgccttgctgcgctacggtggcggcgcacttcgccgggacgtgcttgctcccatttcctcttctcacttagcagctaagtcacaggcgggtgaaaatgacaccaaagcagctagatggttttctattatgagctctgatagatccacatttgattcctcaaacttgaaaagggatttgttctttggcaaacgatatgaatcaactgctgcagaatcttcttcctcagcagccgccgagagatatgagtaccaagctgaggttagtcgcctcatggacctcattgttaacagtttatatagtaacaaggaagtgtttcttagggagcttatcagcaatgcaagtgatgctttggataagctgcggtttctgagtgtaacagagcctggactgttgaaggaggcagttgattttgatatccgaattcaagctgataaggataatgggatcatcagtattactgatacaggcattggtatgactaggcaagaactagttgattgtcttggaactatcgctcaaagtggaactgcaaagtttttgaaggctctaaaggatagcaaggatgctggtggtgacaacaacttaattggtcaatttggtgtgggattttattctgcttttctggtttctgatcgggtggttgtctcaacaaagagtccaaaatccgataagcaatatgtttgggaaggggaggcaaatgctagctcatatacaatatctgaggagacagatcccgagaagctgattccaagaggaactcgccttacactgtatcttaaggcatgttga

SEQ ID NO: 19721 - DNA, 780 bp, Glycine max
  Peptide Sequence Number=SeqID_136499
atggcagtagaagtgtgctccgagatatccagcacgggaatcagccctcgaatctcattctcacacgatctgaagaacacagaggatgcatcggttcgtgttgaagatcctcaccgtggatcagacttgtgcctcttggactcaagctctgacttcgtgttctgcatcaccaatggcttagctcaacaactctcttcagccgatgaactcttctccaatggaaaaattatcccgacggagatcaagagagtttccaacgaaccttctcaatctcaacttgcaaccacggaaaagattcaaaagaagaggctcaaggagttcttgtctgcatcctctgatgaagcagagaacgaagaagagaagccatcttccaagtatttctggcaattcaagcgcagtagcagtttgaatttcgatactactcgtgggaatggcttgattcgctcactgcagttcctatcacgaagcaactcaactggttcggcgccgaatccgaaacaaacagagcttccgagggaaactcacaaacagaggctgcagaaacagtcctctgtttcaagtagaaggtcatcatcttcctcttcgagttcaagtacatattatttttatagttcgtctcaaaagccttctttaaagaaaaacggtggatcttctggtaatggtgttaggattagtcctgtattgaatctaccgcaagcatatattcccaaggccactgccagattttttggatttggttctctgttctgtaatggaaagagtaaaagaaataagaaatag

SEQ ID NO: 19722 - DNA, 318 bp, Glycine max
  Peptide Sequence Number=SeqID_136500
atggaaccactgcctgtagtcactttgaaatgggcagtaacgcaaagcaatactttgagggaggataatgattgtatggctgctcatttcactgccaaaggattgaaagttgttctttttcatatgcactccaataaatcaccaggaccaaatggcctcaatccaacattcttcaaaagatttcggcatctccttggacctaaagtgcataaagttgcctcttcttggttacaacaaagtactttccttctacagctaaattccacaaccattgttctcatcccaaaatgtccaaaccgtgaccatgaaaaattttag

SEQ ID NO: 19723 - DNA, 435 bp, Glycine max
  Peptide Sequence Number=SeqID_136501
atgaagggcaaaaaaatttcaagctttggcacacaaacaagaataaccggaagagaatgcacatttgtgatgaagaacagtcacagtgaacaagaagcagaaccaagaagagaagccataataattttcaaaggaatgagatgtttagctatgttcacactctcacgtccacgcagaaaagtgaaaacggtaaacttcaatttgagtcacccttcccgaacctcgagtataatccctaaatcccacataaattatggatacattgaatgcccgcctgctctttctcttgttgtggccttgtgggctttggatgttgttggtaatggaagatggattcattcgtttatggttttaatcatggctttgaattggatggtgtacaaggcacgtacatcactaatagatagattccttgaacatggtttcaacgtttga

SEQ ID NO: 19724 - DNA, 192 bp, Glycine max
  Peptide Sequence Number=SeqID_136502
atgtcctatggaggactcatttggaaaaataataaaaatgataatcaaattggcttgtctgaaaggggagcagaaggtgcggcggccatggtgggcaccggcttgcctatctacagtgttcttaaaggttgcaaaatccaacagacaatcaagagttgtttccttgaagctggaaccatgataatacaataa

SEQ ID NO: 19725 - DNA, 3516 bp, Glycine max
  Peptide Sequence Number=SeqID_136503
atgttttcttgcggaacgaagaagagcaatgttcgctctcgcagattgcaaggtcgcgattccacggtggtagattctccggtcactcctgctcgaacctctttccacgataacggcgttcccaatcgcccgaccaccggcactcccgctccctgggctcctcgcttatctgttcttgcgagggttcctcaggtcaacagaagtggaaaaggcgacgacacagatcctaccaaacctgttttcgtcggcgagtttccgcaagtggttcgtgatgagcagaacattttgctacacaagcgaattcctgctgaagatcacgcgtgtggcgggattgacaagagcacatcccttgcttggattatttgtgggaacagggtctacctatggagttatttgtcgcctgcttcctccgtgaaatgtgttgtcctcaagattcctttgaatgatgctgatgttggcagaaatgatgctggtagttggttgcttcgtgttgttaattgtgacgccacgtctgtgggaacgaataaaattgcgaaacagtgcaactctgctgctgtggttttgtgtaattgtcggactcgggctgttatatactggccggacatctattctcagtcgcacgctccggtcactagtcttgtgtcttctgatgagctggaggctgttatgattcctgatgggaaagcgtccttccacaggcagcggcgacaaagtaagctgggaagtagtttgagtggattgcacacatttaactctatgattgcttctgctgatcccagttgtaagtttgtatgtgttgcccttgcgtgtagctcgagtggtgaactttggcagtttcaatgcactcctactggcattcatagaaggaaagtatatgaaaatttcccgctccaacagggtgaatcaggtcaaattgtgagcaatattgggtaccctaggtctctgacgtggtgttttccacatcattctattcaggaatcaaattggcaattcttggtattgacagaccatgagatacagtgtttcagagtagagtttggttctgatatacctatttcaaggctttggtctcaggcaattgtcggaacagatgctgaggttggcattaagaaggatctggcaggtcaaaagagaatctggcctcttgatatgcaagtagatgatcatggtaaagtcattaccattcttgttgcaaccttttgcaatgaccggattagcagttcaagctacacgcagtactctctcctgaccatgcaatataaatcagggttgggtttagagactacaaatgacagggttttggagaaaaaagcccctattgaggtgataatgccaaaagctagagttgaagacgaagacttcttgttttccatgaggcttcggatagggggcaagccttcaggatctgcagtcataatatctggggatggaacaacaactgtctcccattattatagaaactctacacaactctatcagtttgatttaccctatgatgctgggaaagtgctagatgcttctatccttccttctgcagatgattatgaagaaggtgcatgggttgtattaacagagaaagcaggaatatgggcaataccagagaaagctgttatacttggaggagtggaacctcctgagagaagcttatctcgtaaaggcagttcaaatgaaagatctgcacaagaagagataagaaatcttacatttgcaggtaattttgctcctagaagggctagctctgaagcatggaatgctggagacaaacagaggacggttttgagtgggattgcacgtcgaactgcactagatgaagaatcagaagctttattgaataatcttttcaatgactttttatcatctggccaaattgataggtctcttgaaaagctagaaacatctggttcatttgaaagggatggggaaaccaatgtttttgttcggatgagcaaatcaattatagacaccttggctaaacattggacaactaccagaggagcagagattttggccatggctgttgtttcaacccaactcttagaaaagcagcagaaacatcaaaagttccttcactttcttgccttatccaaatgccacgaggagctgtgttctaagcagagacttgccttgcaaattattttggagcatggtgaaaagttatctgcaatgattcagctgagggaactgcaaaatctgattagccaaaatcgatcaactaatgttgactcctcaaattctagtttggatattcagatgtcaggtgccatttgggacatgatacaattagttggtgagagagctcgtcggaatactgtccttttgatggatagagataatgctgaagtgttctacagtaaggtttcagatcttgaagatctctttttctgcttagatgcagagttagaatatgttataagaccagagcatccgttaggaatccagatccagagggcatgtgaactctctactgcatgtgttaccataattaggacatgcttcaactataagaatgagaaccgattatggtatccaccacctgaaggattaacaccttggtattgtcaacctgttgtacggactggtatttggagtgttgcttctgtcctgcttcacttgttaaatgaaatatctggacttgataaaactgcaaaattagatctgtataatcatttagaagccctagctgaagttctattcgaggcatattctggtgctgttacagctaaaaatgagtgcggagaagaacacaaaggtctgttaaatgaatattgggagaggcgagatagccttcttgaatctctctatcaaaaagttaaagattttgaagatactcacaaggattcgattgaaggagctggagagcagaatgaagaggccataatgaaggttacttcacatctgttatcaattgctaaacgacatggatgctacaaagttatgtggacaatttgttgtgatgtgaatgactcggaattactgagaaacattatgagcttccaaagaaagattgtgcaaacaaatgttaaccagcatgaaagcctgggacctaatgggggatttagttactatgtctttatgaaactccatgaaagcagacaattttctcaacttttaaggctaggggaagaatttccagaagagctatccattttcctaagggagcatccagatcttctttggcttcatgatttgttccttcaccaattttcttctgcctcagaaacacttcatgcattggctctctcacaaaacttactatctacgtcagttgctgaagaggaaggagaacaggagtatatgaaaatgaaactaaaattgactgacagaaaaaatcttttatttctctctaagattgctgcctttgcagctggtaacgatgctggtactcaagtcaaggtggaccgcattgaggctgatttgaagattctaaaattacaggggctaaaattggaaagcactaacttacaaagactaaaaatgaacaaaaaaacttacatgagcgcaaacttaagggactaa

SEQ ID NO: 19726 - DNA, 699 bp, Glycine max
  Peptide Sequence Number=SeqID_136504
atggagctttggagaatgaaagttcctcctaaatttaagcagttaatctggggaattttgaggaattgcctcccttcacggagtagattgagagataaaagagttctttgtccacttccatgtattgcccctctcattcttgacatcatcaactctgtacatgaagaggacttatgcaacaaatttgctactggactatggtgtatttggaggcaacaaaatgataaattttggaggaatcaggtccagccaacgcagatcacgattcaacaagcatttcaacaccttgaagaatggaaggatgcaagacagcagcaatcccaatcacatgtgatgcagattctagacaatcaatgtgagtggaagaaaccatcttttggctacttgaagtgtaacgttgatgcaacaattttcaatcaggatcaacagtttgggaatggaatgtgtattagagatcacaatgggcaatttattcaagcaaaaacatggtttcaaggtgtttcagacccaacaatagctgaagcatgcggcttataccaagccatggaatggttaaaggagagctacaacaacaatataatttctgagttggacaacaagtttgtggttgatgatttcaaccataacaacaaagatttatcatatttagcttcaattctcagattagtatttgatgttattgatgatgacatggtgtaa

SEQ ID NO: 19727 - DNA, 912 bp, Glycine max
  Peptide Sequence Number=SeqID_136505
atgaattgtgaaataggaaaagaaagcattcagaaggggcctccatcagagggagcaacagtaaacagtaacactttgtctgctggtgtagaaagctttagcttgggtagtggtgtggcaactcacatcaagtctagcggcagtgacatacttgcacaagattttcaggttgttgaacaagatgataaactgaatgaaggcaacacaggaataacactttgtaaaaacatcctaatccaagaagggtcaaacttattggataaaacaaagaaaataggaattgtttccacttctgcagatactcgtactagattgggagcacataaacactttgttgatctggatgatgcacaaattgctctgctggcggaggcaatagcagcatatcctcaacttggaatgcttgtgagaagttcaagagaaaacgagttccataaactatgcaatgaagctgttcaacttggatttgagaggtcatgggttgatgaaatgcgtcaacgtgttgtggcaagggatcctgcctggaccatgcacaagcacgaattggattcgatggcaacgattacgactaagaaaaatttagtatctgttattattgagaacacctctaaaatcaaagaaattttctatcttgagggatttccaatcaatggccaaccaaatattgagaggaactggagcaaatcattaaggacgataaagaaaatgaaaatatctcaaattctaaatcccaaacagcttaaattccatcttgccacactctgcgacaactgggagtatctgttgcttatccccatttctcacctccttccagaattagagcatcagatcctaaatcaaaattctcgcccagtgcatttattactcttgacattgtacaaaacagcgcaacaaactgatgagaaagtttaa

SEQ ID NO: 19728 - DNA, 576 bp, Glycine max
  Peptide Sequence Number=SeqID_136506
aaaaagaaagatgaagaacatggagcagagcagagcagagacaacgttgtggtcatcattgcagccgttgggcttcatgttgaggtacgcggtggtgccacgacagaatttgtcaacgatgttgacgacctggacctccacagcgttggtgccttgggcataaaggtagcttttaatgacgactttgttaaagggggagaggatgacataaccgaagttgggatgggggagagtagaatgtttgggacggcgattcgatgtttggcgaagaaaccgaagccgaagatgggacccgtgatcctgaaaacgccgccggagcagaggcagacaatcacaagaaccctcttcgatataattaaggagcatggtcccatcactgttgctaacacctgggaacgtgtccaggaagttggattgaaagatttgacaagcaagaatcacatgaaaatagtgctgaaatggatgagagagaggcagaagattcggctcctttgcaaccacgttggagcacacaaacagtttctctacaccacttggtttaccaagccggttacccctcccaagaattcctcttga

SEQ ID NO: 19729 - DNA, 1116 bp, Glycine max
  Peptide Sequence Number=SeqID_136507
atggaattagatggttcagtacgggtttgtatgctaccccaaatcctctttgtagaagggggtctgtggatgcatctaagctttcttacttctactatcacgggaccttggctagttatgggagattttaatgagactatccttcctagtgatcaaagagggggcatttttaatcaccagagggcgatagagcttcttcagaaacttgatagggggatggctaatcttgactggcagatggcctttccagaaggctatgtggaggtattatgtcgtatgcattctgatcataacccgctcttgcttagatgtggtggccttactccagccagaggccaacgaccttcccatgatgttgcatggattatgcatgatcagtatgcaactgtggaggaaaaatcttggaatgatgagaaaggaagacctatccaggtcctaactaaagttaaagaaaacttcttgatttttaataaagaggtttttgggagtattgttaagaaaaaaggaccattgaagcttgccttagagcctgctaattcttctttccaagtaactccttgctcgtggattgaggatgatgatggtctttctcttactagacctgttactaaagatgaagatgctttctctacgggctatttcgatcctgttctttctgaaaccctcatggcgctaattcctaaaatggataatccagatggtcaccttagttatgcattgtgtaacttcttcattatcccttcttacagcagacaaatcaactggatctcggaaggaaatatagcacttcctaagagcataggggcattgggcactagaaaggcaagggacatgaatgtggcatttctaggaaaggtaatgggaataactcgttttggtatgaaaactggtcgggctagggtcttctttgcaataaggtggattatgagcatcttactagatcatgttgtgatggatgaaaataacgtgggacccgaattagaggttgataaccaaaggaggaatcctggacacgtggcaaatgatcctcaggatgttggatgtaggagaagcacacgcgtgaagtttactagctcaaaattgcgtgggtttgaggctgaaatggggtacaaatag

SEQ ID NO: 19730 - DNA, 498 bp, Glycine max
  Peptide Sequence Number=SeqID_136508
atgggtgaacgggcactggtacaaaggcctgtacgaagctcaacctcacaggcagaagtgagtcctgagagtggtcaacatgaagataatcggaaaggttggagtgcagaaaaaaatcctgcagcaaagtgcagaaaaaaggaacagcctcgctggcagcaacaaacgatgagggcaaatcagaagcaaactttggaagcatcaatcccggataatgtggagagtgatttgcaaggaaattggatggtagttagtcgaaaaaagagatcgaataatcagggcaatcaagaagtgggagcttcacttcaccagactttcaccccgattgagcaattaataactaatgtcgcgaaagctgcaaaacatattattccaagatctcaatcccaagtaactcggtatgatgaattggtcacagtacctaggaagaatataagtgatcctcctgaatcttccaatgtgcaggctatggagttggaagcaaatcagaatcaatga

SEQ ID NO: 19731 - DNA, 1578 bp, Glycine max
  Peptide Sequence Number=SeqID_136509
atgaatgctcaaaatttcgaaaacattggactttcgccgttggactttgtctactcgatttgtaatatgattgaatcagatgaagtttctacaagtagcggcacgaatgagttgccttcatcacagattaatgaaaaatcagagaacgattttattgggaatattcctggttcagaagcacaggctgctgcaacttcaacaaattcagagccgaataaaaggccaaccccaagtcccttggataattgtcaacgtgaaacacattcacatgagttggtggatgggcaatcaacgagtcaatcatattttacagaccaacaaaggccacttggaaaaactgaaagtgccattggaattcctcagcatgagcagaatcccgcgccagaaaacacttctccatttcaaatgaacctagaagatccatcaacatccaaaagtaaaccaccttctccacaagtcaatgataacaatcaatttgtactgggaagcataactgaaacagtacgtgaacataagcaatttgaaagcagagtaactgtgttcgaaacaggcgagtgccctgaattagagagagaaaacaaaaggacatcaaacttacaaaaactggagcaaaaattgtcacccatttcttctccaaacatgatagagagtattgatgaaatagagacaaccattattggaaaagttccaacatcagtgaaactagcaataccaacttctgttttagaggtgagaagcccatctctgacttgtatgacaactcgtcaacataaaatacatttgcatttcctggataaagaatcaagcaatgaagcaggttttccagaccaacatgcacttggagaatcaatgaatattgaggaaacaggaaaagaaagcattcaagaggggcatccgttagagggagctacggtaaaaacgttgtcaactggtgtaggaagcattagcttgggtagcggtgttgtgactctcaccgacattagtagcagggacatacttgcacaagatttccaaatccaagaaataatgccatgtcaagaaatccaaatccaagaagggttgaacctgatggataaacaagagggaacaggcattatttctaataacagcattgaggtttctccagatatccgtacaagattgggagcatataagcactttgttgatctggatgatacacaagttgctctgctggaggaggcagtaaaaaaatatcctcatctttggaatacttgtgagatgtgtagtgagcgctttcaagctttgatgttaaaatctttggcagaaattttgttgttcctccggaatgaaactgcagttagtattactcctcagagaaaaaatgagttccatagactatgcaatgtagctgttcaacttggatttgagaggtcatgggttgatgaaatgcatcaacgtgttgtagcgagggatcctgagttggacaatgcacgagcagcaatccggaagcttcttaagaggcgtgatcatttaactcaggaactacgcgacatacagaatgaacttaagattcttgatgactttcttgatgcccagacaaaatgtttcgacttttga

SEQ ID NO: 19732 - DNA, 2079 bp, Glycine max
  Peptide Sequence Number=SeqID_136510
atgagatttaaaggatctatcaatggtattattatacaagttctgcttgatagtggaagttctaataattttctccaaccaagactagcctcctgtcttaaattacctattgaaccagtccctaattttcatgttctggtaggcaatggaaactttttaattgctgaaggtttagtcagcaagttggacgttttgatccaaggacatgcactccaattatcagcctatctgttgcttgttactggtgctgatttagtacttggagctgcttggctagttactctgagcccacacatatctgattacaacacattgacactaaaattttacttggacaagcaatttgtgactcttcatggtgaaaaatcaacaacagccagtcctgcacagttcaatcatttaagaagaatgtaccgtactaatgccattgccgaactatttgcattacaacctgaaattccagtctatcctcaggatgattggttggatatacctaggtacatggaacctgaattggctatcttgattcatacatacaaacaagtctttgttgttcctaaaggtctacctcccaatagatctcaaaaccacgctattccgttgatgcatggcactggacctgtgaaagtgaggccttatagatatccccatagtcagaagctacatattgaaaaaatgattttggatatggctttgaatgccatcactgttaaggatagttttcccattcctacagtggatgagctacttgatgaattacatggagctaattatttttctaaattggatctcagtgcacctgccacgtttcaatgtttgatgaacgatgtgtttaagggagtgttgagcaactattgcttcagcatcaactctatgctaggctttctaaatgttcatttggcttgcaaactgttgactatttgggtcattcagtttcaggatctgggaagatttattagaggttatgcatctctagctacaccattgactaatatgttaaagaaagataactctcagtggagcaatgaggcattgacagcattcgattcactcaaagcagccatgacacaagcttttgtcttggcattacctgattttaataaaccattcacattggagactgatgcttcgggtttgggcataggggcagtattgagtcaagataatcaccctatttcctttttctctaagaaattaacacctagtttgcaaaagaagtcaacatacaccagggaattttacgcattcactgaggctattgccaaatttagacactacttgctgggacacaaattttatgatttcaccattgagtataaacctggtaaagacaacattcctgctgattctttatctagattggttattcctgatgatctttctcttaaacaacaaatcgtacatgaatgtcataattcattggttggtggccatgctggatatacaaggacattggctcgagttactgctcaatttcattggcagggcatgcataagttcatcaaggattatgttcagacgtgtttagtgtgtcaacgggatttcatcactgggctgcctttgtcccatggttacacagtcattatggttgtagtagatagattatccaagtatgctcatttctctgatctgaaggctaattattccagcaaggttgtagctgaaacatttatgaatacaatggttaaattacatggatttcccaagacaattgtttctgatagagacaaagtctttactagtcaattttggcaacaattgtttaaattgagtggtacatcattaaacatgtccacagcctaccatccacagtctgatggtccatcagaagctgtcaataaatgccttgaaatgtatcttagatgcttcacatttgatagtcctaaggagtggtataagttactaccatgggcagaatattggtacaacacagcttatcatactagtattggtatgactccttttcgggtggtatatggtagaaaacctcctcaactactgagatacactcctaatttgcaagattcagcttcagtgcaagatcagctcatgctcagagatgctactttagctaagtag

SEQ ID NO: 19733 - DNA, 3333 bp, Glycine max
  Peptide Sequence Number=SeqID_136511
atggaatgcctttacggttttgcatcttctatttcaagagatttagtgtgcggagcaataaatcaattacgttatccttgttattttaacaatttgattgaagagcttgagaaagaagagggcaatttgattgtaacgagaaatgatgtccaaaaatttgttgcacatgccaataaccaaacgagaacgactgctgaagttgttaaccactggctacaggatgctgagaatgacatagacaatgtgaatcagttgctgaaagaggcaagaacaaaaaaaagttgttgttttgggcactctccaaattggatttggcgatactgtgtaggaaagaagttagcaaataaaactagggaccttgaaaagcgcattcaaagaggtagaccatatattcaaattgaacgcaatactacacttccttctagcacacttgatattctctcggaaaaatgtatgaattttgacagtagagaatcttcttatgagaaactaatggaagcactgaaagataatgaggttgccatgattggtttgtatgggatggggggttgtggtaaaaccacgttaggaatggaagtaacgaagatagcaaaagcagaggatctttttgacaaagtgctttttgtgcctgtgtctagtacagtagatgttccaaggatccaagaaaaaattgctagttcgatggggtatgggtttccagaaaatgaaaagggagaaagggagagagcccagcgcttatgcatgagattaacccaagaaaataagctactagtgattttggatgatgtgtgggagaagcttgattttggtgccatagggattcccttctttgaacaccataaaggttgcaaggttctcattaccactagatcagaagcagtttgtacttcaatggattgccaaagaatgattcacttgccaatcttaactagtgaagaagcgtgggctcttttccaagagaaagcacttataacagaaggcacccctgataccgtaaaacatttggcaagattaatttcaaatgaatgtaaaggactgccagttgccattgcagctgttgctagcactttgaaaggcaaggctgaagtggaatggagggttgcattgggtagattaaaaagttctaagccgatgaatattgaaaaaggtttgcaagatccctacaaatgcttgcaattgagctacgataatttggatagtgaagaagccaaatcacttttcttgttgtgttctgtattccctgaagattatgaaattccaactgaacttttaacaagatgcgcaatagggttaggcgtagttggagaagttcgctcatatgaagaggcaaggagtgaagtgattgcagccaaaattaagctcatgagttcttgtttattgttgaatgcatttcatgaacgtgtcaaaatgcacgattttcatcgcaatgtagcccacttgatagcaaagaatgaggataaggtcattaagtgcgaattggagaaggatgcgactttggagcaaatttcagtaagatatctatggtgtgtgaaatttccaaatgatttggactgttccagtcttgagtttctttgcataaaaacaaaattggaaatatcagatcaaattttcagaagaatggaaaatcttagagttatgtatcttgacaatggagggtggcacaaactaccattgtcaacaatgacatttaaaacattgaaaaatcttcgttgtctaatccttagcaattgggtattaagtgacatctcatttataagtgatatgaagaaacttgagtgccttgcattgtctgattgttatttgccttcattccttgaattacaaaatgatggtgtagttgcacaactaaccaacttgaaatcgttaatgttatataaatgtgacatggagacgaataattttgatgtggtcagaagaatcccacggctagaagaattgtgcatcattaatagacagcaagaatgggatgtttacaatgaaaacaccattaaattctctaacacgtttagtgtcccccaagaactgcaatggtatacaataaaattaggaagcctacgccaagatgatgaagatgatgatgcaaattttatctcccataaaagaactctattgcttagctgttttcacatatcaaataaggcgattaaggatttggcaaaaaaagcaaaggttctatccatagcaaatactcagggaggtgcaaaaaatataatccctgatatatttcaattggaaaaaggagatattcatgagttgaataagctcgagatatgtaattctaaggagatagagtgtttggttgacactagcaatcatttgagtgaggtgggaattctcttctccgagttgcttaagctgaaaatatgcaagatggatcaattaagagttttatggcatggttgtatacctcctagtggcccttttgagaaattagagaagctaaatttaagtaattgtgcacagttgacatctttcttcacgcatgctattgtccaaagtcatgtgcaatccacaatcttccaaaatcttcaagaagtgattataagtggatgtagagaattaaagtatgtcttctcagccaatactgttcgaggcctacctcaactgaaagtgttgaagataaaagattgcaatcaactagatcaaatagttgaggatattgtcccatcaacacctgatatgaattatccacttgcacaccaggatcaaaaacaagaattagatgaaatcattcaagatgagcaacatcaacagtttttgaatcctcattttgaacctaatcaattggaaattttcccagaaagtactgcaattccaggatcgtttactctatccagccttacaacccttgaactaagatcatgtccgacattgggctcattgtttacggcatccacggctaaaaccttgacttcattggaagaattaattatagaagattgtgatggtttgaagcatatcctaactcgtgaaagaggtcataaaaatcaaaaggaaaacctcgttgaggatgatcgtgaatttcagagtgatatttcaatgttcttaggtttgaaacggctatccatcgaagggtgtgatttacaacatatattatctgtctcttttgttggataccaggcgaaattagaagatataagaaataaagagactcataataattttgaacatcttcagcgaaaaaacattcagattggacaagtgcgtttgaagttaaaaaagttggagttgtacgacctacctcaaatgacttatatttgggtggcttccaagagttcacttttcctccaatatcttaaaacattagacatagaggaatgtgcaaaattggaa

SEQ ID NO: 19734 - DNA, 497 bp, Glycine max
  Peptide Sequence Number=SeqID_136512
atgaagcatcaacttgcttccaacgggtttgttccaaggtgggaatatcctttgcctgagtggtcaagtgatcggcacggccttggccttggaaccaaagctgaacatcggcgggcagtgagtgggattgccggcagtgggtatgtcggaatctgtcacatgccagactggttcaggcgcgtggggctgctgactgcggcgagacttgtggcattgggttcgtcggaggatgatggtcccggtgatgtggtcacaccggcaaaaggagattgtagtagcgatggggagggctcacagctgtggcagtgttgggctgactcaacccaaccctacccgatattctattacaaaagcgcaacacacagcggggagaacacacagcacaagacacccgcacccagcagcgatgaacggcaacagcacgaccccgtgaaggcgacgcacatgacccctcacccgcacgcggccaacagcacgatgaatgacggcgacgaacg

SEQ ID NO: 19735 - DNA, 570 bp, Glycine max
  Peptide Sequence Number=SeqID_136513
atgactattgtggcgacaaacaaagttatgttttgcaatcactcggctgtagactggtgctattgtcatgcaggagatattgaacgtggtcttcaaacttttgagaaccacctaaggctggacaggcctgttgcttcagaactttttgtgacacttgcagaaggggcaatgattgggtacactgaaaaaggaatgcaaatggctcaagatgttctggtaaggatgaatgagagaaacatttttgtgaataacaaattgggaagtgagctcctatttgtagctgcgggggaaaagactgggggatataccactgctaactacatatgggacatgatgcgagctcgtggaattaccccttcatttcctgcagtagaagcatattaccaaggcctaaaaaagttgcctaagccatgtgatctctcagatgcagctgctgccatggcactgaatttagcaatggtttttcgcttcaggcttctccatgagatcaagtttcctccaataaggacacaatacctagaggtggacttcttgtgtgacggtgatcctgcccaatcagcatcagagtaa

SEQ ID NO: 19736 - DNA, 186 bp, Glycine max
  Peptide Sequence Number=SeqID_136514
atgaagaacaaggctagggttcgagtggggttagcagtcaagttatttaataaaaatcggcgcaaatttcaccgccttagaatgtgcgtcatgaattacaattttcaccacgataattacaaaattgccaccaaaccactttttaaggcggttccagttataaccgtcgtagaaacgatgtcgtaa

SEQ ID NO: 19737 - DNA, 1134 bp, Glycine max
  Peptide Sequence Number=SeqID_136515
atggatatgcagagctaccttggtcctgttgttccttcctatgacgcggttagtgaacagctgcttcgcctctccactctgcatgcctttggatcatcctctgcaccggctggagattcctctgctcttgtctcccattcttctaatcatggtggcgagacaaaggtcgtggtggtcaacgacgttccagatattgcaattattgcaacatttatggtcatattgaagccgactgtcacaacaaggctcgcaatcaagcgaaatcgacgcatcagagagacgattggagcaggacatgagtctggaggattataccaactttcatcgtcaatggtctgtgtctccgctatctctatagaacttgctcatcagcatcttggtcatcctagtctaaacaaaatgtacttggattttcttaatgaaaagacgttcttatgtgttttccattttcaagattttacacttgaaattcaaaatcaatttgatgtttccattaagattttacacagtgataatgcctgcaaatatttgtcctcccagttttgctcttttctaaccttgaagggaattcttcatgagacctcatatgcccacacaccacaacaaaatggtgttgccaaagggaaaaatcgtcatttagttgaaacagcttgtactcttatccttcactataatgttccacatcatttttggggtgatgcacttcttacagcctgttacctaatcagccgcatgccttcctctgtccttggaaatcaggtcccttactccattttgtaccctaaagaacctttatacattgtccctctccgtgtcttgggttgcacttgttatgtccatgatcttacaccagcctgttacctaatcagccgcatgccttcctctgtccttggaaatcaggtcccttactccattttgtaccctaaagaacctttatacattgtccctcaacgtgtctttggttgcacttgttatgtccatgatcttacactaggttcatgcttggtggccaaaggatacactcatatttttggtcttgactacgggacaactactaccctgtggccaaaatcgcatttgtgcatctctttcttgttatggctgccattcaacattgacctctgcaccagctag

SEQ ID NO: 19738 - DNA, 351 bp, Glycine max
  Peptide Sequence Number=SeqID_136516
atgaaggaccttaaccctgtgcatgatatcatcaatcagtatgagtacaaggagaagtactttaaaagcttaattcctcttggccttaaatatgctgagctttttccatggggagggaagccacaagtatggttggaattgatatgcaaagcagttaaagagacagatgaatctcagattttccacaatctcgaagcacaacatagatatctgacatggagagctgaaaagccaatcataaatatgattggtgatctagccataagcaaacttatatttgtccctggtataattggtttaggattttttaattcacccaggatcttcactcatttagctagcatcggttga

SEQ ID NO: 19739 - DNA, 1683 bp, Glycine max
  Peptide Sequence Number=SeqID_136517
atggcgaaggatctgtggacacacttcaagaaatggggggacgtaagggagatctttatccctaatcacaagaatcaaggagggagaaggtacgactttgctaggtttaagggagtacctgatgaacacgaactcgaaagaaagcttgtcaagctcgtcatagatggcctaaaattgtacgtcaacctcccaaagtatgggagacgaaacatggggattgaagaccacagagccaacatgaggaccagaccagaaggacatagcaatgaagcgagaattgaatgccgcaagccaacacaggttagactcccacacaggacatatgccgaggtcacaacaaccaacacgacgaacgctggacagagaaagcaacccagacctgcacaaatcggacaaacccactcacaatcgtcgatccaacttcaggtagattgggagaagaagaaatggcttaaagaagcttgggttggtaggctaaagaaactaagtgctttcgatagcattgaagaagacataccatgggaattaggtgtgaacgtggtgtcgaaatatatcggcgacgatatggtccttcttctcggtctctcggatagtaaggcagaggcgatgataaacagtgaagcccagtcactgttccactccatacaaaagtggaacccgaacatgaggccgggctacaagctggtgtgggcgcagtgctggggagttccactacaagtatgggatatcgacaacattcgaaggattgtggctgcagtaggagagctcgttgaagttgatgacgaagtcgaagagctgaggaggttggacagggcgagagtcctccttagaactcaatggaaaccgctgatccatcatacggtggacgcgacgatcaacggtgaggcttatcagatagttatcgtggaagaaggggaggcttacggtggaatgcgtaaccagtgggcacgcaaacacacatacacgtcggaggacatcgactccgatgacatcaacgacgactccgtgcatgcgggaatgtcggcaaaccacgatttcctgcacccacggaacgggatcaacggcgagggatggcctgacgacgcccacaaccactgtgggtctttacctgcaggaccgacaccggtagagtgcccactgggtattgaccaacggacaatggcaccactcctgagaattcaaattgcaaagcggcctgaagagttccaacaaccatctgcaggatatgcctctacagatgttgacccagagattacagtggcagaagctagcatgcgtgactcacagaagaagaaactaaacaggagtagggggcttttgtcaggggcagagagcatagaagaagaaatgtttggtgagccagaccaaggtcaaaaggaagatgacatcggaagctgccacaagcaggcccaacacaggggcgagcaatgcacacagcgtgaggtaccattatcggtcgacaccttacctccagcagctattggaagtccagaagccaatggaactatgaagaatccagaagaagaagacatccaagaggcagagtcacaatgggaattagcaaaaagcatgggagtgcatactgaattagaccaggcagcaatcatcaacaggataactgaaatggagaatagagataagcaggaggctgctgagatgggaaaaagacaaagtgcaccatga

SEQ ID NO: 19740 - DNA, 231 bp, Glycine max
  Peptide Sequence Number=SeqID_136518
atgggtcatctttcttctcgagccactaacagcaagcagacagaacctgtagatatgcagtgcagcacaatttgcttgctccagtggccaattttcatgattttggctgcgaaaatcaccgctccagctgtgatggccagttgtggctcgatggcatttgggcaacaaggtgccgcaacctaccatatatcaggtgtgtcttttgtcaaaattttctggtatgctatgtaa

SEQ ID NO: 19741 - DNA, 111 bp, Glycine max
  Peptide Sequence Number=SeqID_136519
atgcaagacatggctcaggccctccacgtcggtaagcacctccacggttgctcccctgatcgacgctccgtggaaggaatgatgaagcttatagaggaaatacctgaatga

SEQ ID NO: 19742 - DNA, 435 bp, Glycine max
  Peptide Sequence Number=SeqID_136520
atggagaagaacaaagatgaagaagataactcaaagaattgcagaagatggcgggagcaacttgcaaggaaggagtaccgaaaagacaagttaaggccactgaatcgggtctcggggctccgattcttctcggtttccacggaagagtattccaagagaaactatgcaaacaacgttgctgagtacaacactgttttgggttctctcactgcacaaagaaggaatttcttgctgagggatgtgtacgatgatatgatgcttgatggggtaaagcctacgcgtgacactttccattcccttgttgttggaaccatgaaaggagctagaatgcaagatgctttctacttcgtggaacaaatgaaaatcatgggtttgcttcctgatgggtggggtggaatgatgctgttgttagggattaatgagtggaatgcttga

SEQ ID NO: 19743 - DNA, 1356 bp, Glycine max
  Peptide Sequence Number=SeqID_136521
cctccacacttcactcacaccctcatgtcttctacttcttcttcgtcatcatcatcatcatcaacttcttcttcaaccccatatgacgctgttgcccctgatatccctggccctagtacgaggagaaccacccgtagtggtcaatttgaagcttcttcctcctcctctcagcgtcaacgtgctatgaatgaggtcttgcctgagccttttcttgaagctttggccacccaacttgcccttgatgctgccaactacaatggtcgtctttctgctgcttctgcccttgccattttatttcagctggagtacatgtattggcatcggacggccaggaacttctcgacagggagacacaggtttttcgacccaccggtgtttgacccttcggatcaccacctcctccagaacctgctctgtcgctgcctcgccctctccgacacccacctggcctgcggcttcgtcgacggcaccgtgcgcctcttcgacctcgaaacccgggcccacgtcaccaccttcttgtccctacacggccacctcttcgggcctttctcacgctcagtctcgggcattgttatcttcaactctaacattgccttcgccaggctggacggggatatctacgtggataacgtgaacgggcccgggcctgggcccagccaagctcgccgggccgtggagggtgacgttgtcaacaacggggtgctggtcgggttcgctggaacgggccggtggtgggtgggcctgttcgcgggaatagcggggcgggcttttcagatatgggacgcgcggagcgaggagcgcgtgttcgttggtggttctttgacggatccagaaacggttatggggtggcatatgctgacggagttagttgaagccgtggggcgcgtgcgggtgacggagcgtgagtatgttgtggcgtgcacgggttcgaggttggtgtgtttcagttttcggaacccggaggtgttgttgcgtgacgtggggtccacgacggggttcgtggtgagttcgctggacgcgagtcaggaggcgtatgtggtggttgagaggaacggcgtgggaacggttcggcgagtgagcacgttggagcggttgagtcggtttcggttgaaccggttattatgggttcagggtttgtgggcttgcatgaaccttggctacgcgttaacctattcgccttcgccttcgccttccttgagggtttgggacattgagcaagccataggacgcttgtgtgtcacacttggcctcagagctggagagctgaatagcttcgtggccaatgacagacacgtcgctatctcttccaatgacaataacattaacttattggattttggtgtacaggatccttag

SEQ ID NO: 19744 - DNA, 363 bp, Glycine max
  Peptide Sequence Number=SeqID_136522
atgaaggtggagggtttgctttccataaccagtagccaagacctgcgtctctcacttcagtccttgcaagactcgattttgcttcaccagaatcaccacaacaatgagcacatactatttgctggaattaggtctaaaaacatggtagcgtggaatagtaataataataatattgcttctaatgatatatgtggtggtggaggaggagggaagtttgtgtttaacgctccttcgactttgatagggctggcgacggtggcatcaatgatgttgatgaagacgtcgacaaacttggaccaccccaacgccgatgagctccagatctgcaattatatcaggttacaatttggaggtggacggtga

SEQ ID NO: 19745 - DNA, 287 bp, Glycine max
  Peptide Sequence Number=SeqID_136523
agcatcttctccgacaaagaccatcgtctccgacaaccaccatctcgtgtccgttgcgtctcgttccgtttgaagccgccgccgacaaaggcccttggttgttgttggttgtcttcatcgtggtctacattgtactgtttaaggaagataagctggttcctggggtttatgtggggctcattgatgaagctgacttgcgagcagtgagtgaacgactttcgggaacagcctgctgccatccttcatcagtggtgtgtcatcctgtgccacattatcagtttcgttga

SEQ ID NO: 19746 - DNA, 1209 bp, Glycine max
  Peptide Sequence Number=SeqID_136524
atgtcaggtgacacacttcttattcaagaagccctgggagagaaggtaggaaaattcatacaatgtgtggcatgttttttaggacgtttagtcatagcattcatcaagggttggcttctaacccttgtccttctatcttgtattccacctcttgtaatctctggttccatgatgagctttacttttgcaaagttgccatcccatggacaagcagcttattctgaagcagcaactgtagtagagcgcacaattgattcaattcgacaagttgcatcatttacaggcgagagtcaagctatagctcaatacaatcaatccttaaccaaagcttacaggactgcagtgcaagatggagtggttgctgggaggataatagacagtgctaagattcttgcttggagttttagtgattcaaatttttcaattggtgatgcattagtgacagaaaatttgccttcatttgttcatcataaaaagtggtttcctggagcacaagctttcgcggtaggtgtcaccagtattgtgtttgtgttaatcattggttttggttatgtcgcatttttcgttctccgcagaagaaagacacaagaagaagttgaagattgggaactggagtattggcctcacaggataggtttccatgagatcgatgcagcaacaacggggttttctgaagagaatgtggttgttgtaggagggaccaggaaggtatataaaggggttttgcatggggtagaagttgcagtcaagagaattcctcaagaaagggaagaagggatgagacagtttttggccgaggtttcaagccttggcagaatgaagcacagaaatttagtaggattaagaggctggtgcaaaaaagaaaagggaaatttgattctagtttatgacttcatgagaaatggaagtttagacaaatggatatttgagtgtgaagagggaatgatgctaacatgggaagagaggattcaagttttgaaaaatgtagccacagggattctatacctgcatgagggttgggaagttaaggtcttgcatagggacattcaagcaaacaatgttcttcttcataaggacatgaatgcaaggctgggagatttcggattggctcgtatgcatgatcatcagggacaagtggtcagcacaacaagagtaatagggacactaggatacattgctcctgaagtgattcaaagaggaacaacgtga

SEQ ID NO: 19747 - DNA, 1563 bp, Glycine max
  Peptide Sequence Number=SeqID_136525
atggtggaggatgttgatgaagagaaggagaaggaagaaaaaaagaaaaagaagattaaggaagtgtcacatgaatgctccttggtgaacaagcacaagcccatttggatgagaaagcctgaggagatgacaaaggaggagtattctgccataatgaacagcagttcaatcagtttaataaggagtatgacaaaggaggagtattctgccataatgaacagcagttcaatcagtttaataaggagtatgacaaaggaggagtattctgccaaggcaactacttgcaaattgatggagggtatccgagagcctcaaacctatttgatacaatttacagaaccaaaaggaagcaaatgcaacctgctagaatgtgatagacaagttacaaatagggtgggaacagaagcaaaaacaaggctagtgaatgccactgagaattctgatttagaaagacgaaaacctaaaaagttagcctcaaaagtggacagtgccataaggagtgagagtgagacttggtcaaatttgggagcatcccacctccatagttttgcttctgtagtggactgggctataaggagtagcaggactgtgtcgaatttgggaacatcacctgtccctagttttgcttcggcagaggacaataatgcgatgagggttgttcctgcacgattattcacctgggctgagcttgtagcagccaccaacaatttctcaattcacaaccagattggtgctggctgtttcagtgttgtgtacagaggtaaacttgtcgatggtcgtgaggttgcaatcaagacgggtggaacctggccaaagagagagagcaaattgaccttgttatccggtttacaccacaagaacttgattaggctggttggattctgtgaaacgaattatgaaagactcagtgtgtatgagtacatgaagaatgggtccttgtatgatcgtttgcatgacaagggtagcagtgtcttgaattcgtggaaaatgaggatcaaaattgctttggatgcctctcgaggaatagaatatcttcataattatgcagattcatttattattcacggagatatcaagtcttccaacattcttcttgatgccacctggacggcaagagtatctgattttggatggaagtttatgagaaacagacgacgtataattgagaacactgatcctgagtacgttattcgaggtgcattgtcagcagagagtgatgtgcatgggcttggagttgtactgtttgaacttctaacaggaaagagacctacattcgtgtacggggaagatggaggcaccctattaagtagaaaacatttggtagactttgctgtgactgctatttcaaatggatttttggagaaaattttggatcaaagggctggacaacccgatgtgaatgaaacagaagcagtaaagttagtggctgataccgctatccgttatgtgaatttgaaactgaaagatagaccaaccatggctgacattgtagtcagattagagcgggctttggctatttttgaatatgatagcattttcagggctttggtttcgaattgttaa

SEQ ID NO: 19748 - DNA, 615 bp, Glycine max
  Peptide Sequence Number=SeqID_136526
atggcaagcatgatgacagagtctacaaatcaaatgatagataggtggattgcacaaatcaactccggcaaccccaaaatcgatgtcgaaagagaggttgtagaaacggccggagaaatcattgcaaaaacaagctttggcatgaagggaaaaaatgcaaaggaagtgtctgaaaaactacgtgccctacaaatgacactttttaagacaacaagatatgtaggtgttccatttggcaagtgtttcaacgtcaagaaaaccctagaggccaagaagcttgggaaagagattgacaagctattgttatccgtcataacatctcgtatgaaatcaatcaaaaggcaaactcaagaagacttgttgggattgttgttgcaaggaaacaataatcatcaagatgatggcaagttagggaagacattcaccactagagacttgttggatgagtgcaagactttcttctttgctggccatgaaacaacggcattggctatctcatggacgttgtttcttctagctatgcatgaagattggcaaatccagttaagagatgagataagagaagtggtcggtgataaagaacttgatatcaacacgcttgcggggcttagaaag

SEQ ID NO: 19749 - DNA, 147 bp, Glycine max
  Peptide Sequence Number=SeqID_136527
atgggtacaactgatattggacttgtctaccatggagacacgtctagtgctcttgttggttatttagattttgactatgctgtagatttggatgcaaggagaactatgacaagcttctatggaggttgggtctttgagcttccttaa

SEQ ID NO: 19750 - DNA, 249 bp, Glycine max
  Peptide Sequence Number=SeqID_136528
atggttggctcgggcatgaccacacatatccaggatgaattgattacctctgaatctcgagtgttgcctagtcaagcaaaagccgtggaggatgaagcccaagatgtctttcaagataaaagaagaggtgaaaaggaatttggcgttggcttcttggctgtggctcgatacccgaaatgggtcgtcaacattgtgccagtccctaagaaggatgggaagatgcgatgtgcgtggactatcaagatctaa

SEQ ID NO: 19751 - DNA, 531 bp, Glycine max
  Peptide Sequence Number=SeqID_136529
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgctttttcgtga

SEQ ID NO: 19752 - DNA, 405 bp, Glycine max
  Peptide Sequence Number=SeqID_136530
atggaggacagtcattgtgctttctatgttaaaactgttgtgaatccgtctggggaagaacatgttggtcatatcctgctaactatgaggttggtcagtgttgaaaaagttgttgacgatgaagctcaagtcttgtttccgacttcagaaatccagtccctgtatgacatttatgagaaacctgttgagttattgtgggatgggaaaaaatttggcctaccaaatgcagatgcatccttcttcttgacatattttgatgtaaatgaaataatatcagtgtatggattccttgagcctcaatccgtacacaatgcaaaggatagacgtgctgaatgtcgacaatatattgaaacatgggtgaaggaatcccaagaagaggtctacctaggagcctacttgaattag

SEQ ID NO: 19753 - DNA, 264 bp, Glycine max
  Peptide Sequence Number=SeqID_136531
atgacccttcggtcacttttccttgtttatgctgtagagcctgcattagggccagctcctgatcatgcagagcttgtagaatgtggtccatcagctgccagtgatgagcgtcgaggagtttattcagaggatgttatagcaccagagccatctcctcagcctgagcctgagccatcagcaccagtgccagatctgcatattcctcaggattcatctactagcactctagcattggatctaaatgagcatgcacaggatgattga

SEQ ID NO: 19754 - DNA, 240 bp, Glycine max
  Peptide Sequence Number=SeqID_136532
atgcttagtttttggggtatatgggttgagcggagtgagatattgaatatccattatagcgactctgtccgccaatgcactgctatgatatacagtgcattattagctttctgccattttttgcattctgcaattgacagcactgctaagatgcaaggcgggtttgaagatttgtctcatcttgggctgggtgggcatagcagtagcactttagcacttgtttttgagagtatgagataa

SEQ ID NO: 19755 - DNA, 165 bp, Glycine max
  Peptide Sequence Number=SeqID_136533
atgggggacgctgagaaaattggagaaggtgcagaatcggaggcaacaagagcttttttgaatgaggacgctgagaaaattggagaaggtgcaaaatcaaaggcaagaacagcgagtacaaaggaatgcatgcagaacagggttatttataggtgcaaaaattag

SEQ ID NO: 19756 - DNA, 405 bp, Glycine max
  Peptide Sequence Number=SeqID_136534
atggacaatgtctatatcatttccaatcccaagtcaaagtatccagttcttcaattagacttgaggtttacttactgttcctatctcctagttgagacagttgctcaatttggtgtcatttttttgctctttgcattgggcttagagctttcaacaagaaagcttcgagttgttcaggcagtggctattcttggaggcctactccaaattttcttatctatgtccttgtgtggaataacagcttcaaggctcttcgctatgcgaaggtataggggagggatgttgtacgcggtcttacccttgcatatgcaaagaggctgtttccggattcgaacccatgaccaacaagtcaccaaggcacaactttaccgctgcaccagggctcgccctcacttctacaaatag

SEQ ID NO: 19757 - DNA, 288 bp, Glycine max
  Peptide Sequence Number=SeqID_136535
atggcttgttttgatgatgatttacaatctccctccttggttgtgcatcaagcaaaaatacattgtgctttgtctgatgatagcgggtccaagcggacccattgggctgggcgtgcatccatcactaagcgtggcttcagtgcgcttagcgtgaagaaggaatctggcagagcatatgaatcaaagcagcatgctaagcgtgagatcaactcgctaagtgagtcgttcgtctcttgccagactcagcgcaacattggtgctaagcccaaatccacttactcgcgctaa

SEQ ID NO: 19758 - DNA, 936 bp, Glycine max
  Peptide Sequence Number=SeqID_136536
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggtgtggccggagcacatattgtgttttcgggcttgtgctttttagcggctatttggcattgggggtggcttgtttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttatggggatggaattgttagggccgatgttccttttcgaagggcagaatctaaatatagtgtggaacaagtag

SEQ ID NO: 19759 - DNA, 177 bp, Glycine max
  Peptide Sequence Number=SeqID_136537
atgtgggtgcaagccattggtctgtttgctcaagcgacctgtgctcctgattttggacttccaagaccgttcaatcagagattactcgtcttgcacgttggtggggagagaagtgagttatcaagaataggatgttggacaaatggcctcagttaccttaagaaaaaggggggttga

SEQ ID NO: 19760 - DNA, 414 bp, Glycine max
  Peptide Sequence Number=SeqID_136538
atggttggcaaagatttgagaagtacgggcaatcccatgatgtgcaaattcaaaacgagcacgccttctcatcatatggcttgcctctccaactatacaccacccaatgtggcatacactctcaatgaaaatctcaataactccactcccatactcattgagagccagcaaccccaaactgatcatgcacatgtctctcgacccatggaggagacacatgaaattccccaccacgatctagccgacttcgagccttggctcgaatatgccactgaagggcaagcagttggtggtataccccttgcaaaacactttggagggccctcagtatcacccacagcgtttaaaaaccctcatgactatggcaggaatgggaaagttggatcatctagaggaaaggctcagggccattga

SEQ ID NO: 19761 - DNA, 1365 bp, Glycine max
  Peptide Sequence Number=SeqID_136539
atgcaaattgaggaggtagaagctctccttgcgcatgagatgcgtctagaaaaatctcagaagaaacttgcctctgaaacagtttctttgaatcttactgaagcctcttcctcgactttgcaacagcaatcgtcctcctttgctaaggcacatgttgcttctgaatctgtgaatttgaactacaacttgaattttggttttcacggctttggacgtgcctcggattgctatcatccttatgatcagaactatcaacttcaagtgcctgctaattttcaaggttttcagacttcatcgaatccttggaatcaattcctggcagcacagcagcactatggttcttatcaacccaataatttccctaattttgctgatccgtggggaatgatgccaaggaaattgcaatttcctcaacagtttcagcaatctcactctcaagaacaagcacaaaatcctcctggtgctttgattactaattctggagtacttggttcatgtcctacaactagcagtacctggttccctgattcgggagcttcctatcatgccactgcagaccagaataatatccatcaacttagttcctttgaatgtccagaccaaatcttcattggtaacagacaaggcaaagtgggtcctgatggcttgtaccagtttccaagcctccacttgcagcctcagtccaagctacctctcaacaaatttctcacagatttggggataattcacagacttgcttgtcctcacacacatcaccaaaatggtgtggtggagaggaagcattgccacattgtagagttaggtcttactctacttagtcatgcatcaatgcctcttgagttttgggatcatgactttgttactgctgtctatcttataaatagactacccactgcttccttaaatttttctgttccttatactgttctgtttggtcaacctccttcatatcagcagcatcttaaagcctttggttgtgcttgttttgcttttctaagaccttacaactctcataaattggaattcagatctcatgagtgtctttttctaggatactctaatcataagggctataaatgtttgtctcccagtggaaagtctacaaatattgtttctgaacctgtcactcaaccagttgctaatgattctatcccagaacttccttcttccactgcttctgcatctgattcctcctcctcctatgagtcagcctcccattatcctattcctcacaattctcctcctatgcagaccagggctaagtctgagtcaaaatctgtcaaacaggcgtttcaggatcctaattgtcaggctgctgtagtggccacaatcgcagccaaaaatagtgtatgtagcagctattga

SEQ ID NO: 19762 - DNA, 192 bp, Glycine max
  Peptide Sequence Number=SeqID_136540
atgcagtgtacgcaggattcatggtgcctgaatcctgatcagcttggttcgcatattgaagaggaatattcggacaaactagaagatgaagagaagcaaggaggagcaggaggtggaggattagattcggccattgtaggaccttcaagttcggcataccatattagaaacagagagagagagagaaactaa

SEQ ID NO: 19763 - DNA, 474 bp, Glycine max
  Peptide Sequence Number=SeqID_136541
atgggacatggcgcatatttgaaaagcggatactatcaaatccacatgaaagaaggaataagtgtggattgtggaagcaatgacttccaagattattttgatgatggcaaagaatcaagagttaagcaagttccaaagaatcaggagtcaaaaagcttcaagaatcaagtttcaaagaatcaagattcaagaataatcaagtttcaagattcaatcaagtttcaagaatcaagattcaagaataatcaagatcaagattcaagactcaagattcaagaatcaagagaagactcaatcaagataagtactaaaaaaaagtttttcaaaacattgagtagcacaagaatttttcacaaaatcttttaccaaagagttttactctctagtaatcaattaccagaaggtaataatcaattaccagtagccaacattattttcaaaactgatttacaaaactgtaatcgattaccataa

SEQ ID NO: 19764 - DNA, 213 bp, Glycine max
  Peptide Sequence Number=SeqID_136542
atggcgacctcgccgccagaagagcggccgaaacgaacgccacatgtgccgatgaagtgcattgtttggcacgtcaaggaaagggaagggtccactagaagaagggagacaagcaaaagggctcaccggggacagtgggttgccagaaaagtgacggtggccgacaaaggccagaaaaatgcgacaaccaataaggtccactggggacagtag

SEQ ID NO: 19765 - DNA, 577 bp, Glycine max
  Peptide Sequence Number=SeqID_136543
atggttttgagggtttctctcattctagttctccttgtgttgcactgttcctgcactgtgcaatccatttttgggcatcacaatcacaatgatctcaacaagaatggatcttctcttgctgcagtcaagtttcctgatcatgcacacttcaatgctgtttcttcttccacagaaactgggtgtagcttctccaagtcagagaaatttgagccttcggtagcaaccatgacatcaaatggtgacacggatggtgaagagggagaggcttttgtggcagcaaaacagcacaagcaatctgtgaaactcaatttgagacaccactcagtgagcaaagattctgagcctaaaaggtctgtggctgattctacagtgagagacttgaagagaattcagacccttcacagaagggtcatagagaagaagaaccaaaacacaatttcaaggctggagaaagcaccggagcaatcaaagaagtcctataagctggcggcagcggcggctgctccggctgccccgccggagtatttctccggtcagcttgtggcaaccttggagtcaggggtcagtcttggctctg

SEQ ID NO: 19766 - DNA, 558 bp, Glycine max
  Peptide Sequence Number=SeqID_136544
atggaaattatcaacaaaatacagattcatggtgataagatagaggatgtaaaagtaattgagaagatacttcgatcgatgacatcaaagttcaattatgtggtgtgttcaattgaagagtcaaagaaccttgatcagctctcaattgatgaactccaaggttcattattggttcgtgagcacaagttgatcgagcaagacaatgaggtgcaagctctaaaagcttcaactaactacaatgctacaacacagaatcaattagcagatcgaggtggaggaaaaggaggtcgaggcaatagagatgcatgtagcaaaagagaaggacaaggtaatagaggcagagccaacccgcccagcgaggacgttatctcttccgtgctcagtgtgcctaatctcactaagtcaaaattcacttactctcgcttagcgagccttcgaaaactgaaaggtccaagagcctttaaaactctgaagttggcggaaataaaagagggagttcaaaaagttcgcatgggaggaagtagtagagacacaaagagagaagcaaagagagcttag

SEQ ID NO: 19767 - DNA, 408 bp, Glycine max
  Peptide Sequence Number=SeqID_136545
atggcttcaagaagaagattggttgatccatccgaaaaggtaatggagtttaagtacaataaccaagtttggaccctagttgttccacccaaaagggtaaaacctatagggtgtaaatgggtcttcaagaagaagactggcatggatggtgaaacatcttatgtgctaggaatcaggatctatagagatagatcattgagattgtttggccttagtcaagtacatatattgacaaagtgcttaggcacttcggtatgcatgattccaataagggattcttgcctgccacatggcatatacttgtccaagggacagtatgctactacatcaaatgaaagggaacacatgagtaagatttcatatgcttcaacaataggatctatcatgtatgccatgatgtgtacctga

SEQ ID NO: 19768 - DNA, 528 bp, Glycine max
  Peptide Sequence Number=SeqID_136546
atggcagagagatcaggggtaatgatgtcgattcactgtcatggtggcgagatcaaaaaagaaaggaagggaggttggggtgacgagggaaggggagagggaagagaaaaggagaagagaacttggtgcagaggaagagggagagggaagaaaagggaaaagaatgcttggggcgaggagattggggtagaggaaaggggaaagggaagagaaaggaactgtggaatagggggaggggaaaggttctcatggaagagaaagaaggagatgttgaagatgtcatcacgtgggtctaaagagtattggcagattgttgagaatggagtagcagaaccagcaacaagcacaatcttaacataccagcagaaaattgaacttgatgggcaacgattgaaggatctcaaagcaaagaactatcttttccaagctattgatcgctcaatcctggaaaccattctttgcaaagacacctccaaacatatttgggattccatgaagaagaagtaccaaggaacaacaagagcatag

SEQ ID NO: 19769 - DNA, 300 bp, Glycine max
  Peptide Sequence Number=SeqID_136547
atggggagtcgcaggagaactgggacatggcagcgtacaccaccacacccgaccacagcattcaatacggcgcaaggcatggcccaggcctttcgtgctggcgagtacttccgccgcatgatggttttgcgtgttcccttacgcccgcacccgatcgacgctccacgagctcagacggtgtttcttgaagaagatgatcatcggcatgaggaaagagtcgcgagttcgagaatgagatttcggaaactttcgggtggaagagaggatgaaggttataaaggaaatacgcgaacattttga

SEQ ID NO: 19770 - DNA, 373 bp, Glycine max
  Peptide Sequence Number=SeqID_136548
atgcctgctctcaaaataatgctttcagattattttagcatctcaaatggtcgatatcacccggagcttcttcgcaggtatcctattctcaaggatttggaagcgaataagattgatgtcatagagtttcaaagcatacccaagttggtgaggggaaatatttgtgataattatgggttcgagtttcctctgaaggcaaaattattgagtgatgagaataagacgtgttcatgtcccaaccaagttaataaaaacctattcacatataggtacggacttagagctcttaactttgagtatgcttcagtgtgtctacaagataggtacggacttagagctcttaactttgagtatgtttcagtgtgtctccaag

SEQ ID NO: 19771 - DNA, 309 bp, Glycine max
  Peptide Sequence Number=SeqID_136549
atggcgagagtgtgcgaaattgaatttcgagcaacatatccaaatttcatgaaaatccaacattttgggtttctacgggaaaataaaaagctacaatgcaaagggttttcctctaagctcagacatgattctgaaattcccaacggtgagaatgctcgaaattgggttgcgaacgtggtgctcaaatttcacgacgatccaacggtgaatgagtccgagattatcgtttttccgagacaggttttgtggactgcgggaaaaagaaagggttttgagaggagaaggggaaaaacgaaaatgagaggctga

SEQ ID NO: 19772 - DNA, 192 bp, Glycine max
  Peptide Sequence Number=SeqID_136550
atggaaggtggagagaaatctcaacctatccctccaccaccaccacccccacacccacccattcaaaaaagcatggaaaaccctcactctagagccactacatacactgtttggccactacagtccatatttggaaaagcattgttattcaaactttgtagtgcccccaaaatgccgtctacaccactatag

SEQ ID NO: 19773 - DNA, 177 bp, Glycine max
  Peptide Sequence Number=SeqID_136551
atgggtgatcaagccacaagcatgctcttggacctttcagattctgaaggcttgcttagcgaggctggctcgctaagcgagaggtttcccaacccgctaagcaagctatatgcctcgcttagcggatgtcactcgctaagcggatttgtcacgcttaacaagtcatcaattacttga

SEQ ID NO: 19774 - DNA, 310 bp, Glycine max
  Peptide Sequence Number=SeqID_136552
atgattcctataaaaacccatcacttctctagtgatctttcaaagccaaaaaaggttggttgtttcaagcacttcagtgtagatctctctcgcttgtatgagattcactatccaatggacgagaatagaagttccaacgaacccaacaagtggaagatgcctctcttcgttttcttcaaagatgcaaggaatgttttcaagctggatgctctatctcgggagatattagggattgcactcccctcagcactggccgtttctgctgatccaattgcttctctcatagacacagcattcataggccgtttag

SEQ ID NO: 19775 - DNA, 285 bp, Glycine max
  Peptide Sequence Number=SeqID_136553
ccggtgatacgacgggttgttgaccgacgctacaatcacaaacaccatgccaacgacgaggagcctcccgacgatgagtctatcgacaatctgcctctgcggtctagaaaggtacaaggcgaatgcgttcaggatcaccgccagagaatcatggtggaggaaggtggcggacatggagaggatattgaggcggtcatggaaagtgactgtggcgacagtggcaccggtgggagtgaaagaaggttgacggaaagtgacattggcgactgttccaaaaacggttaa

SEQ ID NO: 19776 - DNA, 590 bp, Glycine max
  Peptide Sequence Number=SeqID_136554
gagccaatacaatatgcaagttttcatcggttactagcagtaagaagagtaaggacaaagttggaaagaaaaagcgacttattgcttcagcatcaacagcactactttttggcacaatccttggtctcattcaagctgcagttcttatatttgcaaccaaacctctgttaggtgttatgggtgtcaaacgagattctcctatgctaaaacctgcagagagctacttaagattgagatcgttcggggcaccagcagtacttctctccttggccatgcaaggcatctttcgagggttcaaggatacaacaactcctttatatgtcatcgtttcgggatatgcattgaatgtcatattggacccaatttttattttcacattgaagttaggcatcaaaggtgcagccattgcacatgttctctcccagaggattgttgatgctaaagcaacatcattggctgcaaggctaggttcaattcccatggctgcatttcaaacatgcctacaggtctggatgacatcgtcccttcttgcagatggtttggctgttgctgttcaggaaatgttggattccaatttctattttcaataa

SEQ ID NO: 19777 - DNA, 180 bp, Glycine max
  Peptide Sequence Number=SeqID_136555
atggggcttttacaaaagaaaacaatggtatatcatgtgcttgtggatcttgtttcttcttctgcaaatgcaacgcctggtcttggaaggtatcctccattcaagagagagattatggcaattgtaagttcatccttagaggcatttaaaaatgaatccaaaaaatggtggttgcactag

SEQ ID NO: 19778 - DNA, 289 bp, Glycine max
  Peptide Sequence Number=SeqID_136556
atgaggaagcccaaagacgcgcttagcgtgaaaactggtgctaagcgtgaagaaattccgaatttcaatatacttcttgttgttgccaatcctagcgttgattggaaagtgagcatacacgaacctcatcttgtaacgatatcccttggtgaggccggtgatcagattctcgatgtggctcagcaaggtcttgaagatcttctcgccgttcttggagtttctgggaggagcttcattgaacgatggaggttggaagcaatagagggaagcactgcatggtgggaagaaa

SEQ ID NO: 19779 - DNA, 477 bp, Glycine max
  Peptide Sequence Number=SeqID_136557
atgactgaccacggaaccagaaagacgaccaccgaccgcctcgaggaggccatcgtccgcctcaccaacagtcacacttccatcaatgatcgatataatgacctctccggcaaggttgactcaatcctcgagcacttgcgtttacttgactccggcaatcacacctccaccgtgccagcgaatcctccaaatcatccacataacgcggtcaaaatcgacataccaaggtttgatggccgtgatcccttgggatggatctttaagatcacgcaactgttccaataccagaacacgccggaagaagagcgtatcatagttgcatccctttatctcgacagcgctgccttgagctggtaccagtggatgttcaacaacgggttaatcacgccatggaatggtttccttcaagctctcgaatctcgatttgctccaacgttttacgaagatcccaaaggagccttgttcaaattaacatag

SEQ ID NO: 19780 - DNA, 987 bp, Glycine max
  Peptide Sequence Number=SeqID_136558
atggcactccaaccaatttccctcttacaagctacagccctagctaagctacaggaggagaagttacgggatagagccacccccgtaccacgaagttttccccatcccgaaccttcttctacctctaaccctaacatctccgccaaacctaagtcaccttttgttcagcgaactccggcagaaatggccttcaggagagagaagggactttgttacaattgtgacgaaaagtggaatgcgggtcatcggtgcaaggggaaatccaccattcctgactcagtggaccatgaggtcgaggatgaacgaggtgcaatcgtgattgaaaatcacgagtttcagggtgatgcaaattgctcacacataagccttcatgctctggccggactaccatcatcggaaactttcagaatatatggcagcatcaagaattctaaactaacgattcttgtggatagcggaagtacccataacttcctccaacctcgaatagcgcaatttcttcatctaccagctcaatacacccacccacttcaagtaatggtgggaaatgggacgatgttgacaagtgaccaggtctgcccggagactcaggtcatcatacaaggcaaccctttcgtgatatcattccatctccttccgataagcgggggggacgccgtacttggcatagattggcttaggagattgggaccagttaccactgattacactgagtctatcatcaacccaattaaagcgtctcattcagacgggctcaacttcagagttctatcaattgcacatcatcaccccaaaccagcccgacccaccccactcttcacaccccatccaatctgtggagcacctacttcttcggtatggtcatctcttccaaccaccatcacagcttctgcctccacgacaggtggtacatcgcattaccttgaagccatccacaactccgataagtgtcagaccttactgatatccacattttcagaagaatga

SEQ ID NO: 19781 - DNA, 465 bp, Glycine max
  Peptide Sequence Number=SeqID_136559
atgacaacggatatctcggctcttgcatcgatgaagaacgtagcgaaatgcgatacttggtcgtcctcagtggcggaccgggcccaagtcccctggaagggggcgccagagagggtgagaaccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggatatataaatagtagactactcttaaatccttggctctctcaagggatggaccctattgcttcgatgcatgttagggacgcggtggggaagggtggcgcagtcaactgtgggcggaggaagaagatgcaaaatgaatatggacgtaagaaaggaaagatacaccccttattcgagaaagggaaaactccttatcgtaactga

SEQ ID NO: 19782 - DNA, 255 bp, Glycine max
  Peptide Sequence Number=SeqID_136560
atggcgatggcgcaggtcagaccagttgttagggacgcggtggggaagggtggcgcagtcaactgtgggcggaggaagaagatgcaaaatgaatatggactgcgtgctggcctcgcggtggctatgggcgaagaagacagtggtggtatcaacggagaaggctgtgcctggacggtgctgctaacattgcatgccacacaaaagcgcgaacgcgagaaagctaaaacgaaaggagagagaagaatgaaaagttaa

SEQ ID NO: 19783 - DNA, 2073 bp, Glycine max
  Peptide Sequence Number=SeqID_136561
atggattaccgagctctcaactcggtcacggtccgagatcgcttccctattcccacgatcgacgagctactagatgagttagggtgcgcctcctggttctcaaagttaaatctccggcaggggttccatcaaatattaatggagaagcacaatgggcactttgagtacctggtgatgcccttcgggctttgcaatgccctatcgacattccaatccgccatgaaccagcttcttcaaccattcttgaggcgatttgcaaccgtgttcttcgatgacatcttaatatacaacaactcgttgtcatcctacatactccatctcgagactatctttcgcaccctccagcaaggcgaattcttcctcaaacgttctaagtgcttgtttgcgcaagaaagcatcgaatatctgggtcacattgtctcaggcaagggaggttctaccgcaagttcatcaagaactatgcttccattgcatcccctcttacaaaagctcctgtgtaaggatgctttcagctggacacaggaatctcaggtagccttcgatcaacttaaagctgccatgaccaatgcccgagtgttggccttaccaaacttctcagaaccattcgtgattgagacagatgcatctgggaccgccatcggagctgtgctcatgcaaaatggccaccctttagcatatttcagtaagaaccttggccctcgtttactccatgcttccacttacatacgagaattacatgccatcgtagcagcaatccggagatggagacaatacctcctgggtcgtcccttcacaatcctcactgatcacaagagcattcgcgagctgatgacacaagtaattcagactccagaacagcactattatctttcgaaattgcctggctacgattattccatacaatacaagtctggcgtcactaacgtagtggctgacgcgctttcgagagctccagctaccgacggggagctactcatcctctccgttcctcagcttgactttcttcatgacatcaagcactcattgaaaaccaatctggaattccagcaactcatgaagttgatccaggatgaccctacatcacaccctgattatacactttgtgatggcttgattttgttcaagggaaggatttggcttaataagggtaatccttctatccctagcctgctactcgaacaccatgcgactccacttgtggtagttgatcgctattctaaagggatacatttgggtgccttgccaacagggtttaccgcgttcaaggttgcagccttattcatggagatcatctgcaacttacacagatttccgaagagtattgtctcagaccgcgaccccatcttcaccgaggtcatcaaccgcgtcttggagcagtacctccgatgcttcgtccatgatcagccagcatcatggttcccatacttggctctcgtggaatggagctacaacacctcgcgacactccagctcgggtctcaccccgttcgaagtcacctatggtaagccacctccaaccatagttgactatatcactggtgcaactaagaatgaagcaattcacgcagtgctggatgaacgtcaagcattgcactcaaagctccagcagaggttgaagaaggcccaagaggtaatgacgaagtatacagatacaaaacgcgaggatgtaaccttcgacgtgggccagtgggtatacgtgaaattgagacctggtcgacaaacatctatcgcggggcaacgccacccaaagctgtccaagagattttttgggtccttccagatcactgaacgcataggacatgttgcctattgtctcaaacttccactggagtctcaaatccatctgggtgagccgccggaggatacgacttgggaatcatggactgagttatgcgagacataccaccttgaggataaggtggattttcgggagggcggtagtgttagcagcaccatccaggcacagcctcctccgttgataccaccaccgtcttctccgcccatagccaccgcgaggccagcacgcactaggaagacacctccacacctgcacgactattatacgaacacgtga

SEQ ID NO: 19784 - DNA, 414 bp, Glycine max
  Peptide Sequence Number=SeqID_136562
atggccccaaacttcagaggtagatgggctagggaggtatcatgccagaggtggaagcgagccatcaactgcagcagcacacgctctagtgcgctggaaaacaaatttgcactggtgatgtttggcacgaaaagaatgggcactgggaggtggcagcggcagtcgccgaaaaatgtgccagagttgcagaaacaggtcgtcagaataagtgtgacgagcataaaggcccaccaaaatgtggaaagaagggtgacgagcagagagcggccggaaaagacgtcagagaaggagaaagggccgtctgaaaagaggaagcaggtcgctggaataagtgcgaccaccagaaaggtccactggggacacggtgggggacggttttcgttattccctcaacctggcactgataccatgtaa

SEQ ID NO: 19785 - DNA, 297 bp, Glycine max
  Peptide Sequence Number=SeqID_136563
atggtgatggtgataatttcaatagcaatgacgacgattaagttatcaatggtggttgcaatggtagtgacaattgcattggaggtggtggtggaggggcattggtggtggtggcaatgcaaatgtgacactaatgatggtggtggcaatgctagtggtggtggcaatgacaagaatgattatggtggtggtaactatgacagaggtggtattagtggcggtgatagtgacaataatggtggttgtgacaccctctaccccacacatatatgtactaataataaaagaaataattaa

SEQ ID NO: 19786 - DNA, 135 bp, Glycine max
  Peptide Sequence Number=SeqID_136564
atgcctttgacaggaggggggacctacaaaacaaaggactccagcactcaaggtagtagtcttgacatgcagagggtgacgagtttgtcaagcccccaagtatggacaagtgttgtcctatgtcaggtgtggtag

SEQ ID NO: 19787 - DNA, 237 bp, Glycine max
  Peptide Sequence Number=SeqID_136565
atgctgataatacatgagaacggaggagagcttgggagggctttgcaaaaatcaactgtgatggagcatattctctgcagcgatggggactttatccaagcttttgctaggagaggcttgaaccttgctccattcaagaagctgaactatgggcaatttggtatggaagctaacagtatggcagattcctttgccaagactggtttatctttaaaatcaagaattttaaacaactaa

SEQ ID NO: 19788 - DNA, 207 bp, Glycine max
  Peptide Sequence Number=SeqID_136566
atgaggggtggaggttgcacagcagctcgcccaggtgagctgcttgcttcctctagaagtagcctagctcgcccaagtgagcttagttttctagtgggcccaggggctgaaaagtgccccaaaagtgacccttttgccctcattttgagtattttacacatttcctttcgaaacatcacaaatccctacagattgcacgacaattag

SEQ ID NO: 19789 - DNA, 339 bp, Glycine max
  Peptide Sequence Number=SeqID_136567
atgaggggtggaggttgcacagcagcttgcccaggcgggctcagctcgctattctgtttgaatcgaaaagaaagaagagtttatggaaagggattcacaggttcaaggaagtatttacaaagtataaggctaagacaagaaagagggcttcgaaccattgggagaatcgagctggcatatggtcgaatcgaagtcaaggcagcaagatttctggacttagcgcaatttctgacaaaacttcacaaaatcagttcgacttcgagcgatatggataaccgttctaaggagcagttatgtgcatgcaaggtgtatgtagcaggacacttggcattaggatag

SEQ ID NO: 19790 - DNA, 609 bp, Glycine max
  Peptide Sequence Number=SeqID_136568
atggtctgtgttgaaaatgctgatatgactgatcgtttgcttgttggttcttttacctttaagtgtcacatcatgcattatattttatgtcgagtcttgcttcctcattctaccaatcttgctcaagcctctgaggaagatttaattctgttatgggccctgcaaactggctgtcaaattgattgggcccatcttgttcactatcatatgcataagacattacaggcaaatgcacatgtcccttatccccaccttgttactctaattttgcagcacttcaatattcctttggttaatgaaccttttatcaaagttaaatgttcctttgccattggagtcgttgcagttgcatcctttgggtataggaaggatttggatggtcaacggattcgtaaacaagacctcccgcctaatgctcctgatgaacgcactccttctccaccaccaagggatcacttctcttcattgttgaatgatgtccttaatgagctttgggatcttcgtgcctttgtcggagaccggtttgattctatggattcatgtattacgcgacttgaggacgatatgagctttattcgtagttgttttgatcctccgattgattcttag

SEQ ID NO: 19791 - DNA, 225 bp, Glycine max
  Peptide Sequence Number=SeqID_136569
atgtcctcgaaggctcgcgtagcgccattttcgtgcttagcgcgagttagtgaatatccgctgagcaagctgggcgcgcttatcacgggaagagaaaaacgcctcactgagcgagctgatgacacgttgagcgcgaagatgcttctcagattctcccaacttgctaaacgggctgagtgtctcgctttgcgcatgattctcgctaagcgcacaagcctcacttag

SEQ ID NO: 19792 - DNA, 483 bp, Glycine max
  Peptide Sequence Number=SeqID_136570
atgccctcgactttaccaggagatgcagacgtgccacacactcctcctaacaaccttcatagtctaagctccccttggtccttcgccataagcaagaccactttgggaaattacggccagctaggtggaaaaattcacttggaagcacctcatctgcagacttacgaagatttcctgacaaggctaggcatcaagcacttggtcacctttgttgaacatcctcagactaacgaacaggtagaggcagctaatagagtcatcctcaaggccttacaaactatactcgatggcctaaagaaagaagaactctacaacatactctgggcgtaccattatacaccccagacagtaaccaacgaaactccttaccgacttacatatgacacagacaccatgatcctcgtaaaattcagggaaccatcgacaacaagattactattcaagcaacaacaaaatgaagaaaaatacgagggtggaacttga

SEQ ID NO: 19793 - DNA, 195 bp, Glycine max
  Peptide Sequence Number=SeqID_136571
atgctggctactggtaatcgattactaccttctgatcagaggtgtgagagatgggagcaaggttggagtaggaaaggacactccaggtctaagctaaggtggccaagtccttcctcagaagcttccaagggccccccctcagcatttagcacaaatccccgccctggcagccataacttggctgcaatagcctga

SEQ ID NO: 19794 - DNA, 1785 bp, Glycine max
  Peptide Sequence Number=SeqID_136572
atgtcttcttttctacctgattccgccattggactaagcggcggtgagtgtcactgcgcttcagcgccaggtcttgggtgtcattctacccttaaccgcttttcagtgtactctgctggagcacttgaatgtggctctttcctagctccacccaaacagttgggtgatgggacgttgagccttgcttcctattctactagcagtctgaccccactaggttcaagtcgacaaggatctgttgacccttatggagagggtattatgggtgactttgcttggaggccactcgtgaagcaggtcggacctgtaggtgggaccgtgccaccatctactgttgctttatctgttggagaagggggtcaacctactaatgaggttggctctattgttgttgctactgaggtcacccacagcactccttcctctgttttggcaaagaggaagagggatgatgctactaggccgtcgggccgcaagaagtcgaaggcccctatgagcctctgtgtcctaaggcaggctataaggctggggcccactgtgggtcgccgcacgactacgcaagatattcctctagctcatttgaccatcgaggcttctgttgctgctactgccacttctgctacttctgctccttcacctcatgtggctgttgttcaagaggtttctcccattgttgttaaagttgttgcaccagccactcaggctgactctgttatggtgtcatcgtccatcgttgcagcccctttgctaattgtcgatgtgatgaccattggtgctcttacggtgctgcctccttcttcgtcagctctggtggtcctccctgctattattttggcggctatggtgtcgcctttttcatcctcgcaccctcgtgtctcccttgatcatctgtgcacctctagtgatactgactcattgtggagtgtaacttacaaaccaaggcaaaagaccccagtaggctttgtttcagccttcaataggaatctatcaggagaacggactgcggcaccaagaggcagtttaaaagatggcatccttggaggcggaggtcgccaagctataaggacgaaccgccaattgtcttccaaggttggtggtgcactggccaagttgttacgcacccagttagatggtgatgacttgtttagacattgcaaggactttcaggttgagaatatggacctggatggtagagtggagagcatggtggctgagaaggacgagcttgccaagagagttgctgagttagaagcccggcttagggaatcagagtccagattggaggagtccgagctacgagctgccaaggagtgggaaaccaacaccgagctcgaggaagagttgattctgtacaagaaggaggcaatagagaaacatcagaaaggctttcagaaggccatcaggaagagattgatgcggaagaggaggctgttgatgaagggtagagtgttgcagagcaaggcgatgacgcttagcttcttccttcctgattgtgaggatttgtgtttgacttacccctggttgaaggtctttcctaaccagtgtggggataggtcgcttgacctgctgaattcctcctttgatggttataaggaaagtactcccccgatggttatgaggagtaagtgtggctttgacctgattaaaagtctttccaataatggggtggcaggtcactttgcggaacttcgacccttggcggtgatcgttgtagttgttggtggaccttgggctttggtaccaagggtgaaccttgggttttgtagatgtgagtaccaagggtag

SEQ ID NO: 19795 - DNA, 201 bp, Glycine max
  Peptide Sequence Number=SeqID_136573
atgtttgaatatgagttccaaacctggtgctcaaatttcatgacaatccaacggttaacgagttcaaaatcgtcattttaccaagataggtttaggcttcaccaagggtggtccttgggtttgtcgagccttggatcagggacgtgtttgtcctggattttgtcaagcccacagagctgtgtcgaggcttaccaaggatag

SEQ ID NO: 19796 - DNA, 567 bp, Glycine max
  Peptide Sequence Number=SeqID_136574
atgacagacaaagacactttacaacaactccaaaaccgcattacggagatggagcaacgccacgaggaaaagttgacaaagctaaatgctaaccatgaccagctagaggctcgtgttagacgtccccaaggcgacgagcaatccgcccacatcttgcccgaaacccaaggagaatcatacccccgatgcataggcgacactatagataacctaagtctttcctacatgcaacgtccatcggcacaaactgtctgtcggcattcttttgtcgaccgcattatggagacagacatacctttggggtggaaaccactcaacctcgagtggtacgatgggacaacaaatctagacgagcacctagatgctttcctgacacaggcgaacctctacaccaacgataatgcgattctatgttttgtcctccctacatctttcaagggagtagcattgacctggtacgatggactcccacccagatctatagacagcatcgacaccctcattgaacggttcagtgcgcaatacgccattagcaggtctctgttggatcgagtggcctcagaataa

SEQ ID NO: 19797 - DNA, 444 bp, Glycine max
  Peptide Sequence Number=SeqID_136575
tcttctgctcttcttttgtctgcttcctggttcttgttctactcctctggatgtcctttgggtcttgctcctgcttggttgttgtctgatctcttaacaaactgggctaagtacccaacctatataagtttcgtctggggtagctggatgggtacctctaggttgaatgctttctcgagaatcatggactcatcgtctgcttgtcacggactagccaaggcggccgagattataacaaaagatgatgacaaaggtgatgacaaaaagctcaaaggtcaatcaaagaatgagttcaagatgttcaagatagaatcaagaacacttcaagattcaagaggaaagttgaattcaagaatcaagaatcaagattcaagagatcaaggttcaagactcaagattcaagaatcaagaaaaggctattcaagaatcaagaaaaaagcttaa

SEQ ID NO: 19798 - DNA, 568 bp, Glycine max
  Peptide Sequence Number=SeqID_136576
gtttctccatttttgagccatcaggagtacctaaaggcttctccatgttgggtagctacagccagcccaacaacaagcctctttctggatatgttcttgtggcaaaagatgtgtccacaaacaccagcaaccctagtctaaagcaaccacttgattacacacttgtgtggaacagtgcatctctggagattgaccaagatggtcccatctatgtttggcttccaatagcaccgaatgggtataaagctgtaggccatgttgtcaccacaacaccaactaagccttcacttgaaaaaatcatgtgtgtcaggttagacctcactgaccagtgtgagacaaattcattcatttgggattcagacaacttcaattttcttgatgtcagaccaagcaatagggggattcaagcacctggtgttagagtaggcacctttgttgcacaaaatgcaagtcttaactctccatctattgcttgtttgagaaacaccaatgccataccaaaatacatgcctaatctaccacaaatcaaggcaattcttcaagtttactctccagttatgtccttgct

SEQ ID NO: 19799 - DNA, 552 bp, Glycine max
  Peptide Sequence Number=SeqID_136577
atggcttcctcttcttctctactcttacttgagctcaaatttcgtgcgccgcaaattacccccaaacgacgccgttctctctctagattttgctctcagaactccaggtacaatgttgctctccgtacgcgaatccgcgccttcaaggaagaaggtgccgtcattgacagagtgaacgacgtgaaatggagcggaaacggagttgccgcgagcgaatacggtgctaacggctccgttaacggttacgcgaacggcgtctcgggcgttagggagagtgagaatgcgaatggaagcttggtgaagtacgtgaacgacaatggcaatggcaatggtgtagcggcggaagtggttgaagattctgcagaagcgtcaaagcggatggaagatggaagaaagaagagggaaaccaatactgccctaattccatggcctagtgcatttgacgcgccgtcaaactacacaatccacttgtttctgtcgttgtcttctacttcctcctcaaacaaggtcatgatgtcctcatcagggaattctggatgcataggctggtag

SEQ ID NO: 19800 - DNA, 327 bp, Glycine max
  Peptide Sequence Number=SeqID_136578
atggaggaagttcgagccgtccacctcgtcgagttcaatggaagagcaaggatgatgcaatcctaccccgcaagggtattggatagaagactccaagaggattgggctagagctgctaaagaaggcctgggggttctcatgaatccaaggctaagctctagcttcccaaggaagcttctcaaggagctcaaagatccagccttcatagaagccccgcaagcaacttctatcaaaggaagagcaatgtcagagtggctagggttcaatggaaaaacaaggaagagcctagggtttaattggaagaacaaggaagaggctagggcttga

SEQ ID NO: 19801 - DNA, 570 bp, Glycine max
  Peptide Sequence Number=SeqID_136579
atggaacaaaatgcgtgcaaggaattgtcaaaaattgcttcggatttcaagtgcgagaaggttctcgaaacagttgatgaatcaatcgtatgccccactccacagaagaatgaggaacccctaactgtcaaatccagagagggacaaaccaaccttcctgaaaagaaattctcccatgcccatcttgcgcagatgaagtatatactccctaaaagtgtgtgtatagatagggtgcttgttcatgataagaaaagcttgtgtatggtgcctgatatgaagatcaccttgaaatttgaggttgtggaagattgctctggcgaatctgctgatctggctcttcgacgatattttaaatctaagctgattgatttctttgatatgcatcctgaggacatgcctacccaaaagtcaacatcatcttataagccaggaaaaagagtgcttgacttttccctcatggaggacaatgatggcttgggcattgaagtggacaagttagaatctatcagagctctgcatggatctattaggtatatgatcagaagtctcaaaggcttgttgaagaaataa

SEQ ID NO: 19802 - DNA, 375 bp, Glycine max
  Peptide Sequence Number=SeqID_136580
atggaggttgtttgctcaaaaagaggaattgttgtttcccaacagaagtatattctagacctcttggaagaaactggaatgagcggttgtagaccagtagatacccccatcgatcccaatgggaaactgtgggaaaaaggaagtttgcatgttgatgttggaagataccaaaggtatttaaagagcaatcctggaaaaggtatgttttttaagaaaaatagtgacttggagaagagcaaaaaacaaggtgttgttgccaaaagcaatgcggaagctaaatttagagcaatggcccaagggatttgtgaaggattgtggatttatagagtcttagaagaactggagatggaaatagaactcccattgaagttgtaa

SEQ ID NO: 19803 - DNA, 226 bp, Glycine max
  Peptide Sequence Number=SeqID_136581
tcctttcgctaagtgcacgccctgcgctaagcgcatctctgttcatgcgctaagctacgagtctcacgcgctaagcttcagcctgatcgctaagcgacaacttatccgtggccaagcgcaattccttatggccataattgaggttcatgacgctaagcgccagtcatggcagctaagcgagattcattgtggcaatatgagcgctaagcgagtccctctcagctaa

SEQ ID NO: 19804 - DNA, 489 bp, Glycine max
  Peptide Sequence Number=SeqID_136582
atgccgcagtttcggcagaatcgcttccggcggcaggctaaagcgtgcggcgataccggggttgcgcacgggcttatcgcgttcgccctgctgcacgttttcggtaaaccgggtggtaatcgggcccggctcaatcaggctgacgcgcacgccgctggggcgtacttccatgcgcagcgcatcgctccacgcctccagcgcccatttactggcggcataagcgccgcggcccggcgtggaaatcaggccgagcaccgagctggtgttgataatccgcccgtcgccgctattttgcagcgccggcaacaggcgcagcgtcagctggtgggtgccgaaaaagttggtggagaattgctgctccagctgctgacgcgacacgctggtcagcggaccgtactggccgaagccgccgttattgaacagcccgtgcaggcagtgatcggtgagggccagcacgcgatcggcggcggcatccacactggccggatc

SEQ ID NO: 19805 - DNA, 162 bp, Glycine max
  Peptide Sequence Number=SeqID_136583
atggagtggagcatgcttgcttgttgggataatagcatcactattgtgaattataagcaaacaagattacttcaagaaacattcaaggttaagcaaacaaagattgcttcaatattaattcaaggtcaagcaaacaagatcaagaaaaagataaggccttag

SEQ ID NO: 19806 - DNA, 270 bp, Glycine max
  Peptide Sequence Number=SeqID_136584
atgcttcatgctttgtgggattgtccccattctaaagaggtgcagatcggtatgggtgtcaactctagacgaattctgaccggtaacaagtggagtatccagcatgtttgccagcttattcgctccatagtcactgaattagaggtttactgcacttctcgccaaccagtgactactgaggcgttgaatgctcccaagaatcatttcgttaaattgaatgtggatatgattctaggctatctcataatgttatgggtggaggaggtgtga

SEQ ID NO: 19807 - DNA, 1152 bp, Glycine max
  Peptide Sequence Number=SeqID_136585
atgatgctgcattttgtgcagccgtcaaagttgaaaactaagaagatggtgtttgaggatgtatatgcttcctgtgattctacaacgcttgagcatcttaaggaattaagctcaaaacgtaaagctattgaagattctattaatgagtgcaacttcgttacagaagctattgcaaaagaaatgtctggagggttggaatctcgctttgaacaggatattcacaaaatagagaattatctgccatttctggaaattttgattccctatgctgatgcaacaagtaccattaaccaaatccaaatttctcaatggaatgcggctcttaagatacgctggagtagtgccctgaccacatcttctttcttcaaaatcaagggccccaaattttttcaaattaacaatttgcgatttgagcttggtatgaccctttttctttgtggtggaatcctgcgagagagggctttagaagttttatcaaccgatttggttcaatctgccaccattttcagacaagctgctggcatttatcatcacctagcacaagaggttcttccccacttagagcctgaattgccaccagaaaaaccccctgaagctcttgctgcagtatcctccattatgagcctcatttgcttggctgaggcccaggcagtaaccataaggaaggctgaagagaaaggtacttcttcaagtctcctggcaaagttgcatcatggtgttacactttttcttgaagaagctattggaatttttcatacagttgttacacagtgcaaagacatttcatcacgcttgtcggaatttatgtatttctgcaagtgtttacatgagttgaaaggtcagcaatatcttgcagaaagcctgaaggcttgtggtcaaataggggctgctattggagttcttagttctgtgttgaataaggtgaaaaagaagataccaggggaagatccttggaaatctatttaccaaaagcaaattcaagatgcttctgaagtgcttagaaagtttgtacatgagaatgattttgtttggcatgagaaaatcccttcaatatatgagttacccttgcctgagggtactaaaatagtcacttttattccttatagtcccaaaagatgggaaagacaactttctttcaagggactggtgtag

SEQ ID NO: 19808 - DNA, 531 bp, Glycine max
  Peptide Sequence Number=SeqID_136586
atgcccccttatggtggtatgttatggttagaacaaggttcactgccatcaagtctaagtgaaatgaatatcgtacttattcccaaatgcgataacctgttgtcaatgaaggagcttaggtcgatatcgctatgcaacataacatataagatcctctccaaggctttagcaaaccctttgaagccttttttgtcgaggtgcatagatgaggaacaatcaactttagtggagggtagagtgatccttgataatgtgatggtagcaaacgaactcatgcactacttgagattcaaggcaagaggcattaaggatttgtcgacattaaacaagagagttgaagctcaaggagtggtggaaggtctgggaaacaagtacttggctcttccttcactggttggaagaagtagaaagtttatgtttggatacattaaagatagagtgtggaaagtggaaaaggatccaatcctggagcggcaagtttttatcaagacaaagaaaagagatcatgataaagtctatgtgatagcataa

SEQ ID NO: 19809 - DNA, 2592 bp, Glycine max
  Peptide Sequence Number=SeqID_136587
atggtggcgcagtatcttgcggattttgaagacctagccaacaggatcattggcttgccggcgcccttcttgcttagctacttcatatcgggcctcaatgccgacattcactgtgaggttcaggcccaccagcccctcactttggtacaggtggcgggccttgctcgcctccaagaagagaagttcgtggatgctcgacaaaaccctcaccctccacccctgcgacctcgtcatcagccctcacctctcccacacccgataacccctcatgtttcgtctccgcccattcgccctgtatctaccccttccctgttaccaccaccccctcgtcagccaggcccttctgttaagcgtttctcgcttgaggagattgcttcgcgcagagagagaggcctctgctttaattgtgaagagaaataccaccgcggccataggtgcgcctctcgggttgctccggagacactccgtttcatgggtgtcatcgctgatcatcagatcatcttgctcgtggatggtgggagcacccacaacttcatccagttccagttagtctcccaattgggattacccacgcgcaccaccatgcctctgcgggttatggttggcaatggccaacaattggagtgcaattccttgtgtgaagctgttacagtcaccattcaggccacctccttcgtggtagacttgcatgtccttccgattgcgggtgccaatgtcgtgcttgaggtacaatggctgaagtctctcggccctgtacttacatactacaatacattgtgcatgaaattcttccatgcagctttgaatgctctgaccatcaaggacaggtttctgatacccaccgttgaagaacttcttgacgagttagggggcacaagtttcttctcgaaattggacttactccaagggtataatcaaattcgcatgtactccggcgacattccgaagacagcttttcggactcaccacgaccattacgaatttcgcgtaatgccgtttggcctgtgcaatgcaccgtcttcatttcaggcgaccatgaacgttgtgtttcgtccatacctcaggcgcttcataattgtcttcttcgacgacaatttggtctacagcgcgttcatggctgaccatctcactcacttggaagctacctttcaggtcgagtacctcggccacgtggtcttatcacagggggtacaaccagttgcttccaaagtggatgttgtccttcactggcccacaccgcagtcttccagggctgtccgcagctttcttggccttgccggattttatagacgcttcataaaagggtacgccacgattgcagctcccttggtgaaactcactacgcttgatcatttccagtggactgaacaagcccaaattgctttcgatgaattgaagcgagccctgtcatctgctccagtcttggccctccccgattttgacattccgttcatcgtagaaacagacgcctcaggcatcggcatgggtgtcgtcctctcccagaagggccaccccatagctttcttcagcaagcctttccacccgcacctcctgactgcctctacttatgtgcgtgaattattcgcaatcactaccgctgtcaagaagtggcggcagtacttacttggccaccgcttcatcatcattactgatcatatgagccttaaggagctcctcacacagatgattcagacccctgagcagcacacttacttggcaaggctgatgggttatgattaccagatcatccaccgttctggtgctcagaatcaagctgctgacgccctgtctcgcattcctgacttagcatcatcttcttacttgacattgtcagtaccatgccccaccttcctcgaggaattacgaagacaattggagtcctcttcaacttatggcttctcaatgatacccactctcctcactgagtaccattctaccccaacaggtggccatatggggatcgcaaagaccttagctcgtttgtcagaaaatttcagctggccgggaattcgacaggatgtgactgacttcgttacaaattgccttccctatcaacagaccaaatacgaaacgaagaagatcgcggggttgctttgcccccttcctgttccacagagaccttgggaagacctttcccttgacttcatcttgggcctgcctttgtaccatggcaattctgttatacttgttgtagtagaccgcttctcgaaagggatacatctgggcatgttgccggcagctcacacagctcatgttgtagcttccctgttcattgaaatcgtgggcaaaatttacgggttaccaagaagcttggtttcggacagagaccctctgttccttagtcacttttggagggaattgtttcaattgagtgggacacagctgagaatgagttcggcttaccatcctcaaagtgatggacaaaccgaagtagaatggtgccataacacttcgtggaatgtggccactagatccaccccgtatgagatcacctttggatgtaaaccgtttaattttcctgactacatcgcgggctcttcaaacttggatgcagtagatgacatgctcaaggaccgtgaagaaaccttctag

SEQ ID NO: 19810 - DNA, 246 bp, Glycine max
  Peptide Sequence Number=SeqID_136588
atgagtgaagggttccaaggttcagtactgaaggatattgagagaagagggaaagaagaagaagaaggaagagaaaatgaggccgatgcgctaccgaatcacgactgtaatcaacttctacatcgttcatcgttcggtgttcttcgttcgtcatccgacttaatgaactacgtaggtctgaatttctcatcgcacctgaggatacgtaggaacaagggcaacacccttgtcgaccccaaaaaataa

SEQ ID NO: 19811 - DNA, 450 bp, Glycine max
  Peptide Sequence Number=SeqID_136589
atgaatgagttggaattgaaaggggaggaggttcccctaaatgaggaagagctagtttcttggagaacacaacaagaggagttttggaggattgtgatgcacaaagagtccttgcgtcatcaaaaggcaaaagtcaagtggcttaatgagggggattgcacctctaaatatttccatcttatggtgaattggaagaggagaaataatttgcttaggggtttacatatggaggcatttggggatgaggaggttagagaggcggtgtgggaatgtggaagctctaaaaacctgggtctggacagttttaaatttaaatttattaaggaatctttgtgcttcatgaagcatgatatcttgaattttttacaagacattcatgttaatgtggttattgctagagggtgtaatgcctctttcattatcctaattcctaaggtggtggatccataa

SEQ ID NO: 19812 - DNA, 726 bp, Glycine max
  Peptide Sequence Number=SeqID_136590
atggcaagtagggtgttattaggaacactgtttttcaaaaagaactacctacttttctttcttgatttttcccttcctagtattatttcagtacatgcattaggaatagtcagcaaatgtgggataactcttgctataatcaatgtttcccttgcacaagatactaaattaaatgaagaaaagagtactccagagcctagtaatgtacttgtgaacactactactgagacaactaatgcagaagttgaagatgaattgtccttatcgctcacattgccaaatccttcacctcagagtttaggcagtgagataagtgaggcaatctcatcatgccctgggtttggcaacaactacaaggactgctctagaagtgaatggccaattttggattgcctaaagaggatgaagatagcaattggctccacaaggggtcgagcatatctccatgatggcttgagaaaaggggacttacaaagaggcaggaggaagaggtggcgcatggtgcaaaaaagggaaagcagcattcaaggagagaacgaaaaggtgagtggttgtggcattggagacaaaagaagaagaagaagaagaagaactagaaggatcaaaaaagggtcttcgttctacacaacttaccaggacacgacgatgagcatgacgacaaacacaacagagtgcgacgacagacacagggtcagagatgatgacagtgacaatacttgcggctga

SEQ ID NO: 19813 - DNA, 375 bp, Glycine max
  Peptide Sequence Number=SeqID_136591
atggtgagtttgaataaatggaaataccaacattcaacagatgaggactcattattagagagtgatgtgagccttgacatgaggtcatttcaggaaaagtttgatgaggaagtgaggctcgagaacatcaatgtgttggtggctaaaggaaggaatcaaggaaaaggtctcaatggagatggaaatggagatggagtaggagaggaccaatcggttctttacccaatgtcagtaaggtggcttaagggggacaatggggatgaaaaatgtcagattctgttagatgaagatggtaaagaggttaggttgaatgaaaaaggtggtttggatggtgatgttatgaagtcagagttagtgtctgaggaaggaaaatag

SEQ ID NO: 19814 - DNA, 438 bp, Glycine max
  Peptide Sequence Number=SeqID_136592
atggtgaaggagcttgttgacagggatgaggcactcaggcctttaaggcagaaaaatgggattgttgttccttactggttgatcaagtggcaagggaaacttgttgaggaggcaacttgggaagatgcagttacgattaaaaatcagtttcctggtgtaagccttgaggacaagcttgttgctgaaggggagggtaatgtcaggtttcacaaattacctagcccagtccaacttagtcatgagacttgggaccttgccacagggaagacaattttaattgctaaagagcagggtgcattcagggttgttcttcttggagcacaagaagatccacgaccagaatcaaaagttaccataaagccaacaagcaaagtcagacacttgggctacctctcaaatatggcttcaccacaaaccacttgggaatcctcagtttag

SEQ ID NO: 19815 - DNA, 576 bp, Glycine max
  Peptide Sequence Number=SeqID_136593
atggctgagaaagaggggatctcgatcacttattatggacttaggaatactgtgcaattcaagaattcaacacaaagaaaatttttatcatggagtaaacacaaaatttgggttacatatttagaacctggggagagctcggatattgaaacaaattatggttctaagataagtgttaaggctacagcaggaccagttcttggacctccatggcaacgtccagagaatgggtatattgttacatccccacaaggccaattgtctctctactacgaaccccactgtgtatataatcaaagtttcactgagaaggaaagggcagatattgtgataacaccagtcataaagcagcttttgcccaattttaccttggtttcgggacaagaagatgcagtgaaacttgcaaagctgcttcaagccaagttcattgtgccaatgaaaaatggagacctagatagcaaagggcttcttgcaagcttaattagtggtgaaggaacagtggaatcatttaaggatctgtgttctggctttgagaacagaatgaacgtgtcactttctccaatgcttatagcgtga

SEQ ID NO: 19816 - DNA, 276 bp, Glycine max
  Peptide Sequence Number=SeqID_136594
atgacaaacgaagaacaccgaatgaagaacgatgtagaagttgattacagtcatgattcgcgagctggttacttcagccttaagccatttgggggcccaggcaagctagaggctagtctaggcgagccagggtctagaaaattgcctagtatgaaccttttgcccctatctttcgcacccttgaccaaaacattgaatgatctttcgttttgcacagtaactaatgttgaacaactcacttcggctagtgaagatcaaaagatcaacgaatgttag

SEQ ID NO: 19817 - DNA, 594 bp, Glycine max
  Peptide Sequence Number=SeqID_136595
atggccacgttacagtgcaactgcaattctcttgcactcaacaaacccagttattccagaagaagaagaagacaatttcttcaaccccttttctcatccactcgttttgtttcaagcaattcaatctgcacaagttccagtgccacaacttcaaggtggggttgtgctgtttctgctgttgtctcagaagagaacgctgttggttcctctttctctgcagctgatgtcttcaaactcacgtatttagagggaaacagttggatctggaatgtgggtgggataaacatattggttgatcctattttggtgggcaacttggattttggaattccttggctatatgatgctgctaagaaagtgttgcagaagttccagctcagtgatcttccggaaatcaattgcttactcattactcaaagccttgatgatcactgccatttgaagaccttaaagcctttctctcagaaattcccagatattagagttatagcaacccctaatgccaagggcttgttggatcctcttttcagaaattggtttaaattgttccaaatgagagcctccactgctatgtcaaacatttattgcacttag

SEQ ID NO: 19818 - DNA, 4425 bp, Glycine max
  Peptide Sequence Number=SeqID_136596
atgaaagctaaggttacaacattggagagtgaagtgtcggaggtacgtaccacgctcatggaggttcaaaacactgtgaaggagaatcacgcgaccttaatcgcgttgttggagaagtgttttggaaaatccgttcagcaggatgaaggcgagagtggggggaaacagaaaacgccggaaggaaaagggtctccagagaatgagggctcaagtggtaacagttccggtggaagcggaggtgcggtgttgtcggaatttcgacacgctgtgaagaaagtagaacttccgatgtttaacggcaaggatccagcgggatggatctcgcgagcagagatctactttcgcatccaagaaacgacgccgaaagtgaagatcagattggctcagcttgaaaatgaagggttgacatgggaagggttgaaagaagcactgctaggaaggtatggaggtcacggagagggtgatgtgtatgagcagctgacggagttgagacaaggaggaacagtggatgagtacataacagaatttgagtatttaatagctcagattccaaaacttccagacaaacaatttctgggatatttcttacatggattgaagccggagattcgtgggaaggttagaagcttggcgacgatgggagagatgaatcgatcgaagcttcttcaggtgactaaggcgatggagagagaagtaaaaggtagtgggtcgaatttctatcgtgggcctaaatctggaaatgggtcacaccggcccaattcctatggatccagcaaacccgggtccgattgggtcatggtaaaggggcgtgaggtggaagcaacagggggtgcaagaagtaatgctaatgggcccaatgctgataagccagcccattcagataggaggaggactgggcctagagataggggcttcactcatctttcctaccaagagctcatggataggaaacagaaggggttatgttttaagtgcaaaggcccctaccatccaaaccaccaatgtcccgacaaacagttacgcattttggtggtggatgacgacgccggagcagagcaagaggcgaatatattggcggtggaggtagacgaatcagaagaggaagagggtggtgagatgtgcatcttaaacttgaatcacattgcttttgaaaaccaccaaaccgtcaaattccaaggtcaaatccaaggggttcctgtgctagtgatggtggatagtggtgcaatgcacaattttatctcacaaaagctggtgcataaaatggagtggccaattgaagaaacacctatgatgaatatcaagttgggagatgggtgttacaagagctcaagaggagtttgttgtggaatggagttgggcattgggagtttcacaatctctcccaagttgcatttatttgagttgggaggcattgatgttgttttgggcatggaatggttaaaaaaattgggtgacatgatagtgaattggcgccagcaaacaatgagtttttggagtgataagaggtgggtgagtctacaaggcattgatgggcaagagaagaagttagtagctctgcagagtatcttgagcaaacccaagctcaatgatcaagaagtgttgtggggcttaaagactcaagaaagaagtgaggtgcagtgcttgactaaacaccagcaggtggagttggatcatttattggtacaatttgaagatgttttcaaggaaccctcaggcttgccccctaggaggaataaagagcatgcaatcaaccttgtagaagggcatggggctgtcaatgttaggccctatagatatccacatcatcataaaaatgaaattgagaggcaagtgcaggaaatgctcactgctggaatcatcagacacagcactagttcttttagcagccctgtcattttggtgaagaagaaggatagcacatggaggatgtgcgttgactatcgtgccttgaataaggtaaccataccagataaatttcctattcccgttattgaagagttattagatgagttgcatggagctaatttcttttcaaaacttgatctaaaatctggttatcaccaagtgagagtcaaggatagtgatgtatgcaagactgcattcagaacacatgagggccattatgagttcttagtgatgccttttggactcatgaatgccccttcaaccttccaaagcttaatgaatgaggtattcagatcattgttaagaaaatgtgtgctggttttctttgacgatattttgatttatagtagaggatgggagaaccatatgaaacatttggagactgttttaaaaatgttagctcaacacagtttggttgctaacaaaaagaagtgtcagtttgtccaaaaatcagtagagtacctaggccatgtaattagtgaagcaggagtagcagtggatccgaacaaagtgaagagtgtgatccaatggccagtccccaagaatgtgaaaggggtgagggggttcttgggacttactgggtactacataaagtttattagagactatgggaaggtggctaggccactgacagagttgacaaagaaagataatttcaagtggggggtggagtcccaacaagcatttgaagaattaaaaagaagactcactactgcaccagtgttggccttgcctgatttcaccaaacagtttgtcattgagagtgatgcatcaggtggaggcattggagcaattctcatgcaagacaaaagaccaattgcctatttcagcaaggcattagggaggagaaatctgacaaaatctgcttatgagaaagaaatgatggcaatacaaagaatagttactgctgagcaacagaattgggcagccaagttgttggggtatgattttgagattgtgtacaagcaaggaaggttgaacaagggggcagatgctctgtcaagaatgtatgagaggacagagttgaacaccattacatcttatgcacaatgggatcagaaacaacaagtaactatggaaatacaaaaagatgagaagctccaatctattattaaggctttgcagcaagaccctaaggcaaaaccagggtatgtctacaagcaaggtgtgttgatgtacaatggaaggattgcaacaaatgtatattggatgggaatgaaagggactattcaggagtatgtgaggagttgtgatatctgtcaaagacagaaatatatggctactgctccaggaggtttgctacaaccattacctattccagagcaaatatgggatgacatatcgatggattttattactggattgcccaaatccagagggtatgaagctatcttagtagttgtggatagactgtccaagtattcacattttataccacttaagcatccttatacagcaagaagcattgctgatgtgttttgtaaggagatagttaagcttcatggggtaccagtgagtatagtaagtgatagggaccctgtgtttgtaagtggtttttggaaggaattgtttaggatgcaaggaacacagctcaagatgagctctgcctatcatccagagtcggatggacagacagaagttgtgaataggtggttacaaggtgaagtcagaatagaagcagtccagagggatttgatagatagagatgaagcattgagacagttgagaagccaattgctgagagctcaagaaagaatgaagagacaagctgataagaaaagaatagacaaaagctttgtggttggagagtgggtttttgtgaagctcagggcacacagacaacagtctgtagtaactagaattaatgcaaagttggctgcaagatattacggtccttaccctattcttgagagaattggagctgttgcttataaattgaagctccctacaggatcaaaagttcatccagtattccatgtttcactacttaagaaggcaataggcgagtatcatgaagaagaggcattgtcggagctgttgagtgatgaacagacagaaatctttgaacctgaggctgtgttgggcactagaaaaattaaacagcaaggagaagagatcaagcaggttctgatacagtggaagggtaaaactactgatgaggccacatgggaggatgttataatgatgaaaagtcaatttccaactttcaaccttgaggacaaggttctaattgaagaaggaggtgttgataggggccatgctgttgattcagtgccacatgaggaattagctcatcatgagacaacagggcccagaacctggctagtatattctagaagggttcttgaagagttcttccccctccggttggagtattatgagagaaggaagcacaaaggtttcactcccatgcctaggaaatgtaaatctgcagaaccccaagttgctggggcaaatgaagatcaagaagatgacaacaatactacagagctggagaagaaattgtataaggaagttaag

SEQ ID NO: 19819 - DNA, 561 bp, Glycine max
  Peptide Sequence Number=SeqID_136597
atgacttttcttccaaatagatttatgaatgagtgtggtagaagcaaagctgatcagtcactgtatggtttgctggagcctcaatctatacaaaatgctaaggaaagacgtcaacaatgccaacaatacattgaaacatgggtcaaggaatcacaaagacagttgtatttaggagcttacttgcatcaggcacgttggcaactatttgttctccacccaagggaaaacacggtcgtttggttttgttctctgaggaagaagcctgatattaacatcaaaggcgcaattaacagtgcaatgaagacaataaccagttcttttgaaggcatgtctaatcaaggtgcacctcggtgggttgaacccaagagtaatgtgcaaagtggagggtttgagtgcggatattatgtcatgcactggatgtggtgcatcgtgactgccggtttgaaggatgattggcacaagtggttttctgatggatcaccgttagacgtggaggccatcacaacagttcggcagaaatgggcaacttactttttaacttttaggaaaagcagttgctaa

SEQ ID NO: 19820 - DNA, 1305 bp, Glycine max
  Peptide Sequence Number=SeqID_136598
atgagttgcttttcatgttttttgcccaacgaaaagaaagtagcaaagaagcccaacaataggaagaggatacaacagcctgctattcattctcccaaggaatcagcccaaccagttcagccacggccagataatcattttaacaaggcaaaggcaaccccacaaacagaacctaaaataaacaaggaggccaacaaagataatgggaacaacattgctgcccaaacattcaccttcagggaactggctgctgtcacaaagaacttcaggcaggaatgcctaataggtgaaggtggttttggaagagtttataaaggaagacttgaaaaaaccaaccaggaagtagctgtgaagcaacttgacaggaatggattacaagggaatagagagtttcttgttgaagttttaatgttgagcctcttgcaccatcaaaatctagtgaatctaattggatattgtgctgatggagatcagagattattggtgtatgagtacatgccattgggagctcttgaggatcatctgcttgatcttcaaccacaacaaaagcctctagattggttcatcagaatgaaaatagctttggatgctgcaaaaggtctagaatatttgcatgataaggcgaatcctccggtcatctaccgcgacttaaaatcctccaacatcttgctggacaaagagttcaatgcaaaactctctgattttggactagcaaagttggggccaacaggggacaagtctcatgtctcttcaagagtaatgggtacttatggatattgtgcacctgagtatcaaagaactggtcagcttactgtaaaatcagatgtgtacagctttggagttgttttgcttgaattgatcactggaaggagagccattgataacacaagaccaacccgggagcaaaatctagtttcttgggcatatccagtattcaaggaccctcacagatacccagaattagcagacccccatcttcaaggaaacttcccaatgagatcattgcatcaagcagtggcagtagcagccatgtgcctcaatgaggagccatcagtgaggcccttggtcagtgatattgtcactgctcttactttccttggaacagctccagggagccaagacctcacaggaattgcacctgttgacatgtcctcatcaccacaagaagccaataatagtgcccctttgaatcttcttgacgatgatatcttcatggatcgccaaagggctgttgctgaagccattgaatggggtacaaacactaggagcaaagcaccactacgtgacagtcccacctctctgtaa

SEQ ID NO: 19821 - DNA, 174 bp, Glycine max
  Peptide Sequence Number=SeqID_136599
atggttggtgggttgattggccgatgtgtctcaaacatatcaaggatcagaaatgagtttggagcaatgattaagggctcaagaggtgtggaaggagttgtaggattaggtggactaactatcccagacctgatcttaaaaacgacaacttcacaacccaagaagaagatctaa

SEQ ID NO: 19822 - DNA, 453 bp, Glycine max
  Peptide Sequence Number=SeqID_136600
atggcaataagcaatatgcaccctcagttcaaagaaaagttggtggctcaagaatatggtgatctctatcaattagcctctaaaactaaccgaatggagcaatttatacataagaaaaaggttttgaagaggaagctgaaatcttacgaggtaaaccttactcatgtccaaggcaagggcattgctagagatggaaagaaggctttgaaggaaggccattttaagctagccaatagaggggtagtcaaaacggaaatggatgtagatcctttcccaaagttagatataaatatggtctcatatgaagagcctgctaacaagggaaaaaagatgaagcaggcatggaagcctaaaataataggcatccagaaaaccaagggatccatcaaaaggacttcagtatttgaaaagattgtagtcacctcatttagcaataggaatatgggtacctaa

SEQ ID NO: 19823 - DNA, 270 bp, Glycine max
  Peptide Sequence Number=SeqID_136601
gtgttactgttaaggcatgtggcgactgttaaggatagcaatatagttgatacacttccattagcatattgtcatctcattgagtgttgcatccccgccaacaaagatttccttactatcatcgttcaagtaaaaaattgtctttctgaatggggtagggtcatacctttttatgaaaaagagaggttggcatgcatatcggttaatgtgcgggctatggcagtacaccaaaatggatcgaagttggatgacaagaccacgcataagtga

SEQ ID NO: 19824 - DNA, 234 bp, Glycine max
  Peptide Sequence Number=SeqID_136602
atggtaaccacaaggaacgggaatgattcaaagggaggagccaaccactttgatggcggagcaaacaatgataacccactccttcaacaactactcaaagcagtggaggatttgaagaataagaatgaggcacaacaaaatctcaacgaggagactcaacaacaaaacattgaggcaaaaacacgacgaagagaggagaaagaaaggcacttggctgcggtgatagaggcctaa

SEQ ID NO: 19825 - DNA, 411 bp, Glycine max
  Peptide Sequence Number=SeqID_136603
atgactgaagcacgtcaaaagggggtacggaaacattcgaagaaattacggaaactcacggattgcgcgacaacacctccttttggtttccgcctcattacggaatttcacgcccatgatgactctcgtctctactacttcttttttctgcacaacacaaaacaaaatacaaacaacaacaaaaacaacaataatataatatacacgtttggcaaaggaatcaatcgggaaaataacaaaggtcacattttccagtcaagagggtccgcacttcacaatgaagaacacattggagaatggaggattgcactagagggtccacactatgcaatcatgaagaatggctccaaactcattggtggaggatgcatgaacgaaaacgtaattcatggggctccgaaaacggggtag

SEQ ID NO: 19826 - DNA, 138 bp, Glycine max
  Peptide Sequence Number=SeqID_136604
atggatacctcagagccctacactagggcaatgaggggcatcgtgcatgagcctcaagtgaacctaggggtcatgatgaaagacaacgattggtacctcaaagccttacactggggcaatgaggggcaccgtgcatga

SEQ ID NO: 19827 - DNA, 240 bp, Glycine max
  Peptide Sequence Number=SeqID_136605
atggttacccgcaccttttgtcaaccagggtcaaacgagcccgttgacgcacagagactaacattgtctcctacaccttttgtcgttgtaacccgcgaagtcagggtttttgctctcgttgtccggaaacattcaagcccaacgacacacgagattcttctctactgggcagagacgatcgggtgcaatggcgaagggaagtgttgtggtcgtccaactttgtcgttttcaaaacactga

SEQ ID NO: 19828 - DNA, 669 bp, Glycine max
  Peptide Sequence Number=SeqID_136606
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgggataccgagaaggctgcgcataacgacgtggaagccagcgccgagccggcgtgacgctatctgcgcgttgaaggaaagccccgccatgcggggcttttctttttctgcccgggccgaccttgagggaactcctccaaggcgtgccgcgagcaagctcgcgtcgccaacaccaaacgcgcgaaggtctgcccgggcttggccggggagcccatctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 19829 - DNA, 1131 bp, Glycine max
  Peptide Sequence Number=SeqID_136607
atggctaaggaaagagggcttcccctaaaggataaagtcatgctttggatttctgtactagagagctctaagagtcggggattacagtattcaccctcgattgaggcagatatacatctattaggtgcacgtgtgagaacaaaggggagcaatgctaaaactattgctaatccattgggggaagaacatgttgctaatgtgatgccaactatggggttgtacatgcaacgtgatcacatggcacacctagtggccttgggaaaaatatatgagggtgggtcaaccatacacaacgtgccttatgcagatgatgtgaagcctgttgagttgttgtgggatgggaccaaatttgggattccaaatgaagaaacatccttcttcttaagatattctaatgtaaatgaaataatatcaggtgacaaatgtttgaacatggctatactacaagtgtggatgattgcaatgaagacattaaagactactgtgaatggtaaaactgatcaagttacacctcagtggattgaagtaaagagccatgttgaaagcggaggctataagtgtgactattatgtcatgcattggatgcggaacatagtaaatgggcgtttgaagaatgattggagcatgttgaagaagttgggagccaacaatattgaagttgttattggatgtggggttcgttttgatcatggttttggagttgtaaaagtgatattggaacaaaactgtgacactcataagaactttgatgacatgtgtgcggatattagattggctttgagctatctaaataatgcagatcaatgtgggtttgattcaagcaaagatcatccatttgatggatctaagcctgtccattttagtcagcacaccttatggaaacctatgaataattttgtagtagacccatgtggtgaagtaaatgatgttgagattttatcaataaagggaactacacaacaatctcaaagagatctaagccagttaatcggttgtttaccaattctacaggattgggagataattgttgcttcagaaaagttggcagagtgtcaagaaaccatcgttaaccttgggaagcagttgaaggcattggttgcaccaaaggatgcctcaacaaagattaactag

SEQ ID NO: 19830 - DNA, 690 bp, Glycine max
  Peptide Sequence Number=SeqID_136608
atggagaaagatgttcatgaaaagttgcaaaggatgttgttgtcagttgggttttgtgcttccaagctcaccccaatgccaaggctgatctcaatgatgggaaattcaatggctttcatggatccaaaacttcacagtttcctccagatgagaatgggatacggaaaagttttgattcacaacaatagtcaattggcaagtacttattgtgccatttccatattgaaaatttttggttgtgaattgtccaatcttgattctgaaacaattgtgacttctatgaggaaccttcaacagcctgatggaagtttcattcctattcatactggaggccaaacagatcttagtggcatggacaaggagatgaccaaggattacatcttacgttgccaggtatgtgaagctagtgcatcaactcgtgatgggataagagaattatctgaggattgtactatattctggacatacatgtttgttgaaaattcttataatggtggctttggattagttcctggtgcaaaatctcatgcgcccaaaatttggaaatcattgagccatttcattctatcgtattgggaacaagcaacaaaaaaagaagtctatttcacatgctcaagacgacaaaaactattggagggacaatctattgcagcctctaaaagacattcagacaatcaatgcttgtcttga

SEQ ID NO: 19831 - DNA, 723 bp, Glycine max
  Peptide Sequence Number=SeqID_136609
atgcatgccaagaaaaatgttgatgacagtgaaattggcacccttcttaacattcaaggcaagacaaaggatggtttgaaatatcatcaagacttgcttgacatggtatacgagagcagttgcatccgatatcacaaggtcaacgaatatttctgcccccaacatgtcacacaatgtcaacaaaagagaaaaaacaaagtcattgaccctcgacaattggatgatttggagaatgaggctaccattgtcctttctcaattggagatgtattttcctttgtcattttttgacataatggttcatttaaatttgttgggcttcctgaaactcgtcatgaccgaacatgaggagaataagccagacaagtgttttatgtccaagatccgtgtgattcaagattgtcagtggttctataaggaagacccagtgggtcatttgaacacccctaaggttccctccgcatttggatggtcattcaaaggaaaatttgatgtcccaaaagcactgaatgccaagaagaaggatccttctgtaaagtatgatgatctggatccacaaacttgggaggaatttgctgcaagccgcaaaacccctaactggcagggaatcaggaaaaaggctcaggaaattcaaaaatataatgactgcaagcatatattatctcgtaggggttatgatttgcttgaaaagaagctaatggaggaaaaaatgaagaaaatataa

SEQ ID NO: 19832 - DNA, 498 bp, Glycine max
  Peptide Sequence Number=SeqID_136610
atgcaagctcaccaccctttctcctacatatcatcttgtcctggtaatagtactagtagtgccttcttggaacctcatcatcatcatcatgaagctgtagtggatgaagcttccatctccctctctcttggccctcctggccaacaacaccaacaacccaacaaccccaacaaagccgtgacttcttccattcctcaccaccattaccagcaaaaccctactactactactagctctgatgatcatcatcgtcagagaggtggtgtaactgtggcccttcacattggccttcccagtactaccccaacaacttcaccaaacagtgtcaccacaactactactactactagcaagtcgcctgatcttcatttggcctctgctgcacccaacattcagggccagtactggatcccttctcctgctcaaatcctcattggacccacccagttctcttgcactgtatgcaacaaaatgttcaaccgtttcaacaacatgcag

SEQ ID NO: 19833 - DNA, 432 bp, Glycine max
  Peptide Sequence Number=SeqID_136611
atgctgcggcttccctgctacttctgtgcggaggtctgcaaaaacaatatagaacacccgagatcacggccgttgaaggacttcaggaccctccagacgcactacaagaggaagcacggggcgaagccgttcgggtgccggaagtgcgggaagccttttgcggtgagaggtgactggaggacgcacgagaagaactgcgggaagctatggttctgtatctgtgggtctgatttcaagcacaagaggtcgcttaaggaccatgttcgtgcctttggggatggacatgctcctcacactgtggagagctgtggtcgggtgggggaggatggcttgttgttgttgggggatgatgatgatgatgagttggaagtggaggaggatgatgaggaggaggattataatagtaatgatttggcttttggttttaattaa

SEQ ID NO: 19834 - DNA, 318 bp, Glycine max
  Peptide Sequence Number=SeqID_136612
atgatcctgtgctgggagttgcaagattgtatagagaggaggcggcggagggagaagtgcgacggcgaggagatgaaagggtggtggcgaagggaggaagggaataaggagaaagacgggttagggtcgctagagaccaccaacggtcgtgcttgcatgatgacgatcgtggtccttgagtggcaacttcaaatttcaaatcttgctcttcggctgtcaattggctcccaagatcaagacagttgtggtcatggtgaccatgactatgctcggaaaagtgacgttcatgctcggaaaagtaacttctcttcaatgtaa

SEQ ID NO: 19835 - DNA, 267 bp, Glycine max
  Peptide Sequence Number=SeqID_136613
atgtgggcacatctagattccatcaaactcctaaatttgtttccaacaatgttgatttatgatacaacttacaagacaaacaagttgaaaggattttttgtgaaagataatgtgttgcctcaggttattgtcagtgataagaatcttgctttcacgaatgcattagagactttgttttcttcttcaaccaacttgttatttatgttccacattagaaagaatgtaagtgcaaaatgcaaactcctcgtggataagggtgaagattga

SEQ ID NO: 19836 - DNA, 330 bp, Glycine max
  Peptide Sequence Number=SeqID_136614
atggaagagaggaaatcagatgatgtggtgcacggggactcatcctcctccttgagaagcagtgagccgggttcagtcaagtcaaaggcatggctgtttttgagagagtgcgatgaggcgacagtgagtttctatgacgatgacgatggtgaaccaaagcgggtgaaggcgaaggtgtgctttgaggaccgagtcgatctgaatcgggacatggcgcaggcgatccggttggttcgagccaccattgaagatctctccaccatcgatgtggcagaagcattattgagctcaaagccaccctcgacgatatctccatcaagagcaccatag

SEQ ID NO: 19837 - DNA, 252 bp, Glycine max
  Peptide Sequence Number=SeqID_136615
atggcaaaatcagatgacaatgtgaggtcacaggtgcgtattttggtcaaagaaaggaaggaagagtgggtacctgcgggtacggatgaagagagggtgtggaggtgcattgatgcaaagagcatttctctcacctctgatattattttaaaatttccaacggttagaatgcttaaaaatgagttgcgaacttggtttcgaaatatcacgatgatccaacggttagcgagtgcgagattgtcattttactaa

SEQ ID NO: 19838 - DNA, 375 bp, Glycine max
  Peptide Sequence Number=SeqID_136616
atggcattcccttgtaaactgactttccaatgtttgctttcgcaggagatggccccaagaaaacttccaacaaagagatccaggaaggacaccaccggagaaggctccagcgtagccccacaagctgacatggactttgatcggctccgattctggagcgccgaacatcagcaacgctttgagaccatcaaggggtggtcattcctcagagaaagacgggtccagctgagggatgatgagttccctgactttcagggggagatagcccgcaggcactgggcaccacttgtgagatccatggctaaatttgacctggagatactcatagagttttatgccaatgcctggcctaccgaggagggagtccgagaatag

SEQ ID NO: 19839 - DNA, 501 bp, Glycine max
  Peptide Sequence Number=SeqID_136617
atgtcagggatagggactgacactgcttcctcaaaccctcctagtaagaggatagacattggatggaaacattgcacggctgttagagaaaatgttacgaatgaaatatgttgtaactactgccacaagatcatgaaaggaggaattacaagggaaaagcatcatttgattgaaaagtcaaggaatgttgcaccttgtttagtatgcccaaaagaagtttcagatgagataagggcaactgaaaatagtgactatctgagtactgtggctctttctcataatccagttcttcactcccacaccaaacacatggagctggacattttctttgtcagggaaaaagttttgaatcgctccttggtagtcactgatgttcctgctcaagatcagattgcagatgtcctcaccaaaccactatctagaaccagatttgtttatcttagagccaaattcaagttattgatttttatcaataaccctgagtttgtggggggagtataa

SEQ ID NO: 19840 - DNA, 411 bp, Glycine max
  Peptide Sequence Number=SeqID_136618
atgggttggtttccttatgcaccttttgggcctgctagtagatgtcggactggtgttgctaacatcaccctctcttggaaaactaaccctgccctcaaggttataagaggtccacaatgtatcccaatcttcacatgttttatcttctgcggtcaaaccagggcattagaccaaaacatgcttgattggtgtggtaattgggccaacacatttgtggagttgaagttgaagcatttctttgaaaacaataagccagtggagtgtatctgtcatgggcaacacattttagctgctgctggtgttccaaagttgtttgttgggttacattttcctgacaattattttgaattgttgggttacaaaggtgtaattggtaagaccgagcaagtaggagaaattacattcatttag

SEQ ID NO: 19841 - DNA, 420 bp, Glycine max
  Peptide Sequence Number=SeqID_136619
atggatagattgaaagagataagagtatttgcttttcttttgaaacattatctcagtgagcatgctgaaaagtatggctatggtgtagtggagcgttttgttgggcatggtgtgggaacagtgtttcattctgaaccaattattatacacaatcgcaatgagaaggcaggccgcatggttgaaggtcaaacatttacaattggtaagtgcattgttagtctgtaccaagaatctgaggtgataactgttaccttgtctttgacatactactgtgagccgattctttcaatgggaagcattgattccattacatggccagacaactggacaacactaacagctgatggtagtccggctgcacagtttgagcataccattttgataactaagactggagccgaaattttgactacatgttga

SEQ ID NO: 19842 - DNA, 135 bp, Glycine max
  Peptide Sequence Number=SeqID_136620
atggtcaaataccgcgccaaatccaagatagagatgaaccgaggtgctcgggaatgggtacgagtagacgctaggcccgtgatcagcagatcgtcgtcccacgtccggttccggacgatcaagaagcactactag

SEQ ID NO: 19843 - DNA, 258 bp, Glycine max
  Peptide Sequence Number=SeqID_136621
atggacgaagaacaatggaggtatgatactatcatgtatgaaaaagttgatatgagtgttgaaaatgaggaagatgttggtgtgaaggtagaacacgttgattgctctgatacttttaatacttctcagcttgcgaaaagagtggtaagtataggcctaagaagaaggatttggttagaatatgcattggcagtagaaaatgtggatgcccgtttaagttgtgtgcgaagccagttttgggaggagaatgatggatga

SEQ ID NO: 19844 - DNA, 579 bp, Glycine max
  Peptide Sequence Number=SeqID_136622
atgtggatgtgtagccctctgaaggcaagggcgtgcatccctctaaaggcgaggacgtgcagccctctgaaggcaaggtcgtgtaactctacgaaggtgagggcttgttgccctctgaaggggaggatgtgtagtccttcaatggtgaggacatgtagccttctgaacgcgaggacgtgtagtccactgaatgtgagggcgtgtagtcctctgaaggttggggcgtgtagccctatgaaggcaagggcttgtagccctttgaaggtttggatgtgcagtcctctaaaggtgaggacatgtagccctctgacggcgaggacgtgtagtccttcaatggtgaggacatgtagcaagactcacgggtgcatcttccaagaaaggaatatgcacggagtcgccaccagcatttatttgaggaaaatgggaaaagagggaggtggttgccacccagctcgcccaggcgacctcaactcgcccaagcgagttaggttgcttccaccagaaggcaccgccttttgttggaagatcctggaaggccctagtgggcctgattgctatttgttaccccctgtttactaa

SEQ ID NO: 19845 - DNA, 558 bp, Glycine max
  Peptide Sequence Number=SeqID_136623
atgcaggcgcgccgccgtagtgttacgttgctgattatcgcgttcatccttctgattgccgggctgatcgccggtgcggtgcatttacataaaaacgccgacgcgctgtggcagattgtcagcgaaaagtgcgtaccggacatgacgcaacgcggtaatcctgccccctgtcagcaggtcaatctggtgcagggttacgtcacgctcaaagatctgaatggcccgctgcaatatctgctgatgccgatagcgaaaatcaccggcatggagagcccaatccttctcgaacctaccacgccgaacctgtttgctgccgcctggcagcagcgccgcctgctggcgcagaagcgcggtgcgcctgtcgacgaccgcgtgctgtcgctggccatcaacgcgcagtatggtcctggatacgctggcaccgaagctgaatgcgcagtggcagacggcaacgctgctgcggcatacctggctgattcgcacgctgagcaccgccgaactggcgcagcagagcgtgtttatccggctggcagaggaggtgccgcatgcgcgcggtga

SEQ ID NO: 19846 - DNA, 378 bp, Glycine max
  Peptide Sequence Number=SeqID_136624
atgtcaggatttacacgcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgagccttggctagggttatggctaccattgaattatcaagtagatatgggagcaaggattgcctttgtggataactgggcggtgggtaaggagaaggtttgttattggctgagtaatgacattgttgggttggtgggaaacttggctgtatcggaatggcagtcacagcatgggcttctccctcattctcaccctcttcatttgccctag

SEQ ID NO: 19847 - DNA, 216 bp, Glycine max
  Peptide Sequence Number=SeqID_136625
atgggaagacgaaaaggttccaataaccgtcctactaccatttcttccagagagaatcagagaagtagtcgtattgcccaaattcatcgttctataaatgacaaagatgatggaagtgttgaggatcctatacaagctgatgaaatgtcacattctgttcatagagataatattatgcagcctttggaagaaatgcctgttgaagaccatgtttaa

SEQ ID NO: 19848 - DNA, 192 bp, Glycine max
  Peptide Sequence Number=SeqID_136626
atggcaagtgcattgatgatgctcatatttcatacttcatattgcatggaaatatttttcatgaggaaaaatacttgtacatgggggcatgtcactcggtttggaacttccttaagactcaggttgatcaccacggggggggggggggagttgcctgtgcacgataaggtgacctcgacacttggtgcctag

SEQ ID NO: 19849 - DNA, 576 bp, Glycine max
  Peptide Sequence Number=SeqID_136627
atgacattcttaggagacacttcctctcagacgatcgtcaactcaaggttgaccttcatttttccaaatgattccgttattcacaacaagtgtggggtttattttaaaagttcaactccagtgcccatgcgagtaccaaacatgtgcgatttttcaactcttaaaagcagaatacacaacatccttcagctaaacgacaatcaatttgtggatgaaattcattaccggcgaccactcgaagatacagataacatggatgtgaacacaatgttaatgtctaacgatcgattttcatgtgttggaccgattgagttgttatgcaccgttggtagaacaccagatgaaattttaaacttacttgaacgcagtatgacccctactcatgatgcggttctgtattacaacggaaggtggaacatgccacgccaaaacaactttgtaggttacgcgttcacaggaaaaaatccccaaaaatttgatatttcaaaaggatgtaccatagatgaactgaaggatttgatcaagcaactagcacctaaagggaatcctcctcatgggattcatgaatcccaactt

SEQ ID NO: 19850 - DNA, 309 bp, Glycine max
  Peptide Sequence Number=SeqID_136628
atgcaagctctagaggaagagattttgagcacaaaggagaggagagaggaaaaaagtgagatggatgggatatttggagttatgacgttaaggggggagggggtgttgctaggtgtccatttcttctccgcgcttcctccattgccgaagttaccaaggttagacgacttttgtgttttgcttgttgtgcgagggagaagacgaaggtcgcgtgaacgtgcagaagaaagttcttctgcacgttcacgcggaagaacattcttccgcaggcgggatttgtcaaccacggaaaaacgttctttcacgtga

SEQ ID NO: 19851 - DNA, 189 bp, Glycine max
  Peptide Sequence Number=SeqID_136629
atgacttctaaggtggatctccctttaggaggtgtggtggatggggcaagtatgaagatttccaaaaaccattttcaacaacctaatcctactggttatccaattattacaaatgaggttggggatgaagtttttatttatttattgaaggtagatatcatttccaaaatagggcatgttggtgagtaa

SEQ ID NO: 19852 - DNA, 441 bp, Glycine max
  Peptide Sequence Number=SeqID_136630
atgggagaagtgaagctactgggagtttggcctagtggattcgtttacaggatcatatgggctttagcgctgaagggctataacccagtttacaaaaaggttccagttcttgttcttgaaggaaagccaatcgctgaatccatggttattcttgaatacatagaggaaacatggccacaaccacacttgcttccacaggacatgtatgagagggtcgtggcacgattctgggttagttttgcagaggaaaaagtaacaagagcgttttttttgtcattctttgtgagtgttggagaagagtttcagaaggcaagaaaggaagtcagaggagtgctcaaagtattagaagaaaccattggggacaagaagtattttggtggtgaagaaattggactgttagacataaaattcggatggctagtcttgttttccttgtgctag

SEQ ID NO: 19853 - DNA, 543 bp, Glycine max
  Peptide Sequence Number=SeqID_136631
atgcctatatgcgttagaccaatgaaatttgagagaatgaaatcagtgacggaatttgcgcgtcgacggcctaccgcatccgcacggaggcagcgagtacctgtgattgtggcgcacgatgagtcagtgctccctgcgccagatgtagaggctgacgtatttccggatgacccgatggcactgactgatgtagaggacactggggcagacattcctacagactcaggcacccaggctactgaggatgagcctgagggattttcaggtggtccgagcgacccatccgtgctgacccagtatgcgaatcacgttgcttgcagcgtatggacgggagaggagtgtcctgagttgaagttatcctctcatggaaggaaggtctatagtttaggcaggtctgtccctgccattgagggactagttgttgggacaggactaagtcctctgatcgcgtgttcggtagacactggcgatcggggatatttgttctcgtttgtcgagcagtggcaccgagagacgtctagtttccatctccctgtgggagag

SEQ ID NO: 19854 - DNA, 213 bp, Glycine max
  Peptide Sequence Number=SeqID_136632
atggtgtgggtcaactggaatgggggagggactaggaagattcatggtgtgatagtggggactgtgaggaatgggaagagggcattgaagaagggacatgctcatccaacaagaaaattcttaccccccacttggcttcatctcattcgcccttgccaagttccactttgtcttattagccaggttcacccaagtatcttctcaccaaaataa

SEQ ID NO: 19855 - DNA, 327 bp, Glycine max
  Peptide Sequence Number=SeqID_136633
atggcaaaatcagatgacagtgtgaggtgtgcgtattttggtcgaagaaaggaaggaagagtacagatgaagagagggtgtggaggtgagatgtggtggagcagtaagacagaatcagtcggtgttgaggacggggtgagtctagatcttgatgccctcaatggcatcgagaaggaggagggcattgtcgctgagtcgagcaatggtggagacctcgctgccaggaacggcagcttgcgaatggcaatcggcttcgccttcaaagtcttggactcaccgattaggacagcgcagtccacgccgtcggaggcgatgacatccaattaa

SEQ ID NO: 19856 - DNA, 213 bp, Glycine max
  Peptide Sequence Number=SeqID_136634
atgtcaatagttccttcttcaagacatgaaagattacatgtagaggagagtggtgtcccgtatcttcaggttgttcagcttcaaactggaaagggctcagcacagacattgtcagttgcagtaaaaaggacacgggagagacgtaaggttttcaatgctggcaactgcagggattttggaagttccaaaggaggccaacaagatatattgtga

SEQ ID NO: 19857 - DNA, 264 bp, Glycine max
  Peptide Sequence Number=SeqID_136635
atgtgcaaaatactcaaaataacggcaaaagggtcacttttgaggcattttttagcccctgggcccactagaaagcttaagagtgaagaaaccagctcgcctaggcaagctagattacttcaggaggaagaaagtagattgcctgggcgagctgagatcgcatggcatgaggggctgaaggaaaggggtccagaggtcaagaaagaagaggaaagaagagaaaagaagaagaaagaagagagaaagaagctaaaatgccactga

SEQ ID NO: 19858 - DNA, 168 bp, Glycine max
  Peptide Sequence Number=SeqID_136636
atgaaagctaaaacatcaaacatcaaaatttatgggaaagaggggttaatttccagccttggaacaaaaagaaatggagatgctaggaagaaatataactcaagaggagataaagaggcagtctttgatatgggtagtctcaaggcaccaaggaaggatgaattttag

SEQ ID NO: 19859 - DNA, 447 bp, Glycine max
  Peptide Sequence Number=SeqID_136637
atggtgagcaatccttcaagagaacagaagaaagccaaaacttccaagaggaagcaagatgaatgctcacgggctgctctcaatcatttggacacatggttcaaagataaaagcaagaagaatgactacaagatgatatatattgtaaaagatttctctcaacaaggtttcaactttcctaatctactggaagcacatggattgtcaaagctggtgcaaatgaaagtaactttttatccagagctagtcaaggttttctacacctatgcacgtgctgaccttaaggaagtagttggtctggacatgggtggagtccgcaagttcaatgaaatgcttgaggaatttcttgggagttggtggactgactgtagaagacagaatggtggtttacctcattacctacattctcactccaaggccaagcaatcatgctcatgtaatagatga

SEQ ID NO: 19860 - DNA, 213 bp, Glycine max
  Peptide Sequence Number=SeqID_136638
atggcagagctatcaagaatgaaaagagatcatcccaagacaagaggtgacctggaaatccacagtgtactcgtgggactcggtagtgtgctcgtgatacatcgcgcaagagcgcttacagcagctcgtagctattctatgcatgggagtgatgatatattgatagcacgagctagccgattcggattgagaggaaggtcagttctgatctaa

SEQ ID NO: 19861 - DNA, 426 bp, Glycine max
  Peptide Sequence Number=SeqID_136639
atggaacaacaaacttctgctgccgtttgtggcagcgaaatgcaaacctcggtcattaacctggacggcctgaaaccatcggttagttgccatcctacagttgaacgctggcgcgtagcagacatcatggcattgtttgaattgccattcaatgatttgttacatcaggcacacactgtccatcgtgagcattttgatcctaacgcggtgcaagtgagtaccttgctatccattaaaacaggcggctgttcagaggattgcggctactgcccgcaagcggcgcgttaccacactgaggtggaaaacgagccattgatgcagttggatgaagtgcttgcagctgcccaggcggctaaagacagtggtgccagccgcttctgcatgggcgctgcctggcgtggtcccaagcagcgtgacctggagcct

SEQ ID NO: 19862 - DNA, 1214 bp, Glycine max
  Peptide Sequence Number=SeqID_136640
ctgaacccgaggatgaagctgtagctattccagcaccagcaatttcaaacgttaatgccgcgcctgctaaagcagtcctggcgccacaaatagaaggcgaattcagtatcaagccggctgaaacaaccgccgccaatcccgtggtttcggtgatcgagccaccgttagaagccgcaaatactgctaaacaggtcaaaagcaatcaagaggagcctggggttagaggtgtggtcaacaagcaggtccgtcccgatcaggaagtcaatttgctgattcagcgcgctgtggatcacgaacaaaaaggacgccttaacgaggcattggtcacattgcgacaggccataaatagctatccgcaatcagaggatgcacggcagttgctggcagcttatttgttcgagtcaaaacaagattctgaggcggttgctgtgttgcaaactggcatcaagcaatatcccgggcagattggtttatccaaatcactggctaaatggcagctttcacatggccagccagagcctgtgctgcagaccctgaaacccgtcgccaatctgctgatccaggatgcggagtcacaatggatgcttgccatggcttaccagcaaacagggcaacatgcagcggccttgccgcactttgagcgtgcgacggtgttgcggccaggcgtggcgcagtggatggtggcttacgcgatttcgctgcaggctgcgggccagtctgctcaggcattgcagcaattacagctggcttataacatgccactcagcgagcggttatctgagtttgtgagtcagcgtatccgccaattgggtggcactgtcccggtgcgtgccaacaccagtgctgttacccgctttgcgcctgcgtttttcaatactttggcgactgcgtgcatactggcacccgttgtcatgacatcatccaccaccacgacattgtctatgcacctgctttgccagttccagcgcgtgattgaagccgcgctccctgacgcggttcggatgcatgggcatggccatgagaatatgtggttgttcctgtccggggaaagttggcaagtggtcgagcaggctagttgccagcaggtggccaagagaaagttgttgatgatcccacataatgtgcccgagacattaggcagtgcacattgtgggcagcgaggcgcggtataccaaggtaacaatgcgacgcaatgggcgcaaaggattgaatag

SEQ ID NO: 19863 - DNA, 330 bp, Glycine max
  Peptide Sequence Number=SeqID_136641
atgagttttccatccagtgcggcctcgcccgcgcgccaagaacaggcggtccctgaaggggcggcaaaggagccgatggtcacgttcgaaggcgtgaccaagacctttggcggcacgggcggcaagcccggcttcgcagccctagccggtatcgattacgccgtgccgaaaggctccatcaccggcatcatcggtcgctccggtgctggcaagtccacgctcatccgcctcgccaacggccttgaaaagccttcgaccggtcgtgtgatcgtcgatggcgtcgatgttgcggcgctcgatgaaaagagcctgcgcacgctgcgtcgttcc

SEQ ID NO: 19864 - DNA, 531 bp, Glycine max
  Peptide Sequence Number=SeqID_136642
agggctacacacccttgctttcagaggactacacgctctcgccttcaggggactacacgccctcgccttcgaaggactacacgccctcgccttcagagggctacacaccctcaccttcagaggactacacgccctcgccttcagaggactacatgccctcgccttcaaatggcatcacgtccttaacttcatagggttgcacgccctcgcctttagagggctacgcgtcctcactttcattcatgggccaccccctgatcttggaggagggccaactgtgcgagcacaaccagaggaggaggctatcgcgcaactactattcatactggggaaagattttacccgcaccgctgcaaagagacgagtgcggatcatgcgcaccaagatgaccactcttacacagatatggatgacggatcgcgcccacaagacacccagtggacccggagaagtccaaacagggccctggggtttccagctctggttacgggcctcagtcagtcctacagggtgcccgtcccccccagcaag

SEQ ID NO: 19865 - DNA, 648 bp, Glycine max
  Peptide Sequence Number=SeqID_136643
atggagaaaattttgaagaacgagtatcatccactaagtgaggcatcaacgcacttagcgagtaagaggaatctggaagggaatctaccatgcaagcacgtgctcagcgcattatcagcacgctcagcaagtcgtttttcaccttccaggcttaacgcgagattggcgctgagccaaagttcacttactcgtgctaagtgcgaaaatggcgctaagtgcgacgtcgaggttagaaagccctttttaaagcctggaataacagaattgaaggagagcttgaagagtgcaaacacaaaagagcatatcagagtaaaggagtcaagttttgagattttagggagatttgagcttccttgcaggcttaacgcgagattggcgctgagccaaagttcacttactcgtgctaagtgcgaaaatggcgctaagtgtgacgtcgaggttagaaagccctttttaaagcctggaataacagaattgaaggagagcttgaagagtgcaaacacaaaagagcagatcagagtaaaggagtcaagttttgagattttagggagatttgtgagttttttagcgattatgaggttcctagaggtggaggagacatccccactcctttgtaagaaaacaatttctcttaattcctcttcctaa

SEQ ID NO: 19866 - DNA, 492 bp, Glycine max
  Peptide Sequence Number=SeqID_136644
atggaaaatattcgtgtgaagctgcagaacatatttcgagaagatccaacggttaacgaaggctgggaagcgtttttaccgaggaacttggatgacccttcggtcactttttcggggacccgtaaatcctgggctagaggatctgaggccccgtcttcttcagctccctttacttctgcttttctctcaccaccagcagtcccagttcatctaggtccctccactcagagcttggatcttctcatgtctatgctgcagagcctgcaccagggccaactcctagttatgcagagcttgcagaatatggtccagcagcggcctattatgagcttggaggagttttcacagaaggtggcctggccaggagtccagccttctcctttggaagggggtgaggcctctatagcccaggagcctcagccagaccaggaggatgacacttcagaggactcagaggccactccacctccatctgagcctttcattttttag

SEQ ID NO: 19867 - DNA, 143 bp, Glycine max
  Peptide Sequence Number=SeqID_136645
gcgatccaccccaagaggagagaagtctaagaatcgagatagaggaagaactcaagaatattacagaaggtgatccacctaaacaaaagagaagtcaaggaaatgagaaaaagacagaagacgacaatattactcaaggttag

SEQ ID NO: 19868 - DNA, 699 bp, Glycine max
  Peptide Sequence Number=SeqID_136646
atgggatcaaatcaaacaccttttctcaaaaagaggttttatcaagtcaagatcaaaagactagaagtcaccagtctgctggaattaagacagttgacgggtcaactccaacggcaagccttccgcaaagcctatcgtaagtgtctgggatcccgcacacaaggcttggattggctcctgaagctgaaagctacgagggaagaaaaggccgaggctctggaagagcgcaaagaggtgcaagccctaaaggcagagcttaagaaggtccaagcggtcaaggaaaagtttaagtcaatagctgtcaaagtccgaaaggagtatgacgagttgaaggacgtcaacacggccgccaccgaagccttagagcgagaaaccaagagggcccgaaaggaagaacatggtcggaataagttccgaagggctctatggggaagcaacaaagagcttaaactccggaaagagaaaagggaccaatcgcgagtcgatgacatggtttttgagttgaaggcttgtctaaaatccacaaggagtttatcccaacaactaagcgagatggagggaaacgtgatggccatcattgctaaaaaaggaagcaaggggaagggtgatcgattcattgcaccaagaggcgatgatgtggatggatcgatttgcccttaccttgaacagaagtcaggatcttcctcgactgctagctaa

SEQ ID NO: 19869 - DNA, 522 bp, Glycine max
  Peptide Sequence Number=SeqID_136647
gatggtattatttactgtgaggtgcataatgtgtctattgttattgatcaatctttgttcttttcattgacaaaattacccaatcaaggtgttccttttgagggcacccttgttgatgactggaagtttgattattctattcatgatgctcgccatatggctcacttgattcggtaccggatgcataaggcattacggaccaatgcacctctcccttatcctcacctcgtcaccctttttcttcatcatttcaaaattcctttggaagatgaaccatttgttcaagtaaaaaggtcttttgctattagtgctggtgcgattatctcgtttggttaccgtaaggatgatgatggtcagtgggttcggaaacaaaacttacctcaaccaatccctgacgaatgtactctttctcctccaccgcaaagggttgattcctcttcacttctgaacgatgttctctctgaacttcacagtgttcgagcttttgtgggtgaccgatttgatgctatggatactcgctag

SEQ ID NO: 19870 - DNA, 405 bp, Glycine max
  Peptide Sequence Number=SeqID_136648
gctcatcaaacccaaggtcctcccttggtgagtcttgtagctccaaaggcttgtcaaacccaaggttcgtcctttgtgagtctcataggctcgtcaaacccaaggtttacccttggctcatcaaactcgaggtccgcccttggcgagtctcgcttctctaaaggctcttcaaacccaaggtccacccttggctcgttaaacccaaggtctgcccttggtgagtctcgcttctccaaaggctcgttaaacccaaggtctgtcctttatgagtctcacaggctcgtcaaacccatggtccatccttggaatacaagaaacctagggtccacccttggtacatactcttacaaaaatccaaggcacgcccttggtaagctcactcctttggaactacgacgagcatag

SEQ ID NO: 19871 - DNA, 354 bp, Glycine max
  Peptide Sequence Number=SeqID_136649
atggtccttgaaatgagtgacgaaactcattgcagaagtaatggaggatcgatacttcaaaacatcgtcccttaccctctcaaagccagcaacgacaggggagataatggcgacccagcattgtggctacgccgcgcgtgggggtacgccttaacatccccaccaccactcctccatgctcccccaatgaaaggttgtgccctcctccggaggcgagaaatgcctccaccggtacggtgcgagagcgtcaacctcttcaaggaagacgacttgctattagaagtctcatggcaagtctcctacaaggaggaactattgatggagatgacttctcggtccaccaggggttgttga

SEQ ID NO: 19872 - DNA, 441 bp, Glycine max
  Peptide Sequence Number=SeqID_136650
atgtctcaaccactagggtttcaaaactctaacactacactatatgtggtaagtgctcttcaatacttaagtatcactagacctgaattaagctattcagtcaacaaggcatctgatgttgatgatagaagatcaacttctggtgcagcagtttacttttgtcctaatctcatatcttggtggtcccataagcagcaagttgttgccaaatctagcattgaggcagaatattgtagcttagctcagatcactacagaaatctcatggattcagacactcttaactgaactcaaagttcccttcaacactcctattatcttttgtgacaatcaaagtgcagttgccattgctcacaatcaagtcctccatgcaagaacaaagcatacggagcttgatgttttctttgttcgtgagaaagttttgaccaagcagctcacatag

SEQ ID NO: 19873 - DNA, 240 bp, Glycine max
  Peptide Sequence Number=SeqID_136651
acaacttttgtccatgcttgggggttcgacaaacttgcgaccctcctactcgtcaaggctactaccatcgacacaggacaatctccctcaacattggacaacctctttcacctgcaaaccaacttagagcttgggggacttatgtaccgtctaggatccataaaatacacgtggcaagccttgtggcactctgatacgcaagtcagccgtgacccaggagcatggaagtcatgcctttag

SEQ ID NO: 19874 - DNA, 744 bp, Glycine max
  Peptide Sequence Number=SeqID_136652
atgacattgcttttggggctcacgaagatctgctccctcttcctcctcttcctcgccaccctcacctccccagagggaacccccatcctccccttctaccgctccatcactgccgcctcctactccgtcttcgtcgaatccaagctccggcccctccccgtcgtctcctccctcccccctccgccgagcctcgcctacctcgtctccggctcaaagggcgacagcgccgccgtcacccgcgtcctcttggccctctaccaccccaacaaccgctacgtggtccacctggacctcgaatcctcgccggaggaacgctccgatctggtgaggttcgtggagggccacgcgctgttcaagcggttcgggaatgtgagggttataaagaaggcgaatctcgtcacgtacaggggacccaccatggtcgcaaacacgcttcacgccgccgcgattctgttgagggagcttggggattgggactggttcatcaatctcagcgcctctgattacccacttgtcacacaagatgatctgctgcatatgttttcgtacttgccgcgggatctgaatttcattgatcatacgagtgacattggatggaaagatcatcagcgtgcgaggccgatcatcgttgatccgggtttgtatatgaataagaagcaagatgtgttttggattacgcagaggaggagtaggccaacgactttcaagcttttcacaggtgaagatccttttcttgtctgttaa

SEQ ID NO: 19875 - DNA, 267 bp, Glycine max
  Peptide Sequence Number=SeqID_136653
atggagaatttcactaagcaatcactacgcatggctccaaactctttgggtggaggatgcataaacgaaaacgcaattcatggggctccaaaaaagggtagagaatggagaaatgcactaagcaatcagtacgcatggctccaaactcgtgggcgaaggatgcatgaacgaaaacgcaattcatggggctccaaaaaaggtgtagagaatggagaattgcactatgcaatcactatgcatggctccaaactcgagggcggaggatga

SEQ ID NO: 19876 - DNA, 1105 bp, Glycine max
  Peptide Sequence Number=SeqID_136654
atctgtcgctgtttccaatttgagcgtggcggagaacatcgcctttgagcataacctcaacgggttgctcggctggcaccgtcaggcccggctgcgcgacaccgcgcgcggcattattgatgagctgaaattcgatctcgatctgaacgagaaagtcgccgcgctgtcgattgcccagcgccagcaggtggcgatttgccgcgcgctggtggccgatgcacgactggtgatcatggacgaacccaccgcgtcgctgacgcgtaccgaggtcaatcagctgctgcgcaccgtgcgctatctgaaagacaaaaacatctgcgtggtgtttgtcagtcaccggctggatgaagtgctggagatttcggatcgcgtgacggtgatccgcgacggccgcaagatgggctgctggccagccagagagatgacgccgcatcacctgaccgaactgatgaccggcctgaagctcgactaccagttaaaagcgccaacgcgcaacgccgatcgggcgattctcgaagtagagaagctgacgcgcgccggtcagtatcatgacgtcaatttcaaactctacgccggtgaagtgctgggcctgtgcggcctgctcggctccggccgcaccgaactggcgctgtcgctgtttggcatgaccaaaccggacagcggcaaaatctggctcgacagcaagccggtgcgttttcgcgggcacgaagacgccatcaaagccggcatcggctacgtttcggaagatcgtctgacgctcggcctggtgcagcagcagtcggtggccgacaacatggtgctgccgattctcgataagctgcaaaaccgtttccacctgatcgacgaataccgcaagaacaagctgatcctgcagtggattcagcagctcggcgtgcgcgtggccgatcctaacctggcgatctctaccctgtccggcggcaaccagcaaaaaatcgtgctggcgaaatgggtgctgacccagccgcgcattctgatcctcgactcgccgaccgtcggcgtggatgtcggcgccaaggcaagcatctatcagctgatccacgagctggcgaaagagggactgtcgatcgtcctgatttccgacgaa

SEQ ID NO: 19877 - DNA, 510 bp, Glycine max
  Peptide Sequence Number=SeqID_136655
atgcaggctttactggggatgtggacagtcactttgctgttaaagcctgttatcgtgaccctgcatcttttaggcgggatgacgacgctggccgtactgagttggattgcttttcgtcatacctgcaaagcagatattgccttgccggctggccaacagtactggttgcgtctggcattactgatctggatcgcacaagtgctgctaggcggatggaccagcagtaattatgcggccttggcttgtacggactttccaacctgtcacagtttgtggtggccggcgatggatatgggcgatgcctttcatatcacgcgggcattgggcgtgagccgtgatggcggacagttgcacttggatgcattgacggccattcagtgggatactattgcagcgccaaacttccaaaatgctggcgtgggtattgctggcaattgtgctttgccagattgcggtggggataggcaaccttttattgcagctgccattggtgttggcggtgttgcataa

SEQ ID NO: 19878 - DNA, 768 bp, Glycine max
  Peptide Sequence Number=SeqID_136656
gtccttgccttcagaggactacacgtcctccactttagaggactacacgtcctcgccttcagaaggctacacgccctcgccttcagaggactacacaccctcacctttagagggctacacgtcctcaccttcagaggactacacgtcctcaccttccgagggctacacgccctcgccttcagaggactacacgtcctcaccttcagaggactacacgtccttgccttcagaggactacacgtcctccacttcagaggactacgcgtcctccccttcagagggctatgcgctctcaccttcagagggctacacgccctcaccttcagaggactacatgtcctcgccttcagagggatgcacgccttcactttcagaggactacacgtcctcgccatcaaagggctacacgccctcaccttcagaggactacacatcctccccttcagagggctacagagggctacacgtcctccccttcagaggactaacgtcctcgccatcagagggctacacgtcctcgccttcagagggctacacgtcctcaccttcagaggactacacgccctcacctttagaggactacacgtcctcgccttcaaagggttgcacgccctcgccttcatagggctacatgccctcaccttcaaaggactacacgtcctcgccttcagaggacgacacttcctcgactttagaaggttgcacgccccctcgcctctagagggctacgcgtcctcactttcagtgggctccacatccgcaccttaa

SEQ ID NO: 19879 - DNA, 140 bp, Glycine max
  Peptide Sequence Number=SeqID_136657
cggcacgggtgaaatcttgccccggtatgcacagtagctgcgtgatagcctcctcctatggttgtgctcgcatagttggccctcctccaggatcagggggtggcctaagagctgataaaaggaaactactggccccttaa

SEQ ID NO: 19880 - DNA, 348 bp, Glycine max
  Peptide Sequence Number=SeqID_136658
atggggccaaggacgttttggctcccaccatggggccaaccggtgacctatactaatgaggattctcttcacccctacttaaatgctccaacaaagaatagactgactacatcatccgggagtttcacaaaggaatatgcgacatgcactcttgggaagatgaatggcgacacaagtgataagagtcggttagtagctattgactacttcatcaacagttgggctaagcgcatatccaccgctaagcgcagcttcaacgcgcttagcgctaaggagaatctggcagagcatcagcatcaaagttgcacgctaagcgtgagatcaggtttctttgtaatggctggctaa

SEQ ID NO: 19881 - DNA, 1371 bp, Glycine max
  Peptide Sequence Number=SeqID_136659
atgggtcttgtcatttcttggaggctttccatcgtcatgatagctgtgcaacctatcatcatagcatgcttttacacaaggcgtgtgcttctcaagagcatgtccaacaaatccgtgaaggcccaacaacaaagcagcaacatagcttctgaagcagtttcgaatcttagaactgtcacagctttttcttctcaagacaggattctcaaaatgcttgaagaggcccaacaaggcccaagtcaagagaacataagacaatcttgttttgctggcattgggcttggatgctcccagggccttgcatcttgcatttgggccttgaatttttggtatggtggcaagcttatctcatgtgggtacatctcaataaagacattcttggagagcttcatggttttggtgagcacgggaaggatcattgcagatgcgggaagcatgaccacggatctcgctagaggtgctgatgtagttggtgatatttttgggatcattgatcgtcgtacgaagattgagccggatgatccaaatgggtacatgctagagaggttaattggtcaaatagagcttcatgacgtgcattttgcgtaccctgctaggcctaatgttgctatctttgaaaatttctcgatgaaaattgaggcagggaaatcaacagcattggtggggcaaagtgggtccgggaaatcgaccatcatagggctaatagagaggttttatgatccacttaaagggatggtgacaatagatggcatgaacataaaattgtataacctaaagtcactaaggaagcacatagcactagtgagccaagagccaacgttgtttggtgggaccataagggagaacattgcatatggaaggtgtgaaagggttgatgagagtgagatcatagaggcagcacaagcggcgaacgcgcacgatttcatagctagcttgaaggaagggtacgagacatggtgtggggaaaaaggggtgcaactttcagggggtcaaaagcagaggatagcaatagcaagggcaatactgaaaaaccctaaggtgttgttgttggatgaggccacaagcgcattagatggtcaatcagagaaggtggtgcaagatacgttgatgaggggaaggtggtggagattggaacccattcgtccttgttggccaaaggaccatgtggagcttattactccttggcaacttaaagaagtggaccagaaggagaaggaactttcaaatcgtggtgatggtgtcgatagttgtggttctagtgatgatggtgtcagtgtagcactgatggtggttgtggttttggtggtagtggtgactgcggtggcaacgcaaaaggccattgtcaattgttgggagagtgttgttttctaa

SEQ ID NO: 19882 - DNA, 864 bp, Glycine max
  Peptide Sequence Number=SeqID_136660
atgctggacttcagcccgtcggataaattcatgatggccttgccattgttccatgcctttggttttacaggcgccttgttacctttattaaacggtatcccgctgttactgttcccgtctcctttgcaatacaagctgattccagaagtgatttatgacaaggggtgtacagtctttttctctaccagcacctttctgagcaattacgccaagtatgcgcacccttatgacttttataaattgcgcgtggtgtttgccggagccgaaaagctgaacgaagaagtccgcaaaatctatcacgaaaaatttgggatccgcattcttgaaggatatggcaccactgagtgtgcgccggtgctggcggccaacacgccgatggcaaaccgtaatggtagcgtcggccagtttttcccggggattcaatataaattgacgccggtgccggggattgaaaaaggtgggctattgcatgtcaaaggggacaacatcatgcaaggctattacctgttcgacaatcctggtgtgctcgtagcgcctcaggatggctggtatgaaaccggcgatgtggtcgaggtggatgctgaaggatttatccacatcaagggacgggtcaagcgctttgcaaaagtcgcgggtgaaatggtgtcgctggaggtggtggagaaaatagccagcactgcagcccctgaccaacagcccgcagcaactacagtagcagacgccagccgtggagaaagcatcgtgctatttacgaccgatagcaaactcaagcgtgaagacttgcaaattgtggccaaaaatctcgggtcgccagaaatgccatcgcccggaaaattattgtcgtcgaacagattccagtattag

SEQ ID NO: 19883 - DNA, 228 bp, Glycine max
  Peptide Sequence Number=SeqID_136661
atgcccttagtcaggttatcatcactcaacatcaccctaggttcctttgaacagttcagactgtcccctagtgtaactactacatgccatacatcatctcttaacgaatcctcactcatcctttatgatgagaaccatcgatcctcaaacaatgggcgtgctggaattcatttaggacaaacaatatatgcctctcaaggttttcaaatgcaaggaatccagttttga

SEQ ID NO: 19884 - DNA, 156 bp, Glycine max
  Peptide Sequence Number=SeqID_136662
atgtctccacaatcgaggctaactgagtcttggataccacccagggttgacttggtggatcctgtgtctaaggatgaagttgaagatttggaggaggaaacatctatcgaggaggacccatctatagatgaggaagaccccgtcgcgtataggtga

SEQ ID NO: 19885 - DNA, 636 bp, Glycine max
  Peptide Sequence Number=SeqID_136663
atgtggcttagagttctaaataacttaaggttttgggatagttggttcatgattccaaatgcatttcttcacatacaggctcagaggaagtacatgaaagttggcttatatgaagcacatggaagttggcttatatggaagcacatggaagttcacggtgcttacctcgacggtggacgcgctaacctcctcaacgaccgttgctcttcgcggaagcttcctcgcagcaccaccgcaagctacctcggcaacctcctcaacgaagaagaagaagaggcacaaagaagacgtgcaagcaatgaagaagaagacacaggaagaagaaccaggaagaagaagcaggaagaagaaccaggaagaagaagtaggaagaagaagcaggaaggtgatccgaaagaagaagaagcagaagcgcaaaagcggggagggagagagagaggtgttaactgttcaggtttgtgccatttctgtgatgcccaactcgagaataggtggcacactattgtgggttgtagctacaccattgaagtatggagggaagctgggctgtgggagtttcttcagagcataatcctcagttggaatgagctggtgtggcaagatagacatgtgcagcagaaccatgttgtctattga

SEQ ID NO: 19886 - DNA, 231 bp, Glycine max
  Peptide Sequence Number=SeqID_136664
atggtgggcctggtcagtggtcatggtggtaggggtgcaaacatgaagaaaggcaacccgtcccaacccataattagacaacaaggttggaaaaccctaggtgttatagcctccaaacagtgcagaagaaggagcacctccacgaagggtggcatgcctcctcggcgccatcgatacatgacccaacagtgcgaggccgccacgggggcaacagaggcaccacggcagtga

SEQ ID NO: 19887 - DNA, 318 bp, Glycine max
  Peptide Sequence Number=SeqID_136665
atgaaggaagaggaagaagaaaaggaaaaaacgaagtcgaggctctaccgaatcgcaattgtggatcatttccctacatcgtttctcttgctagccttgtaccctgtgcaaccgtcggttgtgatggtggtcgatactgaggcgtccccagagtgtttggcatggggacaccaaaaaaagtgtgctcttcagtggtatatcccggataaaccccaaaatcggtcagagtgtggtcttgaggagcttcatgtgtttcccccttgggttgagagacatgggcatgagtatgatcgggttgaggtttttgactctcagtga

SEQ ID NO: 19888 - DNA, 1191 bp, Glycine max
  Peptide Sequence Number=SeqID_136666
atggaccagtgctctttaactgctacttctgaagagcaatatgttaatattgagatccctgaacaactgatcaggggttggcaacaacagggatacacccatcttcactatggagcaattaggctggtgttatccttacatggtagaagaggacttcctgtaactgccagagtctcccttctagactccaattacatccactatgaaaatgttgtgatcagaactgtattaactaccctctatgctggaagtgtagttctcaccattttcctaaattacaacgtcaatttgagagatcccactctcccacaaagaatgaaagttcaaatacagaatcatgttgtcaatctatctatgcctactagccatgatagtgctctctttatcctgactaataatcaggaagaaactccatctattgtccaaatccccagaaacatctctagaaaagaactacaggagctgatccctcttcaatgggtgaccggttatgagaagctcagagagaatactaagcatgttagtacttctcaggccactttcagaagatctatagatgggcttgtaaccacgaccttcaagaaaccagatgaagccaataacaacaactcttcagaggtttttcattctttaatgataaaacctaaagttaaagaagatagcagaatgtcgatatttgccgtcaaggcagatggaagtgtgatatattcagataaagtaaatagacactttatttgggatgttgctcccgaaatgtgtgattcagactgttcctgtgatgaccatgatggagacacagatgaaaatacagatgatgatgatgatgatgaagacaaatggaagccagagccaaggccttgcaaaccacctccaccaccacaaagaaggagtgaccctaaaaatggaccgtggacggggataaagaagaaatatccagaagaccctctttggaaggagaaaaggatggtagaaattctaggctggaatcatccatctttgaagatccctgaggcacctataccttgcatgatgtttgcttccaccacatcctatgatcaagagtttccatctcttgacagaaaagcagacccagtgacaaaagtttcaaccaagccttacataattcctacagaagtagggccagaagggaagcttaaaagccctagccaagccgaagaagtcttaaactga

SEQ ID NO: 19889 - DNA, 174 bp, Glycine max
  Peptide Sequence Number=SeqID_136667
atgtcgtgcgggatcggagtcgtgggcacgacgtccttaccatgtttgcaacggcttacttgggttgaggttctagcggaattggaaaatccaagaattgacgaagggtcagttgttgagaatttgagaatgagatgcttttgcatgctgaaacgttgccgtcgatatacttga

SEQ ID NO: 19890 - DNA, 2094 bp, Glycine max
  Peptide Sequence Number=SeqID_136668
atgtggggtaaccagttaattgattggatagctttgccttcgtctggtttgtcgggtggtttgttaatgatgtggaaaaaaggattatgggtggttaagtctaatttttctggtcatggcttcataggtgtttgtgttgagtttaagtcgaaattattcttcttcgttaatgtttatgctccatgtaatactgctggtagaagattattgtgggagactttatataatctcaaatatggtagctctgcgggagagtggtgtctagtgggggatttcaatgcggtatctaatagggaggcaaggacgggcagaagcgaaaattgggggtatattgatatggtggattttaatgcttttgtgaatgaaatgaatcttattgatcctcctttgcatgggaataaatttacttatttctgctctgatggtattgctgctagtagactggacaggtttcttgtttcggatggcatcatgaatctaaggcaagtaaaggggcagagggttggtaaacgagacatttctgatcatcgccccatatggttggaatgttctaatcttaattgggctcctaagccttttcgttttaataactgttggcttgaacatgatggtttcaagtcttttattgttgaggagtggaagaagattcagattactggaagaaaggcatatgtcataaaggagaagctgaaaattattagagagagtttgaaaaagtggaataaggaggtgtttgggtggctagaccttaatatagaaaatatagtggctgatatgaatgagttggacagaggcatagaggaggggtgtaatcttaatgtggtggtgaagaagaaagaagcaaatgcattattttggcaacaactaatgatgaaggagagcttgttgaaacagaaatctaggttgcgttggattaaagaaggagattctaacacaaaattctttcattcttgtcttcaagataggaggagaaagaatcaaattttatccttacaagtggaggggcgttgtgtggaccaggttggggaagtgaagatggaagtgcgtcgattttttgaggaaggattcaaggaagcttctttttctagaccggtgttgggggggatagagtttcagactttggggtcggaagaaaattctttcttagtggcaccattttcagaggaggagataaaggatgtagtgtggagttgtgatggtaataaatgccctggtccggatggtttcaacttgcgctttataaaagaatgttgggagtttgtcaaggatgatattgttgaatttttacaagaatttcatatcacaggtgtgcttcctaaagctattacggcttccttcttggctttgattccaaaggtaaataacccccagaatctaaaggaatataggcccatttgtctgattgggtgcctatataaaattctctccaaggtgttggcgtctagattaaagaaggtaatagctaaacttatatctccttgtcagtcagctttcatttcaggaagacaaattttagatggtgtcttgatgattaatgaggtagttgatcttgccaaacgtagaaaggatgaatgtttgttgtttaaggtagactttgagaaggcatatgactcggtttcctggagttttttgacttacatgttgaacaaaatgggttttgataagaaatggattgggtggatacaggcgtgtgttttttctagttctatgtcagtcttggttaatgggagccccacggatgaattcacagctcataaaggtttaagacaaggagatccactatctccatttttatttctcattgtggcacagggactttctggtttggtacaaaaggcaagtcaggttggaaattttgatggttatcaggtggcagatggtttgaacttgtctctattacaatttgctgatgacacaattttattgggtaaggggtcttggaagaatttgtggagcatcaaaactatttttagaagctttgagttagtatctggtcttcgggtcaatttccacaaaattcttgggtgttctggttggtgccaacccgcggcgaagatcgacttggaaaccggtggtggattctatgagggctaa

SEQ ID NO: 19891 - DNA, 198 bp, Glycine max
  Peptide Sequence Number=SeqID_136669
atggcatatatgatggtggctgcagtggcggctgtattgcaatctggtgtgcttggaaggacaaggcaagcaaaacttcagtggatgaaggtgtgcaaaatgtatgggaaattctgcaaccaaatgggagaagggataacaagtgattttgtgtctttcaatggtagacatagactaatgaattttacctacagttga

SEQ ID NO: 19892 - DNA, 945 bp, Glycine max
  Peptide Sequence Number=SeqID_136670
atggggtcgaaccaagcacatgcttttaagaaaagatgttcatcaagtcaaggtcaagtatggaagaaagaatgtgctttatggaacccttaccgaatgcgtgctagagctaaagaaatgagtcaaatagaggaggtgcaagagcaaatgaaggctgacatggaagccatgaaagagcgaatgaccataattatggaagccatgatgagtatgagaaggatgatggaggtcagggaggcacatgatgcaccccaagaccacaatctagacgactttaaacctcacctcggatatgctactaaggggcaagcattgggtggcgtacccctaccaaacactttggggggcgctcagtatcgcccacaaccacaaccctttcattttgtggtgggaaaagtccctcctgatatggtggaaagggagaaatcggatcatatagaggaaaggctaagggccattgaaggaggcgaaaattatgtctttgctgacatggcagaactgtgcctagtgcccgacgtggtcattcctctgaagttcaagatgcaggacttcgataagtacaaggggactacttgcctcaagaatcacttgaagatgtattgcaggaaaatgggggcatacgcaaaagatgaaagattgttgatgcatttcttccaagaaagtcttacttgggcaactgtcacctggtgtactaatctggaacctttccgagtccattcttggaaggacctaatggttgccttcattaggcagtatcagtacatttctgatatggctccggatagaatgcaactacaaaatatgtgtaaaaaggtgcatgaatctttcaaagaatacgcccaaaggtggagggatctagcagctcaagcagcgttcccaatgatggaaagggagatgatcacaaagataatagacacattaccgatgttctactatgagaagatg

SEQ ID NO: 19893 - DNA, 273 bp, Glycine max
  Peptide Sequence Number=SeqID_136671
cgtggcgattgagaaggattcgtcgaatccgtatcatgatttcaggcattccatgctccaaatgatctttgaaaaggagatcgagtcagaggacgatcttcaagaccttttgcaatgctttcttcagctgaatgcgcagtgtcaccaccacgtcattgttaaggccttcaatgagatctgcaaagaagcatttcctcacaaggttagtaccactcctgccgtctctgaaccttctccctctcaccggagccccctcatcgttcaaaagagccg

SEQ ID NO: 19894 - DNA, 216 bp, Glycine max
  Peptide Sequence Number=SeqID_136672
atgtgtgggagtcaccaccaacgtttattcgtggaaaacgttagaaaaaccaaaaatgggtatgcgaaacttgagaataagggcttgggagttgtttacgcatggggaagctttcaacctctttacaagatgacttacgtaacaaatgatcagttaaaatttactttacaaaagaaaagagattcaccgatgatagaaggagatgaagatacataa

SEQ ID NO: 19895 - DNA, 237 bp, Glycine max
  Peptide Sequence Number=SeqID_136673
atggaaagaagaataagaaagaagagaaaaacgaggttgaggcgctaccaaattgcgactgtaatcaacttctacatcgttcttcgttcggtgttcttcgtttgtcattcgacgctaggttgtgacacgctgccattgatcttcaagaagcaaaggactccattgatgaagaagatccaaggcatacaagctccatatggagctacatcatgtggcatcaagagcatctttgtctag

SEQ ID NO: 19896 - DNA, 1395 bp, Glycine max
  Peptide Sequence Number=SeqID_136674
atgcaactgaagcggaagagtgaagcggctgattttgaagctgattccggtgataggatgactcctggattcactgaagcagctaatagtccttttcagacacctgtatcaggaaagacggggaagggaggcaaatcctttaggctgacaaagggcaacagacttggaactcagaccccaggctcaaatattggttctccttcaggcaataatctcactcctgctggtccatgtcgttatgacagctctttagaggcacaacctggtcctgctctgctaccatctgtcacttctatcctccatattgaaggacatcctaaaatgttcaacttgtggctaatccaaagaataactgttgctgttagtggcaaggatctgatgtctgaggcagatccagtgctgccagcccactcttttattgtgtttttcgctgcaaatggtggatgcagaggtctgttgacaaagaagttcatcaatttgatcaaacaagctgaggatggtatccttgatctgaataaagctgctgacacattagaggtgcaaaagaggaggatatatgatataacaaatgttcttgaagggattggacttatagaaaagaaactcaagaaccgaattcaatggaagggactggatgtttcaagaccgggtgaggctgatgatagttttcctagtttacaggcagaagttgaaaatttaacaatgaaggagcgccagttagatgaacaaataagggagatgcaagaaagactgcgagatcttagtgaagatgaaaataatgacaagttgctttttgttactgaggaggatataaagaatttgccctgcttccagaatgaaaccttaatagctattaaagctcctcatggaaccacattggaggtccctgatcctgacgaggctgttgattatccgcagaggagatacaggatagtcctcagaagcacaatgggcccaatagatctttaccttgttagtcaatttgaagaaaagtttgaagagattaatggtgttgatgttgcacccaaacttccatccagtccagatggtactaaacatcaatcaacagtggtcccggaggatagagggaaggacatagaagtgcagggacaagaagctcctgggcctagttcagattttactacctcccaggattttgtgagtgggatcatgaagattgttccttctgatgttgctagtgaagctgattattggcttttatcagatgccgacgttagtataactgacatgtggagaacagaacctggagttgaatggaatgaactggaaccactccaagaagattattgcatgactcgcgagaacactgcgaccccaagtcatccttcaaatgtagatgaagtgtcttctgcacctaaatctactggaggttga

SEQ ID NO: 19897 - DNA, 180 bp, Glycine max
  Peptide Sequence Number=SeqID_136675
atggcatttggtggacctaaagctcgcccaggcgagctgagacttagccatgaagtaactggctctcccaggcaagctggttacttaacatggaagtcttttggtggcctaggcaagctaggggctagcctggaaacagaggacgtcgagtcctatgaagcacaaagacaaggacattga

SEQ ID NO: 19898 - DNA, 267 bp, Glycine max
  Peptide Sequence Number=SeqID_136676
atggcgttggtcgggggcaaagcggtggtagtctccggcggcgacgaagggaggtttcatagaggagaacgggagttggcgtttcatggagtgcatgatctggtccggcggtttagaggcgccggcgccggcggggggagcgcgcgaggccgacatgcgccgggcggcgatcggcggcggagggggtcggagggttgggggcgggaatttgggggaatcggaagagggaatggcggagatctgatcgtttggcgagtcggaaaatga

SEQ ID NO: 19899 - DNA, 735 bp, Glycine max
  Peptide Sequence Number=SeqID_136677
atgaacaaagaagagttttgccactacgagttcatgacatcctcagcaacaaataaccggggcgttgctacactcacatgcaaaattgccgttttgatcattcatcacacaacaagttcttcgattgttaggtacaagattcgtgaggggccagcaatgaccacatctcttctactcccatctccttcctgtgcttctatactgagcaaagggactaacagaatttgcactcgtgcttcatttcacactcttaaatcccatgtgaagaagggcttcagagttagagcacttaaagaaaagacagaggaaattgaaagtccttctcaacaatcttcacctgaagaagttacaaagaagtatggccttgaagctggtctttggcagattttcagctcaaaagaggaaggaaaggataattctgaacaacagaaatcaaaaggtgatcaagccaaggaattgctagcaaaatatggaggagcatacttagccacctccattactctgtcattgatctctttcgcactatgttatgcattaattagcgctggaattgatgtacaatctttactgcagaaggttggaatctcaactgatgcgactggagagaaagttggtacctttgcattggcatatgctgcacataaagctgcatctccaattaggtttccacccacagtagctcttaccccaattttagctggttggattggaaagaaagttgagaaagataagtag

SEQ ID NO: 19900 - DNA, 329 bp, Glycine max
  Peptide Sequence Number=SeqID_136678
accaccgtggtcaggtggtgttttcgcatactgcagacattggtttctgctcagttattgctgcggaaatttgggccattctgactggtgaagatagcggtgttcagtattgcggtggtcgtcggcagcggcatacaaggtatgcattattgatccgtaaagcaccaccaccacaccgccaaacaccagttgagaagaacgcgcgaggaagaagcagagcagagcagcacaacagcaccaccaccacgccgccaacaatggtgaagaagcaactcacgtcaccggcaccaacagtccactcgaggtcgcggaatcgcgcagaagaagaa

SEQ ID NO: 19901 - DNA, 860 bp, Glycine max
  Peptide Sequence Number=SeqID_136679
caaatgaggtggtggatgatgctaggagatggaagaaagcatgtctcattttgaaagtggattttgcaaaagcttatgattgtgtttgttgggagtttttgctatacatgacgagaaggataaggtttactgaaaaatggatttcttggattaaggtatgcccggagtctacatctatttcagtcttggtcaatgggagtcattatgaggaattccatcctgggagaggtcttagacaaggagatcctattgctcccttcctctttcttattgtggctaagggtatgagtggtttcactaaggaagctttgaggatgacatgtattctggttaatttctacaagagctcttttgaaggagtaaggatgaacacatttgttctccataggtacgcttctatccttaactgttaccctatggttctatcttttgtttatttaggtattcccattgaggaaaaccctaggagggagagtgtattggaagagggtagaaggaaaattgattggataaagtgggaggacatttgtaaaccaagagagttgagtggcttgggaatagaaaatgttatacaatttaattcggctttacttgggaaatggaggtggaggctattgagggagcatggttcgtcgtggggtcttgtcctaaaatctaaatatggagacatatttggtacacctataaaaagggtgtcaaattttgattccatttggtggagtgacttagttaaggtttgtggtgaaaatgagggtggatcatggtttgataacaacatttgttggaaagataacattgtggggattgttggaagttgggaagatgggaggtgggtttggaatttggtgtggaaagaatga

SEQ ID NO: 19902 - DNA, 2013 bp, Glycine max
  Peptide Sequence Number=SeqID_136680
atgaatcaacaacgatcaaggcgttttcgagctgccaaggacaatgaaattcaagaagctgaggaagagaggctaaggagacaattcggaatgaaaaggaaacaagttcttcctaaacagcaatctgatgtgtcagattcaaatatcataacacctggcactgagttcatgcatgaactatctaaggcccttaaaagctacatctcttcaaggataacctctaactcattatggaaggatattatggtaattctttctgatgctaatgtttctggagaaggggaacataagattatgtcatacataaggaaacagcttagtcttgagggatacaatccaaataccagtcttatatggctcacttttgaatttgaaatgcaggatgttgatcttataatgctggcaatggcaactcatgagccccatttttcaatattaagagaggatgtaccaatacagcggcagcactcaaaagatgccgctaagcctttcaagggggctattgatttgctaatgactgtttacaagaaagaattcaataaacttggaggatatcttgtggacatgagcatgagcagaattggggagaaaaatgctgctttcttgaagttatccagacttgaaaaatttatgcttgctgttggtgcatatgaagagaaaatctttaagaaaagatctgaaatacgagaaaaatatctgcgaaggtttattagagatagtgaggatgctaagcaggacgaagagaatgcaacatgttactcagatcttgatgaagaaaatacttctgattgtactcttctgattaagtctgttttggtcaacaatgtttcagctacacatgctgaatatcagattgagcagaacacaaaggatttgaaagacgaattgaagatatgtattagagaaaaatgtgacttgtttcagagcgggaatttcctaacagacaaggtccagaagtacacggaaggtttggtgtgggttcttcaatactatttttcatcagttgcttcatggacatggttttatccattccactatggtccatttgcttctgacttaaaaggcatgggtcaggaaaatgaggccataagaaattcagtcaaagctgatagcttgtttgttagaagtgctagcgaattagctgagaaatttggttctctttctctagacacaaacccaccatgcaaattagaaacaataagtgacggcattgggggtaacataagtctttgtgacgagttcattgagaagccttgcttggacatttgcgacaacaaaaaagaagacagggtcttatgtgtctattacgagcttccggctggtagtaatcatattcctcgtttactttcggatgtgaagcttccagaaaagacaatctttgaaattgacattatggaaacagaactctggcatgaacctcagaaatatgatagtcgttttgagagggtgcaaaatcaagacaagtggaggagtgaaaacacaagcaatacttcaaggtttccccccaatgcaagtaaccaacatgcaagaagctttgtttacaaagatgctggtgttggattgggttcgggtagagggaaaagaattgatgcaatggcaaatgagagtgtgccaaacaacataagaacacagcactttgtggacaactttagacaactcagaatatcagagtctaataatcattttccgaggcctggtggtggcagttctcagtctcgaccgcataatattggtcacattaatcagtcaagaaatgctccttatcatcaaggctcacaatataataatggttacatgaatcagccaagaaatgctccttatcatcaaggctcacagtataataatggttacatgaatcagtccaaaaatgctcctaatcatcaagggtcaaattacctgactgtgtctaatgttggtccaggacaaggtaggggtgcatctagtaacagttcattgcggcctcaatggagtggtggaaactcttaccaagtgaaagatcaaaatctttggtaa

SEQ ID NO: 19903 - DNA, 1348 bp, Glycine max
  Peptide Sequence Number=SeqID_136681
atggactatgtagagcttactattgaggtgtttgctggtcacagaaagaagaaacacaaaggactctcgagaaatgctaggaaaaaacaatttaatgattgttgtcttttcaagaggaaaaagttctatttgggccaagttcctaagcccagatacagctataaagctaaaaagattacaccaagtgatgaaaagatgagtggtaaggctggtgaagtggtattggtgactgggactaatgatgttagtccatatgataaggaatttctcttattcaatttagacaacaaggaacgatgggaggagattggtagatgccgtgctgaacccgtggccaacaagatagagaagagacacactaaggcttctccgttacaaacccaagataagagaaacattggtgtgatgactataaaaagaagaaaggaagggggtagtagggacagtgcaaggacgagtgatggagaatatcctggcaaggagcatgtcatcgttgcaaatattcatcgcctgggaaataaagataaaagccagaaaggaactatgcatgcaacatcggagggggctattaaagattgcattgttaaagaagaggttcaatttgcatgcatccaggaagcaaagatggggaacgtgtttaaatccttatggggagatggaaatattgattggagggaatctccggctgttaattcagctggacgattactatgtatgtggagtcaagatgtgttggaggtaattgatccttttatcggggatggaggagaagaaagtgttatgggatcaacttttgaacttgaatcccaggtgaatgaagccatgtggtgccttgctggagattttaactcaatgaggaagagtggctatgtgcttaaagagaagctaaagttacttaaaagggggcttaaaaagtggaattcccaaagctttggcaaccttcaacatcattctaaggagttacttgcaatgattaatctcttggatgtgaaggatgaggaagttgggctatctacagaagaaattaagaggagaaggatttgtttgggggagtatcacaaagttgctaagagacatgaatcccttgcttaccaaaaatcaagaaccaagtggatcaaagagggtgacgaaaatatgaaattctttcataataagatcaattggagaaagaggaaagatggtattaagggcctagaggtggaccgtgtatgggtggaagaaccaaagattgttaagaagaagcaacttggagatgaaaacaatatctctctttgtagcacttttatggaaaaggaaataaaagaggcgatttgggaatgtagtggagataaaagcccgggtcccaatg

SEQ ID NO: 19904 - DNA, 2004 bp, Glycine max
  Peptide Sequence Number=SeqID_136682
atgacttttgctaactcaagatctgcaagttttgaagatgatccggagctagcaaaatttccatcaaccaacggtgacaatggcgttaagattaaatttcacattgacggaacacaaatacctgagcctagttctaatatggctcagaaaaaggtgacagggaagttcttgaaagctagaatgttgtcaagagtgttctccgaagactacgaccgagtaaatcgaagagtgttagatcctaggggacaaaccatacaccgatggaacaagattttcttggtagcatgtttagcatctttgtttgtggaccctttgttcttttatcttccagtggttcgagatgaagtgtgcattgatattggaataactattgaagttatcctcacattgattttgatgaagtttcggacggcttttgttgctccttcttcaagagtttttgggagaggagaacttgttgtaggatattataagattgcatttaggtacctccgcaagggtttctggttagattttgttgccgccctgccccttcctcaggtgttaatttggattgttatcccagctcttaggggttcaaccatggcaaacacaaaaaatgtccttcgctttttcatcattttccaatatattccgaggctagttttgattttcccactttcatcacaaattgttaaagctacaggggttgtgacagaaacggcatgggcaggggctgcttacaaccttatgctttacatgctggctagccatattttaggggcttgctggtaccttctatcaatcgaacgtcaagaagcatgctggagaagtgtatgtgatttggagaagtcattttgtcaatatggattctttgactgccacagggtaaaagatgcactcagggtgtcctggtttatggcaagtaatatcacaaatttatgctcaccaaatgcaaacgatgacttctatcagtttggtatatacgctgatgccgtgacttccaaagttacatcctcggcattctttaataagtacttcttttgcctgtggtggggcctgaggaatttgagttctttgggacaaggccttcttactagcacacatgttggagaaataatggtcgccattgttgttgcaacccttggattggttctttttgcactgctaattggtaatatgcagacatatctccaatcaactactgttcgcttagaagagtggagggtgaaaagaactgatacagaacaatggatgcatcacaggcaactacctccagaactaagagaaactgtgcgaaaatatgaccaatacaaatggttggctacacgaggagtcgatgaagaagctcttcttaaaggacttcccgtggatcttcggagagacatcaagcgccacctctgtcttgatctagtccgaggagtgccattatttgatcaaatggacgagagaatgctggacgcaatatgcgagagactaaagccagcattgtgcacagagggcacgtttctggtccgcgagggtgatcctgtgaacgagatgctcttcataatccgaggccatctcgattcttacaccaccaacgggggccgggccgggttcttcaactcgtgccgtattgggccgggcgatttctgcggcgaggagcttctgacatgggccttggacccacggcccagtgtgatactcccctcatccactcgaacagtgaaatccatctcagaagtggaggcctttgcactcatagcagaagacctgaaattcgttgcgtcacagtttagaagactacacagcaaacaactcagacataagttcaggttttactctcaccactggagaacttgggctgcgtgtttcattcaagctgcatggagaaggcacaagaaaagaaagcaagtggctgaactaagggcaagggcaattaatgttaatattgctgagcctgaaacaccaactaggacagattctggccttgtaagctccttgcagaagccagcagaacctgatttctctgttgatgaatga

SEQ ID NO: 19905 - DNA, 765 bp, Glycine max
  Peptide Sequence Number=SeqID_136683
atggagtttgatggactaatgctaaaccagcttagaacaggattttccaagaaaaacatcacttcttactacgaaggattttctcttcaacatagttttattgatgatggcataactctgaaccttgtagaaactaaatggcttttcctcagatcaaggaactatcaggaagccactaggttcaaagaaacaaatttcgagcaagatgtattgtatgccatgtctaccgaagggacaaaggatgctttcagaaggcctctttgttgtttgggagccaaagagaaacctttcatggaaatattattattaattgctctaggtggaagtagttacgtataccgtggttggctgaaagatggtagtgatgtggcagtcaagagactaaaagatcagagagggcctgaggcagattatcaattttttaccgagattgaactattgtctagacttcatcattgtcatctggtgccattggtgggatactgctcagagttaaaaggaaaaaatgttcaaaggttgctagtatttgaatacatgactaatggaaatttgagggacaggttggatggagttcttggacaaaaaatggattggtcaactcgcgttacaattgcattaggagctgcaaggggctttgagtatcttcatgaagctgctgctccaagaattctgtacagagatgtcaaatcaacaaacattcttctggacgaaaattggcaagcaaaagtacgagtcttcgtttttctaaatggttctaacttctag

SEQ ID NO: 19906 - DNA, 255 bp, Glycine max
  Peptide Sequence Number=SeqID_136684
atgggaattgcctttggattttttgttggtatttcaatttcatctgtgcatttgactaagattagcttactttcatcacctgtagggaattcttttgatgtacctgtagctgattctgaaatagacagattttcggatgaagtaaagagatcttctgctgttattgacgagtcttctggaaccaaaaaccttgaaaccctagggtcaattagattaccgaagaaaagtaaagctggaggtttcattggttgttag

SEQ ID NO: 19907 - DNA, 363 bp, Glycine max
  Peptide Sequence Number=SeqID_136685
atggctgggagtgaatggcacatgcttgttcttacctatcctaaagctataatattggtgtcagcgagcacagtagagagtatgaaaaatatagggacaagcaagattggcctacttacgatagcaaatgaaatggagaatttagaagtcaacccagatgaagatgcctatgatttggctagtcacaacagaattgacaatgtgagggcaagaacggtggagcgggaaagggtgtttcacgagctcatcacaaacagtgcattccaaagtggtcaacttacgctgtgtctagaatacacaagtaacatcgatctcaaggtactagacaggccggcaatgcatcaattgaagggcctaggataa

SEQ ID NO: 19908 - DNA, 525 bp, Glycine max
  Peptide Sequence Number=SeqID_136686
atggcttctccacctgcatcgcctcctcctcctccttctctttctcctcctcctcctcctcctcctcctctttctgacgcaatagcttcgcctcctaccgtgaagcggacacgcaaagtaccagtggtccatgttgatcctgctaccggcaaggccgacggtccccacaggaagaaattaagaacatatttggggattgtagcgcgagataaggtggccgtcacgtacgagaactggaaagaggtccctattgctcagaaggactttatttgggaggatattcagtgtcaacctacccttcggcaaaagggcgacgcgagacttgtgggtgtgtcttccaagaaaggaaaatgtgcggagtcaccaccaacgtttattcgaggaaaacgtcggaaaaaccgaaaagggtgtggtctacgaactttaagtttgaaaggttctggagttgcatttacgcacggggaagggtgtttcccttgttcctacgtattcctcaattgtgataaggaaatcagacctacatag

SEQ ID NO: 19909 - DNA, 288 bp, Glycine max
  Peptide Sequence Number=SeqID_136687
atggcacctgaggggaggaaagaatacaaaacaaatacttctaccaccgagagtgtacataaaacatgtacaataggaagatggatccacacatcaacccttcccattacgtttaagtccttcaagataagacttgtcagcattggttacgcgaagttgaaactgggcccattcacttctgcatctggctcggacctgaaagggtattgtagtagggggcaaaatatcagaccgcaatacaagtatataactaatataacttttcttgcattcgctaactccacataa

SEQ ID NO: 19910 - DNA, 699 bp, Glycine max
  Peptide Sequence Number=SeqID_136688
atgtcccctacgcatgctttacatgtccatatttgccagagatgtgcacttttctcaattgtgtatttatgcagctcttattcatgcatgagaccattgcatgatctgaagaaaaagccgaagtatttagttacattcactgttggttatgaacagaggcataatatcaatgctgcagtgaaaaagttttctgatgattttgcaattttgctctttcattatgatggtcggactagtgaatgggatcaatttgagtggtcaaggagtgcaatccatgtcagcgcaaggaaacaaactaaatggtggtatgctaaaagatttttgcaccctgatatagtatcagcttatgaatatatttttatttgggatgaagatcttggagtagaacacttcaatgcagacaagtatattcatttagtgaaaaaatatggtttggagatctctcaacctggtcttgagcctaataatggattgacatgggagatgacaaaaaggaggggtgacaaagaagttcacatggtgacagaagagaaaccaggctggtgtagtgatccacatttgcctccttgtgctgcgtatgctctctctcttccaccctgtaattatactgatgaactttccaaatatcttcttgtagaacgatctagtgcatggatggggattggactttgctctcagaagatgtgtagaggtcagtaa

SEQ ID NO: 19911 - DNA, 2046 bp, Glycine max
  Peptide Sequence Number=SeqID_136689
atggttagcatggagagaaaaacaaagaatgaaaatgggtctattgggtttggatccattttcatgcatgccgatggcaaagatttgcttctcatggttttaggtaccattggggctgttggggaaggcttggccacccctctagtgttgtatatcagtagccgcatgatgaataacattgggagttcctctaacatggatggaaacactttcatccataacatcaataagaatgcagtggcttggttatatttggctggtgcctcttttgcggtttgcttcctcgagggttattgttggacaagaacaagcgaaagacaagcagcgaaaatgagatgcagttatctgaaagcagtgctcagacaagatgtggcatacttcgatttgcaagtcacaagcacgtccgatatcatcactagcgtctccggcgacagcatcgtaattcaagatgttcttagtgaaaaggttccgaatttcttgatgaacatttcattgttcgttgggagctacatagcggcttttgcaatgttgtggaggttggccattgtggggtttcctttcgtggttcttcttgtgatcccgggtttaatatacggcaagactttgattggcttgtctagtaaaatcagagaagagtataaccaagctgggacagtggcggaacaaacaatttcgtccatcagaaccgttttttcatttgtgggggaaagcaagaccatgaacgctttctccaacgcgcttcaagggacggttaagttgggcctgaaacaaggcttgactaagggattagccattggaagcaacggcgtcgttttcggcatttggtccttcatgtgctactacggtagcagactcgtcatttatcatgacgccaaaggagggacagtttttgcagtcggagcagcaatcgccgttggtggattggcattaggggcgggtttatccaacatgaagtacttctcggaggcggtggcggtagcagagcgtataaaggaagtgatcaagagggttcccaagatagattctgacaacaaggatgggcaaaccctggaaaaattttacggggaagtggaatttgatcgagtcgaattcgcatacccgtcgagacccgaaagtgcgattttgaaagggctgagcctgaaggttccagcagggaagagagtggcgttggtgggggagagtggctcagggaaatcaacagtgatagctttattacagaggttttatgaccctgttgggggagaggtgcttctggacgggatgggcatccagaagctgcaggtgaagtgggtgaggtcgcagatggggttggtgagccaggagcctgctctgtttgcgaccagcattaaagagaacatacttttcggcaaagaggatgccacggaggaccaggtggttgaggctgcaaaagctgctcatgctcataatttcatttcgcttctgcctcacggttaccatacacaggtgggagagaggggaattcagatgtcagggggacaaaaacagagaatagcaattgcgagggcaataattaagaaaccgcgaattcttcttctggacgaagcaacaagcgcactggactcagagtcagagcgactcgtccaagaagcgttggacaatgcagccgcgggttgcaccgccatcatcatcgcgcaccgcttatccacaatccaaaacgcagacctcatcgccgtcgtcggaggcggaaaaatcatagagatgggctcgcacgacgagctcatccaaaacgacaccggcgcatacgcctccacgtttcgcctccagcaacaaatggacaaagagaaagtagaggaaagcacggaaaaaaccgttactccacggattattttatcaactacagacaccgaaaacgtgggacctaatttaataggtcccacgatattcagtaatcatgatgatgatgtgggggaagggaagaaggtggcagcaccatcagtcaggagactgatggcgctgagcgttcccgagtggaagcatgccgttttggggtgtctgaatgcgatggttttcggtgccgttcagccg

SEQ ID NO: 19912 - DNA, 815 bp, Glycine max
  Peptide Sequence Number=SeqID_136690
accaaggtcaaggcatcttaggggtgacttcttctaagcccaaagatgataaggggaagacaatagaaaagcaacccctaaaggctagtatgcaagagaagactagctccatgaagtgctttaaatgtcttggaagaggacacattacttctcaatgccccaccaagaaaaccatgattatgaggggccaagacatttatagtagccaagatgaggttactacttcaccttcctctagtgaaagtgaagaagcaaaagtggaagaatctagtgaagaaatctacccccaagaagaaggacaacctataatggttaaggaggagtgtaaggagacacttgttagtattgccacacctcttgggcttgagtttattccccaagtaaaggagttgttggatgagggtgttgaggaaaaaagcccagagtttcaagaacctcgggatttgaggtcaaatccttttcaagggggagggaatgatgcaatcctaccccacaagggcattggacaaaagacgactccaattcagacatcttttgaggcactaaatttcgtgctccttctctccctctccctccattcatcttctcctacttcaagctcttatccatggcttcctatggtgtggtgtctcctctcaactcttcttcttctccattccgctgccattaaaattcaagaagcaaaggactccattgatgaagaagatccaaggcctacaaattccaatggagctacatcagttagggtgagaatgaaggagaagtgtgtgaagattggtgagaaaactgagtgtcagaatgagataaggctctag

SEQ ID NO: 19913 - DNA, 546 bp, Glycine max
  Peptide Sequence Number=SeqID_136691
atgaagctttgcttctacagggaaaaggggcataacaaatctgattgtgaagagttcaaggcttggctagagaacaagcagaaatcgagaggggatttagacaatatttcttcatctttagttgttgagaattttgttgctaaaaggtctaaagttgaagaaaattcatttatgtggcacaagcgcttaggtcatatttctaggcaaaaggttgagggattgacaaagacatatattctaccttccttgggttttgatgacttggaaaaatttgaagcacttgaaaagttcaaatttgaagcaattgaaaaggagttgggaaaagtcatcaagattgtaaggtttgtccatggtagaaagtattatggtaaatatggttccacaaagcatcatatggggtcattcgccttatacttccaggatattggaatagttccacaatacaccatgtttgggactcctgaacaaaaagctgtagccaaaaggcataatagaacacttaaagatatgatgagaaacatcatgagtagatgtaacttgtcataa

SEQ ID NO: 19914 - DNA, 862 bp, Glycine max
  Peptide Sequence Number=SeqID_136692
atggcagacaacacacgcatgaaggagcttacaggggatgtcaaaaggatcctggagatgatggaaaaccgcaataaagaatatgctgctcggtttgagaccttagaaacaacactggagatgacactcaaggataaaactagagatcctgggagtatatcactggctatgaacaatcacccttttaaggttgtgccctggtaccaaatgatgactcgtgaaaattcattcaaaacatggattgcttttatgcgagccttagagacagaatttggcccatcaccgtgtgaatgtcctagatctcagttgtttaaactcactcaaattggttcagttcagtcatattacgtgcagttcacggctttagctaatcgagtacaaggaattacacaagaagctctattggattgctttgtgggaagattaaaacctaatatcagaatggatgtcattgcgcaatcacctacatcactcctcagaacagtttcgttggccaaactctatgaagagaaatatacacctaaactcaaacctttttcttcgagtttttcttccaaaacacaaacctcaaacacaaactcaaacctaaacataaaccaaaacagcccgcaatccctaaaatccacaagcttacccccactattacccacaccatacaccaaacctatcaatgttaagaaaatgacatcggcagaaatgcagttgagaagggaaaggggcctaagctttacttgtgatgacaagttttcccctagccatcgttgtcctaataagcaacattttgttctacagtgggaagaagaggatgatcctgcattacaactagatccaccagacgaggttgagacagctggtgacccca

SEQ ID NO: 19915 - DNA, 546 bp, Glycine max
  Peptide Sequence Number=SeqID_136693
atggaaaatgacaaagaaagggtgggttggaagaggaaggggagtacttcgaatcacaatcaaaactatgcccaagcagttagacaaggggatgggacaaagaagcataaatggaaagctaaaggggtaaaccaagtgggaaagcatgaagaactgtggtggggtcaggacatacatacacatggtgagatacaagagtggctagatgaagtgtatcttgtaggtggtatagggaatctgaaactgaactatattggagatctgacggtgctgatcttcgatattaaagatgtagagagaataagattcaatggatctattcaccttgtaagaataattgaagaaggtctctgggatagtggaagctacatatgtagacaaaagggatggaagaactcaagtgatggggagttatctaaaagaagcgtgtatggatgggactttagttccttgatagatgagtgttatgataactgtggcgaagatggtgttaagttgcaaggagatggtggtgggaaaggtgggagacatgacgggaatctctag

SEQ ID NO: 19916 - DNA, 276 bp, Glycine max
  Peptide Sequence Number=SeqID_136694
atgtggacggaccgatttgctcttactttgaacaggagtcaagaacttcccccattgctagccaaggccaaagcaatggcggacacctactccgcccccgaggagatccacggacttctcagctatttgcgaatcaagtcactcccgcattttatccctagcatgcattgtatgttggtctcgtcctttgtcacgggaagccggaaggtccatatcaccttcttaattgtacacatagggcactgcgcccccaaatgcgcaagtaagaagagataa

SEQ ID NO: 19917 - DNA, 375 bp, Glycine max
  Peptide Sequence Number=SeqID_136695
gggtgccttatggttatccgcaccttttgtcatccagagacggcgagtccgatgacatgcgggggtaccttatggttatccgcaccttttgtcaaccagaggaaagcgagccagttgacatgcaaagactaacatcgtcatctgcaccttttgtcaaccagggagacgagtccgatgacatgcgggggtaccttatggttatccgcaccttttgtcatccagaggcaagcgagcccgttgacatacagagactgacatcgtcatctgcaccttttgtcaaccagggagatggcaagtccgatgacatgcgggggtaccttaaggttatccgcatcttttgtcatccagagatggcgagtccgatgacatgggggg

SEQ ID NO: 19918 - DNA, 207 bp, Glycine max
  Peptide Sequence Number=SeqID_136696
atggcagatagatctggtgttactttccatgaggatattagtaatgcagttgtattagaaattagaattggcttatggtgggaatttcttattccattaggagtgattttagccattcttgatcctctgctcattgctatttcgaaaagtggtcctgcggtcattggtggaaagtcaattgtgctgaagcctccaactcagttgtag

SEQ ID NO: 19919 - DNA, 192 bp, Glycine max
  Peptide Sequence Number=SeqID_136697
atgacccagatgaggaagatggtgaggaggatgaggaggacgaaggcggcggtggcgccgaggatgaggcggaggaggttgcggcgttgggaggagtgggcgaaatggcgaataataatggaaatgtacgcgctacttatgttgtacaatgtacaacagagcaccacatgcaatcctggtggagttgattag

SEQ ID NO: 19920 - DNA, 546 bp, Glycine max
  Peptide Sequence Number=SeqID_136698
atggagtctctgatatgtacaatgatagtgcaaacaacaagaggtattggagtagtactcttaactgtgatcggtgtgcttcaagctgagatttggggtattatgtatggcctccaaatggcagctgaggctgaaagggagcatttgcatgttgctactaatagtctccaagacactaatgcagaacatgatatatccaacaacactcaaggttccagtgaaggggttgagcatcaaaccaattcagttggtgacatccataggactcatatagatgaaccagaaaatgcatgcaagaaacaagtggaaagtcctaacaacaacattgaagctgaagatgtgaaggaaatttcacatgttgtgtacaaggagacaggaaaggcttcaaaagttgaagtaaaagatgtgaaattgaatcatccaaaggaagttcaggttaactctgtgagtaagggtagcaatgcagccaagactaagaaaaaatcaatgctacctacttctaaggcatccccaatttcaacaccaaaaagttcaaagcctgcataa

SEQ ID NO: 19921 - DNA, 847 bp, Glycine max
  Peptide Sequence Number=SeqID_136699
atggctatacaccctcgccttcaaaggacttcacgtcctcctcttcagagggctgcacgccctcgccttcagaggactacacgtcctcaccttcaaagggctgcatgccctcaccttcagaaggttgtgggccctctccttcagagggcctcacgccctcaccttaagaggactacatgtcctcgccttcagatggttgcacggctgcacgccttcgccttcagagggcttcacgtccttaccattagaggactacgcatcctccccttcagagggctatacgccctcacctttagaggactaaatgtcctccacttcaaagggcttcacgccctcccattcagaggactacacgtcctcctcttcagagggctatgcgccctttccttcagaggagtacacgtcctcgccttcagatggctacacgccctcgccttcaaaggactacacgtcgttgccttcagagggctgcatgccctcgcctttattggactacacgtcctcgccttcagagggctacacgccctcgtcttcagagggctacacgccctcgcctttagaggactacacgtcctcccttttagaggacttcacttcttctcctatagagggcattacgcactctccttcaaaggactacacgtcgccgccatcagagggatacacgcctttgcctttagaggactatacgtcctcacctttagaggcctgcacgccctcacccttagagggctacatggcctaaccttcagagggctacacgccctcaccttcagaggactacaagtcctccccttcataggacaacaccctcatgccttcagagggctgcacgctgatcgaggcc

SEQ ID NO: 19922 - DNA, 1635 bp, Glycine max
  Peptide Sequence Number=SeqID_136700
atgatccctcttataacagtaagagtaatagtgctcctcttattaggtgtcacactccaaataaccaagcccgtggttgtgaagggttttccactacacacgagtgaacggtggattgtggacgaaagtgggaagagggtgaagctagcatgtgttaattgggtgtcccatttggatgctgtggtggctgagggcttaagccaacaacctttggatgagatttccaagagaatcaaaaccatggggttcaactgtgtaagactcacatggccacttttcttggtcactaatgactctattgcttctctcactctgagaaactctttccaaaatcttggcctaattcaatccttgaatggtgtccaagccatcaacccctccatcatcgatcttcccctcatcaaagcttaccaggcagtggtgaaaagccttggagagaacgatgtaatggtgattttggacaaccacgtgagccagccagggtggtgctgcagtaacttggacggcaatggcttctttggggatcagtattttgatccagacctctggattatgggccttacaaagatggctactattttcaaaggtgtgactaatgtggtagccatgagcttgagaaatgaactacgaggtcccagacaaaatgtcaacgtttggtacaggtacatgccaaaaggagcagaagcagtgcatgcagcaaatccagatgttcttgtgattctatctggcctaaactttgacacgaacctatcattcataagaaatgaggcagtgaaactcagcttcaatgggaaactagtgtttgaggtgcactggtacagcttcagtgatggtcaggcatggacattagggaatccaaaccaagtgtgtgggcaagtcacagagaatgtgatgagaagggcagggttcttgttggaccaagggtggccattgtttgtgagtgaatttggggtggacttgagaggcacaagtgtgaatgacaataggtacctcaactgtttcatggcactggtggcccaacttgacttggattgggccttgtggacactgggtgggaattattacattagacaaggggatgttggaatggaggaatattttggtattctcaattcagattggattcaggttaggaacacaagtttcttgcaaaggatctcagctattcaacttcctttcaaagggccagggttatcagaagctaaaccatacaaagtaatttttcacccattgacaggtctttgcatcttaagaaattcaccggttgagccattgatgaggttgggaccttgttctaattctgatgcatgggaatacacggaccaaaagatactatcaataaagggtacctatttctgtctacaggcagaggaagaagggaagcaagcaaaacttggaaatgcatgttcaggttccaattcaagatgggaaatgatctctgattcaaagatgcacctctcaactcaaaccaacaatgcttctggtgtgtgtcttgatgtagacaccaacaacatcattgtcaccaatatttgccaatgcctaagcaaagataacacttgtgaccctgcaacccaatggttcaaacttgttgacagcacaaggaagtctcggcattatctaaggattccaagttaa

SEQ ID NO: 19923 - DNA, 231 bp, Glycine max
  Peptide Sequence Number=SeqID_136701
atggagattcttccactatacaaaaagatagtagggttacaaggatgtgtttacaaaattgactcactttatggtggctcactcaagcttgaggataaagacttcccaagctatttatcttctctctcaaagaggctctttctcactctaagaagtggattcactcttttgtcttggatgataggaatgaaggctcatacccttatttatactactccacctccacaatga

SEQ ID NO: 19924 - DNA, 1590 bp, Glycine max
  Peptide Sequence Number=SeqID_136702
atggtctccagaattacaattgcccttgttctttttgaatttcttctctgccaagagtttgaacctttaaaagcacaaacatggctacaagctggttattggtattctgggagtggatttcctgtttcagacatcaactctgctctttatactcacctgatatgtgcttttgctgaattgaactcttccacatatgagctctatgtctccccagaagatgagcaatcattctcttcattcacaactactgtcaaacaaaagaatccatccatcactacactgctgtcaattgcaggtggaaatggtaacgacactgtcttatcattaatggtaagcaaagactcttcaaggaaatatttcattcagtcttcaataagaatagccaggctttatggttttcaaggcctggacctgtcatgggttcctgaaacaatttctgacatgaacaacatgggaaggctttttgaggagtggagggcagctgcaaaatctgaggcagcaaacgatagcactcaagtgttgatcttaacggcagctgttcattttagaccaggtttggattccgcttcttacccagtggagtctattcaaaataacttgaattgggtacatattttgacttacgactaccacatgcctcagttggcaaatttcactgctgcccatgcagccttatatgatccttcaagttctgtaaacacagacaatggtatcaaggaatggattggtagtggagtaacggctagcaagttggttttggggttgcctttctatggatatgcctggaatcttaggaacccagaggataatgcaataggtgcatcagcaacaggtccagcaattggaaaaagtggagctatgaactataaggacatcaaggcttatattcaacgatatggaggccatgtcaagtacaatgctacttatgtagttaattacttctccaatggatcgacttggataggttatgatgatgttgaggttgtcaaaatgaaggtttcttatgcaagggaaaataagttacttggctatgctgtgtggcaagttccttatgatgacaattgggttctttctagtgctgcaggcatcttaatttactacttaaggaggagatttcccaaatcaacagcagtaattttaagtactttgaacaatgtgaataaagacgcttcaagacttttccacagcaacgcacctgatttacaagtattcagcttttctgatattgagcaggccacaaatagattctcaattgaaaataaagttggccaggggggctatggtcctgtttacaagggcatcctatcaaaccgtcaagaagtagctgtgaaaaaactatcaaaagcctctacacaaggatttgaagaattcaaaaatgaggtgatgctaactgcacgactccagcatgtgaatcttgttcggcttttgggtttctacattgatggagaacaacaaatgttagtctacgagtacatgccaaacaaaagcctggattcctatctatttggtcagaaatcttcacatttctacattttacatttagtgaatatgcagtatgatcttaactttaggacattaaaatctgaataa

SEQ ID NO: 19925 - DNA, 846 bp, Glycine max
  Peptide Sequence Number=SeqID_136703
atgggcaatgttacggggagcgtggcggcgagattggcgtttttcccgccggagccggcgacgtacagggtttcccgggagcaggacgggagggtggtggtgtcgggtgcgggtttgagcgaggacagggacctggtggctcacgttctggagacgaagggcgggaacaggatcgttgccacgttctggaagcacacttttgcgaggttcacgttgctctactcgcatggcaacgccgctgacttgggacagatgcatgacctcttccttgaactcagggctcacctccgcgtcaatatcatgagctatgactatgcaggatatggagcatctacaggtaagccatctgagttcaacacatattatgacatagaggctgtgtatgattgtttgaagagtgaatatggcattaagcaagaagatttgattttgtatggtcaatcagttggtagtgggcccacaatacatttggctactaagttacctaatttgagaggtgttgttcttcacagtggcatcctttcagggataagggtcttataccctgttaaggtgacattttggtttgacatattcaaaggaactaatgatgaaatcgttgactggtcccatggaaaaagattgtgggaactttccaaggaaaaatatgaccctttgtgggttaagggtgggggtcattgcaaccttgaggctttcccagagtacatcaagcacttgcgcaagttcctaaatgccatggagaaactctcaatcacaggagagacaaacaaacaacccactcatgatcctagtgatactgaagaagaacacaaacataacaaatgtttaagatttggtttaagatag

SEQ ID NO: 19926 - DNA, 1311 bp, Glycine max
  Peptide Sequence Number=SeqID_136704
atggcaattgttttggaacaggatattgctaacatgaaggactcttggtttttcgacaataactttaatggtctctcagacgagatttttgatgatgtcattaacttttttgatttcccgctggaagacgtggaagctaatggcgtcgaagaagactgggatgctcaattaaaatgccttgaagacccgcgtgttgatgtttatacagcatcatcagctgggttgtgtgccaaaactcaaaatgaaaagccccaacttggaatgaagttctctgcttctgagaattggacaattggagtaaaaagtggaagatacaggggttataggtttagtttttgtggcggtagtctgaattcccccttgaaagtgtgctgccaatgtcatttactcattcttggcaataacaggaaaaattgctacatttcatctgatactgacccaaaatgtcctggagatgctgctaatctgtatgaagttctttgtctttattcacctaaagtttccagggatgcacgacaaagggaggaagaaggtaggaagcttggtgctaatctctttcctctgccattcaggttgcagaaacttcctctcttgggaaatgggatttccccaataaaacagctgggaaaagctactggaccagtatatggaaagaccattactcaccagaatgtcacttccaatggaaaagatttgcatcaattccaaacctacacctacagcccagtttcggtttttgaaagcagcagttcgtcctcagttgagaattccaactttgatcgacctgtcatcccagtaaagcgggctcgtagtaaacgtcagcgtccttcaagcttcagtcctctattttcaattcctttcatccttaattcgccggctatgcaaaatcatcaaaggatagcagctgctgactcagattttggaacaaatgttgctgggaatctatcaaacaaactaaaaaagcagaaaaaaaaggattcgtccctgctatcagatgatgttgagatgatgagatcctcatcaccggagtcaggttcccccagaaaatgcatgcattgtgaggtgacaaaaaccccacaatggagagagggacctgtgggtcccaaaacactgtgcaatgcttgtggtgttcgataccggtctggccgcctctttcctgaataccgaccggcagctagcccgacttttgtagcatcactgcactcaaactgtcacaagaaggttgtggagatgagaagcagagccatccaggagcctgttaggggttctatgttggcttcatcaaatctccatggaaatgctgtaggataa

SEQ ID NO: 19927 - DNA, 531 bp, Glycine max
  Peptide Sequence Number=SeqID_136705
atgaagcaacagggcggccttgtctggggcgggccgcccatgttcaagccacgccaatcaatcccgcaacagcggcagcaagctgtcgccctgcctttcgatttccttgagatagggcgtgtcggaaagcacgaaatgggtgatgcccagcgcgcgcacgtcgctttgacggtgcaaatccagcaggcggcgctggccgacagctacggcctgaaggtggtcgttccagcgtacgccactgtttgcggccatctcggcaactttcgcttccgcatcgcgccaagcctcggccgtggtttcgcgtaccagcgtggtgatccgcaggccgaattgcagcggcggcagatcgcggccgagcttttcactgaagtgcctgagccgctcgatccgttcgcgcacgccggcgagcggttctccccagaaaagctgcacatcggcctcggttgcggcaacctgctcggctgcttcggaagcgccgccgaaatagagtttgggatgcggtcggccttcgcgtgcggtgatacgtggtga

SEQ ID NO: 19928 - DNA, 3012 bp, Glycine max
  Peptide Sequence Number=SeqID_136706
atggctcttattgctcgaatccagcacccttacattgtggaattcaaggaggcatgggttgagaagggttgctatgtctgcattgtcactggatactgtgaaggtggagacatggctgaattgatgaaaaaattaaacggtgcttactttcctgaggagaaactctgcaaatggttcactcaattactgttggcagtagattacctgcattcgaattatgttttacatcgtgacctaaagtgttccaacatctttcttaccaaagatcaggatgttcgccttggggattttgggcttgctaagacactaaaagcagatgatttggcttcttcggtggtaggaactcctaattacatgtgtcctgaactgcttgctgatattccgtatggattcaaatctgatatttggtcactcgggtgctgtatatacgagatggctgctcatcgccctgcctttaaagcttttgatatggcaggactgataagcaaagtgaaccgttcatccattggccctttgcctccatgttattccccttccttgaaaacactgataaagggcatgctaagaaaaaatcctgagcatcggccgacagcatctgaggtgttaaagcacccttatttgcagccttatgtggatcaatatcgtccgtctttcagtcctccaacaacctgttctcctgtaaaaccaatttctgctgtcaatgatcatcgaaaaaatatggctgaaagtcaaaacagtaatagttcaagtagtgacaaagatactttgatgtcaaatgagaaaaacattgcaacagcaggaccaaagtgtgataacgaagccactgagatggatcaaacatcaatcgatgatgatggctcagatgaagaaagtggttcttgtaatgtcaatgccaaaacagctgagcaagaggtggttgaaccatctcataacaaacaccattctaacgttgaatctaagcagccaaaaacaattagaaatataatgatggcattgaaggaaggaaaagttagagaagcaacttctccaatgagaggcaaccgcataaagcctagtggcctatcaacacaaaaaataagcacagagacattatctaaattgcctaagcctacttttattgctcctagtatgaagcctaatttagaatcacatgctgcacttgcaagggcaagccctgaccctgcaaaaagaatgatgggatcacattatccaaagcatcagattctgatgacagaagcctcaccaaaagttaaagctagacatgatttcactccaccatctgcacttgtcaaacaagtagaaggagatggagtttctccaaggccaagacaaaggactcccccaagcttacttagaagaccttcattttctggaagaatgaggctggctggaattgatgttccaaatgcagcaaatgatactgggaagctaggcacaaataaaatagtccaggaacctcagatgagcccttgtcaattggccaatggcaatgtaccacatatttcaagacaggttactactagagagcctcagaaggcttttgaaagaagttccaaaggattgcaaacagacagcagcaattctgcctcatcttcagtttctatccaaggatgtgaacttgctgatgatgcaacaactttcattgacatgagagaacagatgcttcctaatcatgagaaagtaaaccacattgtaggtgttgaatcatgtcctgataggagccaacctacaacttgtgcacattgtaagatggttgaaaaagtgcctaaagaaacctgtgaggtttccacgaattttcagaatactattagtagtaatgagaaagtgagttccagtttaactctagatcaccaccatgttgaagattctaaggtaacacttgcttcagaaggtggtcttgtcataaacaagacaactacatctactactacctccaactgtgatgatagatctgtagaaccctctgctggagccaccaaagaaataaaagattttcaagatatttccaaggaaatgcctttaaccaagtctcctaaggaaatcaaggattttcaagatatttccaaggaaatgcctttaaccaagtctccaaaacaagcacccccaagttctggagaaaaatctgttcatgtagaagttagtccagtaagtgaaccagatatagttagccagccaacacttggatgcaagccccctggtgatgacaaattcacagtgagggagcgactgtcaccggtggctgaaactgttcctgtggtcaccactactaaatcatcaagccagaaagtcttgcaagagaaaggaactttgttgcagaatccagcacaagaaaggcctgacactggccatcttcctccagcctttgatgatgttatccatgtcatacgccacagtagttaccgcgttggaagtgagcaaccagtgaaggaatctgtggagatgggagttcaaaatgtagatgttggtaagttcatcaatgtagtgagggatgatttagaaatgaggaacataacctcacctttgacccccctcaaatcttcaagttgctctgatgctgcaagcttgaaatcaaacatttctgatcagccggaaacgaagaactcgaacactcctccaatccttaaatcttcaagtctcttcgatgcttcgagcatgaaatccagcatttctgattatccaggtcttaagaaacaagatgtgagtaaccctcctcctttagtttcagaacctgattctgctgaggccagtaaatgcaacactcctgtaaatgaagagaaactaccggtggcaaaggaaacattggatgtgaaatctttcaggcagagagcagaggcacttgaagagctcttggagttgtctgcagagttgctgcagcaaaacagattggaggaacttcaagttgttctgaagccctttgggaaagacaaggtctctccaagggagacagccatttggttagccaagagtctcaaaggaatgatgtctgaggaaagtgggggacgctcttcatga

SEQ ID NO: 19929 - DNA, 267 bp, Glycine max
  Peptide Sequence Number=SeqID_136707
atggagaagggagacacaaaagaactcaggtggttagtgcttcgattcttttggcaagagggagaagtgaatgaagaaaaaggtgttgttgaggaaattggtatcaaatttatcactaggcaggggcaattgctagcaacaaatagaggaaaggccataggcattgatcaatttagagcaagtgctccagcaggaaaaatatacaaggagtttggtatcaccaaggaagttgttattgttgctgccaaagaactttcgtacatataa

SEQ ID NO: 19930 - DNA, 2013 bp, Glycine max
  Peptide Sequence Number=SeqID_136708
atgaaggaaacagacaagagtttggatccgcagctgtggcacgcgtgcgccggcggtatggttcagatgccgccggtgaactccaaagtgttttatttcccgcagggacacgcggaacatgcgcagtccaacgtcgatttcggagcggcgaggattccgattccgccgctcattctgtgccgcgtggcagccgtgaaattcctggccgaccccgaaaccgacgaggtcttcgccaggctgcggctggttcctctcagaaactcggagctcgactacgaagacagcgacgctaacggcgaggcggagggttcggagaagccggcgtcgttcgcgaagacgttaacccagtcagacgcgaacaacggcggcggattctccgttccgcgatactgcgcggagacgatattcccgcggctggattactcggcggagccgccggtgcagacggtgatcgcgagggacgtgcacggcgaggtgtggaagttccggcacatttaccgagggacgccacgtcggcacttgctgactaccgggtggagcagtttcgtgaaccagaagaaactcgtggcgggggattccatcgtgtttctgcgggccgagaatggggatctttgcgtggggattcgtagggccaagagagggggagttggtgggccagaggggccgtgcgggtggagcagttatggttctggagggcttgggcttgggccatacggggccttttcgggttttatgagggaggagagtgggagggcgaaggtgagtggtgaatcagtgagagaagcagttactttggcggctagtaaccaagcgtttgaggtggtttattatcctcgagcgaatactcctgagttttgtattaggacctcggctgtgagaggggctatgaggattcagtggtgttccggtatgaggttcaagatgccttttgagactgaggattcttccaggataagctggttcatggggactattgcttctgttcaggttcttgatcctattcgctggcctaattcaccttggaggcttcttcaggttagttgggatgagcctgatttgctacataatgtgaagcgagtgagcccatggttggttgagttggtatctaacgtgccaatcatccatctggcagccttctctccaccaaggaagaagcttaggttcccccttgacgttcagtttccgataccatcgttttcaggcaacccctttgggtcttctagctctagcagccccttttgttgtctctctgataacgctcctgcaggcatacagggagccaggcattctcaaattggaatatctttatcagatctccaccttaacaataagctgcagttggggttgcttccaactaaagtccaccagcttaatttgcacgccgggatttctaatgctaagagtaaagaaagtctatcatccttgctctccatgggaaattctaacatgactttggagaaatctgatcatgtcaagagacaccattttttgcttttcggtcaaccgatactcaccgagcaacaaatctctagatcttctagtgatgtcgccacggatgatgagaataaggaaaagaagaagaagggatttcttagtgactcccagtcttcagtttcaccaggaaatttatcttctactgccgagttctcttggcaactcggttctgataccagtcattgcaaggttttcatggagtctgaagatgtaggacggacacttgacttgtcctgcctttcttcttatcaagagttgtacatgagactcgctaacatgtttggaatagagaggtctgatatgttgagtcatgttctctactgcgactcatccggtgctcttaagcaaattggagaggaacccttcagtgagttcatgaagacagcaaaaagattgaccattctgacggattcaaacaacaaagatagtagaagggtttggatcacaggaactcgaaatgctgaacatggattggatgctgcatcaaataagacaggtcctctcagtatatttgcttaa

SEQ ID NO: 19931 - DNA, 2413 bp, Glycine max
  Peptide Sequence Number=SeqID_136709
tttgagagatcaagtccaggttgagcaattgttacggtacattattgaagaaccaccagaagatgctgaaaataaacgggccttcaagtttccattcattgcctgcgagatttttacatgtgaaattgatgtcattttgaagaccttggttgatgatgaagagctgatgaacttattattctcttttttggagcctaatcgctcacatagtaccttgttggctggctactttagcaaggttgttgtttgcctaatgattcgaaagacagtgccacttatgaattatgttcaagcccatcaaaatgtttttcgccaactggttgatttgataggaattacatccattatggaggttttggttcgattggtaggcgctgatgaccacatgtatcacaattttatagatgtgatgcaatggttggctgagagcaacctgcttgagatgattgttgataaattgagtccatctagtcctcctgaagttcatgccaacgcggctgaaacattgtgcacaataactcgaaatccctcatcttctctagcaattaaactttcaagcccaagttttgttgccaaaattttgaattatgcactggaagattcacaatcgaagtctagccttgtgaactcaatttcagtgtgtgtttctttattggatcccaaaagatctgctatatcatctcccctttttcattcatttcgaagtcaacacatgtatgagccaccaattcctgtaaacccagacactattggtgctatgctacctaaactaagtgaattgcatatgcttttgaatgtatcatctgatgaaaaagtattacctacaacatatggagaattgagacctccactcgggaagcatcgtttaaagattgttgagttcattgctgtccttctgaaaactggaaatgaagtggcagaaaatgaaatggtcaattcaggaaccattcaacgagtcattgacctcttctttgagtatccatataataactccttacaccatcatgtagaaagtatcatattatcttgtttggagagcaaaactgatgccattgttgaacatcttcttcgagagtgtgatttaattggaagatttctccaagcagacaaacgttctattctctcttctgacataaatctgccaacagtaactgctgctggaaaacaggcaccacgggcaggaaacattgggcatattactcgaattgttaacaaacttgttcacctggcacataatcgaaacctcatactgacatgtcttcaggaaaatagtgagtggaatgaatggcaagctttagttcttcaggagcgtaatgtagttgagaatgttcaccgttgggcttgtggacgtccgactgctttacaagataggatgagggatagtgatgatgatgaccttcatgacagggactatgatgttgcagctctagcaaataatttgagccaggcttttagatataaaatttatgggaatgaggataatgaggaggaacgtggcaaccttgatcgagatgatgaggatgtctactttgatgatgactctgctcaagtagtcatatcatccctcagactcagtgacgatcaagggagtagtctgtttacaaactccaactggtttgcattccaagatgacagaattggtggtgcaactgggggaacatcatcggagatgatggatgcgataaacttgaatggtgctgcaaatggtggcaacagtagtgatgatgaggtagtggttggagaggatgaagaattggatgaaagcaaaaataatctgaatggtacatctagctcaagcacaaacttaaatgggataactggtagtgattccatgaatggagacaccttgaactttgaaagcaaaaaggcaagcgcttcacatgatatgggattcttcaggtttgaggcatcggacaatgaagagttgtttggggacaggcctttgcctgactgggtgggatggggtgaaccttcagacatgcaagatgccgggtcaagcaagaatccatttatagatcatgatgattcttctggtagcaacctttctactaccaaacctcaaataggtagccctaatcctagtcctccttcgaatggggaatctgttccttcaaacaggtcgccaactaaagattcgattgatgggggtgttgatttgaatcaaagagcagtagcagtaccatcactctttgaagaagatgttgaatttgtaggtgtagaattagaaggtactgagaaggctatggaacaggctctgaaagaagggatagttggggaggcaggaccattgaaaagaaacatggtctctaaagtgccagaaaaggaaagtactgacgagggtggtcctggaataaaggaattcaatgatgcaaattactggagggttgaccaggaggttgctgttctagagtga

SEQ ID NO: 19932 - DNA, 3036 bp, Glycine max
  Peptide Sequence Number=SeqID_136710
atgatagaagtggtgcttaacgaggatgacaccatcggtgactcgaagaagctggtggcggcacaaacaggattcacattccgaaatggatatgagtacggaaaggataatattcgctctgctagggtttctagagaattgacggaagaggaaaaggacttggtagaccgaagcacaaaaaagattaaaggagtggcgcatggtttctcgggtgactcacttttgggagatgtatgggtgaagctgttggggaggaagattaggtttaaagttttggagaataggttgaagcagatgtgggataaagctaaagctcaaatggaaggtccatggctcatttatgatcattatctggtggtaagagagtggagccctaatttccacccttcttcgaaagccatagagaaggtggcagtttgggcagttagagtggataggaatacattgactcaagagaggggcaaatatgcaagattatgtgcggaggcaaacagaataatggacaggggaaaaataggaataatgaagggaagcaacatacaaatggcaacacaagtggccatagtgacccactctcaggggccttggactgttgtgaaaaaaccaaggcaccagaggaaaggtaaggagagggagtttcaattcacagggaatcatgtggaaaaaggaggtcagggaggctcccatgcagcatcgcgatcgaggtttgtttctttgcatgaggatgagggggaccatgcggttgtgatggaaggagatcatgaggtggaagttagggggaaggaatacgagaagggtggagttcttcatccaactcggcctccagatactcatggtgtcatagatgctaaagaaagccctctgaatctccttctattcgagctgaaaaggagcaatcgggggtggaggaaatggagatattgcaagcagtatttgaatgctaataatcctgatatcatgatcattctagatacgcatttggagtctagtaagcttctaaagacggtttattttctagggtttgatggttctgaagcggtggagagacaaggttttgctggaggcattattttaacatggaagaaggacaaagagctttggggcctcgatttactagaaaaggacctttattcaatgggtatcaaagaatttttgaaagatttcttggatcatcatcctctcacgatttctttgcatgctgactataatgggccagggatcaaacctttcagatttgaatgtgcctggttgacacacccatccttcatggatgtcacttctaatgttcatataagaaaaaggaagcttctggctagaataggagggattcggaaggagataaatccagatctcaatggcttcttgaaggagatcggaacacaaggaactaccatggataccccttattcctttccctttattgagcttgaagatttgactatgcttgcggcccctttgcaacatgaggaaattaaaaaggctttgtttgacatgaaaccgtggaaaacccctggtcttgatggctttccagagattatggaagttaatgccacaaacatttgtctgattcccaaggtggaacaactagaatttgttagtcagttttgtcctatatctatgtgtaatgtggtttacaatgttttgacaaaaactttggtgaaccaccttaaagctttaattcctgagttgattactcctcagcagactggtttcatcccttcaaggagcattcatgacaatattgtagtggctcaagaaatgatgcattccatgaggcgtatgcaaggcaaagtggggtacatcattatcaaggtggacctctcaaaggcctatgacaaaatatgttggtcttttgtggcaaagattcttaaagaagttgaacttcctcagaatatgatggatgttattatgagctgtatttcatctgtgaagactaatgttctttggaatgggcaaagatccgacatgttttcttttcatagaggtttaaggcagggcgatcctcttttgccttacctttttgttcttttcatggataagctgtctcacatcttttccaaatgggcattagaaacctatgaagatggggtggaaatccaaacaactttctatggcagaaggattactcttgccaagtcagttgttcagtctttaccagtctactctatgatgactaatgttgttccaggagatcaacaagataaaaggagggttcatgctgttgggtggagtacaatgtctaaggtgtgtagaggaatggccatgtgcaacatgaaagctatgaataaagcttgtcttatgaagcttggttggcagttgagaactaaaggttctggtctttggtgccaggctttggctaatctttggtcagatttggaggaaggtgaattctgggttattggtcaaagggatactgtgaatgtttggaggactaaatgggatggtaggtgggattctgattttattagaatgcttatgcctgaagttattgctcagagaatttttgctattatgcctccctcagctcaagctgattctgataaacggttgtggccaaggtttaatttcttcatggctgatacgaaaggttggatttccatgaacttgactatgtctattgatggctccgggggaagtaattggatggggttgtgggctcatgtttgttactacctttggttttggagaaatcagcagggatggactaaattgaatactgatgagtcggtgcaaggtcctcagattgtggctgcttgtgggggattgattagagatgagaaaggatgttggatatctgagttatggggagtctatgaagggctatgccttgctaggaagattgggttagttgctatggaagttaacattgattctcaagctgttatggatagcttatctgggaagactaacaactgtgttgatgctcttgctagaaatgctattagtatgaatgaggattttttggtgtttcagcaacctccttcttttgttaaggagttgcttttagcttattctgctggagttgtaactccttga

SEQ ID NO: 19933 - DNA, 324 bp, Glycine max
  Peptide Sequence Number=SeqID_136711
atgggaatgaggaaacacaaactccttattgaagatattcttccatccatggcatcaaacaggaaagtgcatagactgcttaatgaattcatggatctggtatctgaatatgaaattgctcctgttaccgaagacattgctgccaatgaccaacaaaaaaatcaaaagtatcctgaagatgcagccctaaatagcaaggacaatcctcaggtggctaaagttcaaacaaagattactcctgcacttgcagatgaagtaactgaacatgcccttgtgacttatcacgctaaccaggatacacaaacaaatgaaggaggttcttga

SEQ ID NO: 19934 - DNA, 183 bp, Glycine max
  Peptide Sequence Number=SeqID_136712
atgaatgagaatattgcttatgtttgcataacgttcgatatactacatgcgtttgatataacatcataccatgatgagcaacaaaggatagtagaatgcgtatttcctctggacgagcaacatgaggaaaattttgaatatagtctatacctacttgttgtcaataacctctcacaagtctag

SEQ ID NO: 19935 - DNA, 153 bp, Glycine max
  Peptide Sequence Number=SeqID_136713
atggctggaagttttaagaggacaactgaattggtggaggcaatattagacaaggagaatttcactttggaagagcttctggacgaagaggaagtgatccaagaatgcaaggccttaaacagtcgtcttatcaacttgtgtgtgtctgtttaa

SEQ ID NO: 19936 - DNA, 822 bp, Glycine max
  Peptide Sequence Number=SeqID_136714
atggctgaatatgaatggacaataattttcttaccagtggcaaaagagactgcaagctcctcaactgaaccagagaacaatgacgaagtggaacagattacaatagcgcgggctttactgaactaccgtttgaaggaaaagatgactatgtctaatccaaatgctccccttccatttcatgaaaggtttcagattcaaaatccaaggccaatcagttctcaaccgcccccagccacttcatcaaagatccttcccctaatttgccagaagacagcacctcgaagtaagccttcattggcaacaacaacaacaaatgaaagtcctggaagcaggcatccacaggcagcagtggcagtgaccagtgacaattccaacctgccacaacaatcttgttctctagaatgccgagcgacccgtcccctgaagtttcctgcagcaggagcagcaccttatgttcccattcgacaaatgagaccatcttgccaacggattgcacctccggtgactataaggacagttgtacctgcatttgctgcaccacctgcctcggtgccccatcctgttatacgggctcctccagtacgagttgctcctccagtcactattcgacaagctgttccattatatgctgctcccaaacaacaaaaagatctaccaactgctaatgcctcgggccagcaagacaaactgcccgttaaaattcaggagatggacaagatcaccgggatacaacaattctcagattctatatttaaagaagcagagcctcagactgataatctggaacctatactgtgtcagagacttaaatggactgcataa

SEQ ID NO: 19937 - DNA, 927 bp, Glycine max
  Peptide Sequence Number=SeqID_136715
atgtacctcttacatacggatttcaacgaagtcgaaatcattgaagaattgattcccgaattttacaatttaaccagcaatgaattcggctatttggaacatactaatgactggctagaggtgttgaaagtgatcaagcattgtccaaaacttcaaaatcttgccattaatcaggttgaatcccgtcctgacgctgataggagagagtggcaatatccattatatgttcctaaatgcatcccttcacaccttaaaacatgccgtattaataattatggtggccatgaaactgagtttgaatttgcaagatatatcatgaccaggagtggcttggatagcagattgtggttgcaggagaagattgctcagaaagataaagatagagttgaattgtccttgttgatctatgcctcaccaaaacaatacgataacatgtggaggaattcctgtatggttgaagtacattcctgcataagcttcagaatggataatgggtctttcaaggttggacttacaattccattgacatggtctcttctattgactcaagtctggaataatctgacattgtcggttttcattcttaggcggcgatgcaagattgagaatgagtacggaccagagagtagaggagctgctggccgtgcatacgtaaactgggcttcaactgcaagtatggctgttgggttgggtacaggaatgccatgggtgatgtgcaaggaaaatgatgccccacatcttgagattttctactctatgagaagcaagaaggagaggaaaggatggatgacgatcaaaattgactttgagaaagcttatgaggatttagtccgtgataccttgcatgatgtgggcattccagagaatatttgggtccatgaaagttttatggaatgccaaggctttggaagattttactccctctag

SEQ ID NO: 19938 - DNA, 420 bp, Glycine max
  Peptide Sequence Number=SeqID_136716
atgacgttgctacttagcaacattctgcccagcgatcaacccctgcggaagtatcgggatcgggcccacaagacacctagtggacccggaggagcccaacagggctctggggtttccaactctggttacaggcctttgtcagtcctacagggtgcccgttccccccagcaagggattgtgcccacaagacacccagtggacccgaaggagcccaacagggccctagggtttccagctctggttacgggcctctctgtcagtactacagggtgctcgttccccccagcaaggggtagcgcccacaagacacccagtggacccggaggagcccaacagggccctagggtttccagctctggttacgggcctctttcaatcctacagggtgcccgtccccctagcaagttcatgtcatcgtga

SEQ ID NO: 19939 - DNA, 156 bp, Glycine max
  Peptide Sequence Number=SeqID_136717
atggaatcaaaaacgtggagcaaaggtgacctaaggctggaaaaccaaggaatcccgggttgctcgcccaggcgagctaacctgcattttttttttgggggaagaaataagtacagcttcctacaggtcgatgctcgcttactcgaacccccgtag

SEQ ID NO: 19940 - DNA, 179 bp, Glycine max
  Peptide Sequence Number=SeqID_136718
atggggctccgaaaaagggatagagaatggagaattgcactaagcaatcactacgcatggctccaaactcgtgggtggaggatgcatgaacaaaaacgcaattcatgtggctccgaaagaaggggtagagaacggagaattgcactaagcaatcactacgcatggctccaaactcgtgg

SEQ ID NO: 19941 - DNA, 1175 bp, Glycine max
  Peptide Sequence Number=SeqID_136719
ccgatctgattaacggccgggttgatgcggtcatggcatcacacaccaaccaaaatgcatatgtgaaaaaacacgcggatgcggtaaacagcaccggttacggctttgagggtggtgtattgggccagggctcggcgattgccattcgtaaaaacaatccggagctgaaaaacgcgctggatcaggcgctggtgtcgatgatcaaagacggcacgctgaagcaactgtcagagaaatggctggggcggcgtgctgctggacgccgccaccgtcacggtaacggtctcgctgtgtgcgtggctgctgggcgcgatgctcggcagcctgctgtgctggatgcagattggtggcggccgctggcagcagcgtcttgccagcggctacatcacgctgtttcgcggcgtgccggagctgctggtgatctacctggaccgtttgacgttaacggcttcgttgccggcgcgatagccatcgggctgatttccggcgcttatcagagcagcgtatttcgcggcgcgttttacgcgattcccgccggcacgctggaagccgctacggtcaccggagtcggcgctggtatcggtgaccgggctggtggaaaccatgaaccagatttccaccgcgtcgaattccacccagatgccgtttttcttctacagcgtaggcgcgcacacgctggcggcgctgctgcgcggactgccgctgacgctcaacctggcggtattgtccctgctgggcggcggaatactggcgctgctgctgaatttgctgcgtcagcatcgccttggcagctacgttacgcgtttttatgtctggctgttccgcgcctgccggcggtgcgcgaaagcgtgctgtggccgctgctgcgtgagccctactggtgcgggttaattgcgctgattctcaacgacgcggcttacaccgccgagatcctgcgcggcggactgaatgcggttagcgtgcagtcactggaagcggcgaaagtgtgcggcatgtcgcgcttcactacactgcgacgcatcacgctgccactggcggtgcgtcaggcgctgccggcctacagcaatgagatcatctcgatgatcaaatccacgtcgctggtgagcaccatcagcctgatggagatgaccggcatcgccgactccatcgtgtcagaaaccttccgcgcgctggag

SEQ ID NO: 19942 - DNA, 177 bp, Glycine max
  Peptide Sequence Number=SeqID_136720
atgcatgttgtacatcggtcagaatcgcgcttcaacaacgaaagcaatgatgttgaatatgggaacttctacatcagtgatgacgtaggcactgatgtagtaagttgcgttttctacatcattttccagaaagcaacgatgttgaatatgggaacttctacatcagtggtgacgtag

SEQ ID NO: 19943 - DNA, 198 bp, Glycine max
  Peptide Sequence Number=SeqID_136721
atgttgcttggagcagttagtttattcaaacggatctttgtgaagggtgaggaggaatatcctgcaaaatgtagtctaccacagcgagcagcgtcattgaataggtttcgtcagaagaggaaagagcggtgctttgataagaaagttagatatagtgtacgtcaagaagttgcactcagcaataataatggaaactga

SEQ ID NO: 19944 - DNA, 426 bp, Glycine max
  Peptide Sequence Number=SeqID_136722
atggacatgcctccgtccaaagatacacctactcaacagcctccacctcctactctcgttgcccctaaagcaacatgtgtcatggcaaatgtctccaaaaggcctgcacttaagaagcaacaacaaaagccttcgtccattgcccaacgcctaagggcactcaatgaaaatgagagtgaggatgataggcccttggtctttagaaaaagaaaagttgcaccacctttagatgagacctatgtgcctcaagtgaaaaaggtgaaacaaactcaacatgctcctcctcctcttactcaaccttgtacaaggatcgaagtacttcctccaccaacgtggaagcgacttgatgtgaacctgagtaggagcggatcgtttgatacaggctatggaggtttggatgatgccacttccggtgaaggaagataa

SEQ ID NO: 19945 - DNA, 345 bp, Glycine max
  Peptide Sequence Number=SeqID_136723
atgggttacacaaaggagctatctcctttctcactggacaagccagtttacagcaaagaacctcattttctgcttttcttatgcagttggtcccagctattagagacccttcctcttccaaatattaaatggatatgtccgactgctcctactcagccaatatctatatttggtggctttccgtccactgcttggtttgatgttggagatatttcagaagatgctcctgatgatctagaaggtttggatgcttctgctgcacatgttgcaaatttgctgtctacagaacctgcagacagaagaaaagaaaattaccctggcctgatctttggttcgtcgaagtaa

SEQ ID NO: 19946 - DNA, 381 bp, Glycine max
  Peptide Sequence Number=SeqID_136724
atggtgggttacatgccttcaagctttgccgatttagttttcaccggtgaaaggatcgaagtgggtctaagaagaggcaaatttgattttcctgctttgatgaagcctggggcaaatggagagaataagaaggagggaaaaaaacatgttgtggctttcgttcctacatggccaaatttctcattagcccaccaatatcaatactctgccaatatcagtccttctcattaccttgctagccaagaacgcccaatcatcaacaaaggccatccccaaatcgaccacaaaatccacccgatgcacctccaagaccaaataccacccctaataccaatcaaaacaccaaccagggaaggaattttccagaaaataagcctatag

SEQ ID NO: 19947 - DNA, 819 bp, Glycine max
  Peptide Sequence Number=SeqID_136725
atgttgcagcagtgttatgatacatccctgttgttggaatccagctacatttcttcatgcctatacttgtctacctcttgcatatgcaaccaggcaagctgccggacttcagaagcattttctcccgtgtgcttgccaagatacaatggtttggcatttttgtatgcttatatccacttttttgatgatgacacatacttgatgttgctgaccactagttctgatgcattttaccatcttaaggattgcaggattcgtattgaaacggtacttttgaagtcaaatgtccttagtgaagttcagagatccttgctagatggtgggatgcatgttgaggatgtaccgcccttacctagttctggatcatctcctcatttgagccagcataggcttccatcagattctcctgaaagggaacctaattgtcacattggtggtgttgctgggttgtggcatttcatatatcgcagcatttatctggatcaatatatatcttcagagttctcatcaccgattaacactcctaagcagcagaaaagcaatataacctgtctccgttgttacagactgtatagagcttaccagaaactttttgcatccatgcatgataaaggaattgggccacacaaaacccagtttagaagggatgaaaactacgttctgctctgttgggtaacacaggattttgagctttatgctgcatttgatccccttgcagacaaggccttggcaataaagacgtgcaatcgggtgtgtcagtgggtaaaagatgtggaaaatgaaatatttttgctgggagctagccccttttcatggtga

SEQ ID NO: 19948 - DNA, 240 bp, Glycine max
  Peptide Sequence Number=SeqID_136726
atgtcattttctgtcactcaaggacgggcactgcctgttgctctatttgagcccttgtttggatttatggatttagcagttagcacaccaaagatgtctttgactggtcttgtctggttttggtttcttcatctctttctcaacggacatcgacttaagccattcctcatgaacccttctttagtggacgtagtggtggaagagacttccttactccaccctactcttcctccaccatga

SEQ ID NO: 19949 - DNA, 340 bp, Glycine max
  Peptide Sequence Number=SeqID_136727
ggctgttcatgtgtcctccattttcgagtttggagctgagtttcatgattgcctaagtgcggaccctcaagacaatcctccatactccacctttgttgggagcaccatgaatatcggttccttcgccaagtataagaaaaaagaagaagtagagacgagagtcgtcatcacggaaagggcagggcggacgaaatcagtgtcctatctttgctttcctcttatctccgatgagaggttgaagcaacatagctcgcttgggcgagctgagctcgcctgggcgagctacgtggccaccacaccccccggggctgttctaaggatcccggatgcccctggtgag

SEQ ID NO: 19950 - DNA, 603 bp, Glycine max
  Peptide Sequence Number=SeqID_136728
atggcagtgcgtggcgggatgcaccctggacgcatgtactcagactcgactccgccaaagcaagcaaagcaccagcgtccagcgactcaaatctctctctctctctcttcattatcttcacaatcgaagaattgcacctcttcgattccgaaccatcatcggagctccaacaacaatccaacggatccgccgcccgaccctcctcctacccctccagccccactagtagcggttacgccgccgaaaggggcagtagcagcaccgcctcaagcatctcccaggtcgatgacgtcctccaccacgaaattcaagagatcaccatccacgattcccaacctcaacctccctctcactcctcctggcttcccggaaaacgacacgccgatgaggtatggagacgaacacaagcttgctggtttttcagcaactttgcaagcaatcatttcctttgtggagaatgggggtgaccatgtcaaattagtgagggctggaaagcatcaggtggtttttcttgtaaaaggaccaatttacttggtctgcatcagctgcacagaagagccttatgagtcactaagggggcagttggagcttatttatggccag

SEQ ID NO: 19951 - DNA, 396 bp, Glycine max
  Peptide Sequence Number=SeqID_136729
atgccctgggatgagaggagagtgagtttgagggttacgagaaggattggagcgggttcgagaaaagagaacagaggtggtcccgttgagatgttggaggaagaggacacttatcttcaattgtacaatcttatacctgtacaatttccaaatctcttccgttctggtgtgattcatcggggtgttgcaacaatcagcttcaccccactcatcctcacccattcaaacttcaatgccaccaccttgcagtacctacaaccttcacccatatcaccgcacgacccatcacccactataaccaccattgtgcgtgtcaccatcgccaacaacacccttcctcacacatgtttgtcgaagctcatcaaaggaaacaatccatttctatcgcttcgatag

SEQ ID NO: 19952 - DNA, 279 bp, Glycine max
  Peptide Sequence Number=SeqID_136730
atggttttgagagtgaagtataataaccaaatttggcttcagctaagaagggacgagaaagagaaaggagatggtgcgatggtgattcaagtcaggcggatgtggatatacctactaggcttggtatacgtaagttcccaagcaatttggacaaacaacttcattattcactggaagatgaaggaaggaaattataagcagagaaatagcaagcgaagcagaatatcaggaatccctgaaggcatgcatgatcagttagtcaacgaaaaaaacttgtga

SEQ ID NO: 19953 - DNA, 300 bp, Glycine max
  Peptide Sequence Number=SeqID_136731
atgactgtgatggtggtggcaatagacacgatggcgacgatgactgcaatggtgaggatccccatgaatctgatacctagcattcgagggctaggaaacctcccactgcgcgtgccctacgaggagattgaaactcggggagaagaaggaacgcaggttcagagaagagagggagagaaggagtttgagagaaagaaacttctggaattcttattatgtcctttgcaagttagttacagcttttatagtggaggacccatgcttaaccatttacggttagctgttattgctaagccctaa

SEQ ID NO: 19954 - DNA, 165 bp, Glycine max
  Peptide Sequence Number=SeqID_136732
atgagtgaattgaaatgcgtggatcatatgccttcaatgagcatgcagtcattagaagagaaagaacatggaattaggatcatgactggaaatgttagttgccacttagctaaaaagcttaccttgtgcatgattgatttatcccttgcacccattttgagctga

SEQ ID NO: 19955 - DNA, 370 bp, Glycine max
  Peptide Sequence Number=SeqID_136733
atgtccaaggaacaaccacttcctctggagtcaggaccataccattataaaaagccagttcaacccacccacaacacaaagtcaaggagacaaaacaaactaaacatgaatcccattggtttctctcttctctccctggtttctctagcacttgtctcaattgtcacagcccaagaaagagcccctcatgggcttgtttacgagaaccctgaagccttttcaccatcagcatataacttcttgcacccgaatgaacgaaagcccgagaccaaagacccttgtgctgcatccaaatgctcaccaatgcctttagcagcacaagtggaagctactgaaattcatgaaagcaaagcctcaacacctcaaggaa

SEQ ID NO: 19956 - DNA, 183 bp, Glycine max
  Peptide Sequence Number=SeqID_136734
ggcactgtgcactgaccttccagggtctttggcactagcttttggccacgatcatacgtcgtatggagtgtatgtcatgggggtagagtgcattgaccttgtcagatggcccagacgtggggaacacctttgggctcctaggctgatcacctatgggaggggggctgttacgtgcacacccgg

SEQ ID NO: 19957 - DNA, 1734 bp, Glycine max
  Peptide Sequence Number=SeqID_136735
atgagcaatttaaggcctgaatctcacgtagcacaacaaattaggcgtgaaaaactgagaatccagaacagttatcagccttcacacgaattccctaacaatcttgaacagttatctttacacccggggtttaacaacttggaccttgttcaagttaggaatgttagaaatgctaacatgcttgatgaactagctgtttattcatcagaaatgccaaacttttctacctcttcgtctgctgcaaggaacgcgttggagtatcaccaagaacaaggtgctgcagctgaacccagtaataggctgctgctgatgaatcagtatggttcatttccccattccatgtctgcaattcattcttcccataaacaacagtgtgagcttcgtaatttgggaaattggaggaacagtaccccccatcaaggatctgattggtttgtaaactatgcaagcaatgccaattcttttttgtctgctgagctcaacaacaatgtgtctgcttacaatgaacttatggatgtacattgtagcaatgcatctggtgaaatcagtggtagagaaatgcataagcaaggtgtactgcatcataattctcctccttcatctccactttatcaaaatgctttgcaagatattgtgaagtctgcttctttcagtgctcacactaggcaagacatggcttcactgatgcaacaaaatgaacatagcatttgggtggggaatgctagtgaagctgagcttcaacaaccaagttatgaaagccagccaaatcatgagttgcgttttgggtggacaaatcgaacaattgcttgtgattcacttcctcagagcttgtccttgtcactttcatcaaatgcacaacctaagccttcagtttctcacctagaacaagggtctgcgtctgatgatcctcagtgtttgaagcatatgaaatctattgtttctagagattgtgggaaatcagttcaagatcaggtggaaataccttcaaagagtactactactattacttatcgaagtgtgggtccccttggccctttcactgggtatgctactattctcaagagttcaaggttcttaaagtctgctcaacaattgttggatgagatttgctgtctatctgatgcaaaatttggaaaatcatacgatgtttcaaagagggtttctccagaagttagtgcttctacttctgctgatactgtcactggggttgctgcaaaaggtagtaattcaggttcttcatcaaccacgttgtataatgtttcaaaggaaaatagggccgatccgggagttggaagtagctttggtctttcctcgcggtcagattatcaacataagaaagcaaagctactgtacatgcaagaggagtctgtagcgggtcttggttctgctactccttacatccccatggctctcaagtcagtatcaaaacacttcagcaccagtacttgtagtaataaagctgacactactactatggcaagggtaagatgcggtagtagcatggaccaaagcttctttctgaagaacaaatgtgtaaagggtaccacggaacttcttgatgaacccccccaacagcatgtgtggaggccccagagagggttgccagagcgtgctgtggcaattcttaaagcctggttatttgagcattttcttcatccttaccctacagacactgataaacacatgctggctagtcaaacaggtctttcacgaaaccagggtgttcatagctag

SEQ ID NO: 19958 - DNA, 561 bp, Glycine max
  Peptide Sequence Number=SeqID_136736
atgagtctcaagtgttggctaagggttgcagatgactgcttccctgcatcaaattttgccagctcttggagtatgggctcaattcaaagtggtgaacttgctgctttgcaggttgatgttagaaaatatttggcacggaagccaggctggactagattgactgatgatggagtgcagacacgcgctcacttggaagctcagttggcctctgctttggctttggaatcctccaaagaatatcggcaatgcctattgtcctatgtacactttcttgctaggcttgttcatggttcggttcatcacagaaaactgaatctaactgaactagaaaacagttctctacaggagaagcagatgaatctcgattacgagaactctgagagtttccttggacctccaacggggatggctggagaagcatcttcagattcaaagagtgcatgggatccttttgtgcttctagcaatggtggaattgcacaccattatagctgaaacttttcctactcttggagtatgtttggatgagggtgataaggggaatggaaagggaaaagaatga

SEQ ID NO: 19959 - DNA, 1428 bp, Glycine max
  Peptide Sequence Number=SeqID_136737
atgggggctaaggctgcccctactcatactgattcaacttctatactccaacaaatcaacctacaaattatacggcatttattaactgcagctgaggctttgttcactttcaagggttctcttggaggtccacagcaattaggatgcagcattgtgaaatatccatgtcaaatgcaatggccttgtcttgactgctataaactaaaagatccaggtggaataacagcaaagatagatgggaataacgacgttccaacacttacacctcttcaagaaactcaagttagaaaaccaggaggaacaagggctgctgccatattcggtattgttgttgctgccttagtcgtcattgtcattttggtgactgtctatatctgcttgatgcgtgttaaaagatttatgaggcaaacatctgaggttgcttcttctatgccatctcccactgttgagataggaagagtcaacaacgcacatgttaatgctttctctccacattatacgcataacacaagacagttaacaattttggaagtagaacaagcaacacgaaatttcagtcatagtaatattattggtgaaggtggatttggttttgtatacaagggcttacttcaagatggatccatagtggctataaaaaggcgtctatttgttctgacacaggattttgtccttaaggtgaaacagatagctcatattcaccacaatcatcttgtgaagctcataggctattacgaagatagctatcaacaattacttgtatatgaatatctccctaacggcaatgtagggagtcacctatatgacagtgaaggtttacctattggaaggttggatttgtggcgaaggatatctattgcttcaggcgcgtccaaaggtgtggaacatcttcatagtttggtccctcctttgattcacacaaattttagaactagcaatgttctgttagatgaaaattacacggccaaggtttctgattatggattctgcaattcgaaaacacaagttgataatgttggctcatcttcaaatgtagactgttttctagacccagagctgagctttccacaaaactatacggagaagagtgatgtatacagtttcggggtcttcttactagagttgatttgtggttgtgaagcacaaaacaaaagcatgtcaaacccagatgaaaatatagtgtttcaggcaaaaaatagcgttgacttggacaagtttgttgacataacgctgggggagcaagaaaagcatggtgctagaagagtgatgaaattggcattgctctgtgtggatgtgactagtagaaggccatcaatggctcaaattgtgcatgagctggagcagattcaaagagaaattgctccaatgtattctcaattcaacgaggagattggtgccgtgactctagggagtgagctctttcagtaa

SEQ ID NO: 19960 - DNA, 192 bp, Glycine max
  Peptide Sequence Number=SeqID_136738
atgacagagcagagaattcagcatcgtggcggcgatcgtgatggtgtacaagaagcggaagcagaatatacggcgctctcattatgcatacgccgtaaggagagaatttctctaaacacgtacatgtacacactcttccggagattctttcttcttgctcttcgtctgtcaccattaccacattacttgtaa

SEQ ID NO: 19961 - DNA, 236 bp, Glycine max
  Peptide Sequence Number=SeqID_136739
atgtatgacattataatgtttggagaagttgatatgaatgaacaaaatgaagatgaagctggtgtgaatgaagaacatattgattgttctaattggactcaatctgttgcttatgaaattgaatttgtggcggtgattatgaggtcagacataaacgctgagatactggcaataggaaatgtaggtgtccttttaagcttcatgggaaaccagtggttagaggccaatgatggatg

SEQ ID NO: 19962 - DNA, 312 bp, Glycine max
  Peptide Sequence Number=SeqID_136740
atggtgaagttaaggatgaactctcacacactgagtatgaagattgtcaagcacacatatacaaggtttagggttcagagtgagacagacacatacacaatcaagattagagagacggaggcggagacaattttgaacaatgatttttgtagagtagtttttgatgattgtcttgtgatgttattgtattgtgtggggttgttcaaatacaaggaaggtgtggttgttgattgcatagtatgttcgctagagttgacgtgtgagagtttatccttgccttggccgttagtaacgcacgggcaaaaagtttga

SEQ ID NO: 19963 - DNA, 900 bp, Glycine max
  Peptide Sequence Number=SeqID_136741
atgaatcagggctttcaggcattaccgtcgctgaatgcgctacgggtatttgaagccgtgacgcggcaccttaattttcgcctcgccgctgaagagctcggtgtgacgcagggtgcggttgcgcagcatattcgcggcctggaggccagcctgggcttgaaactgttcgatcggctgccgcgtacgctggcgctgaccgctgctggtgcaggctatgcggtgcacattcgtcaggcatttgagctgattgatgaggcgacgcgcacgctgcgcccggagccggatcgcctgacgctgagcgtaacaccgacctttgccagccgctggatgctgccgcgtttaccggcatttaccgcggcctggccggacatcgacatgcgcgtgctggcctctgaacggctggtgcagtttcaccatgaaggcgtcgacctggcggtgcgctatggccggccgccgtttggtagcgggctggaggccatgctgctgtttagccagacggtgctggcggtggtcagcccggcgctgctggcacaacacggtgatgcagcgcagccagaaaattgcctgcgctatccgctgctgcacgatggccatcacctgtggccagcgttcctggcgtttatgttccccggccagtcgctgcagcatcagcatcatctgcgcttcaaccagaccgcgctggcgctggaagcggcgctgagtggtcagggtatcgctctgaccagcccgcattttgtgcagaacgatctggccagcggtcggctggttcccgcctggcatcgtgagatgcccgttgatgccggctggtatctggtggctccgcgtcgtccgcgtgagcaggcaacggtgagtgcggttcgtgcgtggctactcagtcaggcggagcagagcaaagattga

SEQ ID NO: 19964 - DNA, 705 bp, Glycine max
  Peptide Sequence Number=SeqID_136742
atgacagtagaaaaagttgcggtgattgtcgcaggtggcagcggtatgggcgcagcggcagcggagaagctggccagcgagggtttcagggttgcgattctttcctcctccggcaaaggcgaggcgctggcaaatcgtctgggcgggctcggcattaccggttcgaatcagtcagtagacgatttgcagcacctgattgatgccactctggcgcgctggggacgtatcgacgtgctggttaacagtgccggtcacggtccgcgcgcgccgatcctcgaattaagcgatgacgcgtggcagcagggaatggaaacctacttcctcaacgtggtgcgcgctgtacgtctggtcacgccgatcatgcagcagcagggtggcggcagtatcattaatatctcatcggcatggacgtttgaacccaccgacatgttcccgacctcggccgtgttccgtgccggtctggcttctttcagtaaaatctttgccgacacctacgcagctgagaatattcgtatcaataacgtcctgccaggctggattgatagcctgccgaaaacggatgaacggcgcgacagcgtgcccatgcagcgctatggcacggctgcagaagtggcggctaccattgcgtttcttgcttcgcccggcgcggcttatatcaccgggcaaaatattcgcgtggacggcggcgtcacgcgcagcgtgtaa

SEQ ID NO: 19965 - DNA, 1188 bp, Glycine max
  Peptide Sequence Number=SeqID_136743
atgaccgatcataaaattcttttagccagggatatcagcgccagaagtgaaagcatgcaggcgcacctcatcgccatccgtcgcgatattcacgcacatccggaactcggtttcgacaccgtccgcaccgcagccatcgtggaaaaggaattgttgcgcctcgggctgacgccgcaaaccggcgtgggccgcaccggcgtgatggtggacattaccggcgcgcagccgggcaaaaccgtgctgctgcgcgccgatatggatgcgctgccgattcatgagcaaaccggcctgccgtttagcagcatctggccgggtaaaatgcacgcctgcggccacgatatccacacggctacgctgctcggcgtcacggcgatcctcgcggacctgcgcagccagctgcacggcacggtgcggctgatttttcagccggccgaagagacgccagagagcggcgcgcaagccatgattgctgccggcgcagcggacggcattgatgtggcgatcacgctgcacaataaaccagagctggccgcaggagaaatcgccctgacgcgcggtgccagcaccgcctccagcgatgaattcgacgtagtgattcacggcaaatccacccacgcggcccggccgcacatgggtaccgatccgatcattgccgccgccagcctggtaacgcagttgcagaccattgtgtcgcgcgagctcgatccggcgaactctgctgtgctgacgattggccatatccacggcggcaccacccataacatcatctccgacagctgcctgattcagggcacgatccgcgctaaatcaccgcaggcgcgcgctcacatggaagacgctttccgtcgcatctgtgccggtgtcgcactgtcgctcaatacgcggattgaggtcaattatcagcgaggcgtaccgccgctgatgaatgatgatgcgctgattgatgcactggagccgatcctctcgcaccagttcggcaagccggtggtggcaaaacccagcagcagctttggcgcggaagatttctcgctgtttactgagcgtgtgccgggctgtcaaatccatatcggctctggcgcgccggggcgcgacgaccatctgcacaactccgactatcagccggacgaacgcagcattcacgctggcacacaggctctggcccgtatagcgatcgacttactctcctga

SEQ ID NO: 19966 - DNA, 708 bp, Glycine max
  Peptide Sequence Number=SeqID_136744
atggctcattccaatgcgaaagtgattattctgaccggtgccagcagcggcatcggcgaagcaatagcgcgtctgctggccagtcaggggcataaactggtgctcggcgcgcgccgtaccgatcggctggcaatactgtgtgatgagctgcgtgccagcggcgcgcaactggattatctggccaccgacgtgacgcagcgtgccgatacgcagcaactggccgattttgcccgcgataaatatggccgggttgatgtgatgatcaacaatgccggcgtcatgccgctgtcgccgctcagttcgctgaaggtagatgaatgggatcgtatgctcgatgtcaacgtgcgtggcgtactgtacggcatcgctgccgtgctgccggtcatggagtcgcagcaaagcggccatatcatcaatatcgcctcgattggtgcgctggcggtatcgccgacggcagcggtgtactgcgccacaaaattcgccgttcgcgccatttcggatggcctgcgtcaggaatcgcgccagctgcgtgtgacggtcattaatcccggcgtggtggaatcggaactggcggacaccatcactgacgagaccgcacgcgtggccatgcagagctatcgtcagattgcgttaaaacccgaagccattgcgcaggcggtgagctgggccattaatcagcctggcgaagttgatgtcaatgagatcacg

SEQ ID NO: 19967 - DNA, 957 bp, Glycine max
  Peptide Sequence Number=SeqID_136745
atggtttcctcgtgttggttgacgaggctattgtggaaaacgccggctaaagcgaacagaccggattgtggcgcatcattgcctgattctctcgtcactgttcagacctgcgcgctgctgcgccagctggcaccgcaggaaggttacaccgcttcactgctcgacggcgtgcgctttatgcgtgccgaccggcagtgggcgcgtacgccggttctttatgagccgagcatcatcattatctgtcagggctcgaagcgggcgtttcttgccgacaaaatgtatcgctacgacgcacagcactatctggtgttgtcggtgccgctgccgttctccgctgaaactgaagcgacctcggctgaaccgttgctgggactggctatccgtctggatgcggccacgctggcgcgcctggtgacgcaggtcgcagcggcagacattccgctggcggagacaccagccagcattatttcgacgccggtaaatgagacgctggcggacagcacgctgagcctgttgcaggcgctgagcgatccgctggaagcgcagggcggtgcggtgcgcgcagcgctgacctatcaggggcattttggccgcatcgcgcgggcgttgcagcgcattcatgctgactggcagcagccgctggatgtgccgcatctggccagcgaagcgggcatgagcgttccgcgcttccatctgcatttcaaaagcgtgacacagacctcgccgattcagtatctaaagtcgctgcggctgcatcaggcgcgtttgatgatgattcgcgataatctcactgccgccggtgccgccgcacgcgtcggttacgaaagtgattcacagtttaaccgggagtttaagcggatgtttggtcgcaccccggctgacgaggcgcgggtgatgaaacgcgcatttgcgctgctgccgccggaacagttatccgcgcggctgcaggcacattag

SEQ ID NO: 19968 - DNA, 1960 bp, Glycine max
  Peptide Sequence Number=SeqID_136746
ccgggttactttatgggcacgtcatctgccgtttggcattgcggtgaaagacctgccgaagctggcgcagcgtcgggcggcttactgggtttgcggactgggtatttttgccatctggccgctcacggtgattgccggtgcggtgattggacgctttattcccgatgtgtcggcgattggcctggatgcggtgtttccggccatcctgatcgcgctgattttcccggcgctgcgccagcgtcgcacgcgcattccggccaccctcggggcactgctgtccgtgctggcgacgccttttgtgcctgccggtatgccgggacgtatgcgattcgctttgccggttaccggctgggcagccggatgcacatgtcggaacgtatgcgcaacatgctgtccgacgcggcaacggtgctgctgctggctgtcgctgtcaccaccgcgctgtttgagggcaccgatttcgccggcgtcgcgcgactgaccggcgtgttgttcgcggtgtttctcgcctggcgtcgcgcgccattgatactggtaatcatcggtgcggcgtccgcagttagctcaacaggagtaaagatgacgccgcgactagcccacattgatgaaacaccggcgctatggcgaatccgtaatctggccattcggcatggctgtcgtgaggtttactccgctgagatcattgccgcatggacgccggacgaattaccgcatgcttactacgatgccgtaaaaaataatcctttttatgtgattgatgatgcaaagcacggtgtggctgcgaccggctttctcgatctgcaaagcggcagcgttgaagcgatttttactttgccagcctgccacggtaaaggctatgccagtgcgattatgcacgccattattgctgaagcacgccgtcgcgcgttcagccacctgacgctggctgcgacaccgaatgccagtggctttgcagctatgattagggatagtgagtacaacaaggacaacgcgaaaatggtgattaattgcgtggtgtatcgccacggcaaacgcgaagagcatgtcgaaatcgatcaaatcagcgaagtgctgaaagaagaaaaatcattcgtctggcttggcctgtatcaacccgatccggcgttcatgcaaacgctgcaggaggagtttatcctgcatgagctggcgattgaggatgcgctggtggcgcatcagcggcccaagattgagcagtacggcgaatcggtatttatcgtggtgaaaaccgcacacatggaagatcgccagcgcatcagctttggcgaaacccactttttcctcggcaaaaattttctgattaccgtgcggcacggttcggttgagggctataaagcgattcgcgctaaagccgagaaaaaccatgccatgctgtgccagggacccggctatgcgctctactgcattctcgattttatcgtcgacaactacagtaagatcaccgaatcgctgagtgaacgtattgctgatctggaagacggcatgttcaccacccgctttgacagcgtcacgctggaaaatgtttaccatttgcggcgtcagctgctgtcgttgcgcaatgcggcgatgccggtgacagagatctgcccgcagctggtgcgcttccatgaagatatcatcccgaaaaatctgcgcgcctatctgcgcgacgtgcaggatcacgcgcaccacgtcatgattgatgccgaagacatgcgcgaaacgctggccagcgccatgcaggtgaatctggcgctggtctcggtacagcagagtgaggtgaataaaaagctggccggctggggggcaatcctgattgtgccgaccatcatcttcagtatgtacggtatgaacttctctgacatgccagagctgcacagccactttggctatccggcggcgctggcggtcacgctggtgatctgtctcgttatgtggtggcggctgtccaagcgggctggct

SEQ ID NO: 19969 - DNA, 908 bp, Glycine max
  Peptide Sequence Number=SeqID_136747
atgacgctttcacgctgggtgggtctggtactgctggcggtgctgctggcttacgcgtttgtgctgccgctgattcagcacggcgatccgctacagcaggatttgctgcagatgctgcagacgcccaaccgcagccatttgctcggtttcgaccatctcggtcgcgatatgttaacgcgcctcagcgccgcgctgcgcctgtcactcgggctggcagccctgtgcgtgatcagtgcgctgatagcgggcgtgttcaccggtgtgctcagtgcactgtacggtggctggcctgagcgattgctgagcatcgttggcgatatgtgcctcgcgctgccgggattgctgctggtactgctactggccgccattgcgccagacgcgccccagatgctgtggctgggcatttcgctggtgctgtgggtggaatttttccgcgtcacgcgtgccacgctgcggccaattgtgcaggcgcccgctgggcctgatgatgaccgaactgctgccgtttgcgtgggaagcgccgtggctgctgatgcagccggtagccgcactgtttttactgttgatcagcctcaatctgctgatgaaaaaggagcgatgatgaagggattacagatcaccgggctgagcgttgccacagcgactgaaacactggttgagccggtggatgtgcggctacaacccggtcagccgctgacgctgctcggcgaaaccggatcggggaaaagtctgctggcgcaagcgatcatggggatattgccgccatcgctgcaggccagcggatacagtgcagctgcgtcggctgtggggcaatacgctggcttcgctgccgcaggagccgtggctgtcgctcgatccgaccatggcgattcagcaacaggtggcggaagggcatcgcttcgtgcgcg

SEQ ID NO: 19970 - DNA, 1167 bp, Glycine max
  Peptide Sequence Number=SeqID_136748
atgcatcgtcaaatcgatcaactggcttatgcgcataccagtttcttcaccagcgataccgttgaacagctcgccgaacagttaacgcgcaccgcaccgggcgatcttaactatgcctattttgtgtcgggcggttcggaggcggtggaaaccgcgctgaaactggcccggcaatactttgttgagatcggacagcctgcgcgcacccgtttcatcgcccgcaaacagagctaccacggcaatacgctgggcgcgctggcggtgggtggcaacgaatggcgccggcgtcagttcgcgcccctgttaatcgacgtgattcgtgtttccgcctgcaatgagtatcgcgatcgccgtgccgatgaaacccagcagcagtatacccagcggctgttgagcgagctggagcaggcgattatcgatgcgggcccggaaacgattattggcttctgcgcggagacggtggtcggtgcgaccagcggtgccacgccaccgacgccgggctatctgcagggtgtacgtcgcctgtgcgaccagtacggcattttgtttatcgccgatgaggtgatgtgcggaatggggcgtaccggcacactgcacgcgttcgaacaggatggcgtggtacctgatttggttaccatcgccaaaggactgggtggcggttatcaacccatcggcgcggtgctggccagtgagaagatcgtgtctgcgctgcaggccggcagcggtctgttccagcatggacacacttatatttgtcatgcgacagccgctgcggcggcgttagcagtacagcaggtgattgagcgcgaccatctgctggaggcggttcagcagcagggcgcttatctgcacaaggcgcttcgcgacgtgctgggggagttaccgcacgtgggtgatacgcgcggccgcggcctgtttgccggtgtggagctggtgcgtgataaagccacaaaaaccccgttcgatccggcgatgaaacttcacgcagccatcaaggccaactgtatggcgcgcggtttgctggtctatccgatgggcggcacgctggacgggcaatatggcgaccatattttaattgccccaccgtttatcgtcaccccgcaacaactggattttgtcgtggatacgctgaacaccgtgatacgtgaagagaccggcaaattatga

SEQ ID NO: 19971 - DNA, 576 bp, Glycine max
  Peptide Sequence Number=SeqID_136749
atgtgccacccaaatatactgaaaagatatgaggccagtgtaaggttcaatattgccactgagctgacagatcgttgcaaaacagaaggggaactggggctgattggaatattagtttggatgaggttcatggcttgcagccatctcacatggaataagaattttactatagttaaagggttgggagagactctggttggggcatatccaggacgtgcaacgaccttcattatgaaaaaaacaaacctaaaatatccagtggttaccagttacccaagcaagctaatgcggttgtacagtaagaagtccattatattcagatcagactccaatgctgaggaccttgaagggtttgctggtgctggtctttttgacagtgtaattatggataaggttgagaaagttgtgctagactactccaaggatccaataattgctgataaaccatttcaaacctcactcttctcaagaattgcaaaggcaggaaaaatcttagaggacctttatggttgccctcaggacattgaaggagtggttaaagatgggacaatatttgtagttcaggcaagaccataa

SEQ ID NO: 19972 - DNA, 1881 bp, Glycine max
  Peptide Sequence Number=SeqID_136750
atgatgctcggtgtagcagcattccatcaaaatttatggttctttcccccttttgttaggagtggaggtattaaggtccagggactgaagagagagcttgtaattgctcaaatatctagaaaggcagcatctgcgtcattaaggacggctcttcaaaaagctgcgcaactacggctaacagaaaaggagaagaacaaaagtccttcctatgctatgcgcatatctttgcaaattaacagagttgcttggagtatgcttgttgatggtaaatcctttgctgaagctgagattaatgacatgatatatgactttgaccgggattacaaggatgtcggcattgctcggtttacaacaaaatattttgttgtcagaaactgcctgcctaatgtcaagtcagatatgcttttgtcagcatggaatcctccatccgaatggggaaagtatttttacatgactacaagcacaataagtcagaagtgctcctcctgttttcatcaccagaaggttgtaaaatacagcttcctccctcctcacccattactttctattaggccctggtccttgtctcagatgcagtttggctctgctagtttccagtcccagatcttgcagtctttaaccagaaaagtgatgcttcgagtggatgcacgacaaggagctccaaaggatgggaattctccccttgaactttttgagatagagatttatccccttaagatccatttaacagagacgatgtacagaatgatgtgggaatatttcttcccagaagaagaacaagattcccaacgtcgtcaggaggtttggaaggtttcaaccactgctggtgcaaggcgtgtaaagaaaggttcatcagttcttgaagcttctgcttcaaacagtcacacaacaaaagagtctgaggcttcatccaaatctggcatatctgcaatgctatttcccacatcaagtcagcctccagcccatgttgactcagctcaagcatccaaaacacaaaatgtcaaagcaaaccctggcaatggtgcaacccccgagttgagaaggacatcatcttttgacagaacttgggaagagactgtggcagaatctgtagctaatgaacttgtgctacaaagcttttcttcctcaaaaaatggccaatttggttctactgagcaacaagatgaagctgctaagaataaatcaaaagattcaaaaggtgtgaaaggtggtcgctcatctcatgaagaaaaaaaggtggctaaatcacatgaagagaagagatctaggccacggaagatgatggagtttcacaacatcaaaattagtcaggttgagttattggttacatatgaagggcagagatttgttgtaaatgatctcaaattactgatggatcaatttcatcgaaccgagtttactggaacttggcgaagactcttctcgcgagttaagaagcacatcatctggggagtcctaaagtctgtaactggaatgcagggtcggaaatttaatagacccactggtgctggtgttcctgaaattgatcttattttaagtgacaatgaaggccaggcaggaaaatctgatcaatatccaccatcttggcctaagcgtccaagtgatggtgcaggtgatggatttgtaacatccattagaggactgttcagtactcaacgccgcaaggcaaaggcatttgtgctccgaactatgaggggagaagcagagaatgattttcaaggtgattggagtgaaagtgatatggatttctctccttttgctcggcagctcacgattacaagagctaaaaagcttattaggaggcacactaagaagttccgttccagaggacagaaaggtttatttgtcactttcatgctattgcttttattgtttttctag

SEQ ID NO: 19973 - DNA, 1155 bp, Glycine max
  Peptide Sequence Number=SeqID_136751
atgaaacggagaaagcgcagccacagcgagggcagaaacgaagaagacagactgagcgacttacccgaatgcgttctcctccacatactaacattcctgaacgccaaacacgccgtaagaacctgcgtgttgtcgactcgatggaaggacctctggaagcgtcttccaaccctaattctgcactcctccgacttctggactttcaagggtttcaccaaattcgtctcgcgcctcctctccctccgcgacgcctcgctcgcactcctcaaactcgatttcgagcgccacggctgcatcgagccgcagctcctcaaacggatcgtcaaatacgccgtttcccacaacgtccgccagttaggaatctccgtcaagtgcgacatccgcgacgttccccagtgcgttttctcgtgccagactttgacctctctcaagctctccgtttgccctagaggttacatctacggcagcacgctgtttccgaaatcgctgaatctcacggccttaaccaccttgcatcttcagcacttcaccttctgtaaaggcgatgatgatgatgatgacatggctgaaccgttttatgcttgccgtaggttgtgtgatttgactattgactattgcactgtgaaggatgcgagaattctctgcatttcgagtgctacgcttgtgagtttgactatgcggtctgatcagtcgggggatttttacaaaattgtgctgtctacgccgaatctttgcgcttttgctttcaccggtgcaccttatcagcaactgcttgggagcaatctttcttcgctcgaaagagtgagtattgatgcggaaatctggtcgacttcgttggagtctcctttgattctgttgagttggctgttagagcttgccaatgtgaaatcattgacagtctctgcaagtactcttcaggttctcttcttaattccagagttgttgaagattaaactcccttgcttgggtaacttgaagtctttgaaagtggaactgaaaccactctcacctatattttccatgagactgaaagctgccaagtcgtggaaagcagcattgaaaccatctccaccgcctatgcctgatgggatagtggattttttgcttcaaaactcgccatcagcaaaagttgacatgatagatttcgcaagatga

SEQ ID NO: 19974 - DNA, 396 bp, Glycine max
  Peptide Sequence Number=SeqID_136752
atgcatattccttatttgatttttaaatgtaggatgcatcgtaataagggtcaatttacttcatcaaagaatcaggatggaactaatagttggggttcagatcaagagtcagggcaggatgctgttcaatctgaaaccttgtgcacacattgtggaataagttcaaaatccactccaatgatgcgtagggggccatctggtccaaggtcactttgcaatgcttgtgggcttttttgggcaaataggggcactttgagggatctttctaagagaaaccaggaacactctcttgcaccacctgagcaggttgatgagggcagtaataataatgactttgactgtcggagtggcatccctgcacaacataacaatcttgttaatgataacaaagcttaa

SEQ ID NO: 19975 - DNA, 522 bp, Glycine max
  Peptide Sequence Number=SeqID_136753
atggcaccgtctgggtcaagcaacaatgccatggcttctcctcgtgttcttcattttgatctaattgaaggaatgcagcttgcgggattagagaaaaagcacaatgcaaatagagtagagactagagagaaagaaaaaggaaagagaaagcaaaattatgatattgcattgagagagctcccaagtcacttaccaaaaggaataaccttgaccaagtcacggaatagctatctaactggaagaataaaacctgtgaatgataacagagatcaactcagaagtggtatgcactattcctaccttaggaaatacaatattgaagactggttgcaaaagcattctgaagggcatgccaaaggagccatatcaacagcagctcttatagagaattttatagggggaacagatgtactgtcaaagcaaatatatcatgttcataactatgagattatgaatgttgataaggggcaagaggtggagatattggtggctagcggtaacatgggctatttggaagtttag

SEQ ID NO: 19976 - DNA, 558 bp, Glycine max
  Peptide Sequence Number=SeqID_136754
atgactgaccacaatgcgctgttggcgcggttgaccaccacgctggcgacagagagtcgcacgccgctgtataaacgctttgccagtgcgattaaagatgcggtgcgcgatggcacgctggtgcacgaagagatcctgccgggcgagcgcgagtttagccagtcgctgaacatttcgcgcatcaccgtgcgtaaagccatggacgagctggaaaaagagggcgtcgtgttccgttcccgcggctacggcacgcagatttgcagccagtttgaatattcactcaaagagccaaaaggattgtcgcagcaggcggtgctgcgcggtaaaacgccggacaccgtgtggatcaacaaaagcaaaattgcctgtagcgcagagatcgccgaaaagctggggctaagcacgggcagcgatgtctatctgctgaaacgtattcgctatgttgaccgccaggcggtctcggttgaagagtcgtgggtgccggcgcgttacatcgccgatgccgatgagattggtatttcgctgtatgactattttcatcgccagcagatcctgccg

SEQ ID NO: 19977 - DNA, 1399 bp, Glycine max
  Peptide Sequence Number=SeqID_136755
ggaggcaataaatggagacaggatgcagatgaaggatatcgatgttggatttacccacgttgcgtttatggtgagggatctggagaagagcatggatttctaccgccgctatgcaggaatgaaggtgatacacacccgtgaacctgacgtcccggctgcccgcaaggcggatgacgtgtcagatacgccactgggtaaatttggacacttaggcattgcctgtgcgtcacgcgaagagatcgatcgtaaaacagcgatggccgtcgccgaaggcgtgttacgcaaagcccccgaagaggctggcgaaccgcgatacgcaccgcgcccggtttactttaactcgcctgcccgcaggcagcggagaacatatggcactgacgttgccgatttatactcaacgcctggtgttgcgcaagctgacaacgttgctcgttatcaaagctgggaagaatttacctggcatgacgctgagaaattatatgcgcagcaggatgcgctgccgttcaacagcaataacacctggtttcagcttgccgtagcacaccaggaagacgaccggctgataggggacatcggaattcatttttttgatgaaggaagacacgctgaactcggcatgacatttgatgccggatatcagaaacagggttttgcgcttgaagcaatgagtgccatcgttaccctgcttttcacgcagtttgcaaaacaccggcttacagccgtagtagacacacgaggcgttgtgacaattagcgaagtaagcaaggaagagtatcacttactgattcaggtctgggaggatgcggtcagggcaacgcatcatttcctgaatgaacaggatatcctgcggctcagacagcttattctggaaaattattttgatgctgttgttttaagaaaagtgagcgatgaaaaccatgacattgtcgggttcatcggcgtgcaggatgagaatatcgagatgcttttcgtctcgcccgctcatcacaaaaaaggggtcggtgcacggttagtccactacgcaatccgttatctttcagcgaaaaaagtggacgttaacgaacaaaataccgctgcgctcgggttttatcagcatctgggctttcaggtgactggacggtcttccgttgatgcattacgcattgctgctgtcatacctgcaggaaagcgcacgccgccgcttatacctccacagcgcgcgtgcggcgtgaggatttcagtctgcggatctcatctgatggctgaaagacctcatcagagccacgtgattctgcgtgtggccacgctggacgacgatcccgctcagacgccggtttcctatatctggtgctcgcacaccgtgccgtggctaacagaacgcgacgatgtgcctcagtatcagcaggataaagaaacatga

SEQ ID NO: 19978 - DNA, 1440 bp, Glycine max
  Peptide Sequence Number=SeqID_136756
atggaacttgaaagagccagatctgtctatcaggaatatatggaggaaaataggccagtaacaaatgtagcattgtttgatatgcaaaatgctaaatttgtacagcgttcaggtgggcttaaagacattgctgtctgttctcttttcagtgctactgacattactgtaaggtgggagcctgatgtacatctatcactagttgaacttgttctccagctgaagttacttgtacacaacagcaagcttcaggagcatggtaatgaacacatggtagatgtgtctcatgtgcaagatgctaattggaaaaaagaagttaccattgaatcagggcaccttgaaaagccgaagaagaaagaatctatttttgccgttgatgtagaaatgttaagtatttcggctgggctaggtgatggagttgatgctatggttcaggttcagtcaattttctctgagaatgctcggataggagtgctccttgaaggacttatgcttagttttaatggagctagaatcttcaagagtagtcggatgcaaatttcacgaattcctagtgtttctgcaagtacatctgatacaaaaggacatgcagttacaacatgggattgggttgtccaaggtcttgattttcacatttgcatgccatacagattgcaattgcgcgccattgatgatgtcattgaggatatgttgcgaggtttgaagctcataattgctgccaagacaagtttgatttttcctgtgaagaaagagagctctaaagttaagaaacctagtacagtacaatttggatgcataaaattttgcatacgcaagctaactgctgatattgaagaggaaccaatccagggatggcttgatgaacattatcagctgctgaagaaggaggctgctgagttagctgcacggttgaactttctagatgaatttatatcgaaggcgaagcaaggttccaaatcaactgacactgttagttcttctcaagaaagaaaattttcttttaataatgttgaggttgatgtaaaagattcttctactattgaatccatgagagaagatatttataaacgatcatttcgatcatattaccaggcatgccagaatctagtgttgtctgaagggtctggtgcttgtgtagaagattttcaagctggtttcagacctagtacttcaaggacatctcttctttcaatatctgcattagatttagatgtaagcttgaaaaaaattgatggcggagattttgggatgattgaggttctgaagaagcttgatcctgtctgtcttgaaaatgatataccattttcccgactgtatgggtcaaatattctcttaaatacaggttctcttgtagtccagcttcgggattactcatttcctcttttctctggaagttctggtaaatgtgaaggctgtcttgtattggctcagcagcaaagataa

SEQ ID NO: 19979 - DNA, 2646 bp, Glycine max
  Peptide Sequence Number=SeqID_136757
atgtatcaagatgtctatgttgggagatggagaaaggttcgcatgcttcgatcagctagtggtactactccaccattgaagacatactcggatttgccgatacattttcagaaaggcgaggtgtcatatggagtgggttatgaacccgcttttgctgatattagttatgctttcactgtagcacttcggagggctaatctaagtgttaggaatcctggtccacttattctgcctccaaaaaaggagcggagtttgccatggtgggatgacatgagaaattacatccatggaaaaatttccttactcttttctgaatcaaaatggaatgttttagcaagtacagatccttatgaaaaggttgacaaacttcaaattgtgaccaactctatggatcttcaccagtctgatggtcgtgttttagtttccgccaaagattttaagattttgttgagtagtttggagagtttggcaaacagacacggttttaaaattccaacaggtgtatcaggtgcattcctggaagctcctgtcttcactcttgaagttacaatggactgggattgtgaatctggagatcctatgaatcattatttatttgcacttccagttgagggcaaaccacgtgataaagtatttgatcccttcagatccacatcactttccctttggtggaatttctctcttagaccctttcctcctccatcacaaaagcagtcctcgtcttccattactagaagagatattgaaggagatgctactgcatttgatccttctcacatatcccataatgtttcacccgtgtccccaacatttaactttggagctcatgatctagcatggattctgaaattctggagcttgaactacattcctccgcataagctgcgcagcttctctcgttggccacgttttggtattccaagagttgccaggtcaggcaatctttcactggataaagtgatgactgaatttatgctccgccttgatgccacaccggcttgtataaagaatatgcctctagatgacgatgatccagccagaggactgaccttcgcaatgacaaaacttaaatatgaactgtgttacagtaggggcaagcaaaagtatacttttgaaagtaagcgtgacattcttgatcttgtttaccaaggtcttgatcttcatatgatcaaggctttcctaaataaaaaagaatgtgctagtgttgccaaagtagttaacatgatactgaaaagttcacaatctctatccatggacaaagtctcctgcaaaaagggttacatgaccgagaaaaattgtgatgatggatttctgttatcctctgattatttcaccatcagaagacaatctccaaaggctgatcctgctaggttactagcatggcaagaagcaggaagaagaactattgagatggcatatgtacggtctgagtatgataatgggagtgaaactgatgaccatatgcggtctgacccaagtgatgacgaaggttacaatgtggtagtagcagatgattgtcagagtgtgtttgtctatggtctcaagcttttgtggactattggaaacagagatgctgtttgggcttgggttggtggcctgtccaaagcctttgaacctcccaagccttctccttctcaacagtatgcacagagaaaattacttgaggaaaaaaaactccgtgatggagctgatttccatcaagacgatgtttctaagtgccctcccactggtaaaatttccaagtctccttctcttcaacagttaagtactcctggatcagtctcatcttcaccaaattcagttaaagtggacaacttgccatctgtcaaaaaagaaaacatggatggttctggtgggactcgacgtttgatggtgaatgttattgagccacagtttaatcttcactctgaggatgcaaatggtagatttttgcttgctgctgtaagtggccgagttttagcccggtcatttcattcaatccttcatgttggttatgagatgattgagcaagtacttgctactaaagatgtacaaattaacgaataccaacctgaaatgacatggaaaagaatggaattctctgttatgttggaggatgtgcaggctcatgttgcaccaacagatgttgatccaggagctggattgcagtggcttccaaaaattctcaaaagctctccaaaaatattgcgtacaggtgctcttcttgaaagagtttttatgccttgtgatatgtactttcggtatacaaggcacaaagggggcactccagaactgaaggtgaagcccttgaaggagctcaaattcaattgtgatgatataacggcaacaatgacatcacgccagtttcaggtcatgctggatgtattgaccaatcttttatttgcacgcctgccaaagcctcgaaaaagtagcttatcctttcctgttgaagatgatgaagatgttgaagaggaagcagatgaagtggtacctgatggtgtcgaagaggtggaacttgcaaaaatcaaccttgaaaaaagagagagggaacaaaggttgcttcttgatgatattcgaaaattgtctctttggtgtgacccttctatggatccacatcaagaaaaggaaagtgacttatggatgatatctggtgggagatctttgttg

SEQ ID NO: 19980 - DNA, 675 bp, Glycine max
  Peptide Sequence Number=SeqID_136758
gtcagcttcaatctaccaaagctggatgtgagttttgtgcatcgtgagcatggtctttctgttgaaaacaacatcatgggcatccaattgaaaagcaccaaatcacgatccactgaggatcttggggagagtacacgccttgatttccaactggagtttagtgaaattcatcttcttagagaagctggttcttccattttggagatattgaagttggatttgatctcttttgtatatatcccgatacagatgcttcctctgcatcagccaatatcacctgttagagctgaaaccgaagtcaagctaggaggtactcagtgcaacatcataatgagcaggttaaagccttggttgttcctccactcgtctaagaagaaaaaaatggtacttcaagaagaagcttctgttgttgcaagacctcaatcaaccgatggcaagactgtcatgtggacatgcaatgtctcagctcctgagatgacaatagtgcttttcaatatggctggttctccagtgtatcatcatgatgcggatgatacttgggtgaggtatagcgaagaagcatcgctttctattgggaaaaatccaaatctcacgttggttagagataatgtcaagatagagtatataagtggaggacaatcatcaccctatgagctagctttggaattgagttaa

SEQ ID NO: 19981 - DNA, 661 bp, Glycine max
  Peptide Sequence Number=SeqID_136759
atgacgaactacgattacattctttggtgtaatcaacttcagccggtcatcgaagttcatggtttatcgcattttctggttgctccgatcattccgccgtggtttcaaggttgctcacaatcatcacatctgtttgcaaacaacatttcaaatatggggactacagtacacactgaacttggagagttaaatctccacttggctgatgaatatcaagaatgcttgaaagaaagtgtttttggtgtggaatcaaattgtggctccattatgcacattgcaaaggttaatttggattggggaaaaaaggatgtggaattatctgaagaagatggtcctaggtgtagactaggtttatcaattgatgttactggcatgggtgtatatataactttcaagcttgtagaatcacttgtatcaacagccatatcttttcaagctctattgaaaagcctatctgcttcaaagaaaaaatcgactcatagtcaggggcgtttaacaaaatcttctgggaaagggactcattttttgaaattcaatcttgaaaggtgttcagtacatgtatggggtgagacaggtttggaaaatacaattgttccagaccccaagcgagttaattacggctcacaggggggtagagttatgctaaatgtgtcagcagatg

SEQ ID NO: 19982 - DNA, 744 bp, Glycine max
  Peptide Sequence Number=SeqID_136760
ggtgccattgaatctgtttctgttggtgaaattaaactcagcttacgacagtccctggttaaacttggtgtgggtttcatatctcgggatcccaagctacaagtgttaatatgcgacctagaagttgttatgaggccttcaaataaaagcccagggaagaagaaaactaggaaatctcgtgcttcaggcaggggaaagtggatgattgtgggcaatattgcaagatatttgtcagtttgtgtgactgatctggttctgaagacaccaaaatttactgttgagatcaaggaattgaatgtggatatatctaaagatggaggatccaattcttctggccaggcatccattactgctttagaaaggtcttcagctccttttatctgcgaaatgttctctgtctcatttgttgttatgctggttgaagaagaggaagtagatgtgtctcagatgatctataagctgtctggcatgaacccttatagttggaacacaatggaagctgggcatggggaggctaccaacccagtgcttctgaaagtgcaagaagctatccaaaataacacccctatgcccctatctgattgggcaagcatccctgttggttccaccaaccttgaggaactcatacagaccttcgagtgcaaattccttactgccattgatggcggtaacattgctcaacaatggcaatgcccgactagtgaaacagccaaccagcataatgcggttttgtctcctgtttga

SEQ ID NO: 19983 - DNA, 273 bp, Glycine max
  Peptide Sequence Number=SeqID_136761
atggaggcgtttggttcgcttgcgggaaacgtcaaggaggagaaggtgcatgagaatgagaacgttgatgtgttcgcgcccgcttgttgggccgcgtccaatcacacatgtctggcggcccaactgtgtccagcgacaatggacacactcgacaccgcgttgcacgcgagttgggtccacatccgtgtccagcgcgagtccgacatgggacacgccgttgaagtgccgtgtccatgcttcttagcatatgaatggccaacaacacccaaatag

SEQ ID NO: 19984 - DNA, 1590 bp, Glycine max
  Peptide Sequence Number=SeqID_136762
atgaacacgagccacaatgtaatcgagagcagcaagaatccgaagaggaagttgacaggagaagccgccatatccgagaggggaaagccactcgaacacgaacacggttctgtcgcgagactccatcgcagagaatgcgacaagaatcacggagaaaaaggaagaaccctagaaaaaggaaaaaaggtagcgatgaatgtacttgaagaagaaaaagaagaagggtttggtgagaaagtgggggatgtcatcgggtgcaacgcgggtgcaggagaggcttgcgtggggaaacgtgcgcccagagtcactgtttgcgcaacaatttataacagcgagcctattacgtggctccgtagtaaaaccaaagggagattttttcaacgatacatggcggcgccgcacacaccggcacggcctccctccctcgcgagtctcaccgccatcgttaatcacggttgtcgtcggagctctcgtagttgctcctcacagtcccaggagccaggtcctgggctgaaatcacagtttgtcggcggttttggagcgtttgaggggtcggatccaagagaagatggaggagatgcggctgcgagtgcggggaggggtggcactcgcagtattggtggtggtggtggtggaccagggagggcagaagcgcctaagcttgcggcgttgttgaaagaaatgaaggaaggacttgatactgtaaggcgtaaaattcaatctttaactgccacggctaagggattatcaatagaagatcatcctgttgttcgaagtgttgtagagataagattgtttttggaaaagattcggccaattgacaagaaacaacaataccagatccagaaactaatacaagctagtgaaaatgcaaccagaagtgatattcaaaacaaggagccagttgcatccaataagagcgaggacgtgtcaaagtatcgtcccaatcctgacatgcttgttagcaaagtagacctaaccttgcaggatggcaatgagtattatcaacctgtaaaatttgcgcctacttctatggatctagagagatcttcaaagtatgaaagaaatgccttgcgaagagaaaaagaaattctgaaacaagctaagcagagtgattatattaggacattgatgaatgatatggaggaaaaacctgaagagataagagattttgagggagctagcagagaagttgatagatatattgccaagatggacgaacgtgctcggcaagaggaggagctgttcacgcgtgttcctcttacgaaacaggagaggaaacgagaaaagtacttgaagaaatcaagaaatgggttgcaaggtctaacagaaagtttctatgatgaaatcaaaacattaccctttggtgataaaactggagagcaaggaactaacaattttgacttctttgcagaggaaacattaaaggaagaaaaattgggttttgagctaaagggcggaaatgcatgctatctgcagaacagaccactgcatgctgttggaggaagtaatactagattcaacggaaaggaatgtaaaacctatagagttggtattggtgcattcctccgtgttgattgcagattttag

SEQ ID NO: 19985 - DNA, 852 bp, Glycine max
  Peptide Sequence Number=SeqID_136763
atgtttttctcttcaagactaccatttcatttagcaaggaatccttattatagggaggcattttcttatgctaccaatacttctaatctcagtggacataagcctccaagttacaataagttgagaactaccttgcttacaacagagagaagccatgtggagaacctcatgcaaccaataagaaattcatggaatcagaaaggtgtgactattgttagtgatgggcggagtgatccacaaagaagacctctcattaacttcatggttgtcactgagagtgaaccaatgttcttaaaggcagtaaattgctctggtgatataaaggacaaggatttcattgctcaacacatgaaagatgcaataatgaaggttgggtcatcaaatgtggtacaaattgtgacagatgcagttttatgtaagacaataggtatgatcatagagaacgaatttcctaccatctattggactccttatgttgtgcacacctcgaaccttgcattgaaaaatatttgtgcagccaaggattctgagaaaaacaatgttcttggatcacacacacaaattgtagacaatgctaatttgattaaaaaatttaccatgggacactttgagattatcaatgagacaagccaatttggagttgcaaatttttttggtggaagagaagactttcatgatgttgactctttaagggatagaggtaaattggatgcaaaatcttggtggcttgttcatggtgctcatgcactaacacttcaaaagatttcccttaagctactaaggcaaccatcttcatcgtcttgccgtgaaaggaattggagcacctacaatttcatacatagtttaaaatga

SEQ ID NO: 19986 - DNA, 561 bp, Glycine max
  Peptide Sequence Number=SeqID_136764
atggtgtgggagtgtctggaaggtgaggccatggtccgacggccggagctccctggcggaggaagctccggcgagaatgagtggcacgaagacagcgagggtgaaggtaactacttccataagagtgaatttggagtgacggttggaagaggaagcatatatagagagagagatggaagtgtggtggagaatacgtgtggaaaattgtccgagttaaaggttacttcttcctcttccaccttcgccgttctctcctttgtctttttaggcggcgccacatgtcagctgaacgtgcatgtcagcacaggacctggggtcaacagcgccgaccctggtgtgggagtgttcataggcggtgccgccacactaggaggattcggaggggttgtttcctccgggggcggtggagactgcagaatcggcggcggcggcggcggcggcaaagataaggtggggttggtgttgaaattggggtttggaaatgtgtgttgtggtggtggcggcggcgaaggagcctcaatcccaaaactagacccagaacaacgagcaccgtcacaatga

SEQ ID NO: 19987 - DNA, 513 bp, Glycine max
  Peptide Sequence Number=SeqID_136765
atgtcgttcgcagtggcattgtgttcaacgtcgtcgttcttcccttcaggtttcgcaattcgcaatccaaagcagcttcaacctttcgtttcaatgtcactgtcttcgaagctaccgttgcatttctccggcaatgccagattcaaccgcaaccacccaaccatgttcaaaattcgagcctcaaattcaaactcttcatcttcatccaaactcgtcttatttagctccactatcgtcgtcacaacagcggtagcgaatcgcgtgctctacaaattggcccttgttcccatgaaagagtaccccttttttctcgctcagttcataacttttgggtatgttgttatatatttctcgatcttgtatttccggtaccgggcgagaattgtgaccgatgagatgctggcgattccgaaattgcgctttgtggccattggctttctagaagctttaggattggtttccggaatgtccgctgcagcttataagctatctgaaaagctggaaaagttataa

SEQ ID NO: 19988 - DNA, 234 bp, Glycine max
  Peptide Sequence Number=SeqID_136766
atggttttggttgtgttcgtctcattgagactaacatcagtagagtatggacaatttacttcaggccaaagaaggcatagaattcaatggatcaaagaatttaggactttgttgcgagaattaaggattgagtcccctgacagatcacttcatgaccatataattgaagctcttggcaagctcactgttgaacaaggaattccttatgttaccaaaaaagtcatgagaaattaa

SEQ ID NO: 19989 - DNA, 303 bp, Glycine max
  misc_feature (135)..(135): n is a, c, g, or t
  Peptide Sequence Number=SeqID_136767
atggaagccaatgcggttgcagttgtcgctaccagagttgttgctaaggtgaatctgatgcccccatctgatctcaaccaaatgaatcatccaacctcagatatggtgggcaaagatttgggaagtacgagcggnccccattatgtgcaaattcaaaacaagcacgccttcacgccatatggcttgccttccaactatacacctcccaatgtggcgtacactcccaatgagaatgtaataactccacttcaatactcattgagagccattaacctcaatctgattaggcacatgtctctctaa

SEQ ID NO: 19990 - DNA, 603 bp, Glycine max
  Peptide Sequence Number=SeqID_136768
atggctgctccaaaagtgaacgaaaagttgcttgaagaccttgaagtaatgggatttccaaaggcacgagcaaccagagcacttcattattctggttcgttgatttatcatatagataaattagtagacatgaaaatcatgtgcactgtgcaaggcaataccagcttagaggatgctataaattggatcattgatcatgagaatgacattgatattgatgagatgccattggtagatgtagacattgatatagagtccactgaatcattccctatcacagaagaaatgagaatgaaagcacagagtttaagggtacaagagcgcaaaaggaaagaggaggaagagaaaagattggagagagaacgggagaagggccttagatttctactccgtcacaagataggtcttggcaacaattgccacaattacatcatctgtcatgaccaggagaggattcaagctggtaagagactccttgaggctaagcgaattgcggaagaaaatgaaagaaaacggaatctagcattgaaaaaagcagaaaaagaagaagagaaaagagctagagaaaaagttctcaagaaactagagcaggataaggtatag

SEQ ID NO: 19991 - DNA, 669 bp, Glycine max
  Peptide Sequence Number=SeqID_136769
atgtggtttaatgttgatgactcaaatggtttgcctgaattagggaagaattacagctatatcataattgctcgacccttgctatatggatacagggatgtgtcggtagatgaacgtgcctctgattttgtggcaaaagctgtggatttagcagccagagaattaatagcaattgcatcaccaagacaaggtttaatctgcgttgctttttgtctcttgctgggatatagcaagggcattaatcttgaactacttgctttgcctgatgacggtgttcctaaattactccttgatatcggttgtggatcgggaattagaggtgagacaatctcggagaatggacaccattggattgggcttgatatttcagcaacaatgcttaggtctaggaattcgtcctggagttatggatggggccatcagtatatctactattcaggttatgcaacgccttatagagctcggagccctccaacctactggggacctgtcatcagtgaggagatctgtgcagtttttcctggaccacttgctaagccaggcaccagattaggagcagaccctttctgcaatcggggagggtggccctcttggctctctaaggttgctggtgaggccatcaatggattgacccctcggagggccgacacttttgagcagattgataag

SEQ ID NO: 19992 - DNA, 267 bp, Glycine max
  Peptide Sequence Number=SeqID_136770
atggagagcttcaagtacaacgattgtgaaatgaatcgaaagggaatcgagcacttacacattgaatgtccattcggggtaggaaaacgtgaacgggttcggagctggactctactcgggtcggtgcctaaagaatactcaaagaaagcggcaatcaaatcggtgaaacttagtagcattaacaaatcaaaagatggaatagaggggagaatggaagattcgagagtggtgagatcgaggggagaaaagaggaaagcacccgtctga

SEQ ID NO: 19993 - DNA, 237 bp, Glycine max
  Peptide Sequence Number=SeqID_136771
atgaagtatagcattgagactttcaccatccatctagtcagcaagggtaaaattataaatagatgggagtcagcttgcaggaagcctatatttaatttggcacataccgggattcacagcaagagacaaaaagcaacgcagattaaaccttgtcttggtgatgcaattgctattaattctctggctgctaaatccacagcttttgccacaaaatcagaggcctatattgatgcataa

SEQ ID NO: 19994 - DNA, 177 bp, Glycine max
  Peptide Sequence Number=SeqID_136772
atggtaagcagggtggctggcacctgttttccgagaacttggtcatgggctgtggacaatgtgaacaccattattgctcctactttggttggcaagttaggacttgctaaaggttatttggctctgtctaacttttatgttgctttttgtgacgatgagcaggacccaactcagtag

SEQ ID NO: 19995 - DNA, 441 bp, Glycine max
  Peptide Sequence Number=SeqID_136773
atgcatttattactatttctacatccagacaataaatatccatcttcaactgacattgataagataatatcagctgaaataccttctcatcaagaagacccagaactctacagattggtggagaaccatatgatacatggcccatgcggaattttacaatccaactctccatgtatgaaagaaggcaaatgcagtcgtttatatcctaaacaatttcagcctcagactcttttggattcaaacggttatccagtctaccgtagaagaaacaatggtcattcaaatacagagaatggtgttatcattgatacatttctccctgtgaagctgcttggagaatatttgcttttccaatccacggcagaaagcctgctattgagagattgtattttcatcttccagatcagcacaatattctttatgaagatcatgatgatatag

SEQ ID NO: 19996 - DNA, 477 bp, Glycine max
  Peptide Sequence Number=SeqID_136774
atgaccctcgccgccctgggtgcaacatacgcatgcgaatggttagactgggcgcctcgccctgcgctcccggatccgcatgaacgcccgcctgttccgcttcggtatcaatctctggccgccgttcctgttcaccggcatccacgtcacccgcatcacgccggactaccggcagatcgatgtcgaactgcgcctgcgaccatggaaccgcaactacgtcgcctgctgcacatcctcggccgcgactactacgtgtgggaccgcgccggcgccatcgacttcctcaagccgggccgtggcatcgtgcggacgtcgttccgcatcgacgacgcgctgctggacgaactgcgcgccgaagcggccagtggcgagaaggtgctgcgctggttcagcaacgacgtgatcgatgagagtggcgaggtggtcgcccaggtgcgcaagcaggtctacctgcggttgaagccacacgcacgctga

SEQ ID NO: 19997 - DNA, 822 bp, Glycine max
  Peptide Sequence Number=SeqID_136775
atgacgatcgcgttgcgcagcggagtggttttcagggacatccgtgacatctcgtgtttcaggaaaacaagcgtccgttctgtgggcgcgtggggtgctgcaaaccaacgtgggggccgggattctagagtgtttccattcgtaactgtttgtcgccatgccgctgaatatgcgacgtgcgcagcgtcacgcacgttgcatgcgcgatgggcagaggcatcgatagcggcggatttccgccgatctgtagcagatgcgcaatctatcgctgggaaatgctcaggtttcgcgcagcgccgtggtgatcggcaaacgtgccgcgcgcagcgccgggaacaggccgccgaccaggccgatgcccagcgcccatttcaaacccgtccacagcagttccggcgacacatggaacttgaacaccactgcgctgaagttgctgccgatggtggacacgctgtagccattgaacagcagccatgccaccgcacagccgagcaggccacccagcagcgccagcagcatcgtctccagcatcaccgcggtcaccaccggcaggccccggaagccgatcgcgcgcatggtggcgatctcgcgcgcacgcgtggccacggccgcatacatggtgttgagcgcgccgaacaccgcaccgaccgccatgatcgtgccgattaccttgccgaggatgtcgatcagcttggtcagcccaccgccctgcttgctgtagtagacacgggtggtttccacgtccagcttcaggcgtggatcagcggcgacggcggccttgaaactgctcgaagccggccttgccatcggtgcgcacgctga

SEQ ID NO: 19998 - DNA, 288 bp, Glycine max
  Peptide Sequence Number=SeqID_136776
atggaatcggagaagaacatggaatggacctccaacaggaaaatcgatggtttccattttccatttcaatgtcttcccattcgcacaaaggcacctccttctacggcgatgccgccccttatcgatccagaggggcttagcactcgacccgttgcatcctccgatgaaatccaattgcacatcgatcccggcatcgacttcgacgacgaaatcaccggtcttcgtggccaagttgctgaagagataggttcagaagtcaagtttcaaagagattttctggaacaagtg

SEQ ID NO: 19999 - DNA, 1590 bp, Glycine max
  Peptide Sequence Number=SeqID_136777
atgaggaagaaaaggaaaggaagcaaaactgatgggtctgcggatctggctgttattttggctcctaatcatggctctgcttcgtcgaatttgaagtcccattactcgctggaagattgttgtaggctgaagaagaggtgttgtaaggaggaggatgctgacactgagccggctacttcctttacgaggaggcttgctggcattgctactgccccaccttgtgggacgtcgtctttgatcacgccggggagagggctcaagaggaagataggttgcattgatgttgctacccagatgggcaggaagaagaagatcgaggatgattatgtttctggggagacaatcgggcaaggcaagttcgggtctgtttggttgtgtaggtcaaaggttagtggagctgaatatgcgtgtaagaccctgaagaaaggggaggagacggttcatcgagaggttgagatcatgcaacacttatccggacattctggggttgttacactgcaagctgtttatgaggaagctgaatgctttcatcttgtgatggaactgtgctctggtggtcggctcatcgatgggatggttaaggatggtctgtattcggaacagcgggttgctaatgtactcaaggaagtgatgttggtcatcaagtattgtcatgacatgggagttgtgcacagagatatcaaacccgagaatattctcctcactgcatccggaaaaataaagcttgcagatttcggcttggccatgagaatttccgaagatctcgctcagatcgtctcccacgaggttgatgaggttggtgctaagtcgctgtcaaggagacgtgagagtagtggtgttgttggtttgtgcagagaagaggatgataggggcgagaacggcacagccctgataggggcagtgcagatgaggatttgtttttgtgttaaggtttctaaaaacttgactggtttggcaggaagccctgcctatgttgccccagaagtattgttaggcagatactctgagaaggtggatatatggagtgctggagtgctcctgcatgctctgttggttggcagtcttccatttcaaggagattcattggaagcagtttttgaggctattaagactgtcaaattagatttccaaaatggaatgtggaaatcaatatctaaacctgcacaagaccttattgggagaatgctgacaagggatatttcagcaaggatatcagctgaagaagtacttaggcatccatggatattgttctacacggcaaatacattgaaaatgctgcccatcaaaacaaaattgaagaaccaaattggtgccacatgccaacagcttgttgctgtaagggaaccaaggttaggaggaaataggatagataattactcacttagcgagggttcgtcctctgaaagttgctattcagatgatcaggatgaatgtgtgttgattgatgtgcttgcctctgcaatttcacacgtgaggatatctgaaccaaagaggagcagggctgacaccacttataccactatcttgacgattcttgctgggattatagaatttactttcctcagcacattacatagtgggcaaaagtga

SEQ ID NO: 20000 - DNA, 267 bp, Glycine max
  Peptide Sequence Number=SeqID_136778
atgataagtgcctttgaaggtggattgggtcagtgtatgtctgttgtgacattggagatattcagatggatggttgttggtgtggttgggttcatgttagcaacttttgtggcacttaacctccgagaacatattatgtcaagaggtcaaagatgggtttacatagttgctagcatttttctattgcagttggttgtagttgttgcattaaaggtgaaatgcgattatcagattaaactgtcatttaattcattaatggcaatataa

SEQ ID NO: 20001 - DNA, 429 bp, Glycine max
  Peptide Sequence Number=SeqID_136779
atgatgtttatgaataattggagtacaagcttaggttatggttcactttatggtttccttgagcctcagtctatacacaatgcaaaggacatgcatcaagaatgtcaatattacattgaaacatgggttaaggaatcacaacgacaaatggcacattggcaacttcttgttttgtgtccagaggacaatattgttgtttggttatgttctttgcgtaagaagcctgatgttaacattaaggctacagttaacattgcaatgaagacattaactgctactttggaaggaaagccagaccaacctgtacctcgatgggttgaaccaaagtggttttcatatggaacaacgttagacagtgtggcaatgacaacacttcacaagaaatgggcaacatattttctacaagtgaaaaacatgaaatttagatga

SEQ ID NO: 20002 - DNA, 168 bp, Glycine max
  Peptide Sequence Number=SeqID_136780
atgaggtgtaataattggacccaaccttggcccatgggctcaaaaatctaccctgaggttcatgagaaccctagggccttcttcagcagctctagtccaatcctcttggagcctattgctcatggctctagtggctggtcccttcctagggaggattgcatcatatga

SEQ ID NO: 20003 - DNA, 403 bp, Glycine max
  Peptide Sequence Number=SeqID_136781
attctggggtagtccttttgtcctcagggtcaagtgggttcttgaactaaaagggattcagtaccaatatgtggaagatctcggcaacaagagtgccatgctcctacagtataaccctgtccacaagaagctaccggctctcgtgcatgacgctgttatggctaccttttccaaaggaggggaggaacaaaagaaggcagcacaagaagctagagagaatctgatattgctattggaaattgtgggcgtaaacctcattaatgaagagttgatggctaagcttgatgcttggttcgataattttcttgagcttcctgttatcaacgaatgcatgtcgcctcgtgacaaactgcttaaccacaacaaggccttccacaagctcttgacatcttcatccacttga

SEQ ID NO: 20004 - DNA, 327 bp, Glycine max
  Peptide Sequence Number=SeqID_136782
atgagtgtttattgggagaattggaaggagaagaagctggtaatgatttggttttttgatgaagatgatgatttgaattggttagatgttgctgaggcaactggggctggtgaacctttaaaaaacacaaggagtcaaacacagataaacaaggcagcagctgcacctgcacctacaaatgaaaaaggaaaaaaagtgatggaaatggaagaagagaatgaagatgagggggaagaagagtacaattctaatgctagtgagagtgatggatttcaagaagataatgacttgaatcttgaagaggatgaagattctgattctaactag

SEQ ID NO: 20005 - DNA, 519 bp, Glycine max
  Peptide Sequence Number=SeqID_136783
atggatccaaagatcgatttttatatgcttttggataaagtcatagatgaagaacttgaagacaacaccgacaaagaactcatatggttgatacttcagaatcaacaacaaaatcgtgaggaaggacaagatcgattgtccaataactatttctcaccaaattctatatatacagatactcaatcccaaaaaaggtttcacatgcaaatgcatttgtttcttcaagttgtggaggccctcaacaatcatgacgagtattcccaaatgatggtaaatgcaacgcgtagaaacgacctatcaccattgcagaagtgcactgctgctatttgtatattgacttatggctcaccaactgatagtgtggacgagtatatttggattgccgaaaccactataatggaatgcttacagatatttgtattaggtatttgtgcaatatttggggatgagtatctaaggaggccaaatgacgaagacactagaagactactacaaatgggagtgacatgtgatttttga

SEQ ID NO: 20006 - DNA, 300 bp, Glycine max
  Peptide Sequence Number=SeqID_136784
atggctatacttcctttaccacaaccaagtgtgggactttacaagttgcatttaatcttgttatactatgatgaaagtgttattgaaagaacaagagcattggttgaggcagctacaaatgatcatgtgcaaacattggtggactatctcatccctaagccttggatcttcttcatcaatggactcatttgcttcttgaagtttgatggcagcggaatggagaaggagaaagatgattggagacgccacttcaaggagaagatgagtctagaagaagctcaccaccataggaagccatga

SEQ ID NO: 20007 - DNA, 351 bp, Glycine max
  Peptide Sequence Number=SeqID_136785
atggattcgagcgggagtcacagcgacacaagtagaggaagcttcgacgcgactcaaatatgtaacccacccaccacgataaagcggagtaatggtggcaccgtggtggtttcaatagctaaaacgatgacatggaggaattgcggtggaagaaaggtggagcgggcttcagtgcaaccgagatttataacatatccaagtcatgaccacgacggcaaggcagagtggtgcagacaccgtgaggtattgcggtggaacgaaggtggcgcagactttgatgcaaccgatatctataacaaatcggagtcacaaccacgacgacaaggcaaagtggtggtggcaccatggtga

SEQ ID NO: 20008 - DNA, 1290 bp, Glycine max
  Peptide Sequence Number=SeqID_136786
atggcccagcaaaagcggttaagaggtctggctcaaaacctcaaagacaaagcctcggtgatcgccgcagcgctatccaccaagcgtcacctctcttccgtccgtgtccacgtgctccgcgccaccacgcacgccctcgcggcaccaccctccgaggaaacaatttctgctgtcctcgcggtcgggcacggcggctcccaccgtcatccacgcgcgtgcatcgacactctcatggaccgcctccacaccacgcgcagtgccaccgtggcactcaaatgcctctacactctccacaacgtcgtcgtaaagggacccttcgtattgaaagaccaactatcttgttacccttcttacggtggccacaattttcttaacctctccaccttccgagacgtctcggacttggaatcgctcgaactcagttcgtgggtgcgctggtacgccgccgtactggaacagaccttaaccgtttcaagaatcttaggttattacttgaacgattcttgtgaatcccaagaaaaaaagaagactttggttgtttcgaacgcgtcgaatgcggatttgttgtataagttggaggttctcgtgggtttcgtcgaacaaataagccacgtgcctgattcgttgcaccttcagaggaacgagttggtgtacgaggttgtgagattggtcggggagaattataggagcgttcaaggtgagatttttttgcgtgttgaggagcttggggaaagaataatggaggattttgatgtgggtgagttgaacgagttggtggggtatttggggagattggaagagagtcgtgaaaagttgttgcttttgtttgtgaatagaagaaagaataatgggttttgggaattggttgagaagacgaaggggaagggtgtggcgaagaagaaggagattgaagggaagtggctcgcggtggtggtgagtggcaacgccgccgagttgactcggtccacgaacccgtttcttgacccggggcaacaactcagtccggtcccccggttaagttttgcaacggaagaaataggtgtttttttattaaggagaaattgttacccgcggtttaaccgcaacaactctgtgagactgcgaacgtcgtcgcaacggtcatcgttgccgtcgaatccaaagtcgaaccgaccaccgcacgctgcccctgtgaacgtgtttgcgtggaggatctacaccatgaaaaacatcatctccctccactccctcctccatgctcgccgccaccgtcattgtccctggatctactggccttgtcaacatcactga

SEQ ID NO: 20009 - DNA, 174 bp, Glycine max
  Peptide Sequence Number=SeqID_136787
atggggtgggttacttccaagaaaccgaaggtgatggagatgaggagggggcaggagatggaggtggccggcgaaggagtgggtgacgacggtgatggagaacacggcgaggcggcgttgactgtatcagaggatgctctgcttggattagtggagaataatgcaatgctataa

SEQ ID NO: 20010 - DNA, 594 bp, Glycine max
  Peptide Sequence Number=SeqID_136788
atgagtccttcatactcttcaccaccccctccacctccaacacattatccatactattctccaccaccaccaccaccaccagattgcaacatgaccaagccaaaactccctccaccaccaccaccaccaccacctccaaactgtaacatgagccaaccacttccaccaattccatataagtataactgctcatgccctccaaacacaacttataatcccgctcctcctccaaacacaacttataatcccgctcctcctccttatactattattaagtatgagtacaacaacaaagctattatagcggtttccgtttctctagggggcttcttggtcgcttttctcctccttgctgttttcttcctcgcaaggcccaaacccaagcctcaaccccaacctcaacccgaacccgaacccgagccttgcgacgaccaggatcctcctcaacctccacctacacatcaatatgccccagttgatcaacaaccaccaccaaccgtaaccacttcctatcaagtcattgagattcaagaagctgcagatgttgctgctgcgagttatcatgatcatggtggccatcacaactatggctaa

SEQ ID NO: 20011 - DNA, 516 bp, Glycine max
  Peptide Sequence Number=SeqID_136789
atggctagtgcgcttgagacactatgcggccaggcctactgcgcaggacatcaccgcatgttgggcgtttacttgcaacgctcgtgggttgttcctgtcttccattctgatgttgccggtgttcatttttgtcacgcccgtgttgaagttaatagggaaacccattgcggtggcggaacaggcgggtttagtggcgctttggttgatccgtttcacctgagcttcccgttccagttcactttgcagcggtttcttcagtgccagttgaagactggaatcattgcttgggtttcagggtggctcttgatgagaaatgggattgttggcactgctctttctattggtttctcgtggtggctctctgttttgggaatgctcgggtatccactctttggtgggtgccctcgctcgtggactggtttttctgctgaagcttttattggtctttgggaattctttaaaccgtctttggcttctggggtcatgcttgcgttagtcttctttctaccactgtag

SEQ ID NO: 20012 - DNA, 381 bp, Glycine max
  Peptide Sequence Number=SeqID_136790
cgattgtctggttattccgttacgaacgagactcagcctgctaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 20013 - DNA, 864 bp, Glycine max
  Peptide Sequence Number=SeqID_136791
atgactatagctcttggtaaatttaccaaagatgaaaatgatttatttgatattatggatgactggttgcggagggaccgtttcgtttttgtaggttggtccggtctattactcttcccttgcgcctatttcgccttggggggttggttcacaggtacgacctttgtaacttcatggtatactcatggattggcaagttcttatttggaaggctgcaacttcttaaccgctgcagtctccactcctgctaatagtttagcacactctttgttgttactgtggggtcctgaagcacagggagattttacccgttggtgtcaattaggtggtctgtggacttttgttgctctccacggcgctttcgcattaataggtttcatgttacgtcaatttgaacttgctcgatctgttcaattgcggccttataatgcaatcgcattctctggtccaattgctgtttttgtttctgtattccttatttatccactgggtcagtctggttggttctttgctcctagttttggtgtagcagctatatttcgattcatcctctttttccaagggtttcataattggacattaaacccatttcatatgatgggagttgctggtgtattgggcgcggcactactatgcgctattcatggtgccaccgtagaaaatactttatttgaagatggtgatggcgcaaatacattccgtgcttttaacccaacccaagctgaagaaacttattcaatggttactgctaatcgcttttggtcccaaatctttggggttgctttttccaataaacgttgtaactggtttatggatgagtgctcttggggtagtcggtttggccctgaacctacgtgcctatga

SEQ ID NO: 20014 - DNA, 858 bp, Glycine max
  Peptide Sequence Number=SeqID_136792
gagatctgggactcattaagcataaactatgaaggcactgaggatgtcagactgaggatagtcattactctgaccaaacattatggaagcttcaccatgaaggatagagagtatgtggatgatatgtttggaagacttcgtgttcttctaaacaatatggaagctcttggagatatgtacactaaggcccaggtaaacatgaaggtgttggaaaattttcccaagaagcctagacatatgaagcttaaaggtccccagctaaagaagaggagatactctcaggacaagaaaaacaaaattattatgatcacatgggatgactcatacaatgagaatagttgcatctcaaattatgaacaagccaacatttgtctcatggtagatacagacaataaggctaagacaaatgtgaacttctatgataagtatgaacactctaaggttagatgcatccaaaagaagaaacaaatgtctaagggtactaacaatgttggacccaaaaagatatgggtaccaaaatctcaaatagtgcttgttggagatatccttggtaggaaaaaggaaggagacattggtaagggagagatctctggtttaggtaaaattggtattccttctgtagtctctatagacaacgtcttatatgttaaaggtgaccaagtgcctaaagaagtggtacttgaagttgtcaaggatgcatctgaagcaaagcaacaccaggttaaaatagctgaaagagttgaaacaactttggagaccagttgtgaaatcttctataccacttttgctaaaagagaagctgagcttgaaccagctatgatgtatgagcagatagttgaggaagaaaaaagttcttga

SEQ ID NO: 20015 - DNA, 408 bp, Glycine max
  Peptide Sequence Number=SeqID_136793
atggctacttcacttcagaaatctcgaagtgcaaccaagaaattgcttgaagatttcacaaagaaacgaagactagaatcgccaaaagaacaagtccaaagtccaatgaaattaaaatttattattgtattgtgtgcctcaattagcacgtttgtatgtatgggagaatgggagccaacttggagcacaagagctgcagaagaagctgaggctgtggcagcaataccatgttcaggacatggaagagcctacttagatggtcttattcttaaagatatgaataagtctcgttgtgaatgcaattcatgctatgctggatctgactgctcccagtttttatctgattgtcctgccaacgctgatggggaagttgatataatattgtttaatggaagtcatagggattag

SEQ ID NO: 20016 - DNA, 313 bp, Glycine max
  Peptide Sequence Number=SeqID_136794
tggtgatccatattttatggagccattttggatgcaacatgcagcaagtagtgccattctagtatcaggatggcatagaatgagttattcttatagcgatggatcagtcatctcacaactattggttgagtacataaaaaaagttcatggcatcgttgggaatgcaatcaccgaaggaaagtacatcgtatttggaagtggctcaactcaacttctcaatgctgctgtttatgccttgtctcccgacccatcaatgtctccagcaaaagtggtagccacagcaccatattacccggtgagttccattaattaa

SEQ ID NO: 20017 - DNA, 444 bp, Glycine max
  Peptide Sequence Number=SeqID_136795
atgtcctcctctatgatatgtttgacatctgtctcaactaccattcctgtgaatgggattatttatctgaagacagcgaagcctaagaaaaagaaagctctctgtgaagaatggtgcaattgtgtgccgaattcagtccattcaaaaaccaataagctaaatcaaaatgtaaaaaatacatatacacatgatggcattacctcttcacaatgcaaagaggccatcgcaaatagcaacctcggagaattggtgactggggatggagggaaggcggaggatagatgggtaggtgagaaacgggtcgtcgtggcggagaaaatagcgaaggaggagaagggagggggagtggatatggtggagatgaaggaagggtgtgtgatgagggacttccatgacttgcatacagttgtgcatttcaaaagggtttttgctggaagtctgtga

SEQ ID NO: 20018 - DNA, 757 bp, Glycine max
  Peptide Sequence Number=SeqID_136796
ggattttagttatgaaggagacacatccttgtggaaaaacaacacaaatagcagcttcagatttattgagtttgtgacttcaccaaacaatccagatggaaagttgaacaagggaattctcaaaggctctgatgtgaaaaccatttatgatcgagcctattattggccacatttcactgctattccttcaccagctgatgacgatctcatgctgttttcaatttccaaactcacaggccatgctgggagtagatttggatgggcaataataaaggatgaggcagtataccaaaagatgatgatatatttgagattgagcgccatgggagtttcccgtgacgttcagctgagagttttaaagcttttggacgtggctactgagggagatggaaaagaaatatttcaatttacatattcaacaatgagagatcgttggataaggttgaaacaaatcatatataaatcaaaacgattttctctacagaaattgtctccccagtactgtacctttttcaagagggtcagagatccttcaccagcgtacgcttggttgaagtgtgagagacaacaagacatgaattgctatgaaaccctaaaagctgctggcatcattggccgtaaaggaagtaactttagtgcagatgaacgttacgtgcgtctcagtcttattaagagccaagatgattttgagatactaacaaataagctcagaagtcttgttgcaaaggaatgggaatccaacccagcttccatttaa

SEQ ID NO: 20019 - DNA, 171 bp, Glycine max
  Peptide Sequence Number=SeqID_136797
atggggaggaataaggtgggtccatttgatccgaggtgcaacgccgacttcatagccgccgcaatctataacaactgctggatcgaaagatctaaatcgatcttacttcagggatttggagaagtagcaatggtgggggagtgggtggcaacaacgacaatgtggagctga

SEQ ID NO: 20020 - DNA, 369 bp, Glycine max
  Peptide Sequence Number=SeqID_136798
atggaggacgacgagaagacacccttggtgggagaaatcgaggaggtggacgcgagtcccgtggaggaggagggcacgagcgagcgggagaagcgcgtgcggaccaaggtcccggaggcagagatccacctgtatcggcaggggaagggccccgtggcggtgttcaagtcggcactgggcggctgggagcaggatcagctcgagatcagggaggacatcctcgagaagtacggcatgaaatcggtcttcgcgttcaatccgaccgccggggggcgcggcgttcctgtccggttcaatcccagaaatgggaggtcgattttgacgtacagggatggggctgttgttttgagttacttgatattagtttaa

SEQ ID NO: 20021 - DNA, 729 bp, Glycine max
  Peptide Sequence Number=SeqID_136799
atggtgtggcgtctccaatcacctttcctccttctccatttcgctgtcattgatcttcaagaagcaaatgactccattgataaagaagatccaaggcctacgagctgtacaaggagctacatcaacttcgatgccaagaagctctaccagatcaccaatggcactgccctcgccaccaccacgtaccaggccaccggcaacgcccacggatccgctggctttgtcaacatcatcgatctccatgagaaaaaggtcaaattcgacatcgaaaacaatgttggcacactctcctcaacttttgtcaaatctgtagaagaaatcctttacaacatctcagtaatccagatcagcaaagttctcccctctaccgtaatagaagctcctgcacccatacccacccaacaaaacctcaccaacattatgtcaaaacatgaatgcaaggtctccgctgacgctctctcttctcaacccaacatgcttaacaccttcaatgacaaccttgatgggggcttaaccatctttttccccctcgacaacgcattcaaagcatttctccctaaatttgaaaacctaaccaaatccagtaagaacactcttgtcactgatggcaccaacaagaacgacttcactgttcaaaacgacaatgaagatgttactctgaaaatgaagctcaccactctgaagatcaccgacacgttgattgacaaacaacctcctgtgatgctatga

SEQ ID NO: 20022 - DNA, 1389 bp, Glycine max
  Peptide Sequence Number=SeqID_136800
atggaagtcaaaggaattaagccaaatcttgttactttgagcatcctcatcaattgtttctgccacttgggccaaatggccttttctttttctgtattgggcaaaattctaaaattaggttatcagccggataccataaccttgaatacactcctgagaggtctatgtctcaagggtgaggtcaagaaatcactgcactttcatgacaaggtcgtagcacaaggatttcagatgaaccaggttagttatgggaccctgctcgatggactatgtaagataggagagacgagatgtgccatcaagttgctgagaatgattgaagacagatcaactaggcctgatgtggtaatgtacaacatcatcattgatggcttatgcaaagataaacttgtagacgaggcttgtgatttttattctgaaatgaatgctagaggaatttttcctaatgttatcacttacaatactctaatatgtggcttttgccttgcgggtcagttgatgggagcattcattttattaaatgaaatgatactgaagaacatcaatccagatgtttatacctataatacattgattgatgcattatgtaaagaaggaaaagtgaaagaaacaaaaaaactattagctgtgatgacgaaagaaggggtaaaacctgatgttgtttcttataatactttaatggatgggtattgtttaattggtgaagtgcataatgcaaaacagatattccacactctgatccagaggggagtaaatcctgatgtttacagctacagtacaatgattaatggattatgtaagtgtaaaatggtcgatgaggccatgaatctcctaagaggaatgctgcataaaaatatggttcctaacacagtgacgtacaattctcttattgatggtttgtgtaaatcagggagaattacttctgctttggatcttatgaaggagatgcaccacaaaggtcaaccagctgatgtagtcacctacaattccttattagatggtttacgcaaaagccaaaaccttgacaaggcaactgcactattcatgaaaatgaagaaatggggaattcagccaaataagtacacatacacggcacttattgatggattatgtaaaggtggaagacttaagaatgcacaaaagctttttcaacatctcttggttaaaggctgttgtatagatgtctggacatataatgtcatgatcagtgggctttgtaaagaggacatgtttgatgaagctttggccatgaagtcaaaaatggaagacaatggttgcatccctaatgctgtaacttttgacatcattattcgttctctttttgagaaggatgagaatgataaggccgagaaacttctccatgaaatgattgctaaaggcctattgtag

SEQ ID NO: 20023 - DNA, 279 bp, Glycine max
  Peptide Sequence Number=SeqID_136801
atggctgcgacgatgcagaatatcgatttcgttcatgggagagaaatagcacaacaaaaagagttgccgaagaggggagaatgggagccaacttggagcagtagagctgcagaagaagcagaggctgtggcagccataccatgctcaggacatggaagagtctacttagatggtcttattctaaaaggccatgaacctgtttgtgagtgcaatccatgctatggtggatctgattgctccaagttgttatctgattgtgctgctaatgctgcagggtaa

SEQ ID NO: 20024 - DNA, 255 bp, Glycine max
  Peptide Sequence Number=SeqID_136802
atggacgacccctcttccccaaagaaaacctctttgttttcatcctttccttctcttctcttcacctacagcacacaagtcgatttgagggccaagtgtgagagaaaaatcgagagagaagtgaggtttgagagttggtggtggcggctggcgatgtggtggccaatggctaggttggtggtgacccttgagaagagagaacaagaagagacaaccatgaaagcaagggcttgcggaaagagctcgttattatga

SEQ ID NO: 20025 - DNA, 714 bp, Glycine max
  Peptide Sequence Number=SeqID_136803
atgtctaaagcagcatctgagggttggttatgtgtgtcatctttgaaatcactttcagaggagcctgaaaaaaacacaatagaagatggtgctgccaaaagtttcaaggtaaagactcagtccatcattcaagagtacttcttatcaggcgatatattggaggtaaatagctgtctagaacaagcaaacagcaagaactgtgctgcactcaatgcaatctttgttaaaaagctgataactctggcaatggataggaagaatagagagaaggaaatggcttctgtgttgctgtcgtctttgtgtttcccagctgatgatgttgtgagtggttttgtgatgttgatagagtcagcagatgatactgctctggacaatcctgttgttgttgaggatcttgctatgtttttagctagagcagtggtggatgaagtcctggccccacaacaccttgaagagataggaacacagtgtttagggccaggttcagttgggagcaaagtgcttcgaatgacaaagtcattgctaaaggctaggcttgctggggagcgaatcttgaggtgttggggtggtggagggagtagcaggtcaggatgggcatttgaggatgtcaaggacatgattgggaagctgttggaggagtatgagtctggaggcgagataagggaggcgtgtcgctgcatgaaagagttaggaatgccatttttccatcattga

SEQ ID NO: 20026 - DNA, 795 bp, Glycine max
  Peptide Sequence Number=SeqID_136804
atggatttcggtgagggttatgtatcaaatgagcatcgcgagcttcatcaatctgcaacagaaagtgcagatccattatctgtttctccattgcagctttcacctaagtcatcacgatcaccaaattctccaaggtcccctaaatctcctaggactccacaatctccaaggtccccaacggggcaaggcaagtgcagcaatctaagtccaaggaatcatagacaatcatattttcaaaaagatggacgtccaaagaaaggtggttctgggggaaaaggtacctggggtggattgcttgatacagatgacacgaatgttcttgatcctaatgatccaaactatgacagcagtgaggaatttgaccattcaaatgaaaagaaaccgacaacagatcttgaaaactacaagaaaaaagctacaataatagtggaggaatacttttccactgatggtgttattgcaacaatgaatgaagttaaagaattgggaaaaccacagtatggctactattttgtcaaaaaacttgtctctatgtccatggacagacatgacaaagaaaaagaaatggctgctattctgttatctgcactttattctgacgtagttgatccttcacaagtttacaaaggcttcagcaaattagttgaatcagcagatgacttgattgtagatataccagacacagttgaaattctagctcttttcatagctcgagcagtggttgatgacatacttcctcctgcatttttgaagaaacagatggcctacttacccaaagattcaaaaggggttgag

SEQ ID NO: 20027 - DNA, 3583 bp, Glycine max
  Peptide Sequence Number=SeqID_136805
agcagaaccatcctcgtcttccttcgcagacaaatggaatttttatgatgtcttcctcagttttagaggcaaagacactcgtcaaaatttcactggccatctctacaattctctattcaaaaatggaattcttactttcatagatgataaagggcttaggaggggggaagaaattacaccagctcttctcaatgccattaagaattcaaggattgccatcattgttttctcagaggactatgcatcctcaacttattgcttggatgaacttgtcacgatccttgagagcttcaaggaagaagagggtcgatcaatttatccaatattttattatgtggatccatcacaagttcggcatcaaacagggacttattcagatgcattggcaaaacacgaagaaaggttccaatatgacattgacaaagtgcaacaatggaggcaggctttatatcaagcagctaatctatcaggctggcatttccatggatctcaaccagagtataagtttatactaaagattgttaaagagatctctgaaaagattgattgtgttcctttacacgttgctgataaaccaattgggctagagtatgcagtgctagcagtgaaatctctctttggactcgaatctgatgtcagcatgataggaatatatggtattggtggtataggtaaaaccacaattgctcgtgccgtgtataacatgagttttagtaaatttgaaggcatctgtttcctccctgacattagagaaaaggcaattaataagcatggccttgttgaactccaagaaatgctactttctgaaacactcaaggagaaagatatcaaagtgggacatgtcaacaaaggaattcaaataataaaacagaggcttcaacaaaagaaggttcttttaattctagatgatgttgacaaattagagcagttaaaggtccttgcaggacaatatgattggtttggttctggaagtataatcattatcaccacaagagacaaacacttgctggctactcatgaggtggtaaaattatatgaggttaaaccattaaatgatgaaaaatctcttgaattgtttgattggcatgcctttaaaaataataaaactgatccaagttatgtgactatttcaaaccgtgcagtttcttatgcatgtggccttcccttggctttggaagttataggttctgacttatttggaaaaagtttgaatgaatgtaattctgcattggataaatatgaaagaattcctcatgaaaaaatccatgaaatatttaaagtaagctatgatggtttggaagaaaacgagaaggggattttccttgacattgcttgtttcttgaatacttttaaagtgagctatgtcacacaaatgctacacgctcatggttttcatccagaagatggtttgagagtgttggttgacaaatctctcgtaaagattgatgcttctggttttgtgagaatgcatgatctaattagagatacaggcatagaaattgtaaggcaagaatcaacagttgagcctggcagacgtagtaggttatggtttaaagaggacattgttcatgttttggaagaaaatacgggaactgataaaatagaattcataaagcttgaagggtacaacaacatacaagtgcaatggaatggaaaagccttccagaagatgaagaacctgagaattttgataattgaaaatacaaccttttctacaggccctgagcatctaccgaatagtttgagatttctagactggagctgctatccttcaccatctttaccatctgatttcaatccaaaacgagttgagatactcaaaatgcctgaaagttgccttaaaatcttccaacctcacaaggcatgttgcaaggtcttaacccatctgccgagcctaagagaagtaccactcgtaacctttttgtgtctcgattactgcagtaatttagttaaaattgattgttcaattgggtttcttgataagctcctcaccctgagtgctaaaggatgctccaagctgaaaattctagcacactgcatcatgttgacttctctcgaaattttggatcttggggattgcttgtgtcttgagggcttcccagaagtattggttaagatggagaaaataagagaaatatgtttagacaacacagccataggcacattgccattttcaattggaaatcttgttggacttgaactcttgtccctggagcaatgcaaaaggctgattcagctaccaggtagtatctttacactgccgaaagttgaagtgatatttggttttaggcattggagatatctattctttgaagagaaccaagatgggaaagagttgagtttagaagtgtttccaaaggccattcttgtttgccatcttgatcccaggcattatcatcatcttgacctgtattatctgtacatgagtcctaataatgtcatccaagtatgcagtcctaatctgtatatgctctgtgatttcgatttgttgttccaaaagcttgcattgggtgtcgagaaggactggtttcgcagatgcaggaaatggtcaatgaatttctcgtttcgaaaaaagtttcctaagattgcgcacgaatggaatgaagctgagattttattcgagttgaaatgtcctgcaccaagttctgtagaagcaatgtgggcccacaacatttccatggaaattatagactggactctaattggtgtctacaatcaaggaaacattaaggatgatattaaattcaaaatgccgatgtcaacttttttactccctaacagagaacctccttcattacctgatcaaccagaggtttatcgaaagattgttaaagaggtctctgaaaagattgattgcattcctttacacgttgctgataatgcaattggactagagtattcagtgcaagaagtgaaatctctccttggacttgagtctgatgaggtgaacatgatacgaatttatggtatcagtggtataggtaaaaccacaattgcctgtgttgtgtataacttgatttttagccattttgaaggagtgtggtttctccccgacattagagaaaagacaattaataagcatggcctcgtccaactccaagaaatgctaccctctgaaatactcaaggagaaatatatcaaagacaatcattgtcaccacaagagagacaaacacttgctagctactcatggagtgataaacttatacgagcatgcctttaaaaataataaagttgatccatgttatgtgaatatttcaaaccgtgaagctcttgatgtgcatggccttccattggctttggaagcaataggttctcacggaattttccttgacatttctaatatcttcaaaactaaagaagtgggctatgtcacacggatgctacatgctcatgattttcatgcagaagatggtttgagagtgttggttgacagatctctcataaagattgatgcttcagggggtctgttcttccatggatgccgccagaagaactggcgacataggtgttccgccattgcagatggcgagaagtacgctgagctggagggtgccgccactggcacaggcgagacatgctga

SEQ ID NO: 20028 - DNA, 210 bp, Glycine max
  Peptide Sequence Number=SeqID_136806
atgggtgatcagctattgcattatttcatgcgactcgaattgattggcggcatgcttcctcagcatagcggcaccctccagctcagcgtacttctcgccatctgcaatggcaaaacacctatgtcgtcagttcttctggcggcattcatggaagaacagacccctcctaaaaagtttaaaaatagaccctccttcgtaattagtttttaa

SEQ ID NO: 20029 - DNA, 261 bp, Glycine max
  Peptide Sequence Number=SeqID_136807
atgaatcctattacacaatctgaaaaagaagggaaggagcaagataactgcatacaaattgagaagggtgaaattgtggaaggaattaagaaaataccaagaactgatatagttccttattgttcccaacgatggcttgtccaaaggtggttggagtacttggcgaccatgttcggaaatgtgcaagttgagcgtcaatcatcaggtcaactggcatggcaacctgcaagcatgccacgtgctgatagaagctattcatga

SEQ ID NO: 20030 - DNA, 432 bp, Glycine max
  Peptide Sequence Number=SeqID_136808
atgagtagaatcttgaagaagattgaaaaagtaactgaagaagccttaaagagtcaggtgaatctcaaaagtgttgttgaatcaagtcaaagtgcacaaagcaaagtttgtaataatctcaacaatggaggaagaggaaattatagaggtaaaggtcaaggaaattacaaaggaggaggttgcggaaatttcaaccaagaaagaaacaacaatttcggatcattcagccaaggaagaggccatcgtaacaaaattgttatgtgtggaagaaatgagttattttcttctttagatgaaatggttaaatctattgtaaaaatatggaagcaatgcaaggattttgtttctgattgtcctatcgtgaatattcctaacagtgtttgcgagacatgtgagattggaaataagcatgaagtatcttttccaacctaa

SEQ ID NO: 20031 - DNA, 531 bp, Glycine max
  Peptide Sequence Number=SeqID_136809
atgtttgactttgatttagtgggtacgagcaatcatagaaagggatcgtcattgtcctcctcttcctttagctatggatggacatatgatgtgtttctcagctttagaggttcagatactcgccatggttttacgggtcatctctacaaagctctctgtgataaaggaatcaatactttcattgacgatgaggagcttcaaagaggagaggagatcacaccaacacttatgaaggcgattgaagagtccaggattgccatccctatcttctctaagaactatgcttcttccaggttttgcttagatgaacttgtacacatagttgcttgttctaaggaaatgcgtcggttgattttgccggttttctatgatgttgatccctctcatgtgagacatcagatgggtagctatgaagaagcactgaatagcctgaaagacagattcaaggatgacaaagagaaattgcagaaatggaggactgctctacgtcaagcagctgacttgtctggttatcattttaaacctgggtaa

SEQ ID NO: 20032 - DNA, 210 bp, Glycine max
  Peptide Sequence Number=SeqID_136810
atgaagcctgaaacatccttgaaaataaaagaagaggtgaagaagcaatttgacgctggttttctagcagtcgctcggtacccagaatgggttgccaacattgtaccggtccctaagaaggatgggaaggtacgaatgtgcgatcataccagcactaatgcaccggatcccatcagaactccgcagttaagcgtgcttgggcgagagtag

SEQ ID NO: 20033 - DNA, 315 bp, Glycine max
  Peptide Sequence Number=SeqID_136811
atgttatgcccatttgaatttctcgagagcttccattgctcaatttcaagcgtctcgatatatcaggggcctcaatcatactcccgaagctttcttgttcaaattcaagcgtgtcaatatgatgaggacatgaccaagagaaagggcaaggatccacttgaaggacttggaggacctatgacaagggctagagcaaggaaagccaaggaagctcttcaacaagtgctgtccatactatttgaatacaagcccaagtttcaaggagaaaagtccaaggctgtgagttgtatcatggcccaaatggaggaggactaa

SEQ ID NO: 20034 - DNA, 173 bp, Glycine max
  Peptide Sequence Number=SeqID_136812
cgcttctttaacgtctttagctggacgccttatgacttgtcggtcactgacctagtgaactctaaaggtggtggcggtgcgtctatgcccgctaccggccatcctaatgctactgtggtgtctcaccctgcgtctgcctgggggcgcagtacttctagatggaaactcgattg

SEQ ID NO: 20035 - DNA, 557 bp, Glycine max
  Peptide Sequence Number=SeqID_136813
tcctcgccttcacagggcaacacgccctcagcttagaggactacacgtcctcgccatcagaaggctacacgtcctccccttcacaggactacacgtcctcgccttcagagggtttcatgccctcagctttaggaggattacacgtcctcgccatcagaggactacacgtcctcaccttcagaggaaaacacgtcctcgccttcagagggctacacgccctcgctttcagaggattagacgtcctcgccatcagagggctacacgtcctctcctttagagggcttcatgtcctcaccttcggaggacttcacgtcctctccttcagagaactacacgtcctcgccttcagaggactacacgtcctcgccttcagcgggcgacacgtcctccccgactacacgtcctcgccttcagaggactacacgtcctcgccttcagcgggctacacgtcctctccttcagagggctacatgccctcagctttagtggacttcacgtcctcgccttcagatggctacacgtcctcgccttcaaaggactacacgtcgtggccatga

SEQ ID NO: 20036 - DNA, 231 bp, Glycine max
  Peptide Sequence Number=SeqID_136814
atggaaagcagacaggcgagtcctgacaagaatcaaatactgtacatggaggagttgtcgttagttttaaatcaagttgaatccattcaagacattcttcctataatttctgtcattcttgagctcccaccagaatcccagcagcaattgcttcaattgccagttaacttggttagaaagttaatatctcgtgctgctgcaagaactgtttgctttttcaaatggttgtaa

SEQ ID NO: 20037 - DNA, 231 bp, Glycine max
  Peptide Sequence Number=SeqID_136815
atgtcgtttggtaatgatgtggagattgtgaggatggcaatgatgacgttgttgttgccggtgacattagtggtggagaatgggatctcatctttggatctgaacacattgcaaagaagaagaagaacaaggaggaagatagagtttcatactattcatttttattttgttcaaatgtatttgttgggtgtgaatacgaatggagtggtgtataattgtgagtatggttga

SEQ ID NO: 20038 - DNA, 1728 bp, Glycine max
  Peptide Sequence Number=SeqID_136816
atggacaatttccagggccaactgttagagcctactatggtgaaacgatatatgtcaatgttcacaacaagggaaaatacaacatcaccttgcactgtgaaacaaccaaggaatccatggtcagatggccctgaatacatcacccagtgccccatcaaacctggtgggaaattcaggcagatgttgattttttctattgaggaaggaaccatatggtggcatgctcatagtgactgggcaagagccactgtccatggagctatctatatttatccaagaaagggtgaatcctacccttttcccacacctgatgaagaagtgcctattgtattaggagaatggtggaagagtgatgtcagcgatgtgtatgaggaatttctcagaaatggaggatccccaaatgaatctgatgctatcacaataaatggtcaacctggtgatctctatccttgctccaaatcagaaacattcaagttaaatgtgcactatggcaagacttatcatctgcgcatggtcaatgctgcaatgaatctcgttctcttttttgccgtttcaaagcacaatctcacagttgttggtgttgatagtgcctactctaagccattaacaagagattacatatgcatagctccaggacaaacagctgatgtattattgcatgccaaccaagagcctaatgactactacatggctgcaagggcatattcaagtgcacttggagttgcctttaataatggcataaccacagctaggatccactatcatgagaatcatgctccaaacaaatctccttcattaccttatctccctctttacaacgacacaaaagcagtttttgactactatgttagcattaagggcttaaatgaagcagacccctatcaagtccctacaaatatcaccactcatatgctaaccaccctttcaattaacacatttccatgccctgaaaaccaaacctgtgcaggaccaaatggaacacgtttagcttctagcgtgaacaacataagttttgaaaaccctaccattgacatactagaagcctattactaccacatcaaaggggtgtatcacaaggggttaccaaaatttcctcctttgaaatttgactttaatgcagagtatttgcctctagaacttcagataccaaagaaaggaaccaaggtggctgttattaaatttggttcaacagttgaacttgtttttcaagggacaaatttggttactgggatagaccatcctatgcatctgcatggcactagtttctttgctgttggatatgggtttgggaattttgataaacacaaggaccgcaagacatacaatctcattgatcctccccttatgaatacaatactagtgcccaagaatggttgggccagcataaggtatagggcttctaacccagtgaagtcggcagcggcgaaaacaagcgacgacgttacgctcttggtgaccagagggttagtttcgagcattcgcatataccaacccacgaacccgcgagacgaagaagaagaagaagaagaagaagaagaagaagaagaagatgatgatgatgaagctgacgtggaaaatcgcggtagcgagagagaagcacgttggtgcggtggcgccttgtggtggaaatgcattctggtgaggcagcgtcgaaaatgcggaagcggggtggcgaggaaacggtttcgtggtgcgaaggaacctaggaagaagcgtttgggaatgtga

SEQ ID NO: 20039 - DNA, 1668 bp, Glycine max
  Peptide Sequence Number=SeqID_136817
atggtattctctgcaaaatatgggagaagtgatggaaatagttgggcaagcatcaaaggcttttccctccaagtcctcacagggaggtggttcatgatgttttcatcatttatgatcatgtcagtgtcaggagcaacctacatgtttagcctctactcccgggaaatcaagttggttcttggttatgaccaatccactcttaatcagttaagtttctttaaggacttgggtgccaacataggcattctttcaggcctaatcaacgaggtcacacccccttgggctagcttattaattggtggagttctcaacttttttgggtactttgcaatttggcttgctgtcaccggcaaaattgcaaagccccaagtgtggaacatgtgcttgtacatcttcattggagcaaattcccattgctcaaccaaaactggagctgttgtgaccagtgtcaagaacttccctggcatcagaggcattgtcttaggccttttgagtgggtatcagggtgtaagtgcagcaataattactcagctatactatgccttctatggaaatgactccaaatccctcattttgctcatggcatggctaccaactgctacagctattgtgttccttccagttatcagaaaccacaggagtattcaacagccaaatgacactaaagctttctataggttcctctatttgtcattagtcctagcggggttcctaatgatcgtaattatagcacaacaatgtttcactttctctccaaatgaatataatgttactaccactgtgatgcttcttttgctcatccttccactggctgttgttattgtagaagaacacaagatttggaagagtagacaacaaaacatcaatagggaagatagtcaaatgttgttggcaaactatcccaatatagctacagaaaatccttatcaagaggagtcttcccatacagaacaaactgtcgaagaaaaagtatcctgttgggaaaacatactcaggcccccagaaaggggtgaagatcatacaatacttcaagccatttttagccttgacatggtggttctcttattagtttctatatgttcatttggtagcaacctgactatggtcattcaaggggttgtcgcagaatttatcttatccaaatttaaagtccctagacctttcatgctcacatcgttacttctattatcttgtgttggtcatcttttaattgcattcaatgtcccaaatggtctctatatagcctcaattgttattggcttctgctttggggctaactggccattactctattccatcatatctgaactttttggccttaaacattattcaacattgttcaatgttgggtcaatatcaagtccaattgggtcatacttgctcagtgtgagggttgcagggtatttatatgatatggaagcaagaaggcaaatggaagctttggggcaaaagacaagtccaggggaggagctgaactgcaatggtgatgagtgctacaagttggcattcattacaatgactgcagtttgcttgtttggggcatgtttgtcactcattctggtctttaggaccatacaactttatagaagagacctatacaagaaattcaatggtgctacaactgatgtaactgaaacaactgatgtaactgaaacggctgtgtcttag

SEQ ID NO: 20040 - DNA, 936 bp, Glycine max
  Peptide Sequence Number=SeqID_136818
atgttcctcaaaacccaattcctgttcctcctcacccttgttttagcaacaagcacagttaccaccgccatagacccaggttctaccctctcagcttcttcttccaaccaaacgtggtcttctcccagcggcaccttctccctcctattcatccccgtccagccaccaaccacccctccctccttcatcgctgccatcgcctacaccggcggcaaccccgtcgtctggtccgctggaaacggcgccgccgtggactccggcgggtccctccagttcctccgctccggcgacctccgcctcgtcaacggctccggctccgccgtgtgggacgccggcacggcgggtgccacttcagcaaccctcgaagacagtggcaatttggtaatttccaacggcactggcaccctctggtcaagctttgaccaccccactgatacccttgtgccctctcagaattttagtgttggtaaggttctcacttctgaaaggtactcttttagccttagttcaattgggaatttgaccctaacatggaacaatagcatagtgtactggaaccaggggaactcttctgtgaatgcgagttcggattcccctgtgttggccttgtctccaattgggcttttgcaactttcttatgcgaaattgagcactgttgctcttgttgcctatagtagtgactatgataagaatgatggagtgtttagggtgttgaagttggataatgatggcaatttgaggatttatagcagtagtcttggtggtggaactcctagtgttagatggactgctgtttcggatcaatgtgaggtttatgcctactgtgggaactatggtgtgtgtagttacaacgattcaagcccggtttgcggttgcccgtctcagaattttgagatggttgatccaaatgatagtaggagagggtgcaggatgaag

SEQ ID NO: 20041 - DNA, 315 bp, Glycine max
  Peptide Sequence Number=SeqID_136819
atggcgagaaagcttggtacgtggagggtgccgcttgtgctactggcgggacacatccacgccggatgtgccgccatgctagttccattggaaagaacaaagttgccttgctcatcaaggaaggtagagaagacacaaaaatgggaagttcctgagttccataatatggcaccagatccatcaacaagttgcaaacttccaattgagagcaattggaatgaacctcttgagtctactaaagttccaccacctacacctccagagtggacaataccaaccatgaaggaaggaggagaaattgggggttggacttga

SEQ ID NO: 20042 - DNA, 660 bp, Glycine max
  Peptide Sequence Number=SeqID_136820
atgagcaactcaactagtactcaagaattgattctcccctgcgatgatcaacagcagcaacagaatgaggatgattactacgatcttgatgactatgacattgatgaatcctactatttctatgtcatcaatgcaatactaagtggcactgctaggctcaatgtgctcttgccaacagtgacaatccttgccttcagcatttttgcacctctcctcacagatgatggtgaatgcaacactttgaaccgttggttgatgggaacctttttgacccttttggcagtgtcatgtgttttcttcaccttaactgatagcttcagaagtgccactggaaggttgtactatggagtggtaacattcagagggatatggactttcaatggtggcaagaagaagccgcgcatgccgtcagattatagactcagatggagtgatcttttctatgcatcattgtctttggtctcttttcttgcttttgcaggattgcatcaagatgttgtcaagtgttactacccagcattgcctagaaaggtgaccaacactctcccccttgtggttggtttctttgtgagtatattgtttgttgtgtttccttccaagagaagaggcattggctaccccttcttgctgcagagagatcctttctactctaaaacttga

SEQ ID NO: 20043 - DNA, 1461 bp, Glycine max
  Peptide Sequence Number=SeqID_136821
atgcggcgtgagattgccaagctgcttgagactggccaagaagccacggctcgaattagggtagaacatattataagagaggagaacatgatggctgctcaagaaatcattgaactcttttgcgaacttattgcggtccgccttccaataattgaatctcaaagggaatgcccccttgacttgaaggaagccatatccagtgtatgttttgctgcaccaaggtgtgcagatttgcctgagttgttgcaggttcagatgctatttgctgccaaatatgggaaggaatttttatctgctgcaactgagctcaggccagactgtggtgttaatcgccagttaatagagctgctttcaattcgtgctccttcaccagaaaagaaactgaaccttctaaaagaaattgctgttgagcatgatttagattgggatccagaagcttcagaaactgagttctttaaaaagcatgaagatttattgaatggcccccttcgacctagtggatctaagttcccccttcctgacgaaaaacacaatgaagagatatactccactcatgatacacccaataaagaacaagctgattctgattctgattctgatacattagaatttcctgaagttcctaaggtatcagtccagccaaatgcaaatgttgccacagctccagaaatggttacacatttgactatggaaccccttgatgttgatcttgattcaccaagacattctggagatttttcagatctgaagcaggagcaagttgaagatagatcaacagttcacaaagatgaacctcacacttcaatcggcaaaatggagaataaacagtatttgccgttcatctcccctccttctgtatcatctggatcgttttttgcaagacatagtgactcacctccctccttctcaagcacaaagtcggaaggcaatgtggacttacaggatgtgttggctgccgcccatgctgctgctgaaactgctgaacgtgcagcagcggcagctcgcaacatggccagcctcgctcaagtccgaattaatgagctgacgaagaagaaaagtactgaacatgtgcccgacagcagcagctctgagaacccattttatgctggtggtggtaatgaatctccaacaatagaaaagcatttcactgatcaaattcctgcaggtaactctgatgcccttaatagaaacaatgttgaacatcacctggatcatcatgcttccccaggctctcattcatcaagttttccttcctttgacacgctcaaggaagattttgcttcttccctacccaatgatcatcatgtattgaatgacaagtcctcgagtcaccagccaaagagattaccttcaatggatgatgacacatatttctcgtaccccaacttatttacctctcaaaactctaatgtgggatctcaggctcattcagataatagccgttcccctcatgatctgtga

SEQ ID NO: 20044 - DNA, 1591 bp, Glycine max
  Peptide Sequence Number=SeqID_136822
gagagggtgcaggaggaaggtgagtcttgatagttgtcaaaggaatgtgactgtgttgacgttggatcatactgtggtcttgagttatccccctgaggcagcgtcgcagtcgtttttcattggtttatcagcatgtagtacgaattgtctttcgaattcgggtgcctgttttgctgctacttccttgtcagatggctcggggcagtgtgtaataaaatcagaagattttgttagtggatatcatgatccttcgctgcctagcacttcatatatcaaggtttgtccgccgctagcgccaaatccaccaccctctataggggactctgtgagggaaaagaggtccagggtgcctgcttgggttgtggtggtgatcattttgggtacccttttgggtttgattgccttggaaggtggtttgtggatgtggtgttgtaggcacagcacaaggcttggtgtgttgtctgctcagtatgcacttcttgagtatgcttctggtgcacctgtgcagttctcgtacaaggagctccagcaagcgacaaaggggttcaaggagaagcttggagctggtggatttggcgctgtgtatagaggaactcttgttaacaaaacagttgttgctgtgaagcaacttgagggcattgagcaaggtgagaagcagtttaggatggaagttgccaccataagtagcacacatcatctgaatttggtgaggcttattggcttttgctcagaagggcgccaccggcttctggtttatgagttcatgaaaaatgggtctcttgatgattttctattcctgacagaacagcattccggaaaattattgaattgggagtatcgattcaacattgccctgggcactgcaagaggcatcacatacctacatgaggagtgccgtgactgcatagtccattgtgacataaaacctgaaaacatactcctggatgagaattatgttgctaaagtctcagattttggtcttgcaaagctcattaatcctaaggaccaccggcatcggaccttgacaagtgtgagaggaacccgaggatatttagctcccgagtggcttgcaaatcttcccataacttccaaatctgatgtttacggctatggcatggttttgttggagattgtgagtgggaggaggaattttgatgtgtcagaggaaacaaataggaagaagttctccatttgggcttatgaagagtttgagaaaggtaacataagtggaattttggacaaaaggctagctaaccaagaagttgatatggagcaagtaagaagagcaattcaggcaagcttttggtgcatccaagagcagccatctcacagaccaacaatgagcagagtgctacaaatgcttgaaggggtaacagagcctgaaaggccacctgccccaaaatcagtgatggaaggagctgttagtggaaccagcacatacctgagtagcaatgccagtgcattctcagtcggagtttcaccccctggtccctcttcttcatcatcatttcagactagtgctgtttcaaccttcacctcaggaaggaaccttgagaagacaacctcatcccttttacaatcagacacatga

SEQ ID NO: 20045 - DNA, 1314 bp, Glycine max
  Peptide Sequence Number=SeqID_136823
atggaaggacaaacaagtgattcattaagtaaacaacaatgtttggagacaacattaaccaacgagcttcaaaatgtggaacctccagaaatgtatggattcgatatgcaatgcatttatagagtaccaccagccattcgtgaaaataatcccaaagcctacacacctcaaatggtttcaattggcccttttcacaaagcacgtgacgctggaaaggaagacagcatttttgagtcaatggaagatcttaaagtgaagtatctcaaggcatttctaaatcgaacccaagtacctgtgggaacctttgttgacacacttcaaaacttggaagacgaaattcgaaggtgttatgcagtgcatattaaatataacagcgatgatttcttaaagatgattctaattgatgcttgcttcataatcgagcattttttgagatgtcatacatatggagattggcagggaaaggaccctgtgttgctaaaagactggatgcaaatgcaaatttggagggacttgatactactagaaaatcagcttcctttctttgttcttgaacaactttacaacatcgctggtatgaatcaggaatttcccacctttcttcagatttctttcaactgtttgaagcatgtgggatatggaacaacatcgtgtccaacagagtccccaaagcacttcaccgatcttatgagaactagtataatatcgtcatcaaaatttgttcctagagaacaaaaagaatgcaaaggtataaaacatgtatacagtgcaagccaactacgggaggcaggtcttaaattcaaggtcagtccaaatgaaaatgaatgcttacttgacatgacctattccgatgagggtgtgttgacaatgccaatcttgaatataactgacaattcagaagtgttcttcaggaatatattgacatttgaggaatgtcacctttcatatgatacaaacagcattactcaatacctagtgattctaaactttcttatcaacactgaaaaagatgtgaatgtactagttgataacaaaattattgtcaattggatgggtgatgctaacaaagtggctacaatggttaacaatctggactcaaatcttgctgtgccacgttttaattcacactactactctctctgcgatagcttaaatggtttctatgaaaaccctcgcaacaagtacaaggctatattcatacacgagtacttcaacactccttggaaaatagcatctacagttgctgcaattgtagctgaggatttgggcgttaagagggaagtcaattgggggaaggaaacttctgtaatgtga

SEQ ID NO: 20046 - DNA, 162 bp, Glycine max
  Peptide Sequence Number=SeqID_136824
atggttggagatctggagggaaaaacaccattgataacgaagagcagactaacgcacgttgcagttgtaggagacatagtacatgtttgtttttacgacgaagttgtggcagcacaaagtacaaagttgcttcatcgtagaagtaccgatgctcctatttga

SEQ ID NO: 20047 - DNA, 177 bp, Glycine max
  Peptide Sequence Number=SeqID_136825
atggtggggataaagggtggaaaggaagcacaaggggagaatggaagggttggtggaaaagtaattgcggggaaggatcagcggctgctgtttcgacacgtggcatattcagatgtgaccatgtggacacttgctaccccttggcttggtagctggctcagaatatgcaccatgtga

SEQ ID NO: 20048 - DNA, 144 bp, Glycine max
  misc_feature (33)..(33): n is a, c, g, or t
  Peptide Sequence Number=SeqID_136826
atgactgacctgctcgatttctcgggaagggancgaaagccacgtgaccaagaatttggcgttatggctctcagttatttcgtcacaatttttactgcgacttaccattgcatgttttttcgtttaccttgtggtttgacgtga

SEQ ID NO: 20049 - DNA, 651 bp, Glycine max
  Peptide Sequence Number=SeqID_136827
atgtacgcaacgattgagcaagcaaacgccgccgttatcgcccgtatccgcgaggcgcgcccgcactggcaggatgtggatctggcgcaccgcttgatcccgcagctggccgaagggcgcaagctgctgcacgccggcccgccggtcacctggcaagagatgagcggcccggtgcgcggcgcctgcatcggcgcctgcctgttcgaaggctgggcgcaggatgagcagcaggcgctggcgctgctggagcagggggagatcgagttcatcccgtgccacagcgtgagcgcggtggggccgatgggtggcatcacctcggcccacatgccgatggtagtggtcaggaacaccgttcacggcaattacgcctactgcaacatgaacgaaggcatcggcaaggtgatgcgcttcggcgcctacggcgaagacgtgcagcagcgcctgcgctggatgcgcgactcgctggccccggtgctgaaagcggtgttggcgacgctggaggaggggatcgatctgaccgcgctgatggcgcaggcgatcagcatgggggacgaattccaccagcgcaatatcgcggcctcggcgctgctgatgcgcaggctggcgccggagatcagcctgctgccgcgcgataaggcggagctggcacag

SEQ ID NO: 20050 - DNA, 1530 bp, Glycine max
  Peptide Sequence Number=SeqID_136828
atggaaggacaaacaagtgattcattaaatgaacaacaatgtttggagacaaaattaaccaacatgcttcaaaacgtggaacctccagaaatgtatggattcgatatgcaatgcatttatagagtaccaccagacattcgtgaaactaatcccaaagcctacacaccacgaattgtttcaattggcccttttcacaaagcatgttacgctggaaatgaagacagcatttttgagtcaatggaagagcttaaagtgaactatctcaaggcatttctaaatcgaacccaaatacctatgggaacctttgttgtcacacttcaagcgttggaagacaaaattcgaagttgttatgcagtgcgtattaaatataacagcgatgatttcttaaagatgattctcattgatgcttgcttcataattgagttgtttttgagattgcataaatatgaagattggcagggaaaggaccctgtgttgctaaaagactggatgcaaatgcaaattggtgaggacttgagactactagaaaatcagcttcctttcttcgttcttgaacaactttacaaccttgctggtatgaatccggaatttccctcctttcttcagatttctttcaactgtttgaaggttgtggaatatggagcaacatcgtgtccaacagagtccccaaagcacttcaccgatcttatgagaacttgtataatattgtcatcaaaatttgttcttagagaagaagaagaatgtaaaggaataaaacatgtatacaatgcaagccaactacgggaggcaggtcttaaattcaaggtcagtccaaatgaaaatgaatgcttacttgacatgacctattccgatgagggtgtgttgacaatgccaatcttgaatatagctgacgattcagaaatgttcttcaggaatatattggcatttgagcattgtcacctttcagatgatacatgcatcatcactcaatacctaaagattctagattttcttatcgacactgaaaaagatgtgaaagaactaattgataagaaaattattgtcaattggatgggtgatcctaatgcactggctgcaatggttaacagtctgagctcaaatcttgcgatgccacgtttcaatccagtgtatttctctatctgcaatagcttaaatgatttctatgaaagtccttgcaacaagtacaaggctatcttcatacacgagtacttcaacactccttggaaaatagcatctacagttgctgcaattgtgcttcttttgctcacattgattcagactatatgtagtttaggaattgggccgttaacagggaagtcaattgggggaagaaagcatttgatgattgtatttgagtgtctcacaaggttcttaccctatctcttgttctgcaattcttcctctatccctgttcataacattggtgctttcattgtgtgcccatgccagattccacacgtttctaaatccaccttagatagtctcgaagatgccatccaaaaactctcctcctcgcaacttgttggttaa

SEQ ID NO: 20051 - DNA, 156 bp, Glycine max
  Peptide Sequence Number=SeqID_136829
atgggcaaaacattggagcaacgtgagaggttgagagcttggaccaatgaagcaatacgaatgtctgatgacaagctcgagatgaagcagttgagcagaaagggaggaaggagaccaatgattcgattggccaaagcctcaaactccgtgagatag

SEQ ID NO: 20052 - DNA, 420 bp, Glycine max
  Peptide Sequence Number=SeqID_136830
tgttcaatgcttgttgaggatgtttttcgtgtccttcaagactaccctcactctaaagagctttggatgcatgttgcgatgaacattcccagcaacctaacttgcaacaatatcattcctgggatagactgtatgcatggtgttgggaaacaaagcaccaaattggttttgttcttggttcccgcaatcaacctttccttaagcttaatgttgatgggagcgagctttctccttgagggatgcggtgggaatgtggcaattaacggagagttggtgtgtgaatctgataacaagaatattgtcaacctcttgttggaagaacatgagcttcttggaaggaattggagtttcaccctttcttccatttctcgactagatgttaatggtgttgcagacaccttggctcgttggggtacttag

SEQ ID NO: 20053 - DNA, 1122 bp, Glycine max
  Peptide Sequence Number=SeqID_136831
atgagaggaagaggcagagagcttcttagcctctctttttctctaaagcacaaacctttagcaaaatcagcatcaccatcctcttctttctttcgaagtagcatcacattctcaacctcttcctcctccgtagcccctcccatcaaagaaccaaagacttcaacttcgtcatccaagtcacaaagggactcgctgattttcgaacggttcaagcaaagaaaactcaaggggtctccaaaagactcaaagggtacccctcaagtgtgttcaacttcagtgccattaagtttgaatgctgatactgagatggtggttcaaaagggtgtgcagaatgagaatgaccccaccatggtggttggaggtttcaaggagttgggtgtgagtgaggagcttgttgaggtcatggaggggattggtgagtttgaacctagtgagatacagtgtgtggctattcctgctgttttggaagggaagagtgtgctgttgagttcaccatctgaacctggcagaaccttggccttcttgttgcctcttattcagctgctaagacgggacagagagttgcctggttcaaattcaaagcatccacgagccatcgtgctttgcgctacagaggagaaagctgcacagtgctttaatgctgcaaaatatatcatccacaatgtagaattgaagtctgtaaaggatcgtccttccccaggtaatggggagtcacatgcctcaattggcctcatgattggaactccttgtgagattcttgaatacattgaagaggggagtgttgttcctgctgaaataagatacttggtgttggatgaggcagattgcatacttggtggtggccttggtcctgatatccataaaattctgagaccattacaagatcaggaatcaaaatcttctgtcaaaagattacaaactattttggtgatttcagcaatagctgaggttttgggtgaacaatccccaattgtaaagcatcttgagtgcgatcatgccggaaatatttctgcaatgtctctagaaatggaacaaacagaagtctttcatttcacagagtcccttcacgctcttaggaaaaaagtggcagaggccatggattcccttttgaaacaacagtag

SEQ ID NO: 20054 - DNA, 534 bp, Glycine max
  Peptide Sequence Number=SeqID_136832
atgaatctcctaagagaaatgctgcataaaaatatgattcctgatacagtgacgtacagttctcttattgatgatggtttatgcaaaaatcaaaaccttgacaaggcaattgcactattcatgaaaatgaaggaacggggaattcaaccaaataagtacacatacactgcacttattgatggattatgtaaaggtggaagacttaagaaaggacaagcactttttcaacatctcttggttaaaggctattgtatagatgtctggacatatactgtcatgatcagtgggctttgtaaagagggcatgtttgatgaagctttggccatgaagtcaaaaatggaagacaatggttgcatccctaatgctgtaacttttgaaatcattattcgttctcttcttgagaaggatgagaatgataaggccgagaaacttctccatgaaatgattgctaaaggcctattaccttttaggaattttcatagtgaacgatcttcagttacaaataaagttattgtgaattttcatagtgagtga

SEQ ID NO: 20055 - DNA, 2001 bp, Glycine max
  Peptide Sequence Number=SeqID_136833
atggcggctgcaatgatttctgctccggcggtggcaatgagggtggtggttccagctttgaacggtgtgcaatccgggaatgcctctttgtacgttggtgatcttgagaggaacgttgatgaggcgcaactgtttgaactgtttggccaagtaggccaagtggtttcaattagggtttgtagggatctcacaatgcgatctcttggatatgcttacgttaactttgtcaacccccaagatgctgctaatgccatggaacatctgaatttcactcctttgaatggaaaatccatccgtgttatgttttctaaccgagatcctagcattcgaaaaagtggatatgcaaatgtgtttatcaagaaccttgacatatcaatagataacaaggcattacatgacactttttctgcctttggatttgtactctctagtaaggtagccgttgataacaatggtcaatcgaaagggtatggatttgtgcagtttgacaatgaagagtctgcacaaaatgctatcaaaaagttgaatggcatgttgataaatgataaaaaagtctatgttggactctttgttaggcgccaagcaagggctcaagtaaatgaatcaccaaagttcactaatgtgtatgtgaaaaacttttctgaaacatatactgatgaagatcttaagcagctctttagcacctatggtccaataaccagtgttgtggtcatgaaagacacagatgggaagtctagatgttttggttttgtgaattttgaaagtccagattcagcagttgctgccattgaaaggttaaacggaaccgcagtcaatgatgataaggttttatatgtaggtagggctcagcgcaaagccgaaagagaggcagaattgaaagctagatttgagcgggaaagaatgagaaaatatgaaaaattacaaggtgctaatttgtacgtgaaaaatctcgattatagcatcaatgaagaaaacttgaaggagttattttctaagtttggaacaataacatcttgcaaggtgatgcttgaaccaaatgggcatagcaagggctatggttttgttgccttttcaactcccgaggaaggaaataaagcattgaatgaaatgaatggaaagatgattggacgtatgcccctgtatgtagctgtggcccaacgcaaagaagagaggaaggctcttttgcaggctcaattttctcaaatgcaagccctaggtgcaattacaccttttcatgggggaatcccaggatatcatccaggggcaccaagcctttcccctcaacagttgtattttggtcaagggccaaatggtcttgtaccacctcagccaacgggatatggtttccagcagcaactcctgccaaacattcatcctggtgttgctccaaatttctttatgccataccacccacaaagacaggcccctccttcgcaaagaagggatcctcgaagatttggaaatctccaacaggtgcaccataaccagatgttgcatcctaactccaaccaagggtttagatacatggagaatggtcgaaatggaatggatccgtcagtaattccccatggtatggggggtccaatgatgccattgccctttgatggttctggaatttctgcagttcatacttataatcaatatcatgctggtgcatcgtctaacacacttgcctcggctctagcttctgctaccccagaaaatcagcacctgatgctaggtgaacatttatacccacttgtggatggacttactgcaaatcaccagcagactgcaaaggtgacaggaatgttgttggaaatggaccagtcagaggtcatccatctgatggagtctcccgaggacttgaaaataaaggtgtctgaggcaatgctggcccttcgtgaagctgcaccaggttctgaagaagttgctggttctgaagaagttggcggttctgaagaagttggtggttctgaagaagttggtgatcaacttggctcactatcattgaatgaatga

SEQ ID NO: 20056 - DNA, 1231 bp, Glycine max
  Peptide Sequence Number=SeqID_136834
atgtcattctcattctcattgtcaagaaggttaagctcttctctctctctttccattcccaactttcctcctttccttccaaaccccactttccctctttgctttcactctcagcctccatccattgacaatgttgttgatgatgttgtttcccagttcgacgacatgctccttctgcgtcatatcccacccattatcgaatttggcaagattttaggatcccttgtgaagatgaagcattatcccactgtcatttccctttctaaacaaatggaagctaaaggaattgtgccagatcttgttactttgagcatcctcatcaattgtttctgccacttgggccaaatggccttttctttttctgtattgggcaaaattctaaaattaggttatcagccgaataccataatcttgaatacactcatgaaaggtctctgtctcaagggtgaggtcaagaaatcactgcactttcatgacaaggtcgtagcacaaggatttcagatggatcaggttagttacgggatcctactcaatggactatgtaaaataggagaaacgagatgcgccatcaagttgctgagaacgattgaagacagatcaactaggcctgatgtggtaatgtacagcaccatcattgatggcttatgcaaagataaacttgtagacgaggcttatgatctttattctgaaatgaatgctaggggaatttttcctgatgttataacttacactactctaatttgtggcttttgccttgcgggtcagttaatggaagcatttggtttattaaatgaaatgatattgaagaacatcaacccgaatatttatacctataatacattgattgatacattatgtaaagaaggaaaggtgaaagaaagcaaaaatttattagctgtgatgacgaaaaaaggggtaaaacctgatgttgttatttatagtattttaatggaggggtattgtttagttggtgaagtgcagaatgcaaaacagatattcctcgctatggtccaaacaggagtaaatcctgatgtttacagctacagtataatgattcatggattatttaagagtaaaagggtggatgaggccatgaatctcctaagagaaatgctgcataaaaatatggttcctaatgcagtgacgtataattctcttattgatgatttgtgtaaatcagggagacttacttatgctttagatcttatggagaaggagatgcacccgagag

SEQ ID NO: 20057 - DNA, 927 bp, Glycine max
  Peptide Sequence Number=SeqID_136835
atggcgacgacaggttataaaatctgggtacacggcagggtgcagggcgtgggcttccgttattacacccaggcgcaggcgaacgcgctgggcgtcaccggctatgcgcataatctggccgatggcagcgtggaggtgctggcggcaggagaagcacagcaggtggagtcactgattgcatggctgaaggcgggcggaccgcccagtgcccgggtggataaggccggcgatttttgtggcctgtttggccggaccttccgggaacaggcgaaacagatagcggctgttgcctttctcttcgccatatttttgcgccatggctttgaccagcatgcgcaccgccggcgagtcgcggttggcgaagcccagcaggctcagcaggctgacaaagatgttgtacagcgagacatacaggctgacggtggcgcgaatgtagttggtttcaccgccctgaatgatgttgctggtttcccacaaaatggcaccggcagagaacagaataaacagggcgctgatcgccaggtgcagcgcgggcagctgcaggaagatattggcaaccacggccaccagcagcaccacaaagccggccatcatcatgccgccaaggaaagacatgtcgcgacgcgtggtcaggacataggcggaacagcagaagaacaccagcgcggtaccgcccagcgccatggcgataacatcacccataccggcggtgaggaacgagctgagaatcgggccgaggcagtaaccaaggaagccggtaaaggcaaacgcggccagaatacccgccggactgttcgccaggcgataggtcaggaacatcaatccgtaaaagcccaccagcatcagaatcagtcccggcgagggcagggcgtagacggtgctgagcgtggcggtgacggcggaaaacgccagcgtcaggccaagtaa

SEQ ID NO: 20058 - DNA, 621 bp, Glycine max
  Peptide Sequence Number=SeqID_136836
atggtagaaaaacagtctacactagacatcatggtttacttaattgttcatctgggtagagaaatcaaatgttgtggtcctgtttatttgcgatggatgtactcggttgagcaatacatgaagatcttaaaagggtatacgaagaatctacatcgtccagaaacatctattgttgaaaggtacattgcaaaaaaaaccattgaattttgttcagagtacattgaaaaagctaacttgttgggcttctcgagtctcgccatgacgatagagtgggcgcatgaaagtttagtcaaagaaggtaatcgaaaaatgtcaaagaactgggtcttgaaaaggcataacaagactttccttgattggtttaaagatataatatttgctgatgaaaatgcttctgaaacattaagaaagctagcagatggacctaaaagaaatgttataacttggcaaggatacgacataaacaagtattccttttatacaaaagcacaagacgagaaaagtacaatacaaaacactggggtcaccctaagggctgaatctcaacacttcgccagtgtacatgatgacaatccctgtgtagcttccatcccttactttgggttcattgaagaaatttag

SEQ ID NO: 20059 - DNA, 666 bp, Glycine max
  Peptide Sequence Number=SeqID_136837
atgaaggtcgatatggaggccttaaaggatcaagtggcttccatgatggaagccatgttgagcatgaagagaataatggaaagcaacacggtcgcaattgccgtcgccagtgccaccgtcgaggcagatcctacccattcgcatgccacaaaccaagcacaccaacccaccccggacatggtgggacaaggaggagaggtgttgggcagcaccggtggtccactcattgggtataataggaatgcttatccctatggcttaccccccaattatatgccgcccaccgtgcacatgcccaacgagaacgctaatcatgttgttcccgttacctttgagggtcagcaaccccagcctataggaggcgcccatgaagaacctcaggagcctgctcaagggggcccgcctccagcagtggaagggagagagaaacttgatctcctcgaaaagagattaagggctgtcaaagggtttggtgattaccctttttccgacatgacaaaattgtgtttggtacctgatgttgtcatccctccaaagttcaagggacgagaaactgctaatgcatttcttccaagaaagcttggtcggggcggcggttatctagtataccaatttggaagcttctcgcatccgctcatggaaagacttgattattaccatcattag

SEQ ID NO: 20060 - DNA, 794 bp, Glycine max
  Peptide Sequence Number=SeqID_136838
atggaggtagggaaatttatcagatgggacataatagcagtcaagcagctttcttcaaaatcaaggcaagggaacctcgagtttctaatcgagttaggcatgatttcagctttgcaacacccttgtcttgttaaactctatggctgttgtgtcgagggagatcagttgttgttggtatacgaatatatggaaaacaatagccttgctcgtgctttgtttgtttccatttttttcactaatgaaggtccagcagaataccacataaaattggattggccaacaaggcaaaagatatgtgttggtattgctagagccaagctagatgaagaggacaatacccacataagcacccgaattgctggaacttatggatacatggctcctgagtatgctatgcatggatatttgacagacaaagcagacgtttatagcttcggagttgttgccttggaaattgttagtgggcggagcaatatgattcaaccgcagaaagaagaagcattccatcttcttgattgcgcacatatgttgaaagggaaaggtaatctgatggagctagttgatagaagattgggtttggacttctacaaaaacgaggttacagcgaagatcaacgtgtctcttttatgcaccaatgtcactccctccctcaggccaacaatgtccttagtggtaagcatgcttgaaggtagatctgtggttcaggaggtgttttcggagtcaagtgaggcattggatgagaagaagttggaggcgatgcaacagcgttaccaagagataatagaagaaaataa

SEQ ID NO: 20061 - DNA, 270 bp, Glycine max
  Peptide Sequence Number=SeqID_136839
atggttatgacaaatgggagatttttgagcgtgagacacagggccatgaccaactcacacaagtctagaatgtcggtggcatattttggtggtccaccacttgatgcatgcattgttgctcccccagttatggttacatccaagaggccctccctcctcttcaagccattcacttgggctgaatacaagaaagtcacctattctatgaagcttggagaacgccgcattgactttttcaggaagtgcactacgcagcagcaaatagagtaa

SEQ ID NO: 20062 - DNA, 354 bp, Glycine max
  Peptide Sequence Number=SeqID_136840
atgcgtccaaacagcagcaccagcagcagcagcgctaaacaggcgacccccaccgagcggtgcaacaacctcgttgaaaagcaattgtggcaacatctacagtacaatctcgaagttgtgattgggtgcaaaccgaaattattggagcctataaaatttttgattagtgcatggatcgatcgccatattgttgttcaactgtgctataaatgtggtggcaatggcaattgtaattgcaactacaactacaatggccaagttgcaagtggcaaagtgcttgcttgctggttcgctggttggctggctggttggctggttggctggttggctgcctgcattttcatgcgaccttga

SEQ ID NO: 20063 - DNA, 285 bp, Glycine max
  Peptide Sequence Number=SeqID_136841
atgttgccacaattgcttttcaacgaggttgttgcaccgctcggtgggggtcgcctgtttagcgctgctgctgctggtgctgctgtttggacgcatacttgggtaggggctgcatttttgttagtgccacagaaagtggcacgcgcttggtcgctcggtcactgtacggttgggtcagcgtttgggttgctcgaaggtgagggcgatggagtgcctgacggggaggagcaaacctatgtaggtgctcatttcatgcgcagcgccagcggagcgcataaagcatga

SEQ ID NO: 20064 - DNA, 234 bp, Glycine max
  Peptide Sequence Number=SeqID_136842
atgacttctcttctgcttatctcgatagacctgtctgtaaagcagggtacatatagatcaagcaccttatacaaagcatcgtgcaacgtttcattcacagttgccgaactatggataagtacgacctacatctcctcaactttggcaagagttcaagtcgtttctgaagacgttgctctgctttctgctggcattgttgttgctgcctttgttgctgttgtcatttctatgtga

SEQ ID NO: 20065 - DNA, 208 bp, Glycine max
  Peptide Sequence Number=SeqID_136843
cggcatatggctgcttgatccgttcgaaacagcagggtccctccacctgcagcagaaagtgaaagatgcctgcattcttgggagtgtcgatcatgctgcgtatctttttcgaattggatattgtcagattgggatacttgatgctcagcacgtagttggccagctcgttgccgaagtgggcgcctggaagagcgaagggagagcatga

SEQ ID NO: 20066 - DNA, 1030 bp, Glycine max
  Peptide Sequence Number=SeqID_136844
cggtttcagtatcaataaccatgttctgctcagcacccacaagtatcgcggccgtgcggtcaacgaatcgaacattcaggagtatgtaagcgaattggctaccaaatacataccctccgacctaccacaatggcaggtgatcgtcatacctaccacattagcaaatacctcgacttcggaaggagagtcgccagaagcgaattcttcaccggagagatattacattttggtaaaagtgcatcatttgataattgcggaggaggatgacttgcatgttagtgaaatgctccagctgcaggacacagagcgacgtgctgtgcttgatatggaggagctagatcagccacctagtcatcaactttctcactttgtgcgtcagccacagcacattcgtaagctggtgaagcgcttggtgcgtctcgtcgtctgccgctggcaacagttcatctacgaatttgaatcgctggaaacccccgatggatatacccgcgttcaggtgcgcgatcttagccagctgttgtcgttagccctgattgtcatcgtgaatgtggtgctgggctataggcatacgatggatatgcgtaggaagatgcagcgaagattcagtggctatcgcaatggcatgggtcgtttgcagaccattcaagcgattttaagacgtgagtgtgagcagagaaatctcaattgggagttggcaacagcagcgttgagccacagcctacagccagccaacatcgcaaaggcgtggaccaagtttgtgtggcgccttaatatgaacaatgtgctattgttgccctatcacatttactgcgagctaatggctctttgggatgtttgctttcgcggacgcaccaatttcacggacacctattgcgctcgactacatctctatgtcccgctgctactctacgcgcagctggagctgctgaagatctgctatgagttgttcaaggcacctagaaacatttacgaagtgctgtttgtgcagcctacgcgggagctcaacattctgcacaagaatcctatgcgg

SEQ ID NO: 20067 - DNA, 315 bp, Glycine max
  Peptide Sequence Number=SeqID_136845
atggaggcaattcagaatttaagttcaacaaagaagcttacatcctgtcgtaacctaccctacgacggaagtgtgggcgaaaagttaaaggagcgtctttcaaaaaggaaaacgcgcgagagtcgccaccaacgtttatttgaggaaaacactagaaaaaccaaaaagaggtatgcggattttgaaaataagggttcgggagttgtttgcgcatcgggaagattcattttaattgcgaacaaaaagtcgtttaaggcgagctggttacttaacatggaagtcttttggtggcccaagctagcttgggtgagctag

SEQ ID NO: 20068 - DNA, 1386 bp, Glycine max
  Peptide Sequence Number=SeqID_136846
atggatgaagccagacctatggctacccctattcatccatctactatcatttacaaagatgagaaaggtaatgatactctaaagaaggagtacagagcgtctcatgttattacagttaaaagaattttgagatattttgttggaactacgaagcatggcctatggtttgagaaagggtatgagtttgatcttgtaggatattgtgatgttgattttgttgatgataaggctgtgaagaaggtggtctatgaaagatacattgatatcttaaaaatcaaggagaatgtgaatgaaccaatctacctaaggctagtaagagctttctttgttgcaactgaggtggataacaacaacttcacattgaaggctacactaaaaggaactgagattttgatcttggaacaactcctagcaattatgttgggagttcttgttgatagctcaaggctctatgatgattggtttgaaatggtggggctcagaaagaagaagattcaaaagaagttcctagagtataaagatgaatacctcaagaaaatccctctcagtctaccctatctgatcatcaaccatattatcaaagcaaccaagcctatgtctatggaggataaaccaagggatgatgagaagagattgaatactaggattggtaaaagtcctcagtccaagttagatgaggtgaaggagacctcagaaaatgaagaagagaatgagattgtctcctttccagttgctaaagcatctgcctcaaaaaaggagttttctgagcagattgagaaggttgttgaagaggaaaaaaccattttgagggtgctaagaatgaggaagaaaaggaagcatccccttctagagaaagaccattttaaggagccattggattttggttccttttatgatgcctcagaacatcattctgagggggagaataaggacaaggaagatcattttgagcctcagaatgaagattctatagttgataaagggactcagaaagctgaagttcagcaaaacaaagacatccatccttctgagggtgtggaagttgttgaatctcataatcctttgagttatgcacctgcacaggatgatctcaatgttgatattattgtagatgtgttgcccaagctaagaactattgattctagcacagaaaaggtttatgaggagattccacatgtccatcttcccactcctcctactgttgttggatcttcttcaaggtcaattgaagtcaaattgacttccatggagaagcaacaatggctagcaaagctaaaatcaagtggtgttgctggtctagttgaggttaggattgaagtccagttggggaacaacaaggtgttgaaatccagtagttgttgctctagttatgactgggagtgttag

SEQ ID NO: 20069 - DNA, 321 bp, Glycine max
  Peptide Sequence Number=SeqID_136847
atggctgggaattatttaggtggcactatagtggcagctgtgagcctcttaaaggaacgtggagttggcaacaagcagattaaagtgatatctgctgtctctgcccctccagctcttcaaaagctgagcgaacagttccctgggcttcatgtgtatactggaataattgaccccgaagttaatgaaaaagggttggtgttccacgatattacaatttatttatgcaataattttttttttaattccttaaccagtgtcatctggttcataattcctggccttggagatgctggggaccgcagctttggtacagatacatga

SEQ ID NO: 20070 - DNA, 477 bp, Glycine max
  Peptide Sequence Number=SeqID_136848
atgtgcgaaaatgtgaaaggtgccaaaaatgtcgtgacatacaacatgcaccagcaaatgaattgcaccacttggcatctccatggccattactttggtgggggattgatatacaagggcatttaccataagctctgggacaaccatgtgtcataccctaatttcatccggggactattatttgatggtatgcaacctttgtttgaccgcttcgaggtacttggcaccctttgtcacaccatacgtgaagttccgagacatgccggaaatcaaaaggaagtattgttacacaattcggtgcaaatagcaaccaggcccacttgggccttccagattcttcctccagaaggcggttgcttttggaggaagcaacctggctcgcctgggcgagctgagctcgcttgggcaagctgggtgattttcaaccgttcttcatcgttcgtcgttcgttcttcgtcgttcttcggtcttcaaccg

SEQ ID NO: 20071 - DNA, 276 bp, Glycine max
  Peptide Sequence Number=SeqID_136849
atggattatgagcccataaccaaaactcagtccaaggtaatgctcactgagttggattatagagaagatatcaggaaagcgacatgggtagtagaagacgaaggagacccactggtaaagaaaaagtgtgcagaaaatgagttgagcaaatcaaaatcggaaattccaccgaagtctagaaagagagatcttcgatcattgtcgtcacaaatatggaggaagaggtggattctgatgaagatatccctttcaacatgtcggtttcaaaacgcttag

SEQ ID NO: 20072 - DNA, 360 bp, Glycine max
  Peptide Sequence Number=SeqID_136850
atggcaatcaagatttctcttgcatgcctttttcgagcattgtttgaagcacccctgctgatgaatcctctttcaatgacatatatcacctcatgctctaagctaaggggaatttgtcttgtctcaggagaatttgccttgtgtctcaacttggatccatcacgatatagtgttctttggagcgacctcttctttgatgtcaatcaagacttcttaatatttcttgctgctcatcgcaaggggttgatcatatcaaggaactcctccaaggtatttggtaacatttttgaaatggatacaaagaaagaagatccttccctcacaccatccttagtcgacatcagtgactcccagttgtag

SEQ ID NO: 20073 - DNA, 204 bp, Glycine max
  Peptide Sequence Number=SeqID_136851
atggaacttttgcaaaatggccacaaaaatttcgtcagcatcaaaccctccgagttacccctcacgaatggggcagcgttaactctcctcaactcgctctccaaaactcagtacttgggcaacatagatccttccagagtttttgtcaccaaagttaagcgtatcattgtaaagaaatcaaactcaagtaggttgagtttataa

SEQ ID NO: 20074 - DNA, 2046 bp, Glycine max
  Peptide Sequence Number=SeqID_136852
gttggaacagctgttgttactcgaagtgatggaagattagcattgggcagaattggagcactatgtgagcagcttaaagaactaagcagtcaagggtatgaagtcatattggtaacttcaggtgctgttggtcttggcaggcaaaggcttagatatcgcaaattggccaatagcagcttttctgatcttcaaaagccacaagaagagcttgatggaaaagcatgtgcggctgttgggcagagtagtctcatggctctctatgataccatgttcagccagcttgatgtgacttcttcccaacttcttgtgaatgatgggttcttcagggattctggcttcagaaaacaactttcagacacagtgaactcattgttggatttaagggttatccccattttcaatgaaaatgatgctgttagtactaggaaggcaccatatgaggattcttccggtattttctgggacaatgatagtttggctggtctattagcccttgaacttaaagctgacctccttgttttattgagtgatgttgaggggctctatagtggtcctccaagtgacccaaactcaaggttgatccatacatatataaaagagaaacatcaaggggaaattacttttggagacaagtcaagattgggcagagggggtatgactgctaaagttaatgctgctgtttgcgctgctcatgctggcatcccggtcattataactagtggctatgctacaaacaacatcatacgagtgcttcaaggggaaagaataggtactgtctttcataaggacgctcatttatggaccaatataaaggaagtaagtgcacgtgaaatggcagttgcagcacgtgagggttctagacggcttcagatcctcaaatctgaagaaaggaggaaaatattgctggcaattgctgatgcattggagacaagtgaaagtatgataaggcatgagaatgaagctgatgttgctgatgctatctctagtcttgcaaagtctgtgcgcatgctggcagatatggaagaaccaattggtcaaattttaaaaaggactgagctagtagataaactcatcctggagaagatatcatgtcctttgggtgtccttctggttatatttgagtctcgacctgatgcccttgttcagatagctgcattggcaattcgaagtgggaatggtttactgcttaaaggtggaaaggaagcccgacgatcaaatgcaatcttacacaaggtcattacttcagtgatgccggatactgttggtgacaaacttattgggcttgtgacttcaagagatgagattctagacctacttaagcttgatgatgtaatagatctagtggtccctagaggcagtaataagcttgtttctcaaatcaaggaatcaacaaaaattcctgttcttggtcatgctgatggaatttgtcatgtatatgttgacaagtctgctaatattgatatggcaaagcagattgttagggatgcaaagaccgattatcctgcagcttgcaatgcgatggaaactcttctcgtacacaaggatctgtcaaataatggtggacttcatgagcttgtccttgaactccaacgtgaaggtgttaaaatgtttggtggaccaagagccagtggcttactaaacattgcagaaacgaacacttttcatcatgagtatagttcacttgcttgcacagttgaaattgtagaagatgtatttgctgccattgaccacataaatcaacatggaaggcatgttggtgctcatactgaatgcattgttacagaagatagtgaagttgctgagactttcttaagtcaagttgacagtgctgctgtattccacaatgcaagtacacggttttgtgatggagcacgctttgggcttggcgcagaggttggaattagtacaagtcgaattcatgctcgaggtcctgtaggagttgaggggttgttgacaaacagatggatattgagagggagtgggcatgtggttgatggagatcaagggatcaattacacttacaaagagttgccactaaaagcataa

SEQ ID NO: 20075 - DNA, 366 bp, Glycine max
  Peptide Sequence Number=SeqID_136853
atgccttttctttccctcattttcgttttccctcttctcctccccaaaaccctttctttttcccacaacccacacaacctgtctcagaaaaacgatgatctcggactcgttcaccgttggattgtcgtgaaatttgagtaccacgtttgcaactcaatttcgagaaataccaccgtcgggaattccaaaatcatgcctgatcttagaggagaacccttcgcattgcagccttttattttcccgcagaaacccaaaactgtctcggtaaaactacgatcccagtttcataaaccgttggattttcatgaaatttggatatgttgttcgaaattcaattgctcacactttcaccgttgggatttgtga

SEQ ID NO: 20076 - DNA, 1125 bp, Glycine max
  Peptide Sequence Number=SeqID_136854
atggatgttccaaccaataaccaagctcattggaagaaaattgaaatctctttatatagtgtcccatggttctttcttgcccttaatcttcaatcacagaaccaggattttacaaccagttatgatgtgtggaccaaggccaagaaagtttattccaatgatgtccatcacttctatggtgtactgaccagcctaatgaacattaagctgaagaacatggacatgcaaacatactttggtaagctagaccgtttaattgtggaatattccactcttatgccctttacgattgatgcaaagacattttacaaacaacacaaacaattctttatggtggttgctcttgctggactcacattggaccttgaggcaactcgtaatcagattttattgaatcccatgttgttccatctctccattccacatacctttggaccttcttccatgtctaccggggattcctctgcctttgtctctcactcctttcattgtagaggacatggtggtggtggtgaacatggtgaacgtagtgaaggacatggtgttcactctcactacttcaagaactggggtcatgttgaagcaaattgtcgcatcaaagccagagaactatctcgattagttaatatgcttggtaatcctatagcctttgtttctcagtcctcttcccttggaccttggattcttgattctgatgcctttgatcatatgattgtctctattgatgttccattctttgagactactcttttcttttcttccactgttgacgatgtccctttagaggttccacctattattccagtgccattggttgctcctgctccacctctacttcttgtataccaccaacggatacaagtagcactggcaacactacccactaatcctcaagcatcacctcttgctccaaatgcccaaacactcttccaccaccatcacctgcacctgaatttcccattactctatgcaaagatcgcacctgatggcacaattgatcactacaaagctcgtctgttggctaagggctatactcaaatttttggtcttgattatggcgacactttttgtcctatggccaaaatcacctttgctcatctttttcttgatatggccaccatttga

SEQ ID NO: 20077 - DNA, 522 bp, Glycine max
  Peptide Sequence Number=SeqID_136855
atgttcaaactttccaaaacccttagtggaccaaagctcatcattatacaagttctgaaagcttttccttacaaggataataaagcagtgccttggagatatgaagtcaaagtgtgtattgatggttttgatgagaaatttgaaggtattgttggtaatgtcacggcaagcaattaccttacgttcactgatgaagagatgctagcaaaaggagcagggcataataaagccctacatatatcagtgaaatgcatggaccatgtcttggctagagttctagttgataatggttcctcgttgaatgtcatgccaaagacaacattggcaaaactaccatctgatgagtcacacatgaagccaagcactatggtagtatgtgctttcaataggtctcatagagaagtgattggggaaataagtctgcctatccagattggtttcattacctttgaggtagtatttcatgtgatggaaattgcgcttgtaacgacccgcctcgtcactacaatgtcactactctaa

SEQ ID NO: 20078 - DNA, 276 bp, Glycine max
  Peptide Sequence Number=SeqID_136856
atggctctctacaaagctctgtatgaaagaaggtgtaggacacctctgtgctggctagaacctagagagaacctcaccttagggtctgaagtggtacaacaaaccactgagaaggtcaagttaatccaagaaaggatgaggattgctcagagtaggcggaaaaacaatcaggacaagaggaggaaagacctgaaattcgaggttcagaacccaggtcctcatgctttgaccgttgggatttgcagaataacactttgggacatctcgcttagctag

SEQ ID NO: 20079 - DNA, 243 bp, Glycine max
  Peptide Sequence Number=SeqID_136857
atgtctaaagaaacctggaaccagtgtggggatcatgttcgagggcttcctcagtgttgtgttgggccacaccaccatgaattccatgttggacccaacgaatctcttgagtcccttaatgataacaacaatgacaatgatgttatcgatggtgaaggtgctcaacatgttggtcaacaacaacaatcaataagttgtgatcatcctagaccaagagaagtaaaaactcattcgagaagatga

SEQ ID NO: 20080 - DNA, 153 bp, Glycine max
  Peptide Sequence Number=SeqID_136858
atggcattttcggaggggcagaaggttgcttttggtacatatactctggtggaaaaagctaagtattggtgggaaaacactcaccaatgcttggaggaacaagaaagagatggagttcctagagctcaagcaggggaacatgactgtggctga

SEQ ID NO: 20081 - DNA, 432 bp, Glycine max
  Peptide Sequence Number=SeqID_136859
atgtcaggcttgagttcaggagttgaatacattttccaagtacattctgggcatgtagcaagtgtcgggttgattctgggcttgaatgttggtattgggtcgttttcgggattgaatgatggtgttgagtcggctccggccttgcctactggtgttggactcgattgttgctgtcgggtcgattatgggcttaactgttggtgtcgggtcaattccaggctttggctaccggtgccaagtcgattatgggctttgactgctggtgctgggtcggttacgggctttgaagatggaatattgatgttaggcaacttggtcattgaaactgaaatgattgtgcctggtaagtactggcttgaagagaaagggcaaggggctaggtctaagaaaaaattagaggcttcacggactaagaagttcaaatgggaatga

SEQ ID NO: 20082 - DNA, 1554 bp, Glycine max
  Peptide Sequence Number=SeqID_136860
atggctgaagaggatagggagaaaaccacattcatcacgccttggggcaccttttgttataagatcatgccgtttgggttgaagaatccaaatgcagaagatcatgtaatccatatgcagaaattgtttgagcggctacggaagttcaaactatggctaaatctagccaaatgcacttttggcgtcaaatctgacaaattattaggtttcatcgtcagccaaagaggaattgaaatggatcctgacaaagttcatgcaatcttggaaatgccacccctcgcacgaaaaatgagatttgaggtttcttgggaagttgctggaagacccctcataatgtatctaacaatgcttgatggatctatgggttgtgtattagggcaacatgatgattctggaagaaaagagcatgctatatactatttaagcaagaagttcactggttgtgaaaccagatattcatttttagagcgaacttgttgtgctttgtcattgctgaaggcactatatgctaagtcacacaacttggttgttaaaggtagtgctctggcagattatctagtacaccaacctgttgaagattatcagtcaatgcaatgtgaattcccggatgaaggcataatggcgttgtttaacaacaaagattcgtcaaaaggaagaggatggatcatatggtttaatggtgcttccaacatcatggaccacgagataggagttatattactctccctagagaagcagtatatcctaatcatggctaggatatgctttaattgtaccaacaatatatcaaagtatgaggcatgcattttggggttacagctaactccttaccaaacccacattaaggaattggttaaacaatttgaagaaatcacattcgagcacattcctcgtgaagataaccaattggtagatgcactagccactttatcatccatgtttgcattgagcaatgatgagggcatgccacttataaggatccaacgtcatgatcagcctgcatattgtcgcttagtagaagaggaatctgatgggaaaccatggaaatgtcacaagtgccagacatatgctgataatatcaatgttctaccaatgtcattgaatgtactatcatctccttggcctttttctatgtggggaatggatgtcattgggcccatagaacccaaagcgtcaaatgggcatcacttcattctagtagcaattgattatttcactaaatgggttgaagttgtttcatatgtcagggtaactcgaaatgtgatagagaaattcatcaagaaagaattgatttgtcgctatggcataccaagcaaactcatcaccgacaatgcaactaatttgaacaataagatgatgacaaagttgtttgttggcttcaagagtcaacatcataattctatcctatatcatccaaagatgaatgggatagttgaagtggccaagaagcacaacaaaaagatcattcagaagatggcagcagtccttccaattgaggttgaaatcccttccttaagagtattaatggaggtcgagttacaagaagcagaatag

SEQ ID NO: 20083 - DNA, 291 bp, Glycine max
  Peptide Sequence Number=SeqID_136861
atgtcgtgctcaacgcatatcccaacccaagaggaaatttgctcagcaccaaaggctgcgctcaccgtaattcccaacaaaaaaggaaattcactcagtgtgagatgttgcgctcagcgcaagaggccgaactcagtgccaaaagtggatttccatgatcagtgcattgatgtttttcatgagagaaaatacttgtacttgggggcatgtcactcagtttggaactcccttgtgacttacgttgatcaccatgggatgggggatgggagttgcctatgcatgacagggtga

SEQ ID NO: 20084 - DNA, 360 bp, Glycine max
  Peptide Sequence Number=SeqID_136862
atggataatttgctatgtgatgaggtgtggctttcaaagtctgcaaatacttttgaagaagttattagtgaccctgttgcactaaagagttatgaaaatgaagagtttgaagaggcttttgcagtgtgtctagagaaggaggtcttgtgcttgcccgaacctgactatacaaagtacttacactccaacaatttgatttttcctaggtgtagagttattcaatggtttatcaaggattgggaatactggatgcttgaattgctttctattgcatgcttatcaattgccataaagttcaatgagatatcaggactttcgttgcatgaaattcagggttatatagaagcacttataggataa

SEQ ID NO: 20085 - DNA, 378 bp, Glycine max
  Peptide Sequence Number=SeqID_136863
atgtcaattagctggaagcctccggaggaagggaagtttaaattgaactgtgacggtgtggtgaccggggatggcaatgcgtcttgtgggggagtgagtggtcagagaccattgtggtgggtggcttggtcgagaggtttcactagtttgagtatggagtctgattcgaaggtcactatttctaggttagaagggcaatgtgattcaagacatggatgttatcaactagtgcaagctatcaaagagcacaccaacagaggaggtaattattcatgggcacatatcttaagagaggccaaccaagtggctgactcgactttcttctcatggagagggacatattttcgattttcttgtcttcttatgttcagctcataa

SEQ ID NO: 20086 - DNA, 174 bp, Glycine max
  Peptide Sequence Number=SeqID_136864
atgcaacaacttgaaggttacctcgaagaatccataagcttggtggtcgccactggccgcagaacgttttatggatttcgggatatgaggcttttaggtatatataatagaaaattgctggcaatggagctatgcaaaggaggatttacattactatgctttactggatattaa

SEQ ID NO: 20087 - DNA, 252 bp, Glycine max
  Peptide Sequence Number=SeqID_136865
atgttagtgaaaaacctcatcaggcgcctaggagtacatgataagacaaaccacacactagtaagtcaggtcactctcacttggcttaaaggagcactcaaaccgggtgtatttacccccaaggcctacactccgaagagtccgtcagggcctctccctcctgattcaggtccaacccagaaaacatttagcacgcatactctatctatgaattgtacaaaacacacgactcctcaattgttctcaaaataa

SEQ ID NO: 20088 - DNA, 270 bp, Glycine max
  Peptide Sequence Number=SeqID_136866
atgagaggctccatacatgagcctcaagcacacctaggggcagatcagaagttctcacccggcgttctaggggttgttttaagggttccaaggtcagaaattgagggaattaagagaggagataaagaagaaaaagaagaaagaagaggaaacgaggccgaggagctaccgaattacgaccgtaatcgatttctacatcgttcttcgttcatcatccgacttaaagaactacataggtctgaattcctcatcgcacctgaggatacgtag

SEQ ID NO: 20089 - DNA, 907 bp, Glycine max
  Peptide Sequence Number=SeqID_136867
aatgctccaaccatatgggatcggcacaggcttaaaggagcactcaaatcgggtgtatttacccccaaggcctacactccgaagagtccgtcagggcccctccctcctgattcaggccgggtttggttcaaacattccaagagatattgggtatacaacaatttcaagaagaaatttggtggtggcacattgttaagaagcttgatgatgggggctgccaaggcaacttatgtagaggcaagggattctaaaattcaacaaattaaggagattagtagagaagcttatgactacacaattttggttgctagagataagcccttattgacaatgtgtgatttgattcgaaagtatgtaatgaggaggtttgcaaatttaagggagaaagtggatagaatccaaggcaatgccatgccaaaaccaaaaatgaggctagaatttgaaaaagaaaagagtgggaattggtttgctacattggctggaaattttcattttgaggtggcacactcaatgtcacctaataagtttattgtggatttgcaacgttggtcatgtacctacaatttctgggatgtaacaagaattccttgcaaacatgcggtggctgccatcaattacaactgtcctactcattggccaataattgatgacgaagacttgcaaccacctgagtattgcagaggtcctggacgtcctaagaagctcagaagaagagagctagatgaagctcctaagcaaccaaatttagaaggattggcacaaatcggccatattgttagaaaatgtccacttccaacaccaccaccaccaccagaaccagagttgatagatgaacctgcagcagaaactcaagtagatcaatatgagatggttaatctgtcccaaaataaccatgttgctgaaacag

SEQ ID NO: 20090 - DNA, 312 bp, Glycine max
  misc_feature (14)..(14): n is a, c, g, or t
  misc_feature (55)..(55): n is a, c, g, or t
  Peptide Sequence Number=SeqID_136868
atgttcccattttntagatactccggggaacagatatccagtggagatgacgggntggggcctgtagctcagaggattagagcacgtggctacgaaccacggtgtcgggggttcgaatccctcctcgcccacaaccggccaaaaaagggaaggatttttccctctgggggtaggaaaatcatgatcgggctagcggacccaaagctatggaacttccccggactgtggaacaaaggagtatcccgaacctacaccgaggtattgacggcgattctcaaatatcgcagaacagaacagaatgggatacgatga

SEQ ID NO: 20091 - DNA, 246 bp, Glycine max
  Peptide Sequence Number=SeqID_136869
atggggtgttggagtaccgaggaaatgtttggaagcaaaagcaagagtcttggcagggggttgcatcaattacaatctcgtcctcgctataagacaacttggctatcctatgagaggggcaccacaagaggaaaacctcgcacctattattgcacgaggtttcaatatcaccaacgcggaggcactttagaaggtccgcaaggcatgggagataatgcaaaagaaggacaaggaactcagaggtag

SEQ ID NO: 20092 - DNA, 1341 bp, Glycine max
  Peptide Sequence Number=SeqID_136870
atggggcgggcatgtcagcaattgtgtcatgcactcgtggctgtcggaatcacgacattcgtggctatcgatcgggcgaatccatcgcgcccgatcgattggaggctgctgtcagtcctggcgcgcgggcagcaccgtggcgcggcactcgccgaagccgatgcgcgcggcgcccggcttctcgcaccagccgcgcaggatcacggcatcgccatcctgcaggaaggtgcggctctcgccattggccagcgccacgggcttcttgccgccttcggtcagctccagcagagcgccggcctcggtggccgtggggccggacagcgtgcccgtgcccagcaggtcaccgggctgcaggtcgcagccgttgacgctgtggtgggccaccagctgggccatggtccagtaggcgtggcggtagctggtgtgggtgatctgctgggcggcctggccttcggcgcgcatgcggccggtctccagcgccacgctcagctgcacgtcgaacgcgccgcgctcggaattggcggacgagctgaggtagggcaagggctggggatctgcggcgggccgcgtgaacgccgtgcgatagggctccagcgcctccagcgtcacgatccagggcgagaccgtggtggcgaagttcttcgacaggaaggggcccagcggctggtattcccaggcctggatgtcgcgcgccgaccagtcgttcaggatgcacaggccgaacacgtgcgcatcggcgtccgccagcttgatgcgttcgccctgggcgttgccggtgccgacgaagatgcccagttcaagttcgtagtccagccgcgcgcacgggccgaactgcggcgtctcgccttcgttggcggggcgggtctggccgaccggacgcgggaacttctggtccacgccgatgctggaggcgcggccgtggtagccgatcggcacccacttgtagttcggcagcaggggggtgtcgggtcggaactgcttgccgatggcggtggcgtggtgcaccgagatgtagaagtcggtgtagtcgccgatgcgggcgggcgtggtgtattcggcgtcggcctgggccaccagcagcggctcgaccgtggcgcgcagcgcggcgccttcacgcagcgcgcgcgacagcgccaggcgcagtgcgctccagtgggcatggcccagggccatcagcgcgttcaggctatcgccctggcaggcggccagcgcctcggcggccgcgccttcgaagggcttggcggcggccagcgcgtccaggtcgacgatctggtcgccgatggccacgccggggcggaacgattcctgcgagcccttgcggcggaacgcggcgtagggcag

SEQ ID NO: 20093 - DNA, 1261 bp, Glycine max
  Peptide Sequence Number=SeqID_136871
tgcgtgcgcaacgtcactggggcaacagcggcttctggggctacctgggttggcgtcgtttcagcgtgctgcgcagcctgtgcctgccggtgaacctgctggaaggcaacacaccgggccagcgcggcccacgtcgtcgtgcagtggcagccggcgcagcgggcgcggcactggtactgaccgtgacctgcatggcgttcgaagccgtgctggtgtccggcgcgatcggtgcggtgttcatgttcatgccactggagctgatgtccgaatcatggcgcgccgcatgggacatgatcggccaggacacacccgcatgggcacggctgggcttcaacctggcgtgctggctggcctcggtgctgatcggcccgttcttcgtcggtgcgggctttggcctgtacttgaaccggcgcacgcagatggaagcctgggatgtggagatcgccctgcgccgcctgcgcgagcggctgctgccggcggcatcgacgctggccctgctgctgtgcctggcactgccgctggtctccgcaccggcgacgaagcaccgaccatcgacccggccaacaccccggcaatgatcttcggcggtacgccggtggataccgccggcttccgtcaggcagtgaaccgcgcctatgaagacccgctgcagcgcccgacccgccaggtcacccgctggaagccgatcgaacaggccgaggaagagaagaaggaagacaagcagctgcggagtgacaccaacagcaacggtgaacgcaaagcgcgcaaggacggcatcgcctggctggcgcggctggccgaatggggcctgtgggggctgctcggcgtcctgctgctggtgctgctgctgaccgcacggctgtggctgccgtggctgcggggcagtggccgacgcaaggccgaggccgcaccgccggtggtggaggaacaggtggagttgccggtggtgctgccgccggacgtggccacccaggccggcctgctctgggaccagggccggccgcggcaggcgctggcccttctgtaccgcgccagcgtgcgcacggtgggcgagcgcagcggtatcgcgcttccacccggtgccaccgaagcgcaatgcctgcgcgcgtcgcggcgcatgcccgaggccagcgaccgtgacctgttcgcgcgcatcgtgcgcatgtggcagtacgccgcctacggtggccgcctgtccagccgcgccgatttcgatgcattggccgatacgctgcgccagcagtaccggtggcaggcatga

SEQ ID NO: 20094 - DNA, 426 bp, Glycine max
  Peptide Sequence Number=SeqID_136872
atggggcagaaacaagttccgaagggctctatggggaagcaacaacaagctcaagcttcaaagggccgaaagggattagccgaggaggagctaagcctagcgactagtcatgggcagagactaaaggatgagcacgcgaagatagtgatgcaatcctaccccgcaagggcattggatagaagactccaagtagattgggccagagatgcaaaagaaggccctaggcttcttgatgaggacatgaccaagagcaagggcaaggatccacttgaaggacttggaggacctatgacaagggctagagcaaggaaagccaaggaagctcttcaacaagtgttgtccatactatttgaatacaagaccaagtttcaaggagaaaagtccaaggttgtgagttgtatcatggcccaaatggaggaggactaa

SEQ ID NO: 20095 - DNA, 216 bp, Glycine max
  Peptide Sequence Number=SeqID_136873
atgtataatagtataataacctatattggtctccactgcagtgcacattggcaaatggtcatcattttgcctaaggaaaatgttgtcatttggttttgttcgttgcataataggccagacaactacctcaaaggcataattaatagtgctttgaaaggacttgacgatactcaacaaagtaaatccaagcctcttactaggtggattgttgttaaa

SEQ ID NO: 20096 - DNA, 111 bp, Glycine max
  Peptide Sequence Number=SeqID_136874
atgaataaggtgatgcatctaggaaacacaacaactaacagggttgagtatgcatattgggccttgaagagactaatagccttggaaacctatgatgtgtgttcctcctga

SEQ ID NO: 20097 - DNA, 543 bp, Glycine max
  Peptide Sequence Number=SeqID_136875
atggaggccctgaaggagaagataacaacaattatggaagtgatgatgagcataaggaagatgatggaggtcaacgctgccacagctactgttgccagtacaactactgagagggacccaacataccttcccgatttcaatcaagagtgtcgtccagtctcagacgtgggaggtcaaagaggctcaaccgcgatgatcgcatatgggcctcattatgcccaggtccaaagtagatcttcctttccaccatatggtttgcctccaaatcatacaccacccattgttgtatatgccccaggcgagaataccagtagttccacgcccgtattcattgagaatcaacaaccccaacttgatcacactcatgcccatgtttctcaagccatggaggaaacacatgcagctccccaagattatactttgactagtttcagggtttatctgggatatactagtgaaaggcgtgtgttttttggtcttcatgtgctaaatgctcaggggctcctcagtcttgaccaccattacaacccttgcattttgtga

SEQ ID NO: 20098 - DNA, 2304 bp, Glycine max
  Peptide Sequence Number=SeqID_136876
atgaagagcatgaaatcttctgcgaggaaaagggtgtcaattatcaggaactcaaatcctggccaagatattgctgaacttcaacctgcatccccaggaagccctcttttggttcctaggcaaaagtattgtgaatcattgcacaaacccatcaggagaaaaacaagcacagtaatggttggtaacgtggctattggtagcgagcatcctataagaattcagaccatgactacaactgacactaaggatgttgctgggacagttgaacaggtgatgagaatagcagataaaggagctgatattgtacggataacagttcaagggaagaaagaagctgatgcttgttttgagattaaaaacacccttgtgcagaaaaattacaacataccgttggtggctgatattcattttgctccctctgttgctttgcgggtagctgaatgctttgataagattcgtgtaaaccctggaaattttgctgatagacgggctcaatttgaaacattagagtacacagaagaagactatcagaaagaacttgagcatattgaaaagatgcgaccaacaacgattgacacaagtggtagcggcttgtggttcagggttctaatcttggttgacccttgggttttcacaccattggttgagaaatgtaagaaatatgggagagcaatgcgcattgggacaaaccatggaagtctttctgatcgtataatgagctactatggagattcacctaggggaatggtaagcagttcttccacctcttatactgcatctgcaacacatctattgtgtatttacgtgtgtccctcaaagaattgtccttcttacaaagcaatgattggacaggtagaatctgcttttgaatttgcaaggatatgccgaaagttggactatcacaattttgttttttctatgaaagcaagcaacccggttatcatggttcaggcataccgcttacttgtggctgaaatgtatgtccaaggctgggattatccattacacttgggtgttactgaagctggagaaggtgaggatgggaggatgaagtctgcaattggcattggaactcttcttcaggatggattgggtgatacaattagggtttctctcacagaaccaccagaagaggagatagatccttgcagaaggttggcaaatcttggaatgagagcttctgaactccagaagggggtggaaccttttgaagaaaagcacagacattattttgacttccagcgccgatctggtcaattgccagtgcaaaaagagggtgaggaggtggattacagaggtgcactgcaccgtgacggttctgttctcatgtcagtctccttggatcagttaaagatgccagaggtcctctacaagtcacttgctgccaaactcattgttggcatgccatttaaggatttggcaacagtagattcaattttattacgggaacttcctccagtagatgatgctgatgctcgactagcactcaagagactgatagatatcagcatgggggttataactcctttgacagagcagctaacaaagccattacccaatgccatggttctagtaaaccttaaggaaatatctaccggagcttataagcttttgccacaaggaacacgcttggttgtgtctgtccgaggtgatgagccttatgaagaactggacattcttaagggtgttgatgctactatgcttctccatgaccttccttatacagaagacagaattagcagagtgcatgcagccagacggttatttgagtacctatctgacaattctctaaacttccctgttattcaccatattcagttcccaaatgggattcacagggatgacttggtaattggtgctggttctgatgctggagcccttctggttgatgggcttggagatggactacttttggaagccccggacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccctggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagagcatggacgatgggtggaccctcctgcagaggagtaa

SEQ ID NO: 20099 - DNA, 981 bp, Glycine max
  Peptide Sequence Number=SeqID_136877
atggacgaaaatcaatggatgcatggcaatataatgtttgaagaagttgatatgaatgaacaaaatgaagacgaaggtggtgtgaatgaagaagatgttgattgttctgatgcgttcaatacttctcagatgatgttctgcattgagctcgatctgttgattatgaaattggatttgtggcggagtggtcagtataggtttaggaagaaagattttgtaagaatagataccggcagtagaaaatgtgggtgtctctttaagctccataggaaaccagtggttggagggcaaggatggataatgaagtatgctttaaatcagattgctgctaagtttgcacgtgtacattatgctagcaaaaacccttctcattgtagatgtgtcatgagaactactcacgatcttccatatgcataccaaggtttatctgagccccaagtgagcataaccaaagaggtggaaatcatatccaagcgatttgaagagcttgatgtttatggaaaagttactctaaagaaaaaggtcaacaccaaaggtgctaagaagaaaccgatgaccagacatcaaagaccaacaaaacgtgatccatctaactgggagtatgttgatgctttacattttgtgcaaaatagtaattctttagtcaaacgtagcacatcatcatctaaccaggaaattccaagaaggactatgttgatgttggatcaatttcatccgtgcattcacgatttcattgaaaacattgtcgatgtcaaagttgacaataactctggatatcgtgcaattgctgtcttattaagtatgggtgaagattcatggtctttggagtgcactcatttgcttaaagaacttgccaaatggtctaatgagtatatcaacctccttagtggcatacacagatttgaggaattaaagagaatgcagcagttcaaaaatttgatgaggttgaaaaaagactatgttgatttaagtgaagagtga

SEQ ID NO: 20100 - DNA, 1170 bp, Glycine max
  Peptide Sequence Number=SeqID_136878
atggagtcgaaagcggtggaggttgagggagtagaagggttgaaggtgactgaagatgtggtaatggatgtaatccatgttgaggattttgttcctaaaaataaggaaaatgttatgttgaatattaatggaaagaatgggagtatttatggccatggttgtctccaccacagtcatgccgttttcgctgtcgaggcttgccaagcaatagctgaaaggttggagcagttgctcaacctaaggaaaatgactaaaggcacagaaacatatgatgtcatgcaagactacctaaggatcgctagaggtgtgacagtggatcgcaatgaagctgccactattgctgaggatgttcatcacgtggatgacgcagctgacaaggtcttccaacaacctctagaagcaattgttgatgcccagggtgtcttccacagctttgagactcttcatgtcgacaaagcggtgttgatgttagtggaattacttgaagtcagtgcaaatgaagccaaagttgagacacattttccatctgttgttgaggttattactgttgaagactatcatgaaaggaaaccacgtgccaatcgttggacctctatgaaggcattaccagtgtcgatacatatccgatggggtcccattgttgtcagacaccaaccaaagagggttgtactgcagtttgggtatgttcagacgattcctccacactatccaggttcaagattatgcttagaagatattggcgacagatggatgcacttctctgagtaccttgcaccggtgggtcaaatttgtgttgttcttggacagtgtgcatcatacttcatggactggttctacatgatttcgcatccattcatgaggtcggcacagcttggggatccagtcaaacatccacctgtcatgcaagatgacacatacgtcaaaccaggtatgcctcaatatccggtgacgacagcaactatggaggaagcacttgtgcaggcaccctctcatgtggagcagcctagacatgcggtggaggctttccaagcaatagctgaaaggttggagcagttgctcaacctaaggaaaatggctaaaggcacagaaacatacgatgtcatgcaagactacctaaggatcgctagaggtgtgacagtggatcgcaatgtatatgtgcggtcgcaatga

SEQ ID NO: 20101 - DNA, 183 bp, Glycine max
  Peptide Sequence Number=SeqID_136879
atgttcatacgtgaagaatcgcatgttggtaagcatgcggttttggcaatccttcttgcaacatttgctgggtttggtgtggtgatgagtggaagttcaattcttttggagtcttctagatggagaagaagatggcaggcacaacagcgtggttcttcagcgatgacacaagaaggactatga

SEQ ID NO: 20102 - DNA, 741 bp, Glycine max
  misc_feature (59)..(59): n is a, c, g, or t
  Peptide Sequence Number=SeqID_136880
atggcggaaaagggaaagttggatcatatggaggaaaggctcaaggccattgaaggagncggagatcatgcttttgctgacatgtcagagttgtacctagtgcctgacattgtcatccctctgaagttcaagatgagggcatacgcgaaagatgaaaaattgttgatgcattttttccaagaaagccttactgaggcagccgtcacctggtatactaacttggaaccttcccgagtccattcttggaaggacctaatggttgccttcgttaggctatatcagtataattctgataaggctctagatagaatgcaactacagaacatgtgcaaaaaagagcatgaatctttcaaagaatacgcccaaaggtggagggatctattagctcaagtagcgcccccaatgacagagaaagagatgatcacaatgatagtagacacgttaccggtgttctactatgagaaaatggtgggttacacaccttcaaggtttgcggatttagttttcgtcggcgaaaggatcgaagtgggtctgaaaaaaggaaaatttgatcatcctgctttgataaatgagaaacctggggcaaatagagaggaagagaaggaggaaggaacccatgtcgtgactgtcattcctacatggccaaaattcccactagcacaacaatgtcattactcagccaatatcagtccttctcattacccatcatccaatcaaccacaaaggccacccctaaattag

SEQ ID NO: 20103 - DNA, 594 bp, Glycine max
  Peptide Sequence Number=SeqID_136881
atgcaaattttctccattgatgttcaacctggtgggctccggtttgctactggtggtggtgaccacaaggttcgaatatggaatatgaagtctgtttgtggggagtctggggacataggaaatgatgagtcttctcagaggcttcttgcaaccctgcgggatcgttttgggtctattaactgtgttaggtgggctaagcatgttcacgagagaaagtccggtttgggaaccacgaaatttggcagtggagagccaccgaatattgaatactggaaagttgctttgactttgagagggcacgttgcatatctggtgggtcttaattggtctcctgatgactccacattagctagtgggagtttggacaacactattcatatatggaacatgagcaatggtatttgcactgctgttctgaggggccacacaagtctggttaagggggttgcatgggatcctattggatcttttatagcaagtcaatttgataataaaactgtgattggagtcttgctcatagaacagatggtcactggactaaatcagaaagtttcctattttgaaatctattgtgttgaagatatacttttgtaa

SEQ ID NO: 20104 - DNA, 825 bp, Glycine max
  Peptide Sequence Number=SeqID_136882
atgcttgctaccttggttttgatttgctgtttatttacggcatttctattcctctccttacctgttatgtctcaagaagttgaagatgagagcgagtttagttacgacgaaaagagcgagaatggaccatctaattggggagacatacaccccgaatggagtttgtgcaacaatggatccatgcaatcgcctattgatctattgaatgagagggttcaaatagtatcccatctagggaggcttcagatgaactaccaaccctctaatgccactattaagaataggggccacgacatcaagctagaatgggttgctggcgcaggctatcttcaaattaatgaaactgagtacgtactcaaacaatgtcattggcattctccctctgaacacaccatagatggcaaaaggcttgatctagagttacacatggtgcatgaaactccatcaggacaatctgctgtgattggaatgctctacaagattggaagtccagattctttcttgtcatcgttaacggatcatttaaaggccatttctgatacaacggaagcagaaagagtggtgggtgtagttgaccctaggcagataaaaatattctacaagcagtattacaggtatataggttcactgacaattcctccttgcaccgagaatgtttcttggaccatcattagaaagatacaatccgtttcaaaggaacaagttagattgcttcgagtcgctgttcatgatgaatcagatactaacgcaaggccactgcaactaataaataaccgcttggtgaaactctatgggcgaaaatatactattaaagataaacattga

SEQ ID NO: 20105 - DNA, 1191 bp, Glycine max
  Peptide Sequence Number=SeqID_136883
atgggtggtgggtggaataaggagaagaacaggacactgtcaaccaaggtgaatctggcagaaaacaatgagacctcccccataccttcgcatagcgaagagcctctgggcaatgggtctattggaggttctggaagggttataggaaattatttggaagacctattgcgaccaaaatttggttcagattcgtatgaacggattgataaaagtcttccgccttccaagaagcatgccgccatgaagaaatttaatgataagaacaacagacgatttgtgtttttgttggaaacatgtgcttgccttccaagcatcaagttgtcgtcagttgattctataattatatttgatagtgattggaacccaatgaatgatataagataccttcagaaactaactcttgattcacagtttgaattgataaaaatattccgtttatattcatctttcactgttgaagaaaaagccttaatcctttctaagcaatgtaagatatttgacatcaattcaccaaactggactatctttcatatgctgttgatgtggggtgcttcttgtctatttgacgaattgaaagtttttcatgatggtgaaacttcttcatcaaatgtgaaatccttgtttgggcaaccacttttgaaagaagcaatgcatgagttctcatccctactatctcaggatggagaacatattgattcaagcaactgttcaactttattgaaagtacagcaaaatggggcaacataccatgcaaattcttctttgcttggtgagctaaaatttagggtacttggtgaagagccaacccaaattttttggacaaagcttttggagggaaaacagtttcagtggaagtacttaaatagttcatctcagcgaagccggaagaaagtttatcattttgatggttcagtcaatgggcctgatcttgtaaatgtaggagcatcaaagaagcgcaggaaaattagcaacaatattgttgaacagccttcttcaaaatctgaagatgaaaagttatccaatggaatcaaggcagatagatctcaaggaaataatgctgaatctgagccaaaaagtagacagcatgatgagcagaggagcttacttcttttgctgaagccagagatcagaaagctttgtgatgttcttcttcttccagcttataatgaagtgggaatgaaatgctactga

SEQ ID NO: 20106 - DNA, 696 bp, Glycine max
  Peptide Sequence Number=SeqID_136884
atgcatgatctaagagaaaagcactttcaagctataaatagaattatcaagtatttaaagaccgctccaggaagaggacttctactcaagaagaaggggagtctatctatggaaatatacacagatgctgactatgcaaggttgattattggtagggggtccaccacaggatattgcatattaggtggaaatttggtgacatggaaaagtaaaaagcaaaatgctgttgcaagatcaagtgtagaagcagaatttaaagtcatgactcaaggggaatgtaaattgttatggatgaagattattctcaatgacctcaaaataaagtttgaagctcctatcagagtattttctgataataagtttgtcaccaacattgctcacaaccaagttcaacttgaaaggacaaaacatgaaaatagatcgacatttcatcaaagaaaaattagacagaagacttatggatataatattcttaggctctttagagttataaagtcttgtctcttaagaacagaacaatatagtagtgaagtagaacaaagcaacctaggcagctacagaaattcaattgtgacaacagtcatcaaaggcaaaacccatctccctgcacccacaccccaattttctgaggtattgagcccatttttgtggtattttcatgatttgctttctttttacatcacgaacatattatga

SEQ ID NO: 20107 - DNA, 282 bp, Glycine max
  Peptide Sequence Number=SeqID_136885
atggggagggcgcttatccagtataacccattcggagtctgggagtatggtgagttcacaggcaaggatacttgtcgcggaattaagttaccactgattttaactaccactccactggagggttatatgggagttgctcctattccaccacctcctgaggatcagctgatagctgatgtccatcctgcaccatttgtacggtacttctatttgccgctatccctgttagctacacatgttcctcattcttcctctggatcccgatcattttcacctgtctga

SEQ ID NO: 20108 - DNA, 2502 bp, Glycine max
  Peptide Sequence Number=SeqID_136886
atggtaaatggtactcgttctagtcacaatgctaaggacgaggaaaataataacaggagggtgacacaggatagtgagaagggaaaaatcaaatcacatcctaatgtatcagatacaactggtgtgagaaggtctcctagagagacatcatcaaagaagaacattcctaacccttcttcaagtacccgtaagtctgggcgacttgaaaatagagcaccaccagctcctgtcgacaaaaggaaatctggaaggattgaaaaaaagatgccaagtcctttgagaagatctggaagaactaggagtcagtcttctgcaggttattctgattctaaaagctcagggtcagtgagttcagaccctaagccaaaaaaagagaagagtgtgaaacagttgatatttgaagctaaggaagtaaatggaactgaggaacatcatctgggaacaccccagatcagagtaaagagaatgactgctcgtatgtatcggtctctctttcaattaccaaaggaagagcctaataggaccgataagttaaatcaaggtggcaacaatggtgaaggccagattgatgagtgctctaaagagagtcatgattgtgaagaaatctccaagaatggtgtgctatcatctgaagatggcaaatcaaaagagatgagagttgacattgggtcgagtgggtctgtgaaagatctggtagaaattaccatggctcaaggttcattggcaccatctaatgttgcgctaccatctgaagatggaaaatcgaaagagatgagagttgacactgggttgagtgggcctgtgaaagatctggtagaaaataccatgactctagattcattggcaccatctaatgctgcaacttatgagactggtctggcatctgaaagctttcaccctgattactgcagagaggaaacattacagttgttagtgtcaagcaattccatattggatgaagattctatcaggaacggtgttggggatcgtagaggtgaaaacttgataccttctaagagcaaggaaatcactgtggatatggattcagatgtttcttccatgttggcgaagggtgacaattgcaacttgactcctgatgctagtagcctgtcaaggctaggtggcaatcttatggggactgaccgtccatctaatgccacactttatgagactggtttgctacctgaaagggttcagcctgattgttgcagagaagaaacattaccgtcaagctattccgagaatggtgtgctaccatctgaagatggcaaatcaaaagaggcgagagttgactctgggttgagtgtgcctgtgaaagatctagtagacaataccgtcactctaggttcattggcaccatctactgccgcaacttatgagattggtttggcacctgaaagcattcaggctgattacctcagagagaaagggaattccatattggatgaagaagacttaattaggattagtgttgggcatgatagtagtggtgaaacattgttaccttctaagagaaagggaatcatggtgggcatggattcagatgtttctgccatgttggctaagggcgattactgcaacttggttcctgatagtggtagcccttcacaactaggtgttaacttggttcctgatagtggtagcccttcacaactaggtggcaatattatggggaccaacggtgagggagaacttgccaacaaccctgagtttgtcttgtatggccagaaactgaagaggagagaggagcttgatgagaaagtccgcatttggatcaggggctgggatgaaggagattgtgtagagggagaagtagtatttggagaggataaagttggatgggtagaggaagaggaggaattagataggacaaccgtgttggattataatcctacagtcagggagtcttgtatcccttctgcaactgagcttcaagatggacattatattgatgcaagcatgctgcagaaggattctcaaattgataatgaaaaagaatctggtttaataactaattccaatagcagtgctactcaactaaaggagagattgtcaagtcatattggatacagatgcaagtctgactcctttagttttgttgagtattgggttcctgtacaaatatctaatctgcagcttgaacagtattgttctattttactttcaaatgcttcaattcttcgctcctcatcaaaggttgatagtgttgaggcagttcgtgatgttcttatttctacccgaaagtgttgtagtcatccctatcttgttggtccggaactgcaaccttctctaaacaagggtctcgaaccaattgagtatcttgattttgatttaaaagcaagtggcaagttgcaacttcttgattcgatgcttgaggagttgaggaagaatgatttaagggtgctcattctttttcagggacaaaaggagttgaaaaataaagtgcaaaggcttgcaagcaaagagcagagtgaacagatagatctggatgctggagagtag

SEQ ID NO: 20109 - DNA, 1686 bp, Glycine max
  Peptide Sequence Number=SeqID_136887
atgcattgttggactgcagcttctttgctgaaacacaaacttgaccccattgcttctcttatacaagatttgaactttgagtgtaagaaagaagaggtggactacatttgttctatgttgtgttgtttgaagaaaatatttttatatcgtacaggaaattatcatgataccggttctccaaaagcatctggaccatcaaacagggcatattcctgtacaggagttgcacgagaggttgaattgttcaaaaaagatatgtccaaaagtattaaagaaattcagaagaagtgtgaaaagaagctgaagaagctacatattttgcaagaagaagagaagcaaaggttgagagcagctattgaggaagaaaaggctaaatttgaggaaaggtacaaaatagagtctgctgttattcgatcctgctctcccaatgatgttacaagaatggaaaagctcagagttttgaatactgaatatgaaaaaggaattgaagaactaaaatttcaccatgattcatgtctcaaggatcttgaggacaagcaattagctgaaatacagaagtttcaagataaggaggccgcttgggtagaagatgtgaaatcttgggccgacaatgaatatctaagcataattgcttcaaaggaacttggaactggggttgaatccttgcagacttgtgatcaagtactgcctgacagtggtctaaaaaatcatttggctggtactgctgcgaatcctccttcatccatggaacaaaaatctgatggaggtgctgtaaatgaactttcagatagagaattaagactgagtaatggtccagataacaatacccttttgagtccacagaaccaaaattctgggggcccattagatgtccaaggtttagatagagttttatcaccaagggcttgtcaagctgctagttcaagtgatggtccgaatacaatttccattccaaatccacttttggagcaacaaactaccaacggagtccctttgagtattccagcagcagttgattgtcatgatgatatagagcatttaacaaatgctgtgttgggggataaaagaaccacatcaaaccagcaggaaggagcacctaaaaccatgacagaattgtcccaggggactccagtatctagaacagttaatgtcatggatcctccagaacaagtgcagcatttatctgtggagtcctctcctcaccatgatatatctggggaaatgttgcattcttccagacaacctgaactgttatctagtgcagttgatgttgcacccgctgatcaatccaatcatgtttcactgatcgtgaagcctgtggagcaggtgcaacaagtatcatctgcagagctcccttcttcccatctggattcaactaatttacctttcacaaccgaacttgaacatcagccaactgtggttccaaatcaagacgtgcaacctgattcaaatttggaagttgattcacattctcattcacatgaagtttttgtgcaccctgcctcaaattcagaccctaatacagttacacctagtgaagtaagagtgcaatctgcagacacaacaaatttgtcgactcctttggagataaattatcaaaatatgcaagctgaaacccattcatcttccagaatggtgcatttaagctatgatccgctcaacaatgaattggatagaatacaaaaa

SEQ ID NO: 20110 - DNA, 675 bp, Glycine max
  Peptide Sequence Number=SeqID_136888
ctaggactaaggagaagagtaaatagtatgatttttagtgctgtgaaaaaggagagagggagaccgataaggacattagaggaagttgttaagcagaatcttgtgggtgtgggacacaatgatcagaaagttcttgttcttgcagctacaaatacaccttatgctctagaccaggcaataaggcggcgtttcgataagcgtatatacatacccctacctgatttaaaggctcgccaacacatgttcaaggcatgggcaatatacatgatgatgttcattggtcttattgtgcacctaggagatactccccataacttggctgaaagtgattttgaacatttggctcgcaagacagaggggttttcaggttcagatatatctgtctgtgtaaaggtgaaggatgttttatttgaacctgttcgcaaaacccaagatgccatgtttttctttaggaatcctgagggtatgtggatcccatgtgggccaaagcaacagggttcagtgcaaactacaatgcaggatattgctgcgaaaggacttgcttctaagatcctcccacctcctatatcgagaacagattttgacaaagtacttgctagacaaagacccaccgtaagcaagtctgaccttgatgttcatgagagattcacaaaggagttcggagaggaaggataa

SEQ ID NO: 20111 - DNA, 108 bp, Glycine max
  Peptide Sequence Number=SeqID_136889
atggttgaagtattctcgcaaaacaaagtgaccctgactagtcttcctatgatttcacttagtgagctaacatatgatgagttccatgctggagatggagaggcttag

SEQ ID NO: 20112 - DNA, 2124 bp, Glycine max
  Peptide Sequence Number=SeqID_136890
atggatccaccccaaagccttagtgaagcaaaggcagcagcactccaccattacagtaaaagcttccaaggcttctcagctatgattacaccagtgcaagctagtcaacttgcagaatataaatcagtagtgtccgtatttgagagcaaaatgaataaacttcacacaacacattcttgggattttcttggattagaaactatcaacaagaacaatcctaaagcactggacaccacatccgatgtcattgttggtgtcattgactctggcatctggccggaatcggaaagcttcactgattatggattaggtcctgtgcccaaaaaattcaagggagagtgtgttactggtgaaaaatttacactagccaattgcaacaagaaaattattggtgctcggttctattcaaaagggattgaggcagaagttggtcctctagagactgctaacaagatttttttccggtcagctcgggatggtgatggacacggaacacacacggcttccacaatagcagggtccattgttgctaatgccagcttattaggcattgccaaaggaaccgctagaggtggtgccccaagcgcgagacttgcaatttacaaggcatgttggtttgatttctgcagtgatgctgatgttctttctgccatggatgatgccatccatgatggggttgacatactatctctttcccttggccctgaccctccgcagccaatttacttcgagaatgcaatcagtgtaggagcattccatgcattccaaaagggtgttcttgtttctgcttctgctgggaactcagtttttccacgtactgcatgcaatgttgctccttggatcctcactgttgctgctagcacaatagacagggaattcagttcaaatatctaccttggtaactcgaaggttttaaagggttcttctttaaatccaataagaatggagcattcgaatggtttaatatatggaagtgccgctgcagctgcaggagtttcagcaacaaatgcaagcttctgcaagaacaatactctagatcctaccttaatcaagggtaaaattgtaatctgcacaattgagactttcagtgatgacagacgagccaaggccatagcaataaggcaaggagggggtgtcggaatgatacttattgatcataatgccaaagatattggttttcaatttgtcatcccaagcactctcattggtcaggatgccgtacaagagcttcaagcatatataaagacagataagaatcccactgctataatcaacccaacaataactgtagtcggtaccaaacctgctccagaaatggcagctttttcttccattggaccaaatataataacaccagacattattaagcctgacataacagcacctggagtgaatattttggcagcatggtctccagtggcaactgaagccacagttgaacatcgatctgtcgactataacatcatttccggaacatcaatgtcttgcccacatgtaactgcagttgcggcaattataaaatctcaccacccacactggggtcctgcagccataatgtcttcaataatgacaacagcgacagttattgataacacacgtcgagtcataggaagagatccgaatggaacacaaaccacaccatttgactatggatctggacatgttaatccggttgcatcactcaatcctggattagtatatgattttaattcccaagatgttctcaattttctgtgcagcaatggggcaagcccggcacaacttaagaacctcactggggttattagtcaatgtcagaaacctcttacagcttcctccaacttcaattacccttcaattggtgtgtccagcttgaatggaagtttatcagtgtatcgtacagttacttattatggtcaggggccaacggtatatcgtgcaagcgttgaaaatccatctggtgtgaatgttaaagttacacctgcagaattgaagtttgtgaaaactggggaaaaaataactttcaggattgatttcttccctttcaagaacagcgatggaagctttgtgtttggtgctttgatatggaacaatggcatacaaagggttaggagtcctattggtctcaatgtactatctacttaa

SEQ ID NO: 20113 - DNA, 210 bp, Glycine max
  Peptide Sequence Number=SeqID_136891
atgaaaaatcagtgcgtgaaggagaacaaagtacagaaacacgaagaaaggagaagaaacctaaccttttgtgaccgagaggttccaatgttgcctatgatggagttagagtgtcgtgagaggttgcaaatcagagtgtcaaagtgttcaagtgagagtgatcagaatgagagtgaaagtgttgagagtgagagatttcaaaggtcctga

SEQ ID NO: 20114 - DNA, 409 bp, Glycine max
  Peptide Sequence Number=SeqID_136892
ccgaggaagttcttgctggagtcggaggagtggaagcggacgatgtcgtcgggggagtggatgcgtttggcgggggctatgaagtggtgcggcgggggcaaaatgggaactttttgggattgtgggaccggggcgaggatgatggcgcgggtggagttggggtccggggggatggcgggggcgcggattgggcggtaggttgggggaggggaggtgaaggtgggggtttggggagggggggcgaaggtggtggggccgccgcacttgcagcagagtcttccatggttgcgatcgatggtgatgctgcagtgaaagtgaaggggggccaaaggggaccctctttcgatcgcttggtctccttcaagctcaacgttgacgacaactcttgtggcaatctaggaccttcagg

SEQ ID NO: 20115 - DNA, 270 bp, Glycine max
  Peptide Sequence Number=SeqID_136893
atgggaagcaaatggagaaaagtgaagctcgctattgggatcaacatgtgcgttcaagtccctaaaaccatcgaacattcttcctcttcctctattacctccgccaaagccttctccgaccgcgtttcgccgtccgccgacgcctccggccaccgctccgtcacttccacaaactcctccgcctccgggctccgactctccggatccaaatccaaatgctccaagtattctggtattattacaaaggagattgcgctaattgctaaatag

SEQ ID NO: 20116 - DNA, 813 bp, Glycine max
  Peptide Sequence Number=SeqID_136894
atgggaaaacgagagaagcagaagcagaggcatgagaggggtcaccgtggaagagggtctttcaactatcttcaagaagaccatgattttgatgacactccaagatcctcaccctctgaagaagaaggtgctgatggcagcaatgaggaaaaagaagaagatgaagaaaatgtaacaataagtcatgaaaaccaatctcatgatatgccttccaagttcctcctttaccaacaatctgtgcagtctccaaaaggagacataagttatatgcaaaagttctttctcatgtacgtgggtggaaggatgcccctccatcttcaagaagatttctgtggcacggcgcttcttagtacagaatggctccgcagtgattcaagaagaacagtagtaggattagatttggatcttgaggcactcaattggtgcatggaaaacaacatacctaaagttggggctgatggattttcaagaatttccctctttcatgggaatgttttacaacctcttcagtctaaacttaatgaagaaaatcttcagactggtgtgccagaatctgatgctccaacaggctctattgctcaagatgataagtatactaagggaaacataacactgcctggaagagatattgtgtgtgcttttaactacagctgctgctgtctacataaacgagcagaactggttatgtatttcaaacatgctcgtggggccttgtcaactaaaggtggaatttttgtgatggatttatatgggggtacgtcgtcagagcacaagttgaggcttcagagaagatttcctaattttacggtataa

SEQ ID NO: 20117 - DNA, 483 bp, Glycine max
  Peptide Sequence Number=SeqID_136895
atgaggaagctgcaattacagtactgcttggagcctgttgggtcccatggtgtgtgggggcttgatgattatcattttttgcccttcatatttgggtcttcgcagttgattgatcacaagtatatgaagcccaagtccattcacaatgaggatattttggagaatttctctaatgagtatttgtaccttgcttgcattgcctttgtcaagaaggtgaagaaaggggtgtttgctgagcattcacccatgttggatgatatcagtggggtgcccaattggaacaaggtgaacactgggttgcttaaaatgtataaggctgaggtcttggagaaggtccccatcatgcagcactttcttttcgggtcgattattaagtgcattatattacctccctattcactgctgtttggttatttgtcgggaatagtgcttggagtcttctgccggttttcctatgaggacgagctatataaaccaggctga

SEQ ID NO: 20118 - DNA, 259 bp, Glycine max
  Peptide Sequence Number=SeqID_136896
atgggctacgtgggagtacgtgagctcagttggaggtgggcaacaggggatgagtggtacctggagatatgtcgcgggggtcaggagaccttggggacgtcaggtggggtgctattgcccaaaaccaagcttgaccaatcccgacccaacccgggcatagtcggtcaggaagctaaggaagcctctggtaatcgattaccaaggggtgtaatcgattaccaggcttattacgggaactgggagatggtagaggtctctg

SEQ ID NO: 20119 - DNA, 255 bp, Glycine max
  Peptide Sequence Number=SeqID_136897
atggcacatcagaagtccaacagggtcttggagttgctagctctgattacgggcctctgtcgattctacggggtgcctgtcgcccccagcaaggtcatcaggccccctactaatcgagctttcatcaagaagtactgtgcccccaggcaggcgcaaggtgaaacaccccagcagcttggggacgaccggcagcgggcaacagaccgctctgccaccacctctagagttcacctcagctcatccacaaaaggttag

SEQ ID NO: 20120 - DNA, 273 bp, Glycine max
  Peptide Sequence Number=SeqID_136898
atggctcttattgtcttttatatcaaggcttatgctaaggtatctggtgtacctgcctctagtctatcaactctagacgtgagtgcagaggatttctatggtaaaggctatgatgacagtgataggcgcatccctgacatgacaattatcaccaagcagcttgcttggaagccaaagacacctcttgatgaactgttagatgttaccctccaatatcaacacaagacatattctcgtgctatccaaagagaactttcaaaactgtcaaattga

SEQ ID NO: 20121 - DNA, 927 bp, Glycine max
  Peptide Sequence Number=SeqID_136899
atggcgcgagtgaacttggacggaaactcgattccgatgctggcgatatgcatgatcggcggtggcggcttcatcggatcgcacctctgcgagaagctgatggcggagaccaaccacaaggccgtcgtcgttgacgtctcgtcggagaagatcaaccacctcctcgacagatccctcccctgggcccaccgcatcgagttccaccaaatgaacatcaaaagcgattcccgcctcgaaaccctcgtccaaactaccgatctcacgatcaatctcgctgcaatttgcacaccggcggattacaacacacgccctttggacaccatcttcagcaacttcattgatgcgattccggtgattaaatattgcactgagaacaataagcgtttgatccatttttctacgtgtgaggtatacgggaagactataggcagttttctcccagaggaatatcgacaggaccccaaatatttcatgctcaaggaagatgtcactccttgtacttttggtccggttgagaaacaaagatggtcttatgcttgtgcaaagcaaatgactgacagactgatatatgctgagcatgcggagaatggcctcaagttcaccattgtgagaccttataactggattggtccaagaatggacttcattcctggtgtggatggcccatgtgatggtgtccccagagtcttagcttgcttcagtaatagtctcctgcgaggcgagcccctcaaacttgttgaaggtgggagatcacagagaacctttctctacatcaaagatgcaattgatgctgttgctttaatgattgacaaccctgagagagcagatgggcatatcttcaatgtgggaaacccagacaatgaagtatctgtgaaggaactagctgagcttatgataaaggtagccccaccaaagcttccattctag

SEQ ID NO: 20122 - DNA, 462 bp, Glycine max
  Peptide Sequence Number=SeqID_136900
atgaagtacgatcatgtgatgactacgataatcgagtcccatgacacatatgccatgatcgtatcagagttgcagagtagtatcgaaagccacgtgaatagattttggagaagacaagacaacagaaagttcgagcatagagttgtggactgtagacttaaacaacaagcaagcgtcctagaaagtcaaaatcgaaagaaggagttattttcttctttaaacaaaatggtaaaatctaccatcaaatttggtaacaacacaaatattcctattttgggaaaaggacaaatcacgatcaagttgaaggatggctcacaaaatttcatttatgatgttttctatactctcggtcttcatctcaacttattaagtatgagacaacggtcagagaaagtttttaacatgaagatttatcaaggctactgcacgttgattgacaaaaatggaagattcgtcgccaag

SEQ ID NO: 20123 - DNA, 159 bp, Glycine max
  Peptide Sequence Number=SeqID_136901
atgcttccgagacgtttccgtgagcgatttcgtgaagattttccaccgttcttcatcgttcttcgttcgttcttcgtcgttcttcggtcttcaaccgatgcgtgtgttgctaataccttccctatgcgtaaatacaactcccgaacctttcacacttaa

SEQ ID NO: 20124 - DNA, 747 bp, Glycine max
  Peptide Sequence Number=SeqID_136902
atgcctcagcataatggagtagctgaaaggaagaatagaataatcatggatatggtgaggtacatgttgaaggccaagaaagcacctaaggagttttgggcaaaagcagtttctaccgttgtctacattttgaatagaaaggcgagggatgatgatattcatgctattgagaagaataacacttgggagttggtgaactttccaacaaacaaaaggccaattggagtaaagtgggtgtacaagactaagtacaatcctaaaggagaaattgatcgcttcaaagcaaggctggaagaagaagtagatgttgagcaacctacatggtatattgttgaaggaaaggaagacaaagtctacaggttaaagaaggctctgtatgggttgaaacaggctccaagagcatgggaggttatgataagttgttttgagatcacagattttggcttgatgtcccgttttcttggcattaaggttaatcaacaagatgatgggattttcatctctcaaaggaagtatgcatgtgatattctgaagaaattcaagatggataattcaaagcctgtttccacactagttgaagaaaagctgaagctaacaagagatattgaaagcaaaagggtggatgcaactctatataagagtttgattggaagtctaagatatttgactacaacaagaccatatattttctttggagtcagtttgtttggcagattcatagagaagccacacattagtcatctgtaa

SEQ ID NO: 20125 - DNA, 600 bp, Glycine max
  Peptide Sequence Number=SeqID_136903
atgggtttaatggagtgcaatgtggaggacaataagaatctataccttcatgctcctactttcattgagtggcttaaaccatgttcttctcctaattattcatatctaaacaattccaacacaatattatcatcatcttcttctccttcttcttctttttcttttactcataatcagtttgttcaggaaactatccaattcttgccaattttaagtgaaaagaaggcctcaaaagatgaggaagatcaaacgtttgatgaggtgaaagaggaaaaggttaaacaagtgactgtggctttgcacattggattgcctgacactagtaaagggcatgctgatgatgaggttgttgatgagaagatgattttccatgttaaggaagaagaagaagagtcctcaaagagaagcttccatggatgctcctttaacaacaaccaagagagaaggttttggattcctactcctgcacagatccttgttggacctatgcagtttgcttgctccatatgtagcaagaccttcaataggtataacaacatgcagaagtggaaattaagctatgtaaaaggaccatgtggaagaaagaagaggaaagagtag

SEQ ID NO: 20126 - DNA, 636 bp, Glycine max
  Peptide Sequence Number=SeqID_136904
atgaagttaaggtggtgctttttggaaatttcgaaggttcaagaaacgaggtcgcatgttcatgcacctggggaagaagagaaggtgatgacaaggaagcagaaggctgagtccaaggcacatgaagtggagcattctccaaagaaggccaaggtggaaaaagaagatggccaaatcaacggaaaatctgaaactggagttgcagaagaatatgatgagttctgcaaagtaacaaacgagcaccttcctttggaacaaatgagagagattatggaggctaatagccttgattcttctggctctgatcttgaaattgcaagaagatgccaagacttgctgttttatggtgcattggacaaatgctcggtttgcaatgggagtttggagttcgatggaagacgttatgtttgcagagggttctacagtgagtgggctagttgcactttcagcaccagaaaccctccaaggaaacaagaacccattaagttacctgattctgttcaggactctctggcttcagatttgctaaagaaatatcaggacccgagtcacaggcctcacagggatctaggcttagctgaaaaaccctttactggaatgatgatatctctgatgggtcgtcttactcggacacat

SEQ ID NO: 20127 - DNA, 153 bp, Glycine max
  Peptide Sequence Number=SeqID_136905
atgggggattgcttcctccttataaagagtgaccaaggtagtaggaatgtatctcatctcacgacgaagaatgagcttaggctaaagagaagagtacatcaaacagattggatgagcacaaaacttgataaaaataaaggcaattttatttaa

SEQ ID NO: 20128 - DNA, 516 bp, Glycine max
  Peptide Sequence Number=SeqID_136906
atggccactgcttggatatataaaggactaaaggacgatattgcttggtcaaatatagcagccttgatgcatatgtgggggcatggatcagaatttaggaaaggaccagactcactgaaaggatcacaaccagctgcaatgttaaggttaccatgctattgctgtgctcaaggatgcaagaacaacatcaaccatccaagggctaagccattgaaggacttcagaaccctccaaacacattacaaaagaaagcatggcacaaagccattcatgtgtagaaaatgtgggaaaacatttgcagtcaaaggggattggaggactcatgagaagaactgtggcaagttgtggtattgcacttgtggctcagacttcaagcacaagagatcacttaaggatcatattaggtcttttggaaagggacataaacctcatcctccctttgaagcctttgaggatgagaaggaatgcattactactggctctgatgaagatgaagttaatgctcatcatacatga

SEQ ID NO: 20129 - DNA, 390 bp, Glycine max
  Peptide Sequence Number=SeqID_136907
atggctgtggatcaccaagaaccaaatcaacaccaaccctcgatgtttccgtggcagctccggcggagggtcccactgctccggcggaggaaggtgcagacggtgcggctaggcgggaagaagccacggcggcgaatttcggggatacttaggatgtttcggaggatgcgtttaaggtggctaaagttgcaatatgttcgcatgctgaagaggcttaaggaacagtaccgaaacatcgttaaggatctggtcgaagctgggtccaccattgaaacctttcagcaacgtcttttcatggaaagcacttttgcaatccccgttggggttaacttgtctacctacccttctcgctttggatcagatcatcgccccagaaccatcttcatgtaa

SEQ ID NO: 20130 - DNA, 270 bp, Glycine max
  Peptide Sequence Number=SeqID_136908
atgtggcagggcacacgtgactgtcacgaaggaaagttcaaactgaaaaagaaagggtttttcagtgttcagatttgttttgccgaaaaagggcttggaaattctaagaatagtgggacaaatagtcaaataagatgctctgcaggatcgaggttgctcaaagatctaattagacaagaccttctttcgagccatgaaagaggttgtcttcccagcacagcgcaggatagcagtttgcgcggaggcaatgtaacgtgcaccgaaagttga

SEQ ID NO: 20131 - DNA, 402 bp, Glycine max
  Peptide Sequence Number=SeqID_136909
atggatggtggtggctacaacttaacaacaacctctttgagcagttcaatggagcaagtgatgagacccaaatcaccattgccgggcttagttgattttcatgggaagcggaagcaaatggttaagattcaggttttggagagagagattggtttgcttcaggccttaaccctgcttctagatgctgcaaagagtaaggctcccatcttcactattgtctacattattatatccgattccaagactctgtttcagatcccttcacacccactcttccacgggtttgctgctccaacagttgcctgctgcataagaaaacagcaaaaggttgttgttgggactgctgttcttcatcaaactccaagtgttgtcactgttgtggctgctgctgctgctgcttga

SEQ ID NO: 20132 - DNA, 339 bp, Glycine max
  Peptide Sequence Number=SeqID_136910
atgatattagtgttgggttccttcactattggagggatggttaataatgacctagtttcgtgttcattggttgatccagatacaacaagaattctggaagctgaacaagagatactattcatttcttcacacaatgagaacgagggttcacaggaaaaagcacactctagcaacaattttgagcacaggatcttgatgcactcttcaagcagcagcagcagcagccacaacagtgacaacacttggagtttgatgaagaacagcagtcccaacaacaaccttttgctgttttcttatgcagcaggcaactgttggagcagcaaacccgtggaagactga

SEQ ID NO: 20133 - DNA, 315 bp, Glycine max
  Peptide Sequence Number=SeqID_136911
atgagtggcaatgcatttttctcatgcgaaaaagcaaaagagatttggcaagttgttggtctttggcaacttattcgacccaaggctgatgctgcaaaaggattcacgaaatgccttctcgatctccttcaacatcttcaccaaacagacatgaacaaacttgcgttatcttgtaggaaatttggcaaaaacttgttgacttggctctacaattcagtgttgaatggctatctgtccgagacaccaatgcttaagaaacccatcaagcttcatcttctgccacttcttagactcctctgcattgggcactcataa

SEQ ID NO: 20134 - DNA, 354 bp, Glycine max
  Peptide Sequence Number=SeqID_136912
atgaacaacgagaatagcaaggcaacgctgaacggggttccgccgcaacctaaaccaccagatggtgagggtagcggaggagcgagggtgtcgtttcaagacaaggtgatggagggtagtgttgcggttccgcgtatgacaagaacagatttgattgcaaacaagttgctccggatcgagttggaagatggggataggtggctcccccgatgctatattgaagaccagctactggaggagttgcggaaaccatggacggatgcgcttatcatgaagcttttggggaagagactgagtttattcgtgacgagggaaagcaaaaggggtgtacatctttacgaggaaagggtataa

SEQ ID NO: 20135 - DNA, 1005 bp, Glycine max
  Peptide Sequence Number=SeqID_136913
atgaccactctcacacactccaatttccaccatgaccttcttcttcttttctatttttttctcctcaccgaatttccgtcgccgctcaccgcgcagcttccggacacgctaactccgccgtctccgcagcagcaggaggaccgttttgcgaggctgaagttcgacaaatccatggccatcgttctggtgatcctcgtggcggtgttcttcgtcctagggttcctctccgtgtacactcgccagtgcgcggagcgcaggatgcgagggaggttcgacatctccatctccatctcgcgccggcaacgcggcctggaccgcgaaatcatcgaaacgttcccaacgttcgtgtactccaccgtaaagagcctcaagttagggcgcgccacgctagaatgcgccgtgtgcctcaacgagttcgaggaggtcgaaacgctgcgtttcatcccaaattgcagccacgtgttccactccgagtgcatcgacgcgtggctcgccaatcactccacttgtcccgtgtgtcgcgccaatctttttcccaaacctgatgacccgtcttttgatcctatccaaattccggatccggaacaacccgttatatcatcaccgacccgagccgaaactgggggctctaatcctcgttctccgaatttgattgatcagaaccctacgtcgcggtcaaggtcaacgggttttcgtatcgcggggtggtttccgcggtctcactcgacgggtcactcgctggttcaacccggggagaattgtgaacggtttacgctgcatttgcctgaggaagtgcggaaccagcttatgctgagtcgcaccaagagttgcggcgtgggcgtgacgttcacgcgcgagaacagtgaaaggaggggttatagggcgaggagcgttggtagtagcctcagccctcacgtgagggggtggttttctgtgaaggatgatgtcggggaaaggtcttcggatcggttattctccacgtcgacaagggatagtgaggtttag

SEQ ID NO: 20136 - DNA, 300 bp, Glycine max
  Peptide Sequence Number=SeqID_136914
atgccgatctccccctgcggatggatcgtgcccgtaacacacccagtggacccggagaagtccaacaaggtcttggggtttccagctctgattatgggcttctgtcagttctacggagtgcctgtcacccccgacaaggtcatcaggccccctactaatcaagctttcatcaagaagtactgtgcccccaggcaggtgcagggcgaaacaccacaacagcctggggatggctggcagcgggcaacaaatgcaccgccaccacctctagagtttacctcagctcatccacaaaaaggttag

SEQ ID NO: 20137 - DNA, 186 bp, Glycine max
  Peptide Sequence Number=SeqID_136915
atggctaccttggggctggagattttggttgaatctgcctcaagtgttattttgaagatgatattatcatttgaccttgcttttgctttgattccgctcctaaagttcagtagcagcaaagtgactagcagcacaagcattgaagagagattgcagggattccaagggaaggggaccaggggatga

SEQ ID NO: 20138 - DNA, 750 bp, Glycine max
  Peptide Sequence Number=SeqID_136916
gccacatcagcaaatactgtaggctaaaaaagaagttaagaaaccttaacctagaacccgcaattgaagagcaaataaacaatttgctcatagaaacctcggaggaagaaacagaaacttcatcctccgtgctttccgatgaaaacctaaacttaatccaacaagatgaccaactatcatcaacagatgatgatgatgggcaaatcaatactataacgagagaacaagatctcttgtttgaagcaatcaattccatacctgacccccaggaaaagaaggtttttctggaaaaactcaagaaaacattagaggtaaaacctagacaaaaggattttatcacaaacaacaaatttgatgtaagtaacatactcaagagattagaaaattcttcaaccaaaccaacgacaatccaagatctccaaacagagataaacaatctaaaaagagaagtaaaagaacttcgtcaacaacaagaaattcatcagatcattctttctcaacttaaggaagatagtgattctgaaagtaccaacaacagtgaggaaaaccaaccagaaaatttagaagatgatatgtttatgggattaatcaacaagattaaaatccaaaaattttacataaacataaaaataattattaatgatttcgttttagaaacaatggccctatttgacacagggactgattcaaactgcattttagcaggattaattcctacaaaattctttgagaaaacctcagaaaaattaa

SEQ ID NO: 20139 - DNA, 132 bp, Glycine max
  Peptide Sequence Number=SeqID_136917
atggaaggtattgtgttttcctcttcaactttggccttatcagagatttgggtcttcgattttgtggttgttgtaatggtgggtatggctccaaggtcttcaatttggggtatctggggtctgaaaaagtga

SEQ ID NO: 20140 - DNA, 384 bp, Glycine max
  Peptide Sequence Number=SeqID_136918
atgttttaccagggcactcaacttccccctccaaacaacagagattcaccagattattgtgttccagtttcaccaccaagaattaaactcagagatggaaggttccttgcttatagagaaaagggtgtccccaaagaccaagcaaaacacagcatcatcattgaactaatagatgaattgggtatatatattctgcaatatccaaaccccaaacgctcactgaaaagtgaagcacttgacattgaagagcttgctgatcagttacagatagggtcaaagttttatgtgattgatgtctcaatgggatcatatgctacctggagttgtttgaactacatccccaacaggcaaattacatgcctatctcaaaatatgcatttataa

SEQ ID NO: 20141 - DNA, 396 bp, Glycine max
  Peptide Sequence Number=SeqID_136919
atggaaagggatagaatgaatctcaaacacaacaaggcatgggattgtcctacatacattaagagattgcgaatagacaaacttaaggactatgagatgaaaaatgagatacctttctttaatgttctaaagttaccacaaaggtcatcacctccaacaattgtggttcaagagccagctatagttcaagatcaagttaaggaatcaatcttagagtcaattcagcaacctatgaacctaatgcatgagccttctagaaaacctactcgagtgcaccatccacctaatagattaaacttgatggtcctagatgacacatcaaatgacgtttatcatgatgatgatgatccaagaagctatgaagaggctatgcaaagcttggattgtaagaaatga

SEQ ID NO: 20142 - DNA, 2916 bp, Glycine max
  Peptide Sequence Number=SeqID_136920
atgatgaatgcatcaagattgaagtctggacctgggggaatcaagtctgagggctcttcagagcttactagtacaggtgtgcgtgtgatgcttacaagtgagcaaggcgtttctcttcacagggaacacatagctgagcagagagttgttgccaaaggaagcaataggggaaacactccggaggacccagccagcaaccctaatacgctaataaaaaacaaggtatctcgggcaccaagaacaggttcagttggtgcactagaatcatctaacattcaaccttcatctacaacatttccaggttcttctattcatccaatgacccagtgggttggtcagaggccacctaaaaattcacgctcacgaagagtgaaagtagtttctcctgcctcacgcaatcttgaagttcaggtttcattcgaaggctgtctaacttctgagttctgtgtaaaagcttcttctgctggcaacaatggatttcaacttgcaagtagtgcagacaacagtacaccaaaatataaaagaccgcctgatgatacttcatccccctttggattatctgaaagtgaagaatctggagcgggggaaaacaaaataaaagaaaaagctgtgaatggaagtgactttgctatggccgcagataaggctggggcttctgtgtttcaaatgaggaagaataagatatcaactgatgaatctggagatagtgtgcagagacaaggaagaagtggaaggaatttatcattagtaaggccagacctcccttctgggagggagaagtcagagaatgtaccaacaatgaagccagtacaagacatgaagcctaatgataagagtaaaaccaaatatgggcgccctccttcaaaaaagcagaaagagcgcaaaattttgactcgtgtagggaagcaactgaacattagttctcctgattttggaggtgaacctgatgatgatcacgaagaattatataaagctgcaaatgctgctcgtaatgcaagcaaccttgcttgttcgggtccattttggaagaaaatggaatctatttttgcttctatcagcttggatgatgcatcttacttgaagcaacagctcaatattgctgaagaatttgataaaagtttatctcatatgttttgcattgatcatgatctgttgggtgttgttataaataacaagccaactcagggttcagaggaaagaaagagaagtcactgtgatgaagaatcaactaagtttgatgctttagatggtaagaaggacatggaaagactggacaaggttaccccactattccaaagacttctttgtgctctaattgaagaagatgaaaatgaagaatcatatcaccaaagtgatgcaaagaatatatctcgacaatgtgctagtgatgattctcactgtggttcttgtaatcaaattgattttgaacccaaagatcgggatagaatggactctgaagttgagtcagaggtggatcttcaaattcagaagaactgcatgttggatagactatcttgtgataagagcaccacatccaacacatttagatacccaaacacatccagctctttacaaagcactggagtttggcagggagatgaagaattttctctttcagatatcacacataccggcgaaatatgttcaaatgatcttgatcaactgcagcctgctgaattaagtgttcctagctttccttctcctgatggccagtatcagcagatgtcactggatgatagactgctgcttgagttgcagagcattggcttatatcctgaaatattgcctgatttagctgaggaagatgaagctataaatcaagacattgtgaaacttgagaaagcactgtatgaacagaatgggagtaagaagaataacttggacaagattgatagagctgttcaagaagggagggatgtggaaaggcagaagattgagcaagctgcatttgaccaacttattgaaatggcttacagaaagagattggcatgccgtggaagcaaaaattcaaaaggtgcagttcacaaggtgtctaaacaagttgctttggcttttgtcaaacgtactcttggaagatgtaaaagatatgaagaagctgacattaactgcttcagtgaacctaccctacaaaatatcatgtttgccccaccttcacgtgagaatgatgcacaacctgctgattgcatagtctctgggacagccagcaatacatgtaacaaagtttcccttcaaattgaagccagaaaatcaggtgcagtttctagtgtttctgataaatatgattgccatagagactatgcagacaggggattggttgattcttttcaaggttcaattcagtcatcagagcaagcatcatccaagaatgggtccatgtttatcagggaaaagaagagggaaatgttggtcaatggtggtgtcagtggttcttcctcaagagcatcaaatcttgatggtgctgttcatggtggactgaagggaaagagaagtgagagagaaaggaatcaaagccgggatcagagcggacaaaattctattggcagagctggacgcatatcactggacagtagccaaaatgagaacaaaccaaaagctaagaagcaaaagagtactgctagtggacatgatagggttatggaagcaaaggattctactcgtttaccaattcatgatgcaatcaataatcatagtaaagatggggctacgatatctggtaatcaggacacttctcaaataaaggaatccaatgactttgggaatttgccactacctgacttaagttcaatagaagaatttggtggtacgcaagatcttagttcttggttgaactttgaagaagatggtttgcaagaccatgattctattggccttgatattccaatggatgacctatcagatttaaatatgcttatgtga

SEQ ID NO: 20143 - DNA, 1260 bp, Glycine max
  Peptide Sequence Number=SeqID_136921
atggaccagcttcctgttgaagtgattgggaacattctgtcacacttgagggctgcaagagatgtggtgatagcttctgcaacatgcaggaaatggcgacaagcgtgctgcaagcaccttcatacactctccttcagctccaaagattggcccatttaccgggatttgacgactacccgcctcgagattttgatcacacaaaccattttccagagctctgggttgcaggccctatccattttgatggaagatgtggatgaattctcggcttccaccgttactgcttggctcttgtacaccagggaaactctcaggcaattgcattataatgtcaagactacgcctaatgttaacattcttgaaatatgtggcaggcacaagctggaaatactggatctggctcataattccattgtgggggttgagcctaattatcagcggttcccttgtttgaaatctctttccttgagttatgtcagtatatctgcgttggatctaaatcttttggtgtttgcgtgtccaaagattgaagctttggaacttgtcaatcctgagattgcaatgtctgatgcacaggtgaccgttgaattgagtagtttgacgctgaagagtgtgtatgtagaagcaatcagtttggacaagtttttattggaggctgatgggcttgagtgcttgcacttgaaagattgtgcactcgagttttttgaactcattggcaaggggaccttgaagcattttaagattgatgatgttagtgttatacatcttgatattggtgagacagttgagaatcttgagactgtggatatcagcaacttcactattatatggccaaagttttaccaaatgatttcaagatcgtcgaatttgaagaggcttcgtctttgggatgtgatgtttgacgatgaggatgaggttgtggatttggaaacaattgcgacttgctttccctacctgagccatttatcactgagttatgatgtgagagatggagtgcttcactatggtttacaaggctcttcctatctggagagtgttgttgtcttggagcttggctggactgtgatcaatgatcttttctcccactgggttgagggtctgcttaagcgttgccccaacctgaagaagttggtcattcatgggattgtttctcaggttaagtctcatgaagaatgccagatgttagccaatttcactacatccatggttgagctgatgcggagatacacacatgtagatccatattttaagtatgactag

SEQ ID NO: 20144 - DNA, 984 bp, Glycine max
  Peptide Sequence Number=SeqID_136922
atggcagataaagatgctttttgctacccttatcatgttcatgattgcacatcaccacaagagaatttgcccaataaagggccttttcattcagaaatgcttcccaaaaattctaggaaaggagctggttacacatcagagaagccacttgatgcaaagacactgagacgtttagctcaaaacagagaagctgcaaggaaaagccgtctcaggaaaaaggcttatgtgcagcaactagagtcaagtagattaaagctcacacaccttgaacaagaccttcaaagagctcgctctcaggatgagtttatgggatgtggtggtgctggtggcagtataagttctggagctgcaatgtttgacatggagtatgcaaaatggttagaggatgaccagcggcacatagtggagctccggtcggggctgcagacgccgctgtcggacggcgaactaagagtgattgtggatggatttctgtctcattatgatgaagttttcaggctgaaaggggtggctgctaaaacagatgtgtttcatcttattaatggcacatggacttcaccagctgagagatgcttcctctggataggtggttttaaaccatcagagctcatcacaatgttgataccacagttagagcccctggcggagcagcaaattatggtcatatgtgaactcgggcattcgtcactgcaaacagaagaagctctcagtcaaggtcttgaacagcttcagcagtctcttgttgacaccattgccggcgggcccatcgccgacggtgttcaacagatggtggcagccatgaccaagcttggccaccttgaagaatttgttgctcaggctgataatttgaggcaacaaacccttcaccaattatgtcgattgctgacagttcgtcaagcagcaaggtgttttcttgtgattggagagtattatggccgtcttagagcccttagttctctttgggcatcaagaccacgagagtaa

SEQ ID NO: 20145 - DNA, 342 bp, Glycine max
  Peptide Sequence Number=SeqID_136923
atggcatgggagttccttcaccgaaaatttagaagccaaccaaaggggaaagggaagaaggaagtgcatacctccgcaatgctcggcattggcagggtgatccacctccaatgcaccctaggggaggacgacaaagaggttgtggcggcgattgaaatcctcctagacggattgagggacgatgaggctctcaaaatcgtggatgacgttgtcggggcgaaaggcatcttcagcgtggagtatctcgacatagtcgacagttctctggttggagggcttggaggccaaatgaaggtggtggtcggagagagaaagcttatggagatattattgttgaagtga

SEQ ID NO: 20146 - DNA, 1230 bp, Glycine max
  Peptide Sequence Number=SeqID_136924
atggcaagccccgccatctctttctccttcttcttcttcttcttcttcttctctgcgccactcttgaattttcttcatcttcaccctccaatcacctctacgatgttggagaacttgtcccattgtttgtcaacaaagtgggacccttcaacaaccccagtgagacatatgaatactatgattttccattctgcaccccaggttatgtttttcacagacccaattgtcagaaagaaagagtcccttggggaagttctcaatggtgaccgtttgagcaatgctttgtacgagttcaagttccgggtggacaagattgatgagaccttgtgccaaaataagcttacaattgatcaattttacctggatgatcttccattctgggggttcattgggaaacttgaagaggatgggtggactcctggtggaggagaaccaaattattacctttttacacatgttcaatttgatgttctttacaatgggaactggatcgtgcaagtaaatgcatttggcgatccaaatcgcgctgtggatattactaaagatgttggtgttgatgttaagttcacttattatgttatctggaatgccactaaagtacgttttgagaacaggatggacagatactcaagagcttcgttgatgcctgcccaccggcaagttcattggttctcgttcattaactcaattgtcgtcattttgcttttgattggtttgcttgccctgctttatatacggtatctgaggagtgatttgaaaaagtattctaatgcaactgaagaagataaggaggttggttggaagtccctccaacacggcgatgtattcagacctcctccaaactcatccttactttttgctgttgtgggaactggttcccaattgctatcttcttcatctttgcatcaacggatcaaccaacctaggctctgtgtcttgctgtttctagcacttattggcaccctctatccctacaatcatggaggactgttaaattgccttgtcttgttgtatgctctggcatctgtttttgctgggtacactgcagcatccttccatggccagtttgctgagaatggatggattgtgaagggaagcaacagaaatgaaaaaagaagaggggaagaagatgaagaggagaatgaactaaaaaagccagatcaaacaataaacaacaacaacagatcacagttgaaaaacaagaaaataaacaatccgttgaaaaagtaa

SEQ ID NO: 20147 - DNA, 504 bp, Glycine max
  Peptide Sequence Number=SeqID_136925
atgctgaacaaggatgttgtgtttgtgtttaatgatgaatgtttagaagtctttaatacccttaaagccaagttgctctctgctcctgtgatcacagcaacagactggggacaaaagtttgaattaatgtgtgatgcaagtgattatgcagtagcgattaaatatttgttgcacaaagctgattccaaaacacgacttatcaaatggatattgttacttcaagaatttgatttagtcatcaaggacaagaagggatctgaaaatgtggtagcagaccacctatctagattagtcaatgaggaagtcactttaaaggaggctgaaataaaagatgaatttcctgatgaatttttgtttttgattgcacagtgtcgcaacctacccttttgcgggagggtgaggcgaggctcacgggtgcgtcttccaaaggaggaaaatgtgcagagtcaccaccaacgtttatttgtggaaaacgtcggaaaaactgaaggaaaccggtcatga

SEQ ID NO: 20148 - DNA, 582 bp, Glycine max
  Peptide Sequence Number=SeqID_136926
atggctaattttgttgctcctggccacctgattatcaaagatgaaaacttgaatcttcattctaaaaagactactaagtcgaagaattctaagacaaatggaaagaaagatggttcagggattgcaggtcgaaaagctctaaatgatataacaaacaaaagttcacttcaccaccctgaagcctcggttaagaaaaggaatttacccaagcaagatattaatgtaaaggaggaaatgttcttgcatgatcacaagaagtgcattgaggcacaaaatgctactatgagaaatttcaatcttgagacagttcttccacaagatggtaatcgcaactggcttttacttcagtattcgatgtatggcatgagttgtgaaaatctttatggtgttcctcattcccctcaatgctacccagaaccagtagaattgccaatgcccaacttttccgattggtttgaccattcaatgcagtggagctctcctccatcttctccgttgtcatgggactctccatcttcccttgcatggcaaaatgaagcagttgaatttgttttgaaggaagaaattgctgtccaagtgtaa

SEQ ID NO: 20149 - DNA, 357 bp, Glycine max
  Peptide Sequence Number=SeqID_136927
atggaaatggcagcatctttgcctgctacagaggacccactgcagcaaagggagaagctttatcttctggctgttggatactatagaaatgctgattattcaaggagtagggatctcgtcgacaggtgcctcgcgattgcacccgactggaggcaggcagtgacactcaagacaacaatcgaggataagatcaccaaagatggtgtcattggcctaggcattgctgcaactgctgtaggacttatagcaggcaaacatctatattactgtgattttgctgcatcttactgcttttatgaaaaggagggcgtgaacaataatgtgtacaaagcggtggagatgatgtctaagtactag

SEQ ID NO: 20150 - DNA, 270 bp, Glycine max
  Peptide Sequence Number=SeqID_136928
atggtgcggaatactgtaatggacatggctttgaacacgttcatttccataactgaacatgtatccttgctcaaaattctattccttcttcctttccctcaaagctcaaactccaaaaacgctacccctcttgttgtacagtacgaggagaaagtcttcgagtttttagggttcgaaaaatccaaggattgtcttgagcaggtgaacaaatggcagagcatagagaacataaggttgttgataaatctcagtagctccagctacaagtag

SEQ ID NO: 20151 - DNA, 1740 bp, Glycine max
  Peptide Sequence Number=SeqID_136929
atgggtctgtccaaggagaatctgaaaggtctcatactagctttggtgtcaagtgggttcattggggcaagttttatcattaaaaagcaaggccttagaagagctgcagcagtttatggtgtcagggctggtgttggtgggtattattatctcttggagccattatggtgggtgggaatgatcacaatgattgcaggagaggttgcaaactttgttgcatatgcgtttgctcctgcagtcctagttacccctcttggtgcactaagtattattgtgagtgctgttttggctgacattattctgaaagagaagctacacaatcttgggattttaggctgtataatgtgcattgctggtagtatcattatttttattcatgctcctaaggaacaacctattacatctgttctggaaatatggaatatggctactcaaccagcttttctggcatatgtgggctcagtaatagtattggttttcattctggtcttccattttgcaccaagatgcgggcatacgaatgtgctagtttttactggcatttgttcattgatgggttccctctctgtgatgagtgttaaagcccttggaacttctttgaaattaacttttgaagggaaaaatcagttaatctacccagagacatggttttttatgttagttgtggctatatgtgtcatcatgcaaatgaattatcttaataagcctctttgcatatgcaagggtaaggctgcgtataatatccctcccccataccttcgcatagcgaagagcctccgggcaatggggtacgaagttaaagaagttaaagttaagccttacccttgcatatgcaaagaggctgtttccggattcgaacccatgaccaacaagtcaccaaggcacaactttaccgctgcaccagggctcgccctcaaaaaaatgaaaaatgcaacaaagctgctaatttctttatatatgaaggagactcccttacaaactatatgggtatggttgtggcaaggaagtgaaattacgcccatgaataaggatatgagagattatggagaaaaaataaacaagcttcatagtttaatcttatcagacagtaagaggggaattacattccatgggaggactgtttctgataagatcatcagtaatggctcctatgattttactagttgcatgttaaatcctccatacaacatacagtattacaacatgcgaattcctatggaatgtaaattcaagatagagcaaacctcagaactcagaactcaagatgagtacccgacactaaatctcagaactaagagattacataatacaacaaaagtcaaatcaagatacaacaaagctcttgacaccttcaacacagcaattgtatctcctatatactatgtcatgttcacaacacttacaatactagccagtgtaataatgtttaaggattgggatggccaaagtggtggaactattgtgtcagaaatatgtggcttcatcgttgtactctctggaacaataatgttgcatgcgactaaggacttcgagagaagctcttcttttagaggtgtgataaatttgatcatagcacttaattctgctgccactgactatccagatgaatgcagtgctccttcatcgcctacgctatctgcccgactttttaccggaaatggggactcattacttaagcaagatgaggaaaatggatctcccgagagtaatatgtgctcaagaaggcaagagttgtattag

SEQ ID NO: 20152 - DNA, 2481 bp, Glycine max
  Peptide Sequence Number=SeqID_136930
atggttaggatgttagatatactgggagagtatatgtcccttcgagggtttcaatttcagaggcttgatggcagtacaaaagctgagcttcgacaacaagcaatggatcatttcaatgcacctggtagtgatgatttttgcttccttctttcaacacgggcaggaggtctgggtatcaaccttgctacagcagacactgttataatatttgattctgattggaatcctcaaaatgacctgcaggcaatgagtagagctcatagaattggacaacaagaagttgttaacatatatagatttgttacaagcaaaagtgttgaggaagatattctggaacgtgctaagaagaaaatggttctggaccacttggtgattcaaaaactaaatgcagagggtagactggagaagaaagaagccaaaaaaggaggaagttattttgacaaaaatgagctgtctgcaatcttacgatttggagcagaggagctctttaaggaagaaagaaatgatgaagaaagcaagaaacaactcttaagtatgaatatagatgagattcttgaaagagcagaaaaagttgaagagaaggaagctgacggggaacaaggaaatgcgttattgggtgcttttaaggcaagatatgtggacagtactgttgccaatttttgcaatgatgaagatgatggaagtttctggagccgttggataaagcctgatgctgtattccaagcagaggaagctcttgttcctcgatctgctagaaatattaaaagttatgcagaagttgatccatctgaaaaaagtaataaaagaaaaaagaaggaacctgaaccacttgaccgagtttcgaaacgtcggaaagcagagtattccgctcctgcagtaccaatgattgagggagcatctgtccaagttatgaaatatggcaatgagagccaagttgacttaattgttgccgaggttggtggtgctgttggggctgctccacctggagtacagattgaacttttcaatgctcttattgatggctgtacagaagcagtagaacttggaaatcttgatgcaaaggggcctttgctggatttttttggtgtaccagtgaaggcaaatgatctacttacccgtgtccaacaacttcaacttttggcaaagcgcattggtcgatatgaagatcctattgcacaatttcgtgtgctgtcatatctcaaaccatcaaactggtccaaaggttgtggatggaatcaaattgatgatgctagattgcttcttggaatacattaccatgggtttggtaattgggaaactattagattagatgaaagacttggccttacgaaaaaaattgcacctgtagaacttcaacaccatgaaactttcttgccacgagctccaaatttgaaagaccgtgctaatgcccttctggagcaagaacttgcggttcttggtgtgaaaaatgccaacagcagagttggacggaagccttccaagaaagagagagaaaatatgattaatatctcactgttacgtgggcaggagaaaaagaaaaaatcgagttctgttaatgtccaaatgagaaaggatagatttcagaaaccccagaaggttgaatctatagtaaaggaagagggtgaaatgtctgacaatgaggaagtatatgagcagtttaaggaggtaaaatggatggaatggtgtcaagatgtgatggttgaagaaatgaaaactttgaaacgtcttcacaggttgcagcaaactagtgccaatcttccaaaggaaaaggtgctttcaaaaatacggaactatttacaacttcttgggagaaggatagatcaaattgtgctagaacatgaacaggaaccctataagcaagatagaatgactgtgcgactgtggaaatatgtgtccaccttttcccatctttcaggggagaggcttcatcaaatatattccaaacttagacaggagcaaaatgaggcaggggttggcccctctcacgccaatgggtcagtatctgtttcatttagcagaaatggaaatccattccatcgccatatggagaggcagagaggattaaaaaatatggctccctatcaaatgccagaaccagttgataatactgggaaatctgaggcatggaaacgaagaagaagaactgaaagtgacaatcatttccagggtcagccaccacctcaaaggaccttaagtaatggaatccggattactgatcctaactcactcgggatcctaggtgctgggccatcggacaaacgctttgctagtgagaaaccttataggacacaacctggtgggtttccttcaagacaaggcttctcttcagcttcagcaattgtacattctgtggaatttttttcttccacccatgcgaataagaccttgcggatccctttttggtgtgttttggcggatatgagaaatatccctacactgggattcacatccttgaagatggctgaagccgaaaagatctaa

SEQ ID NO: 20153 - DNA, 237 bp, Glycine max
  Peptide Sequence Number=SeqID_136931
atgcatgaacacgaaaacttggctgacttaatgttacttgccacagtgttagctcatcaacgacaccttggccttgaggccaacttggtgcagttcttgatggaactcttcatcattaagcacatatcagtcttcagctacctaggagctctcataggaggaggcttctttttatctccttttggagatggaccaccaccgtttcactggtctccttgcgtcgtcaccaaagcctga

SEQ ID NO: 20154 - DNA, 222 bp, Glycine max
  Peptide Sequence Number=SeqID_136932
atgtaccaaactgcgaagttgaaaggaagtgagaaggctctagttgcacggcatgaagctcgtcatgctgtagtaggtactgcagtagcaaaccttcttgctggacagccacatgttgaggtgtggactttgggatatcttattttagaattcatttatcttgttttatggtgggaaattaaagaaaagtataaatctgttatgtgtgatattaagcgatga

SEQ ID NO: 20155 - DNA, 300 bp, Glycine max
  Peptide Sequence Number=SeqID_136933
atgaagtcaaggggttacatagaatctgataatctaaaagatgatttgccttaccaagtagaggaaatgtcacatgtcaatgaagtcattgaagttgaaaatatgtcatcaggtggtgctaaccctccccgacacctgtcacatgactctagtgggaaaggaacaggtgggaagaaaaaaagatatgtgattagactattatcacctagagatagtctgctatcatctaccacatccccgtctactatatatttgccagtcagatcttccaatgttgcatcgacaccatctccactgtag

SEQ ID NO: 20156 - DNA, 279 bp, Glycine max
  Peptide Sequence Number=SeqID_136934
atgttttcagcattatccaagaggaagagagttcttattcgtgtgtcatatctagaaatatacaatgaggtgatccttattgggtcatttctatgccatgactcggattctacctggaccgctctttattgggctgcaaggtttgggagaaacctttactttatccttgggagaagggaataccaatgcaaagaaagagaacaagaaggacaaataaagcctctaatacctacccagttagtcaaacattacaaattgttggctgcatttaaggagtaa

SEQ ID NO: 20157 - DNA, 2283 bp, Glycine max
  Peptide Sequence Number=SeqID_136935
atgcagcaagggattatgaagaagtggagaggcggtactttgaaagggttaaggaatgttatggtagatcctgttagcctttgtaccggtactacatgtgaacgatctgctattgaagcttggttttgtgatggcaacaggacagacccagaaactaaagaggttcttgaagatactaccttgaggtctaacattccactaagacaatccattgaagagtggagagaacttaattactgtctggtcataaggtctattagggaaaacttgttatcatattctgacctgcaagaatccctgagccaaatgcagactctagtaagagagaattcgattaacaaggattggatttctatagcagagcttactgacattgtgatctctatccttgggagctctgatgacagagaagtgaagatgaagattttgataactttgaaggatgctgtagaggggaatacaagaaacaaggagaaagtggctgaatctcaaggatgggataacattatttcctgcttagggagtgactctagcacttcaaaggcagctattgatttgctacatgagttgcttcaagaacaatccgggtggaatgaatgtctctgcagaaagctttctgaaaatcgcactgcagttcagttccttgttgcccttctgaagaatcatgtcaatcattctgctgaggttgcagaaaacattttgatgaatctttttgaactaaatgatgaaaccattactattgctgctaattttggctggtataaaccacttgttgatcgcatgattcaaggaccagattcaagaatatcaatgacaaaagccatagttaatttggagttgaaggatccaaacttaaaactccttggcaaggaaggagctatacctcctttgctagaaatgctgtcaggcaatattgaatcaaaagacttgtcgttatcagccctggttaaattagcaggatctcatgccaataagggaattattgctgcatctggaggagtccctcttattatagatttaatgttctctcctcagtcacggacactaattatcattaaatgttctgaaatcattgagaagctttcttctgatggtgatggaattgatttctttgttgatggagaagggaaacaacttgagttggattccatcatcgccaatttgctagctttgcagcagacttccaactcaggtcacaacatccgtaagcctgcactgagtgcacttcttggaatttgcaagtttgagactggtttggttaagaaagcaattcttgcagccaatggtgtatctctaattctcccactccttgatgattctgactcagaaatcagggagacttccataattctgctctttcttttctctcaacatgagccggaaggagtagttgaatacctcttcaggcctagaaggcttgaagccttgattggatttcttgagaatgaagaaaatgccaatgtgcagatagctgctgctggtttactggctaacctgccaaaatccgaaagagaactcactatgaagttgattgagttgggtggactcgatgcaatcataagcattttgaaaactgggaaaatggaagcaaaagaaaatgctctcactgcactcttcaggttcacagaccctacaaatatcgagtcacaacgagatctggttaagcgcggaatataccctttgcttgtagattttctcaacactggttcagtcacagcaaaagcaagagcagcagcattcattggtgatctttctatgagcactccaaaactcacagttgttcccaaaccaactggttgctggcttttcagatcatcgcgtgttccgttatgttcagcacatgggagtgtatgcagtgtgaacaccacattttgtcttttagaagcaaaggctttacctggcttgataaagctgttacatggggaggttcatgcaactgcttgtgaagcaatacaaacactctccacattggttttggaagattttcctcaaaggggagctcgtgtcttgcatgaatataatgcaataaggtccataatggacattttgaactggggaactgattctctaaaggcagaagctctaggactgttggagaaggtgtttgtgtcaaaggaaatggtagaatactatggaacaacagctagatcacgtttaattggtctcactggcatgaatatatatggggatggacaccttaggagaaaagctgccaaggtactatcattgcttgaacgctactcaaagtcatcatcatctgcaatctcaggagttccggagtga

SEQ ID NO: 20158 - DNA, 633 bp, Glycine max
  Peptide Sequence Number=SeqID_136936
ggtaaaaaaattaaatgttcaaaatctcaagccaagcaccgtctttttattggcaatgttcctagaagctggggtgttgaagatctgaagaagattgtaactgagattggacctggagttactggtgtggaactagtcaaggatatgaagaacaccaacaataaccggggctttgcttttattgactattataaccatgcatgtgctgagtattcaaggcaaaagatgatgagcccaacatttaagctaggtgagaatgctccaacagtgagctgggctgatcctaaaaatgctgagtcctctgctgcatctcagaaatcttctccatcaacaaccgctatcatcttctctggtctccctcttcctccacgctcaacatcaacactgaccagacaacacccaaccaaaccatcagccactatattaggactgagcccgactacgctgacaaattcaaccacctcaaaaaccaatcagagaacaaatcagagttttttttttgggggagggggggagcatgctggagattgcagccacaggaagctggaaaaactaggattggcctttcttaggattttccaggggaaggaaaaattagatagcaagttagagttgatagttagaggggcttaa

SEQ ID NO: 20159 - DNA, 948 bp, Glycine max
  Peptide Sequence Number=SeqID_136937
atggagagtgaaatcatccctagtgatagtgcaatggtggtccttgcagatagcgtgcacaatggtgaatcagagaaggagcaagtaatagccatggaggtttgggtttcatgcagtctggtcaactcaccactgccagaactctcagacttggattcacccattttggctaatggatcatcaatgatgagtgacctttggatttcatattaccatgccgttgaatatatagactattttttaacagatcctattctagatgcattgctctgtaaacaaagcattgaatatagtgaattgttgtgcatgtgtgaacaggtgaaggcagtatatgtgaagaaccttccaaagaatgtaactcaagagcagttgaagaagctttttgaacgtcatgggaagatcacaaaggtggttcttccaccagcaaagtctggacaggaaaagaacagaattggctttgtacattttgcagagaggtcaaatgctatgaaagcactgaaaaacactgaaagatatgaattagaaggtcaacttttacaatgctctctggcaaagccacaggctgatcaaaagtctggaggatcaaacacacagaagccaggaccaggattgcttccaagctatccaccacatgttggttatggtttggttggaggtgcctatggtggacttggtgcaggatatgctgctccaggtcttgcacagcccatgctatatggaggaggtcaaactccctcaggaatggccatcatgcctatgcttttagctgatggacggattggatatgtcttgcaacaaccaggaatgcagccacaagccccaccctcacatcatagaggtggcaggggcggtggtggcagtgggagtggcaacaggaatgtcgggagttcaagtaagggaaggcacaacaatgatggtggccatgggcgcagatatcggccatattag

SEQ ID NO: 20160 - DNA, 1254 bp, Glycine max
  Peptide Sequence Number=SeqID_136938
atggaaaattctatttaccccttagtgagagttgtgatcagaatagcttcacaagaggaatcaacaactatttttagcttcctcattctctcaacttggagtagtatctattctcctcatgatttgtttgtgcaaatccatggccttggttttggaatcaactacggacagataggcaacaatttacctcctccatctcaagttgctgttcttataaaatctatgaatgtgagtaggatcaggctctatgattctgatccaaatgttctactagccttctctcaatccaatgtggaattcgtaataggacttggaaatgactacctagagaacatgacaaacccttctaaatttcaaacatggattcagcagcatgttcaaccttacctctctcagaccaaaatcacttgcatcacagtgggaaatgaggtgttcaatagcaatgatactcagcaaatgttgaatcttctcccagcaatgcaaagtgtgcatgatgcccttgttaatcttggactagacaaacatgtaaccgtcacaaccgcccattcattcaacatattatccaattcctaccctccttcatccggggcatttagggaagatcttgtgcaatatatccaaccccttcttgactttcatgctcaaatcaactcacctttcctcatcaatgcataccctttctttgcatacaaagataacccaggcgaagtttccttaaactatgtgctttttcagccaagtgaaggcatgattgatcaaaacaccaatttgcattatgacaacatgttgtatgctcaaattgatgctgtctatgctgccatcaaacaaatggggcatgaccatgatgttcaagttaggatttccgagaccggttggccttctaatggtgatccggacgaggttggagctacaccgcagaatgcagctttgtataatggtaacttgatcaaaaggatacagcagaaacaaggcactcctgcaaaaccatctgttccaattgacatatatgtctttgcactttttaatgagaatttgaagcctggtccagcatcagagagaaactatggactttactatcctgatggtactccagtttataacattggattgaaggattatctccaagagattcctatggcagctaaatccaattttgatgatatggtcgtgtttgtggtggttggcggtgggggcaagatgactatggatgggatcgttatgcttgtgatgtcaaagaagatgaagatgggttag

SEQ ID NO: 20161 - DNA, 456 bp, Glycine max
  Peptide Sequence Number=SeqID_136939
atgcctcgggaaaaagcaatttcttcatcagctgctaagccatctgagcctgaggagccagttgaatctgatgagaaggttgattttgaggaggcaaatgatccagaggaagcaatggaagaagaagtagaatatgaagaagtagaagaagaagaggaagtggaagagatagaagaggaggtggaagaggtggaagaagaggaggaagtggaggtggaagaagatgaagaggaggaggaggaggaggaagaagaggttgaagaagtggaagaagatgatgccatgcaaaatcatagcagtgatgaaacaaaggtggaagatgaggatgagaagaaaaaacatgctgaactcctttcaattcctcctcatgggtctgaagtatacattggtggcattcctcatgcctcagatgaggatttgaaatctttatgtgagcgtattggggaagttgcagag

SEQ ID NO: 20162 - DNA, 2016 bp, Glycine max
  Peptide Sequence Number=SeqID_136940
atgattgctagattatgtggccacgctttttcagttgtacaagccatgattgaggcaacttcagaggagtttctagaacttaccaaaagtgcattgctggcagctctggaagctcttgctcctggttcactttttgggcttgctaccttcagccacaaactaggattgtatgatgttcaaggtccaatacctgttgtgaaaaatgttttcatccctcctgatgcagagggaaccctgcctattgagcttgaagatgtcatgcctttgttacagtttctggctcctggcaaagatcaaattatatggaaaactgcatcagatctaaattgcatattttttttgaaggtggaaacttataaggaccgtattgcatctgcacttgaaacacttagaccaacaacttcatgggagagaaccacgacagcaggtcaagggctggatggtgttctgataggtgggcgtggttttgggatggcaatggaagctctctgcaattaccttggttctgaatatgggaacacttttgctttagctagagtctttgccttcttgtctggtccccctgattatggagctggacaattggacacgagacgatatggtgaacaatatgcaagcaaaggagaggatgcagatcgtgctttactcccagagcagacacccttttataaagatctggctgctgttgctgttcaagcaggtgtatgtgttgacatatttgccgtaacaaatgagtacactgatttggcatccctaaaatttctgagtattgaaagtgggggttccttatttttatacacaagtactgaggattcaacattgcctcaggacatgtatcgaatgctgagtcgaccatatgtttttggttgtgtcctgcggttaagaacctcgactgaatttaaacctggcaattcttatggtcacttctttccagatccacagtatgaaaatgttcaacacatcatatgttgtgattcttatgctacatatgcttacgactttgtgtttgagaacaacattggattttcaagtctccagccactgtgggctgatctcccaatgccatgtcatcattgtggcagaagtaaatcagatgttcctacaattcagattgcattccagtactcagttgtagttcctcctcaggaactttctgattctaattcaggaggggtttctacaaatagaaccaagcactcccttcagcgtcggctaaggatccgaacattgcaatttggtgttgctcagaacattcatgaactttatgatagctgtgatcccgaagttgttctatctttgcttgttcacaaggttatattagcctctttggaggaaggagttagggagggtagaattttgcttcaagaatggctagtgatcctgacagctcagtacaatgatgcatataagcttattcagtatgataatggaagttccataagatctcagattgatgttgcattctctcaatgtcctcaattgcagcccctaccacgcctaatttttgctctccttcgaaatcctcttctccgctttcatgaagagggtgttcatcctgaccatcgcatctatcttcaatgccttttcagcatgttggaacccagttcccttcatcgtgctgtgtatcccgtgttgacatcatatgctactccagataaacaagcatatcctcgccattctttgagccgtgcagcattgattaccagtggcagtccgatatttttccttgatgcattcacaattctgatagtgttttattcttcgacagcagacccgacgcttccttttcctccaccccatgattgtttgttaaggactacaatcaacaaattgaagcaggagagatgcatcactcccaagctgatttttattcgaggagggcatgatgatgcctcaatttttgagaactttctgatcgaagagcaggatgttgatggaagtggtcttaccagtgttatgggttttgtttccttccttgaagatactacacagaaagttttagaattcatgaaatag

SEQ ID NO: 20163 - DNA, 225 bp, Glycine max
  Peptide Sequence Number=SeqID_136941
atgtctccgtctcttgaagccattggacggaaaatcagaaacggcttgtcgcataccgtaattttgacaaacaagaaaaatccaaaactcaaattaacggcgccactacatttaccgttttgccagtatcagcgagacgccactctagggaaggtgcacagattgaagagcttgtgctcaccaacatgccgtttgaactcgggttcctttcgccgccttcgttaa

SEQ ID NO: 20164 - DNA, 213 bp, Glycine max
  Peptide Sequence Number=SeqID_136942
atgggtgtgcgtttggtaacccaagagaagcgggttttggtggtggttttctttggctcatgtggagtagcttctaatactcttgcagaactccaagaatatcttgagaggggaactaggttgctgattctcttgctaatgatgatactcaagggatacatcatttggttattcttcaggcatcatcccttcaccacacccaaggctcgctaa

SEQ ID NO: 20165 - DNA, 1143 bp, Glycine max
  Peptide Sequence Number=SeqID_136943
atggatccccaaaaagctttcccagataaaggtaattgtgcagaagagttcttcaattcggcattaaacattccccaaaaagctttcccagttgaaggaaaattttggaatctcagacacgggaaaaggaaaatatcaaaacacatgctaaaatgggtaacaacaacaaatgaagaggtgcaaaccctaaacacaaacactcacttcaacccacaggtcccacccctccgaaccctctcttcctcgaagcggttcgagggttcctcggagttcgtgaagctcaaataccacatgggacctgtgctatcgtctccgatcaacatctacctcatctggtacggcaagtggccccaatcccagaagctcctcatcaaggacttcctcaactcaatctccgacgaccaccaccgcgcctccccctctccctccgtctccgactggtggcgcactgtctccctctacaccgaccagaccggcgccaacatctcccgctccgtctccatcgccggcgagtactccgacctccgctactcccacggcacacacctcacccgcctctccgtgcaggacgtcatcgccaccgccgtccaggccaagcccttccccgtcgaccaccgcaacgggatctacctaatcctcaccgccgaagacgtcaccatggaagacttctgccgcgccgtctgcggtttccactacttcaccttcccatccaaggtgggttacacgctcccttacgcctgggtggggaactcaggaaaacagtgtcccgaggtttgcgcttatcccttcgctgttcccggctacatgggcggcggcggccccggccacctcacgccgccgaacggcgacgtcggagtggacggcatggtgagcgtgatcgggcacgagctggcggagctctcgtcgaacccgctggtgaacgcgtggtacgccggcgaggaccccaccgcgccaaccgagatcggagatttgtgcgaggggttgtacggaacgggtggtggcgacggttatattggttccgttatgaaagatggtgaagggagaacctttaatcttaacggtaggaatggacggaagtttctagtgcagtggatttggagccccgttttgaaggcttgtgctgggcccaatgctttggattga

SEQ ID NO: 20166 - DNA, 363 bp, Glycine max
  Peptide Sequence Number=SeqID_136944
atggttgtggccattgggcgaccagagcactcttggcgtgtccattctgctgaaattgatgtcacggtcaaacaatactttagaccgactccaaaaagctatcgcatgtctacgtccatgactccaaaatccatggagcaactaacgcaaaatatcagggaccagcttaaggagtcggtcattgaaaaaagaaatatgggttatatgtatgttgatgacaatccttcctgcccgattgcccttgtaagagtttatgagaggtcgacaaccgtccataacatccctttgggaaatgatcaagtgaatgtcggtgttgaggaagttcgagatgttgatgctcatgtccctatacccactcaatag

SEQ ID NO: 20167 - DNA, 222 bp, Glycine max
  Peptide Sequence Number=SeqID_136945
atgaagggtgggtcagttgtagattctatagcatatgccacagaatttgggattgttggatcactatttttgtctaatacagtagacaaagagaatgcccttgatgccttgatgagttctgcagaaatgtggaagccattacttccaagttccagtgataggtttgagatctgggaggattatatgacttggattattggattttgttttcctgggacttaa

SEQ ID NO: 20168 - DNA, 321 bp, Glycine max
  Peptide Sequence Number=SeqID_136946
atggctcgccttggcgaatatgtgacatcagcactaagtaacaattcgtctgcgcacatagttacatcacctagctccccacctcctcctcctgagtcagcaccttcagcgtcttcgccgaagaagactagaaaaacagcacgactcagatcattggctatcagacccatcaagatggagagactagtggttcatatggatcctacaactaggaaagctaattgtccccagagaaagaaattaaggatgcatttgggaatcgtcgctcgagacaaggtgaacattacatttgttaactggaaggaagttcctacaacttag

SEQ ID NO: 20169 - DNA, 618 bp, Glycine max
  Peptide Sequence Number=SeqID_136947
atggcgacgatggcagagttgctgacatggctgtttctgccacgtgggatccgacgtggcgtgggtgatttgggcacccaaggcagtcacggagcacttgggttggcgacgcgtgtcggagaagattatcgtgcgctgtacgcattgggtttttgtaaggggggaatttacgatagtgcccttgccactacgtcgaatatcgggagtgtacgaagaccatggtattatggtggatcaaggcgtttggaaattggaaacatgtggaaagacaaagcggataaccgatatgaatgggaaaactttagagtagctgggaatcacatccgtaagttggaagcagttgccatagcgtacactgcacagaaagatgtgttcatcaacaacaacaataaagatatcaatgttggtcataatggtagtggcggtaacgatggcggtggaggtgacgtcaatggtagtagtgatacaaatggtggtggcagtgacaatgtggtgatagcaatgatgttggtggtgaacgacggtggtggtagtggtgacggaagcggtattagtggtggtggtaacaatattaatgatttcagtggtgacaatgaggttgatgatgatgacaaataa

SEQ ID NO: 20170 - DNA, 1185 bp, Glycine max
  Peptide Sequence Number=SeqID_136948
atgcctccgatgaagatccaaccaatcgacgtcgattcacagaagctcgcggtgatccgaaacgacgccgttaagccggtgctgaagtcgcgcctgaagaggctcttcgtgttcgaccgtcagttctcgaatgtgctcaagacttcttcgacttcctcgtccgagaaaccagccgccggcgaggctccccagtcgaacaccaaagacggagcggcggagtttgaaccgagctccgtttgcttagacaaaatggtgcagagtttcatcgaagagagtaacgagaagcccgcaccggccaccgcgaaatgcggtcgcaaccgctgcaactgcttcaacggcaacaacaatgacagctccgacgaggaactcgacatcttcggcgactcagtttcctctggctccttctgcgacgccagtgacgcactcaagagcttgattccttgcgcgagtgttatggagagaaacctcttagctgacacatcgaagatcgttgacaagaacagcaaggtttataagcggaaagacgatttgagaaagatcgtcaccgaaagcctttcctctctcggttacgattcctccatttgcacttcgaaatgggacaaaaccccaacctgccctgccggtgaatatgaatacatcgatgtggttgtggaaggtgagaggttgataattgatatcgattttcgatcggagttcgagatagctcgatcgacgggaacctacaaggcgatccttcagtctctgccgttcattttcgttggaaaatcggatcgactctgccagatcgtcgccgccgtgtcggaggcggccaagcagagcttgaagaagaaagggatgcacgttccgccgtggaggaaggcggagtacatgttggtgaagtggttatcaagttcctgcactagggcgaatctaacgtcgtcctccgccgtcaatgactcgacggagaatttgagcgacggcggaggcggcggctatgatgccgcggagagtgagtgtggtgaactggaactgatcttcggcgaaaaaacatcgccgccaaagccggagacttttcccggcgttgagaagagctttccaccggtcgcgacgccgacgtggcagccaccggcggtgagagtgaggagtgttgagagaggggttaaggtggtcaccggattagcttctcttctcaaggacaagccatag

SEQ ID NO: 20171 - DNA, 201 bp, Glycine max
  Peptide Sequence Number=SeqID_136949
atgtcagtacagtgcatcgacagagtagtggaattgaaaattccagcaatcctccaaagcttcgtaggaatgcctctacttcatgtgatacaattagcacttcccaatatggtccttcagatccagtatgctatatgtgcttccttacaatataatgcttttacggtagtgagtttagtaatagccatgctttcagggtga

SEQ ID NO: 20172 - DNA, 150 bp, Glycine max
  Peptide Sequence Number=SeqID_136950
gatgcagaaattgaaacaagaatcaagttagaaacaaaggttgaaaagcatattcagaaacttttattactaggtgctggagagtctgggaagtctacaatctttaagcaggcaagaaattgcatcttctcaactgcttgtgaattatga

SEQ ID NO: 20173 - DNA, 609 bp, Glycine max
  Peptide Sequence Number=SeqID_136951
atggatttaccaggcttcatggaatcccttgtgaagcaaatgtctgtaaatcttaaacgcattcacagcttagggataaaaaaggtagcagttgggttattacagccaattgggtgtttccctgtgttaaatgtgatattttgccgtacgaactgcattggccttttgaacgtgatctccaaagatcacaacaaaatgttgctcaaagctgtgcaagaacccaacaaggaagcagcagtcaaatcagttttcataacactggacctctacaactccttcctctctgcaattgaaactatgcagaaaaagcgtgcagaaaagtctacactgatgaatccgttgcaaccatgctgtgagggaaacaagttggaagattcatgtggaagtgtggatgacgaaggatcaaagaaatacagtttatgtgagaacccgaaactttctttcttttgggacacacttcacccttctcaaaatggagaagtggcaaaactgtttgttgatgctggcttaatatgtgttgctagtctgatatctccttacagaagagaccgagacacttgccgtgccatgttacctgatgcaaattttattgaggcaaggcaccattag

SEQ ID NO: 20174 - DNA, 141 bp, Glycine max
  Peptide Sequence Number=SeqID_136952
atgatgcatgcacctgactcaacactcagatgcaatgtgggaactgtgttgagtttgtcgagaccacccggttgtgcacgtaacagcccccctcccataggtgatcagcctgggagcccaaaggtgttccctaccaggtga

SEQ ID NO: 20175 - DNA, 105 bp, Glycine max
  Peptide Sequence Number=SeqID_136953
atggcgagcgagtttaacggttttcactctcatcgttcggagacattcaagcccgatgatgcacaagattcttctatgctgggcgggcacgatcaagttcgatag

SEQ ID NO: 20176 - DNA, 261 bp, Glycine max
  Peptide Sequence Number=SeqID_136954
atgggtatcaagcacctcacaaggaccaaagaaaggtcgcatgtcatcaagcaaaggtccccggacgaaattaggtgggctaagcgcgcatccaccgctaagtgcaccttcagctcgcttagcacaacagaagaatctggaagagcatcaatatcaaggccacgtgctaagcgcgagatcagtgtgctaagcacaacagttgtcttcagccaagctcagcgcacgactgacgctaagctcaaatccacttacttgcgttaa

SEQ ID NO: 20177 - DNA, 1182 bp, Glycine max
  Peptide Sequence Number=SeqID_136955
atggcttctaggaaaaggaaagtcatagcttccaggccccagcctcactacgatacttatagattcacctctaaggacgccctgaaccgctatgctgacaacattcgtggctggaacatccttctggaaaggaatcctccaaagcaagttagggtcagagggcatttaattaagtttgatgtggattccctcaacacttttctggagactctggttgttctagagccaggggagactcttcctacttactccaagttctgcagactaagaccagaccctcaggagctggccacccgactttgtatcccttgtaggggatttgttctgaatgctgagggcctaccatggaagtttttgaggaaggacctcactactctagtgcagacttggagcgttctgtcttatttcaaccttgcccctacatcacacacttctgatttgaacttggatagggcaaggttggtatatggattagtgatgaagatggacatgaatgttggagccctcatctctggacagatcactcttatggctcagtctaactcctcgaggctcggatttttagccctcatcactgctttatgcatggcccaaggagtcacctcagattccttgatttttgaatccctcagcccagccatcaacttggcttacataaagaagaattgttggaacttagacgaccccacggtcagctttccatggacccacaaggccacggctagaggatctgaaggtccatcttctgctcctccccagacatctactgcaccatctcctattccttcagcaccagttcccgttacttccggtccctccgctcaaagcatagacctcatgatggcaatgttgaagagcattcaccagggtcaatacctggtggcctggccaagagtccagccttcttctcatggaagaggtgaggcctccgtagctcaagagcttgagccaaatccagagactacacctgctgctcaggaggatgatttagaggccactcccccagagtcatttgtaccagaaattgatccagaggcagatccaatgattacagaggccagtccacaggcatcaccagtatctacaccagtactagagctgagcaccccgcaaggatcaccagcaggcatgcctgggctgcatttgaccgatgatgaggccatggatcgggacccaccgtag

SEQ ID NO: 20178 - DNA, 729 bp, Glycine max
  Peptide Sequence Number=SeqID_136956
atgtcagtgagtggaagccttcaacatatctttgaaaacccttcattgccagaaaaccctagcctcctcgaatccctctcagggattcgaatcaaaccacccgtgaaatccatccactccttcaccgagatatttggtgaactccatttcaaggaaaaccaccaccaccaccacaacaacaacaacgaatatgtttcaaacaccactccaacaacaacaacacaacacaaaaacatgcatctgtgcactgaagggcttggctttgagagctccgatgatgttgaagaccgcaagaataacgaggtaaatagtgatgagagagagaacgaatgttatgaaaacaaaaagagtttagggttggaagattggtgtgaatggaggacgaggtcgtcaattagggttaataataagaagaagaatgatggggtggaataccctcctccgatttccagcatagggaggagtgggaagccttgtgttagcttcatgtcttatagggacaatgggaggtttgttcttaaggaagtgaggatacccattcaggagttcttgcatgctcatagggaagatgggaggttgaagcttcactttgtgcagcctgatcaggatgatgacgacggtgactgttgcaaccaagaagaagaagaggattatgatgaagtagaaagtgtagtgggagaagaacatatgggaaaagaaaatgatgatgagagtgctatagatatctag

SEQ ID NO: 20179 - DNA, 485 bp, Glycine max
  Peptide Sequence Number=SeqID_136957
gatcatgggatccttttctatcagataggaagggctgtttcacaaaatgtacttctaagtaattgctccatagatcctatatctatctatatgaagaagaaatcatgtgacgggggggattctgatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtcatttcgggacaagcggatcatttatgatgaagaggatgagcttcaagagaatgattcagagttcttgcagggtggaaccatgca

SEQ ID NO: 20180 - DNA, 315 bp, Glycine max
  Peptide Sequence Number=SeqID_136958
gctacagtaacaacgacggtgctgaaggtgacagcgctttgcccatgcaagggttgcaacaatagaattcagagggtggttgtcggagaagttaagatgaagatagaggctatagtcacaacggcggtgctgacggtaacaccgctttgcccatgcaagggttgcaacaataggatttacagggcgaatatcttggtagagttgtgttcaacacaaatgacaggaactgattcagacacaactatcattgatggcctgggtgttgctggatggggagttagtggaatagaagcagaagttgcaatgcttggctag

SEQ ID NO: 20181 - DNA, 1248 bp, Glycine max
  Peptide Sequence Number=SeqID_136959
atgcacttgaattgcatgcaggtgaaagaagagttgaaatcactagccaacattgcatgtccaatgatgatgaccaacgtgcttctgtactctcgatccgccatttccatgcttttcttgggtcgccaagggaaagtggagctagcaggaggatcacttgcaatagggtttgccaacatcactgccaattcattcctcaagggtctcaccatgggaatggacccaatttgttgccaagcatatggtgcaaaaagatggtcagttctaagccaaactttttgcaaaaccttgtgcctcctcctccttgttgccatccccatttcactcctttggctcaacatggcacccctccttcattggcttgggcaggaccctgaagtcacaaaagttgcacaagtttacatggtcttctctatcccagaattgcttgctcaagttcatctcaaccctttaaggtcttttttaagaacacaagggttaacaacaccattaactattgctgcttcttttgctgccatcttacaccttccaataaactacttcttggctacatatttggagttaggagtaaaaggcattgcattagccacaggtttgaattccataaacatgatactagggttggtgctttatcttcttgtgtcaaagaaacccttaaaaccttgggaaggtgctactattctctcttccttccatgattggagaccattgctaactctagcattgcctagttgcatctcagtgtgcttggagtggtggtgctatgagataatgctcttcctatgtggcctattgagtaatccacaaaccacagttgctaccatgggtgtactaattcaaacaactgggttcttatatgtgttcccattttcactgagtgctgcattgacaacacaaattggccactccttaggtgcaggtcaaccttcacgtgcacaaatcacagccacaattggactcttcattgcatttgcattagggttctcagcctttgttttcttgctgattgtgaggaacgtgtgggggaaactcttcacaaacgagacacaaattgttgacatggtcacaaccatacttccaattttagggttgtgtgagattggaaactggcctcaaactgctgcgtgtgggatcttgtctgggactgcacggccttatgtgggtgcaaggataaacttgtgtgctttttacttgattggattgccggttgcagtttttgctgctttcatgcacagtgatagtcactag

SEQ ID NO: 20182 - DNA, 291 bp, Glycine max
  Peptide Sequence Number=SeqID_136960
atgattaaacactccacatccaggattacggatctctctccccctaagtgttggcaatcacccattttgccccaagtaaaactgaatgtagatggcaactatatccccccttcatatcgcatgggtgttggtggcctaatccgggacgcagtgggtaaatggaggtttggatttttccaacatataggcgttggtgatcctacagtggcggagattgtggctatcaaggtcaggtttcagtattgtaggatcatgggctttaaggatgtagtttgtgagtcaaataattag

SEQ ID NO: 20183 - DNA, 1278 bp, Glycine max
  Peptide Sequence Number=SeqID_136961
atggtgccattggaaccacctgatactgacgcggcggtgaggagcggcaatgccatagtcagtgacaaggatggtgcaatgtcgttggacttcgaggaggacgacaaattgttctcgaaattctctatcacagcacaagcctttgatcatttgtgcaagccctgggagaaggtcttgagtggcgggccctggatggtgtttgatcactatcttgttgttcgtcctttgttgccgaacattgtcgcgtcagaagcgaagatcgaaaagacagtggtttggatacactttcctggagaaggcactttgctagagtttgtggaaattgacttgagtatcccagtggtgggaaaggagtgtcaacagtctaaagggagcaatgaggtggatgggatttcgaatgattcacaacccaccgagccaagcagcaatgaggtggcggtgtggagtgtgaaaccaaggacggaaaagggtatagatcatgggggaggcttaggagtgggtgtcgtgagtgcgtctcaaggaccaagtcatgcttcgttaggtggtggcgatgaagagggatcctcgtcgatgcctagggatgttgttaacatcagaggtacgaccaatgctaagggtcagagaagggggacgttgaactatgaaatttgtcatcttgtgaatagattgagaacctttagaacccaggattatttggaagcggtttgtactatggtgactccttcatggttggtcactggagatttcaatgaaatcgccaaaccttttgaagttcggcttgataaagctttggtggatcaaggttggcaacttcgatttcctgaagcttatgcggaaaacctttgtagggtttattgtgatcattgtcaggtgttgattatgtccgaaggccagccattgaggagccagaatcgtccgtttaggtttcaggtggcctgggctacccatagggattttgaaaaggttgttagacaaacttggggcagggggtctccggatgttctcaaaagcctccaggaggagttcttgtggctccaaaaatcccatgaaaaatgggttaagtttggagattggaacactcacttctttcatgcccaaaccttaactcgctggaaaaggaataagatcataggattgttctttgatgatgggggaccttcgaggctaacagagcctgtcacagtggaagaggttagacaagcagtgatgtgtatgaaatcttgcaaagcccctggaccggacaacttccaacccttcctctacaagcaatactactga

SEQ ID NO: 20184 - DNA, 144 bp, Glycine max
  Peptide Sequence Number=SeqID_136962
atgcaacatgatgatgaactttgggaacaattaatcaagcaatgcgttcagaaacctgacatggttggtcaatgctttataattttggctttctatgcgagatttacatacataactacttcataccaggatcctgttgtagag

SEQ ID NO: 20185 - DNA, 249 bp, Glycine max
  Peptide Sequence Number=SeqID_136963
atggaaaaggaaaggttgttaaaattgcaaacacttgaccagacacttgtgagcagagagaaacaccagctttgtaaggaaatgcaaagagaccagtcagaggatcaaggaattgaagtcatggagagtgttggaatgcttggaacttacttgagaaaatttttgcttaagaatggaataattttatttgcttggggacaagcaaaatgtggaaaaagaggtacaataagcaaaaaggagcagaaataa

SEQ ID NO: 20186 - DNA, 231 bp, Glycine max
  Peptide Sequence Number=SeqID_136964
atgtcctttactgcatacttgatcactttggctctaggtagagccaagttgggggatgctcctgctgaagttccagcaaagaaagccaaagaaaaatatatagcacctcacttgagagctcgtgctggcaataaacctgaagaatatactcaaattcgaatacgccttcttaacaggctttctgaatctaatgttgagtcaattactggggaattgtccttgatctttcag

SEQ ID NO: 20187 - DNA, 198 bp, Glycine max
  Peptide Sequence Number=SeqID_136965
atgactaactggaactatgaaacggtagcgtttttgcatgcgccgtgtgagctaaaactacagagtatactacaagcctggaaggtcacagagatgagggtcgagtattttcctctaaaggaagatgtgattttgcagaatgaagcgccaacagacctttatatctttgttattggtgctgcattctgtggtgtttag

SEQ ID NO: 20188 - DNA, 282 bp, Glycine max
  Peptide Sequence Number=SeqID_136966
atggtcaaaagtcgagacgagttgacggcagaaatcaaccaaggtaagataatgacccggtcccgattggccgcacattgtttgctccctacttgcagtaatcgacgctgtcgcaacatgcccttttgcgggcgagtgaaggcaaggctcacgggtgcgctttccaaaggaggaaagatgcgcggagtcgccaccaacgtttatttgtggaaaacgtcgggaaaaccgaaggaaactgatcaaaatgaaaattctaagttcgggagttgtatttacgcttga

SEQ ID NO: 20189 - DNA, 261 bp, Glycine max
  Peptide Sequence Number=SeqID_136967
atgtggatgcagtttgcggagcacttactacctgcgggtcagctttgtctagtgcctgggcaggtatctgcggattacatggagtggtttttccgcatatcacacccattcatgataccgacccaggcaggtgaccaaccgagagatgcaccagctactgaccttgaggactacatacagctgcccaacccccaggttccagtagcatttgacccccctccacatgtggatgattacgagggatatgaggcgattgcatag

SEQ ID NO: 20190 - DNA, 1167 bp, Glycine max
  Peptide Sequence Number=SeqID_136968
atgatacttgaaattgttgatgtcttgggaagcagtttcagggccataatggttgttaatactgggccatctcaatacagaggtaggggtggcaggggtggtagaccatttagaggggctggtcgtggtcgaggccatggtaggggacatggaatggggggtggtagacacataccatctcattcttctggacctgctttttctaatgtgccagctcgagtgcaaccaccagtaccaccgcgtaaagtgtgctgtgaaatttgtaaggttgagtgcaatagtccagaaatcttggagcaacataaggttgggaggaaacatcagaagaatatgagggtgcatgaagaatcgcaaaggcgcaatgctataaatggacaacaaagtgagaaaattcctacctctcaattgaacttaacagaccaacctaaggaagttcaggagtccgagaaaaatgaatgccccacagaaaatatgggctcgggggttataatcaatagtcacaaggaggaaatgcagctgcagaataatgtaggaaacatttctgaggttccagctgaagtgcccgagggaaaaaccgaggataactctgctgcaagaggccaaggattgaagcggaagaagaaaggaggaaaaggaggtaaatacatgagaactaatgatggttctaagccagtggaacctgcacaaactatgtcttttagatgtgagctgtgtgatgttaaatgtgagtcacaagttgtttaccagagtcatgtggctgggaaaaaacacctatcaaaactaaggcgtgcttcatctggagtaggccagcaccagcagcaagctctgtctggggcactcttagggcttcaagcaatttacccacctgacatcaatgctctgtctaatgcaattaatgttcaagtccaacaaggtgataatgatccgcaggtacttttggctcagctcctaatgaccgtactatctcaagcacaggttccagcaacggcaccagtgacaggtggcgtggtcgctcagataccagtacccacatctatggctggaccgagttatgaaccccagttgttgcagacaaatccttctggggaaacaaaaactgagctgccaggttcaagtgtcggcacccaaattgaaggtggaggttctgaaactaaacaacaggtgtga

SEQ ID NO: 20191 - DNA, 531 bp, Glycine max
  Peptide Sequence Number=SeqID_136969
atgattttgtgggatagaattgattctgttgtcttatccaaacacactgttttggaactgcgaggacagaagcttgaggttcagattattaacattgccgaagaagaggttttgattcattttatttcacttgtactacttggattggatcctatatctttgagggaggttgatgagtttataattggacttccaaaatcttctgatgggaaggaaacaccacagtcgaacaaagtccgaagtgttgctggaaggcttgctgttcgagctgctgagaggggttggagagtgtatctacaggatgaacatgggacaacagaagaagccaaagatagaatgatcaacatgagtttaagtaagtcctctcagcagaagaaacttgatgcctatgctgccatgatggtactggagagatatttctccacgtcaggtcagggtactgaacttgttttgcccaagaatctagaattacaagcaaaacttcaaaggggtcctcccaaagatgttgattttttctcggacgaagactaa

SEQ ID NO: 20192 - DNA, 294 bp, Glycine max
  Peptide Sequence Number=SeqID_136970
atggattattcagactacagctaccaacagcaaccgcaacaacattcctatggctacgacccttctcagatcccaatccaaccctacgatcaatcctatgctgcgtaccaacaatactacgcttacaatccccaatacgcgtattaccccaacgcacaccaaacccagtttcagttccaacccgaaaccgctccgcttcaccctcccggcgtcaatcccgccgctctggaacccaccccgtttatttatgaaagtttttcgaaagggaaattgtgtgggtgggtcgtgacctaa

SEQ ID NO: 20193 - DNA, 159 bp, Glycine max
  Peptide Sequence Number=SeqID_136971
atggagatcttgagggtggctccatgccaattacttctcaagcacattgcttccaaggttccaattgcttcccaagctagcgatgtgggtgctcttagagtcaaccaccctcacggttttgatggttatttgttggatccaaaaaccaagttaaaatga

SEQ ID NO: 20194 - DNA, 243 bp, Glycine max
  Peptide Sequence Number=SeqID_136972
atgggattgtccattaacaaccaatcacaggataaggctgcagcatctcctggtctcacaaagtgtggaaactttgtagccgcaaatacattaattattcagctcgttggagataaacctgttcaaaaatgcaaatataaagggtgtgagcctcaacactcaagccaaggcaagggaaatgacatagtggcttccgattattcattgtcattagcttcagcaatggctggtggcgacacctga

SEQ ID NO: 20195 - DNA, 930 bp, Glycine max
  Peptide Sequence Number=SeqID_136973
atggagaagcacaagtgcaagctttgcttgcggagtttcgcgaatggaagagcgttgggaggtcacatgcggtctcacatgatgaacctacctgttcctccgaaacagagcgagttggtgccgattcaactcagcttcgaggccgagtcatctccttcgcagtcttcatcttctttctacggtctcagagagaatcccaagaaaaactttcgcttcgcagatcctgaattctcgttcgcagcagcggaaacttcctccgtgatcctgcaggacagggagagcgagaccgagtcgtcgaggaatccgactcggagacgatccaagagagcgtggcaacaactcggcggcgacagcggcggtggcggtgtttccgatgaatcagaaaaaaagatgatgaaagtttttgacgccgtaaacaagaacaacaacgaatccgcaagttcggtttcggacaccacgacggaggaagccgtggcattctgtctcatgatgttgtctcgcgacaaatggaaggaaaacaacaagttattatatgataacaaggttgagatagcagaatataacgatgattatgatgacgaggaagacgaagacgaagaagaagaggaagatgaagaaatttacgaatccgaagaggaacttaaatctgttaaaaagagtaacaaagtgcgaggaagatacaaatgcgagacgtgtgaaaaggtgtttcgatcttatcaagctcttggaggccatcgtgctagtcacaagaagatcaagctcaacaactgcgaaaacaagaacaagaacaacaacaacaacaacgacgatgaagctgaacaactcgaagttcagcacgttgttgtggtggagaagaaaattcacgaatgtcctgtttgttttagagtatttgcttctggtcaggctctgggaggacacaagagaacacat

SEQ ID NO: 20196 - DNA, 537 bp, Glycine max
  Peptide Sequence Number=SeqID_136974
atggatagcgatggaggctccaaattgactgggattaggcagattgtgaagataaaggaaatgctccagaagtggcaaagtgtgacattaggcccaaaaccttgcaattccctttctgatcatgtggctaatgatgatggaagcatatcaccattgatcaacaaaagggtagtgaatgtgatatcggacaacgaagacagttgccaaagtcctgcagaaccgcttccgccagctgatgttccaaaagggtacttggcagtgtatgttggacctgagcttaggaggttcatcattcccaccagctaccttagccactctctcttcatagttttgctggaaaaggctgcagaggaattcgggtttgatcagagtggtggcctcaccatcccatgtgagattgagaccttcaagtacctgctcaagtgcatggagaatgagcagaaagagcaactcggtgacagtgcccagagggaagacatggaagaggtaggagagattattgaggtggaacacattaaaacattctctccctactag

SEQ ID NO: 20197 - DNA, 183 bp, Glycine max
  Peptide Sequence Number=SeqID_136975
atgatgaaagtcattttcgttgaggaacttataccatggtcggacaatgctcttatcattaatgttggtatcgaggtggatgtggggcacccaggatacattgagttatttcttctgtccatatgtgttgacgggaatgaagtagtggtctggcacatgtctgttggtcaagtggaggagtga

SEQ ID NO: 20198 - DNA, 594 bp, Glycine max
  Peptide Sequence Number=SeqID_136976
atgggcaagtctgtagttgagaagctactttggatggcaattgtgtgcttggtgctgggtgtaatttccattactcccaaggcccaagcagcagtgacatgcaaccaggtggtgagcaacctcaccccatgcatttcttatgtgctcaatggtggcaaaaccgtgcctggcccttgctgcaatgggatcaagaccctctttaacctcgctcactccacaccagaccgccaaaccgtttgcaagtgcataaagaacgctgttagtgcgttccattatggcaagtccaatgtggaccgtgctgctgctcttcctaagcagtgtggggttaacattccttaccagatcagcccttccaccgactgtaccaggattgaatggaggttgcaagtaagagtgatttatttatggttcatttcagactttaaaaatccaaatgacatgaatagcttggagatggttctgctttatgcaaagagtaattcggatattgagaatgaccatggaacaggtcctggcacgagcttctgcaatgaagtttcaaccaaaaagatcaagacctacaactacgcagcatacacgttagaaagtgcttga

SEQ ID NO: 20199 - DNA, 1539 bp, Glycine max
  Peptide Sequence Number=SeqID_136977
atggtggaatatttcaatcagaaggctaatatatcacaaagctttcctcttgggacatttaattctgcgtttagcttcactggttcaaaacacattgatgctactgagacaaaatctctttcttcagatgggttttatattcccctcgcaaaggttcagcttacaaatgcccacttaacattgcaagaaaatgtcaaaagggatattccagtgaattgggatccaccatccttggcaagctttattgaaaactttgggacacatgtcattacatccataactattggtggtaaggatgttatttttgttaaacaccaccgtagttcacctttgtcaacattggagataaagaactatattcaagacattggaaaccagaggttctctgacatcaataaccatacaagttcacttcaaacaaaattcaaggataaggctagtttcactttaattccgattccttatagtgatttgattcaggttgttgatcccttttcattcaataatcaagagatacaccctcaatctgcatctggaacttatctaagtgggaaatttaactcttttcttaacttccttggatacacccaggatgtcagagtcattttcagaaggagaggaggagatgatttggaacaagaccacagtatgtggctcagaactgtttggtcttccccggatgtcattcagatgactttctgtcctataacagatctcattgatgaagttcctggcaaggaacaattgactcacgctattggtctctatcttgaatataaacctcccattgaagaacttagatatttcttagagtttcaaattgctcacgtttgggctcctcttcatgaaaggattcctggacaacaaaggaaggaacctatttgcccatctttacaattcagcataatgggccagaaactttatgttagccaagagcagatcacagttgggcgtttgccagtaaccggcctacgtctgtttcttgaaggaagcaagcagaatcgtttgagtgttcatcttcaacacttatcatctcttccaaagatccttaggccatattgggacacagatgtaaccattggtgctcccaagtggcagggacccgaggagcaagacagccggtggttcgagcccgttaagtggaagaatttttctcatgtgagcacagcacccgttgagaatcctgaaacgtttataggggagttctctggcatctatgtggttaccggggtgcagcttggagtgtgggatttcggaccgcgaagcgtgttgtacatgaagctcttgttttcgaggttacctggttgcacaatcagaagatcattctgggatcacacccccaccaaccctgataactcgagctttggttccagagagaacaacaccacaggaagcaagttgttcaagtatgttgacttgtctgaaatgagcaaagggccacaagatcctcctggacattggttagttactggtggaaaacttggtgttgagaaagggaaaattgttctgagggtgaaatattcgttgctaagttactga

SEQ ID NO: 20200 - DNA, 376 bp, Glycine max
  Peptide Sequence Number=SeqID_136978
aaaacctaattcgggttccgtttggggttcctcggaagtgtgttgttgttccgtcgtgttcggaattggaaactccgtttcttggtccttaacgggagaactccggaacctactagccaaagaggaagatctgtacggcgcggatctacagcgagttaaaagcaaagcgtttctcgggggcgtgcttgaattggaagcaaaatcactatccttatcgacattcactctctcatggaacgggatgtttgagcttggtgggctttcgacggaagaggctgggccagttgggccagaggggtttgcagcggcaggggtggttgttggggcttcggatccaacagcagttgcagcggcagcggcagcgcgtgggagctaa

SEQ ID NO: 20201 - DNA, 118 bp, Glycine max
  Peptide Sequence Number=SeqID_136979
atgactcaacctccaatgttgaggacctgttatctgaatatgagagtttttgggtcaaagactatggtggtgatagtgactcctcttccaggttatccagtggtgtgccatgtcggtg

SEQ ID NO: 20202 - DNA, 543 bp, Glycine max
  Peptide Sequence Number=SeqID_136980
atgcagcggcggtttctggagacggaactgagcatgccaccctcgtacggcggcggcaacactagcgacacgttcatcagcgacgcgaactttgacaccaacatggtgatcattctggcggcgctgctgtgcgctttgatatgcgcgctgggtctgaactccatcgcgcggtgcgcgctgcggtgcgggcggcccttcggcaacgagacggcggagcaggcggcagcgcggctggcggggacggggctaaagcgccgcgagctcagccgcatcccagtcgcggtgtacggcgccgccggcgaaaacacgattccggcgacggagtgccccatatgcctcggcgagttcgagaaaggtgacagggttcgaatgttgcccaagtgcaaccacgggttccacgtgaggtgcattgacacgtggcttctgtcgcattcctcgtgccccaattgccgccactcgctcctcgagaagcccgcggccgcgccggaaagtgggtcggggcggcgtagcgaggtggtggtggtggtggagcaggcgagttga

SEQ ID NO: 20203 - DNA, 285 bp, Glycine max
  Peptide Sequence Number=SeqID_136981
atgtggacaattttcatgaatttggttgcaaagcaacctcttttgtgtgttgggtttgtggggtgtgaagtgattgataaggcgaatttaggaagcatgaggagaatggagaggtggaagaaggagaggttccaagtggtttccatgattgttgttctgtctctgattgcattcccaaccacagtggaaagaggacacagtacagtttccttgtcgtcactgtgtcttgaaggagtccaaggagccgttagaggtttgactgagttggaaattgggatcgcatga

SEQ ID NO: 20204 - DNA, 717 bp, Glycine max
  Peptide Sequence Number=SeqID_136982
atggctagacttccttctcttatggtaaaattcatgctacttttgttcatgactaagttttcttcagctcgaactcttggcaatccatcctctaaccacaaccatggccatcacagaataacatttttaatgagggatatgttcaatggtagcacacaatattcagagaaaccagccactactaaagtcactggtcaactacctttcccaaaacccctaggctttcttcctactaaaggagggattccaattccacaatccactccaacaacaattccactcacttcatcatccactcaaacacttgacctgtctagcattggcttctcttttcccactagagcaacactccaagagctagaatatggagcagtaacaccaattgatgaggaactacttcatgatgatggagatgaactacacaaacttggaagggcacaaggggtgtgtgttgctagctcagaggatggaagcagccatatggtggctatcacagcaagctttttcaagggtgagtttcaggatggactgaggctttttggagtgcacaagactgatgtttttgagtcacatgttgcagttattggaggcaccggaaagtactatggtgctaatggatatgctgctgtcaaggttgtggacaaagtaggatctagtgaaaaagaagggaaagtgacaagttcaaagttcctcttgtttgatgtgtatcttagttga

SEQ ID NO: 20205 - DNA, 720 bp, Glycine max
  Peptide Sequence Number=SeqID_136983
atgggaggattgagtatgggctccggcgatcctggtgtgatcctgggtgggcccatggaggagtcaggtgggcttggaataatgatgggagggttgagcacgggttcgggcgagcccggcgtgatgctgggtgggcctggaacagtttctggggttggtgtgggaaaggacactggtgggcttggagggcctggaaagactggtgtgggaatggtggtggaaggagtacctggtggtggaaacacacaaaatggagggctgttttctggcaatgggattggagcaaggcctctcaatagtctcattgatttatctgcatctggaaaggagaaagcaaatatgcttttgagccatgaacttattgccattgatgtcaatgatattataaagcacttgcttaccacaatgagtgagagaaatagcagccaaagtgaggtagaggagaagtatcccgacattctttttcactctacttgtttccatgaccatgaccctcttgcagttatggtaactgcaatgccacaagatataaagaaaaagaggcttctgattatagccccgctgttgcactccaatgccagtgcattgaaagactcaaaggtagaacaacgtgagattgattctttgggtggacacaactttgatgcacagtcatctttggttgaagatgtgagcatgaaggaatgccaaaagtgcagaaaaaagtgtccacaaatgtga

SEQ ID NO: 20206 - DNA, 1047 bp, Glycine max
  Peptide Sequence Number=SeqID_136984
atggcaataagttcatggctcaaaagcatatttgctttctcctttccagatgcagataaatcaatgagactattgagaggccctaaacatagaagaaatacaaccaacaagaacccaaagaagttgaaaacggttaagcattttgatgagaacccaaccatattatcatcaaatgtacaaccctatagtctcagctccccattttctttgcccccttatgaatcacttgctccaatcccattgccagaaaacagccctccattttgtgtgtttccaccaccaggtactccttccaccaccattcccacacctacaggctttcaaccaaccacaccatcacctccatactatgacacctcaccagtctttccaggccctccaagcccaccagtgtcctttcccacaccaaccccagaaactgttccaggcccacccagcatcacgccgggctcgcccgaacccgtgctcaaccctcccatcattattccaagcccacctgactcctccatgggcccacccaggatcacaccaggatcgccggagcccatactcaatcctcccatcattattccaagcccacctgactcctcaatgggcccaccctactttgagcccaccccaccattcataatcccttcccccacaggtggcatcaccccaggcccaccatcccccactgaaggcactgtgccaagcccaagcgtgtttcagccacctgtggtgtaccctccaccaagtgtgccaccaccacccaactatgcccctaggaccaccttgtggtgtgtggctaagccctcagtcccagacccaatcatccaagaggccatgaactatgcttgttggtcaggagcggattgcacctcaattcagcccaatgggccatgctatgagcccaacactgtgtatgcacatgcatcatacgctttcaatagctattggcaaaggactaaaggggctggtggcaattgtgaatttggaggcacagccatgctggttgcagttgatcctagtgagtaccactgtcataaaatgggtttagattcataa

SEQ ID NO: 20207 - DNA, 1623 bp, Glycine max
  Peptide Sequence Number=SeqID_136985
atggacttcactacgccgccgatcgaggacggtttcaccgccgagaagctcttcacgcagggcttctcctacacctacgatgacgtcatcttcctcccccactacatcgacttcgccgccgacgccgtggacctctccacgcgcctcacgcgccgtctccccctcgccgtgccgtttgtggcctctcctatggacaccgtgtcggagtccgccatggccgccgccatggcctccctcggcggcatcgccgtcgtccactccaacgtccccgccgccgtccaggcggccatcctccgcagagcgaagtcccgccgcgtccccatcctctccgaccccgccttcgccgctccctccgccgtggtcgagcacgacgacgccttcggggcctcccccttcctactcgtcaccgacactggcacctccgccgggaaactcctcggctatgtcgcgaggagcgactggacgaatcaaaccgacaagggcttgagagttggggactacatggcgccacctcccaagccggcgccatggaacgccgacctaaataaaattaatgaaattatggagagtgagaaaagtggtgctgtggctttggagagggatggtgaggtggttgatttggtggtgagggaggaggtggagagggttaggggatacccaaagctggtggcgccggctacagtgggggcggacggggagtttatggtgggggctgcggtggggacgagggaggacgataaggagaggttggagcatttggtgaaggctgggttgaatgttgtggtgttggatagttctcaagggaactcaatttatcagttggagatggtgaagtatgtgaagagggtgtaccctgagcttgatgtgattggggggaatgttgtgactatgtaccaggctgagaatctgattcaggctggggttgatgggttgagggttggaatggggtctgggtccatttgtactactcaggaggtttgtgctgtgggccgtggtcagttgtggtttaggaaattgcagacaaatggagatgatgtgactgcaattgcggtccctgagactccaaaaaccttaacagataaaatcatgatcaatggtggaaatgatgtgaaagcaactgctgtttacaaggtctcatccattgcttataaaagtggtgttcctgtgattgctgatggtggcatctcgaactctggtcatattgttaaggctttgtcattgggagcgtcaactgttatgatgggaagcttcttggctggtagccttgaggctcctggggcttatgtatatcagaatggtcaacgtgtcaaaaagtatagaggaatgggttccctagaagctatgactaaagggagtgatgcaaggtacttgggtgatacagcaaagctaaaaattgctcagggggttgttggagctgttaaagataagggttctgtcttgaatttcataccatacaccttgcaagcagtcaggcaagggtttcaggatatcggtgcctcctctctacagtctgctcatgaccttctaagatccagggagttaagactggaggtccggagtggagcagcacaggttgaaggtggagttcatgggctggtttcttatgaaaagaaatacttttga

SEQ ID NO: 20208 - DNA, 432 bp, Glycine max
  Peptide Sequence Number=SeqID_136986
atggtagctacagcttaccaaacctcccatgagtgttcggaagaaaccattatagatatcttagtggcaggattttccggacaattaaaaggtaggtgggataattatctcacaaatgaagaaaaatcaaagatttacagcgtagttaagattgatctcaatggaaaagtcattactattgacgatgataaagagattcctgacgctgttaacacattaatttttacaatagcccaacatttcattggagacccatccttgtggaaagataggtctgcagaattattatcaaaccttaagtgtagaaccttagcagactttaggtggtatagagatactttcctaactagggtttacactagagaagatagtcaacaacctttttggaaagaaaaatttctagccggtcttccaagatcattaggagacaag

SEQ ID NO: 20209 - DNA, 330 bp, Glycine max
  Peptide Sequence Number=SeqID_136987
atgcttcaatatatgaccaagagtgatcagagaacgaagttcgtagagtctcaacttaccaacatacagtcccttttgtcccaaagacaactaggcaacctcccttcagaatatgaccaaaccctaagagagaatgccgaagttgttatgaccaaaagcaaaagagttcaagaggactctaaggagaaagaagacttttctctaaaagctgcagatgacatccttactgtaaaggatcgagtaccaaagaaggttgatgttcctactgataggaactcaatgccaaagaaggaaaaggataagaagaaagagatactaacatctctttaa

SEQ ID NO: 20210 - DNA, 642 bp, Glycine max
  Peptide Sequence Number=SeqID_136988
atgacagctaatcagactcagacctttatagactacctcacctcgaccttgcgagacaccaatcccatcttactgctcaagatgctagaaggaatcacttttgacttcaagcatgggttcctacaaatgttggagaacaacctatttagtggtgttgcccctaaagatcctatgcagcacctgaggaagttcattaagttgaccaacacaatgaaaaaaatcaagtatcaactaaatacatcagactttatgcctttcgcttcttttttaataggaaggcatgcgattggttgtgttcattgccaaagaacattatcaccacatggaaccaatgcacaagagagattacaagagatgatcagaagctgcccacatcatggattctcccaacaaaagctagttcacatcttctgtggtagagtgtccttacacgataggacaaatttaggtgttgcctgtgggagtaaccttatgttaaaaccccctgctgatgacatcaagatcattgaagatatgtgttttaacctgtataacaactcagtgaataagaggattatgaagagagacgtcaaccacgtggagaatgaagattcccagattgaattaggaaaacaaatgcaagctctttacactaaagattga

SEQ ID NO: 20211 - DNA, 519 bp, Glycine max
  Peptide Sequence Number=SeqID_136989
atggaggcggataaagatgttcctatcatattgggacaaactttccttagtacttgtgatttgcttgttgaagttagccttggtaggctcacccttagattagcggatgagagaataatgtttaacttgcctgatactttgaaacaaccttcctcatttgcttcttgtagttacactgagtttgttgatatgtctgatgcattgatggagggggtgttctcaagtgtgggaatgcctaaccctttagagagagttttcactgatgaagaccttaactgggatttgaacccagaagtgcaggaaatactgatatttctccactctcaacataatcctagaccatctagtttacatgaaactaagaaggggaaattgttggaggttcgaagagacaataaggaagcctttgagcggagtattcatgacataaagggtttgtaccccataactacacccatagaatcaacactgaagaaaggtttccacccaaacggttatcccaaaggagatttaatctaa

SEQ ID NO: 20212 - DNA, 1395 bp, Glycine max
  Peptide Sequence Number=SeqID_136990
atgaagttggtagagtctcaacttaccaacatacaatccctttggtcccaaagacaactaggcaaccttccttcagaatttgaccaaaccctaagagagaatgccaaagttgttatgaccagaagcaagaaagttcaagaggactttgaggagaaagaagactcttctctaaaagctgcaaatgacatccttactgtaaagaatcgagcactagagaaggttgaggttcctacttataggaactcaatgccaaagaaggaaagagataagaagaaggagatattgacatctcttcaagtaagtctaaccttccctcatatagttaaaagtgaccagcgggatgtgcaatttaagaaatctcttaaggttatgaggaaattgcacatcaacctccattttgttgaggctattttacaaatgtcatcttatgcaaaacatttaaaagaaattttatcaaacaaagaaaaattggaaaattttggcactgtgggtttcaatgatgagtgttctgctatggtcattaggaaacttccccctacgatgaaagacctcgataaattcattattccttgtttgatagaaggattttattttgataaatgtttatgtgatttggggggtggtataaatttgatgccctatcctgtctttaagaaattgggcataacggatttagagcctacaaacatctttattcaccttgttgatctttcagttgtctattctagagaggcgattgaggatgtgttggttaaggtggacaagttcatattttcgattgattttgttattttagatttggaggctgatgaagatgcccctatcatattgcaacgaccttttcttagtactcgtgatttacttgttgatgttaggcttggtagactcaccttaatattagggggtgccaaagttggtgcattcccacgtgtggggatgtacgaccttcttgagaggattcttactaatgaggatcttgactgggagctggacctagaagtggaagagatactttcgtttctccactcttattatagtcttaaatcatttagttttgagaggttggaatatggcaatggccttaagccaaagccttttgttgaggaacttcctgaagtagagttgaagcccatcccttccaatctcaaatatgtttttcttaacccaccatcttctcttccagttgtgattgttgtaggtttacatgaaacagaggataaactgttgtgggttctaaagggcaacaaggaagcctttggatggaacattcatgatataaagggtttggactctactcttggcacccacaaaatcaacactaaagatggatttccacccaaaaggttacctcaaagaaggctaaatcccaacataatgaaagtagttaaaggatag

SEQ ID NO: 20213 - DNA, 393 bp, Glycine max
  Peptide Sequence Number=SeqID_136991
atggaaacatgtttccattgtatgcctgcacaacggaagttgggtggtcttagggagatgagagagaagagaagatgtggagaagtgagggaggaaggaagaagggttgggtgtgttgtgaaagaggaaggaggaagtgagagaggaagggagaagggttgggggtgtaggaaaaagggagaatttttgttgttgaaaaaaccaaaccatgagcaccccctaacgatcttagaagaggaagaggagaaacgggtatggaaggaagacaaaaacggtatatattcgatcaaattggcttatcatgttataaaggcgaacataggaggagccaaagatgtgttattctttgagaagatgtgggtgagagtgagaggcattcccttgaaggtgtaa

SEQ ID NO: 20214 - DNA, 360 bp, Glycine max
  Peptide Sequence Number=SeqID_136992
atggcttggagaaatatccgagcacatgtgaaacaggtattgctaaggatcgtaggatatgggattatttatgacaaatttgagcaagccaaacaaactttatttgtcctaccttcagttccatccactttggttgccccatctatacccattcctttagtaggcattatggatcgcatagcagaacttgttgtcaaagtgtttagcgctcctgtcatcgttgttgctaaaaatgcttctattgctaccccaactacaaatgttgggcctttagaccaagctaaaggagatggaggcaatgtcgacacctctttaattgagccaactgatatggtaactgattcagttgcaaatccttga

SEQ ID NO: 20215 - DNA, 195 bp, Glycine max
  Peptide Sequence Number=SeqID_136993
atgtccaaatttcatgaaaatccaacggttaacgaaaccgagatcgtaattttactgaaaccattctgggtttctgcgggaaaggaaaatgctgaaatgcgaaaggttaggtggcctgcgggaaaaagagagggttttgagagaagagagaagaaaagaaattgtgaaacagaggaggctgaggagtcagtctaa

SEQ ID NO: 20216 - DNA, 4226 bp, Glycine max
  Peptide Sequence Number=SeqID_136994
atgagaggtggggcgagaaggggagtggacggtgggagaggggattcttggcggtgggagaatggaggtggtgcttttcacacaaaggtgcaatatgatgatgggtggaatcttgtgcaatatcgtaagaggtgggatggtgggagaggctctggttataccaaaccagatatttatcaatccagggaccaaaggagtaaggagcaactacaatcaacaacgatttacattaccaattttgcggaggagatgaatgcgaagcacttgttcaacagtctcaggagctatggtgacttgcaagaggtggtgattccgacaaggagaaataggatgggtaaaagattcggttttgctcgtttttgccggattcaagagccggaacgattcgccatgaagctagacaatattttcattggaagggataagctttttgcaaatcttcctcgatatcaaagagatcaagcgaagaagatgcccggggggccaatatctaaggagagtgagccggtggtacggaagtcaactcaggtgtggaaaccgaaagtcattggccaagcttgtaaaattacaaacggatccatgcatgaccaaatgggtggcgagctgaagtatgaggcaaaggtggatgatatgaagcgtctaagtaaagctatggtcggcgttgtgatacatccgggccaatcttatcttatacaagaacattttgctatgcaaggggtgtctacaattttagttactcccttaggagctaacatggttctcttagaaggtagtgtagatgacgaggacttccaaggctacatagaggaagcgaaagggtggctacaacaatggttcaaagaaatcaagccgtggaatgcgtcgatcgtagacgaggagagattggtttgggtgagatgttacggggttccaagccacgtatgggactccgatttcttctcttttttaacgaaggatattggcgtttttgtacattctgatgacaacaccatgaagagaaagacaatggatgtagctcgattaatggtgcgcacagtcaaaaaagaggcaattaatatgatccgcaaggatcaaagtaagcgcgagttatataatgatgaaaattcttctagtgacgatgaagtgtggccggagagttcgccggaagatgatttggtggaggaggatgatgaagctggcagttatggaaataattcaacattaaatgaggcattaattggaatatcaatttcaaattcaaatgtaggcaataatgagttggtaagtaaaagtggtaatcaggaattaggggaggattacgtggaggagataaaagaccactcaaaggataattcattgtgttggaactctgctggagattttatgaaacgattagagagtcaacaagtgggggaatattcagcaaattcgcataatcatttgggtccagtttttaataataactcaggcccattattggaaagactctcttcaatccaaagaaacaatctctcttctcagatcccacgcgtgaaacagagaaaactttccaaacgtggcttgctctcaaaaccgggttgggcatcacgttccaacaaggtcaatcatgatttgaaatcaatttctcagcaatcctccatgaacgaagctcctgtaaagtcgtgcacagcaatagagcaagcctcaacgcatttctctggtggctcggtcttgtgcggtgggtcgttgtcaagcgctgatatgcgtttatgtaacaacaagttctgggttttacagagcaaatcagtggcgcagagggtttgggaagaggcacgtcacataggggtggaaggcacggagaaggacgaggtgtacattcagcagattaatttatgtgagagcagagatgcagttgcaaagcagcagaggggttgggagacaattcaaagagaaggaggttggccaaaattatcaattcagttaattgattggatagctttgccttcgtctggtttgtcgggtggtttgttaatgatgtggaaaaggggattatgggtggttaagtctaatttttctggtcatggcttcataggtgtttgtgttgagtttaagtcgaaattattcttcttcgttaatgtttatgctccatgtaatactgctggtagaagattattgtgggagactttatataatctcaaatatggtagctctgcgggagagtggtgtctggtgggggatttcaatgcggtatctaatagggaggaaaggacaggcagaagcgaaaattgggggcatattgatatggtggattttaatgcttttgtgaatgaaatgaatcttattgatcctcctttgcatgggaataaatttacttatttttgctctgatggtattgctgctagtagattggacaggtttcttgtttcagatggcatcatgaatctatggcaagtaaaggggcagagggttggtaaacgagacatttctgatcattgccccatatggttggaatgttctaatcccaattggggtcctaagccttttcgttttaataactgctggcttgaacatgatggtttcaagtcttttattgttgaggagtggaagaagattcagattactggaagaaaggcatatgtcataaaggagaagctgaaaattattagagagagtttgaaaaagtggaataaggaggtgtttgggtggctagaccttaatatagaaaatatagtggctgatatgaatgagttggacagaggcatagaggaggggtgtaatcttaatgtggtggtgaagaagaaagaagcaaatgcattattttggcaacaactaatgatgaaggagagcttgttgaaacagaaatctaggttgcattggattaaagaaggagattctaacacaaaattctttcattcttgtcttcaagataggaggagaaagaatcaaattttatccttacaagtggaggggcgttgtgtggaacaggttggggaagtgaagatggaaactttggggtcggaagaaaattctttcttagtggcaccattttcagaggaggagataaaggatgtagtgtggagttgtgatggtaataaatgccctggtccggatggtttcaacttgcgctttataaaagaatgttgggagtttgtcaaggatgatattgttgaatttttacaagaatttcatatcacaggtgtgcttcctaaagctattacggcttccttcttggctttgattccaaagtcagctttcatttcaggaagacaaattttagatggtgtcttgatgattaatgaggtagttgatctttccaaacgtagaaaggatgaatgtttgttgtttaaggtagactttgagaaggcatatgactcggtttcctggagttttttgacttacatgttgaacagaatgggttttgataagagatggattgggtggatacaggcgtgtgttttttctagttctatgtcagtcttggttaatgggagccccacggatgaattcacagctcataaaggtttaagacaaggagatccactatctccatttttatttctcattgtggcacagggactttctggtttggtacaaaaggcaagtcaggttggaaattttgatggttatcaggtggcagatggtttgaacttgtctctattacaatttgctgatgacacaattttattgggtaaggggtcttggaagaatttgtggagcatcaaaactactttcagaagctttgagttagtatctggtcttcggttcttgggtgttccaattggtgccaacccgcggcgaagatcgacttggaaaccggtggtggattctatgagggctaaattgtcttgttggaggggacgtaatctatccatcggaggaaaggaggaaaggaagatttgttgggtgtcatgggaagacatttgcaaaccgaagaaagagggagggttgggtgtgaagaatttagaggttttcaacatatctttgctggctaaatggaagtggaggtgtattcatgatcataaagcactttggagggatttgctagcttttagatatgggtctgagccgttgaaggatgcttttccggagctatttgcaatttcatctcagcagttggtgtctataggaaacgcaggttcatggaggagagaccaatggacgtggggcttgacttggaagagacagttaaatccgaaggaggaagagtcacttcactctttggagaccattctggttgatgtgcatctagtggcagaatctcatgacag

SEQ ID NO: 20217 - DNA, 129 bp, Glycine max
  Peptide Sequence Number=SeqID_136995
atgcaactcaaagcccatgcgcaatctcccagcatcacttggaagtatcagcatatcctaaaactcatttcaagcatgcaaggttatcaaaaactcgagagtcagcctagactcgtgggagccctgtaa

SEQ ID NO: 20218 - DNA, 306 bp, Glycine max
  Peptide Sequence Number=SeqID_136996
atgtcacggaacttcacgtattgtgcaacaaagggtgccaagtacctcgaagcggtcaaacaaaggttgcatgccatcaaacaatggtccccggacgaaattaggaaaattgtccctcaatcgagcaatggcctgagaagaatgagaagaaaagtcatgaagaaagaagatccaagaaggcatatattgcataggatgacaatcactcatcctatggttcggagaaggagatcaaccttctatccaaggactatgagagcgatgacaacatctctcaagaagattaagcaaaaagcaaaagtctga

SEQ ID NO: 20219 - DNA, 424 bp, Glycine max
  Peptide Sequence Number=SeqID_136997
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggac

SEQ ID NO: 20220 - DNA, 1395 bp, Glycine max
  Peptide Sequence Number=SeqID_136998
atggttctgcagtttttcattacaagttctgtattagatcttacgattgtgggtttagatgacggggatggagactcaaatgcacagggtcagtgccctcactacttgaagaccagttgtaaagccaatctggatctgggaagtgcagtgtaccttttaggctacacagagaaacaggagctcactgttggtgaaggaaaggtggtcatagccactgacaatctcataaaactgtcaactgatggaattcaatggagtcctggttctgcaggttttgatgtgcacggcaatctagcttttatgatatgcgatcctatgaaattagccacatcacctaataccaaatcttcttcaacttcaacttcatcatcatcatcctcttggaagaaagaccaccccatgcaatttggcataccaatttctgtcatatgtgattggttaaaccagcattgggaaggcaaccttgatgagcttaacaagccaaaattaccaatcatgcgattgatgtctaccggccaaaagagcgaccattcatgtgcttccttcaccctgaggcaagttttcaagtcaactgagggtgatgatgatggcaccccttcttcatcaaacaacgccttgaaggcaagggatcagggaccaagctcttctgctgctaccaacacagttgaagaagaaagcttgatcactaatcccaatgctgcacatgtacagggaattcccactccagaaatatatgaatcgcctagagtaaccgctggcccactcagaaggaaagaaaacataccattgcagcttttggacatcaattttcctccaaggactgccaaacatgcagtttttccacaattatccaaaccaaagtgtgctgaaaatcttgccaaagaacctttgcccgaaaaccaagtagaaggagaacaaaacaagcacacaaggccaacaactcctattccagatgtttcctcaacaggttctgtcaatggagcagctcaaagcgaggttcagtctagttcgtctcccgtggaagtacacgagatgcaaaatggatacagcagcgaaggcgagaccatgtactcagcagaaaccgcagagtctcgcaactacacaagccctagagagttgaagtttcaacaagtgggaaggagccagagttgtgtgagttacaataggtggggtgctgcaccaagaagccaagttgcacgtgggatgatggtggaaaatcagagaagcttcatgcatgtgaagagaatgtattcacaaggtgcaacaacttctcagagaagcaatgactatttcagccccactgtctcctcaatcatgaaacgtaacagcagttcaagcaagccaccaccccggcagagtgctgttcattctccttcacccagatggatgttttga

SEQ ID NO: 20221 - DNA, 487 bp, Glycine max
  Peptide Sequence Number=SeqID_136999
attggaaagtggctatggtccgtcgtgcattgtgcagacgactgatggcttacgttgccaagagggcattgtgagacaaaggaaagggctgaaaaggatgaccgggctagagtgctgttaccaccggaagaaatgccatgatgctctcttgtggcaattgaagtggaacttcacttcaaggggatgtgatgtctggtgtggcgaaccgtcatcactactgcaggagagagctgcaatgagactcgctgcggaagactcaagcttcgtagttagggcaaagtactggcatgctgctattggtagactgatgaagtcacaaaggctgaattggaaaaagtcggataccttcataagggtttggcatgagttagcgggagactctgtgacggctcactggttggtgagaacgctggatgaaaacgaagttgctagaatgctgtttcgaaagggccgttccaaggggaggcgaaccctccagtttgcttga

SEQ ID NO: 20222 - DNA, 844 bp, Glycine max
  Peptide Sequence Number=SeqID_137000
agttgtcaaggaagatgatcttgcaaatcttacaagcttgacggagtttggtgcatcggggaacaatttcactttaaaagtgggtcccaattggattcccaattttcaacttacctatttggaagtgacatcatggccgttaggtcccagctttccattgtggattcagtcacaaaacaaacttgaatatgttggactatctaacacggggattttcgattctatttccacacagatgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtaatgtgcttcagttggatctttcaagcaattcattctccgaatccatgaatgactttttatgtaacgatcaggacgagccaatgcaattagaatttctgaatcttgcatcaaataatttgtcaggagagatacctgattgctggatggattggacatctcttgtggatgtaaatttacaaagcaaccattttgttgggaacttaccccaatccatgggttccttggcagagctgcagtctttacaaattcataacaacacactctcaggaatatttccaaccagtttgaagaagaataaccaattgatatccttggaccttggggcaaataatctttcaggaactattccaacatgggttggagaaaacctcttaaatttgaaaatcctccgccttcgatcaaacagatttgccagccacattccaagtgaaatatgtcagatgagtcatcttcag

SEQ ID NO: 20223 - DNA, 498 bp, Glycine max
  Peptide Sequence Number=SeqID_137001
atgtattatcctggtcatcaccaacatcagtcatatgtggaacctaatgtacctccggtgcatgttcctgaatttatgtcccaacatcatccatcacaagcacaatatcaatcaacaagtttttccggtcatgcatctcaaggatgtcaacaaagttttcaaccactgggattctcatcatatatacctcaatattcatttcaagtcccttctatctcaaatgttttttttggctcctcacaaatgcttgccaccactttcaacactcctccatctacatataatcttgcaccattgagttcttgttatcgtccatcattagctactcaaatatgtgacatgagtcacgaagatgaggacgagaatgaggacgaggatgtgttggaagcccacgttatgtgcacgttgcacgttcctttatattttattactttggaaaaatttgttacttctgaatctggtccattttccatccacattcatctcatatctttgtaa

SEQ ID NO: 20224 - DNA, 210 bp, Glycine max
  Peptide Sequence Number=SeqID_137002
atgaagaaaatccacgacgaagcgcttccgagacgtttccgtgagcgatttcgtgaagattcttcaccgttcttcatcattcttcgttcgtgcttcgtcattcttcggtcttcaaccgttctcaaagaactacgtaggtctgatttccttatcacaattgagaaatacgtaggagcaagggaaacacctttgtctaccacaaaaagataa

SEQ ID NO: 20225 - DNA, 444 bp, Glycine max
  Peptide Sequence Number=SeqID_137003
atgatattagcaccaaataatgataatgacaaccacaatgcttttggaaggtggaagaaacctttgcagggtactacgaaaattaattataatggcccttaccttaactcagtggctcttgccgcttgtggtgttgtgctttggaatgataagagtgcctgtgatttgggttatagaacaattgttgttgagaatgattgtattgaagttgtcaagcttatggaggatccaagatatcataaaggtcaatttgtagaccttatctctgagattgtgaagaccaaggaaaattttacttcttgttccattgtccatccaccacaagtagctaaaccaccttgccttcttagagaaccatcggtgttaagggcagcccactcgtccaatagagctctccggtggatgagtgctttcacctttcgaccaagattttacacttgttga

SEQ ID NO: 20226 - DNA, 993 bp, Glycine max
  Peptide Sequence Number=SeqID_137004
atggaaattttagacattggtcacaatcgggtacatgatcatttcccctgttggttgaagaacatatccaccttacgtattcttattctgcaatccaacaaattacatggctccctaaaatgtggaggagccaaggtagtatggccacaccttcagatttttgaccttgcatccaacaattttggtggtggaattccattgtcattctttggaaactggaaagcaatgatagctgataaaaatgatgggagcttgtccaagtcagatcatcttcaatttgaaatcctaaaattggatcaagtttattaccaggacagagttacagttacaagcaaacagctacaaatggagttagtaaaaatcctaactatcttcactgccattgacttgtcatgcaataaatttgagggacaaataccagaagggcttggagaactaaatgctctctacattcttaatctatcacacaatgctttctcaggccgaatcccaccatctcttggaaatctgaaagatcttgaatcctttgacctggccaacaacaacttgagcgggaatatccccacacaaataacagatttatcttttctttcattcttgaacctttcaggtaatcatcttgtggggagaattccaacaggtacccaaattcagtcatttccagcagactcattcaaaggcaatgatgggctgtgtggacctccattgtcccagaattgtagtggtgatggaatgaaagagacaccatctccagcatcaaattccaatgttgatacaaagaattccatttattggaattttatatcagttgaagtaggattcatttttgggattggaattattgttttgcctcttttattctatatgccgtggaggacaaggtactggaaatttgttgatggcattctttatcacaccttccctcagctggattttgtacatgaacggcgtggaggacaaagttacagcattctaaggtggaaatcacactga

SEQ ID NO: 20227 - DNA, 432 bp, Glycine max
  Peptide Sequence Number=SeqID_137005
atggctttgatatcggatcaacaatcaaacttcaagcacttctgtaaaatttgcaagaaaggttttggttgtgggagagctttgggaggtcacatgagggctcatggcataggagatgaaagtggtcacatggatgatgatgaccaagcaagtgattgggaagataggttgggtggaaatgtgccaccaagcaacaaacgcatgtatgccctaagaacaaaccctaataggctaaagagttgtagggtgtgtgagaattgtggcaaagagttcttgtcatggaaatctttccttgaacatggaaaatgcacctctgaggatgctgagtccttagtctcctctcccgggtctgacgccgacgatggtgacatcggtggtggcggccggagaggatgtggatggtccaaaagtaaaaggtcgttgagaactaag

SEQ ID NO: 20228 - DNA, 228 bp, Glycine max
  Peptide Sequence Number=SeqID_137006
atgaccacagattcacctccactccgtatgtttccacggacccggcctaactctctaaaaacagtccccagtggagtcgccaactgtcgcaacctacccttaggcgggagggcgacgcggggctcacgggtgcgtcttccaagaaaggaaaatgcgcggagtcgccaccaacgtttattcgaggaaaacgtcggaaaaatcggaaaaggcgtggtctacgaactttaa

SEQ ID NO: 20229 - DNA, 399 bp, Glycine max
  Peptide Sequence Number=SeqID_137007
atgttgagggctttgtccttctttaaggaatcagggtattgtgaattttccatgacatttacattttctacagaaggaaaatggggttgcttcctaggactttatggtggtgtgtttacctccaaagtctctgagtggacttcaaatggttgttattacagtatgagcgagtgcttaaggttcgagcatgcaattaatcagaaggttcatggatcaactatattttccatatttgatctgcattctcaactgccatgctatgctgtactagaacttgtcaccacaaatgaaaagccaatttttgatagagaattggaaattgtttgtggtgcagagaattggacatttacactttttggttgtcttactacatctgatgttgagtgtgatggtagttga

SEQ ID NO: 20230 - DNA, 3132 bp, Glycine max
  Peptide Sequence Number=SeqID_137008
atgttttcacgcaccaatccctttcattcatgggttgcttttacacgagctcttgaactggaatttggaccctctccctatgaatgtcccagagcacatctatttaaattgacacaggccactactgtacatgattattatgtgcaatttacagctcttgctaatcgggttcaaggcattatgccagaagcattactcgtctgctttattggtggtcttaagtctgatattcgtcgcgatgttattgcccaagccccaaccaccttaattcgaacagtgtcccttgccaagctttatgaagagaagtatgttgttaaaccaagatcttatccttctcaaccttggcctaaaacacataaccatcccaatagcctacctattagccaatccatcaaatccacaagcctaccaccactccctccctcacccaaccagtcctaccctacaaataacctgaaacctacaaatgtcaaaaaaatgactccagcagaaatgcacatccgcagagaaaaagggttatgttacacttgtgatgaacggttcacactgaaccatcggtgtcccaacaaacaataccttctcctgtacatggacgatgatgacttgaatgaattgcaaccagacccccctgatagtagtgcacctactgatattgaaaattcattggatcaccatctgtcttataatgcacttaaaggatcttgtgggctcgacactatgaaattccaaggctcaatcaatggaatgcatgtgcagattttagtggacagcggtatttctgataattttttacagccaaggctggcacattgtttaaagttaccagttgaacctattcctaacctgcaagttttggttggcaatggcaactccttagtggctgaaggtttggtggaggaattggaggtaaagattcaaggacattccttcaaattacctgtctatttgttgcctgttactggggcagatttggttttgggagctgcttggttggctactgtgggcccccatatttatgattacagcaaactgactttaaagttttatttgaacaatcaattcatcaccctatatggtgagcaacccaaactgccaactcaggcacaattcactcatttaaggcgaatgcacaatactcatgctatagctgagttatttactctacacattcaacaactagattcacctcaggaccaatggttagatcttcccactgacatggaacctgaaatggcccttctgttgcacacttacaaagaggttttctccataccttccggcttaccccctccaagagctcaaaatcactccattccattgattcaagggtctggtcctattaaggttaaaccttacaggtatcctcatagccaaaaatttcaaattgaatccacgatacacgacatgctgcgcgaaggaattattgtccctagcactagtcctttttcttctcctatagttttggtgaagaagaaggatgacacttggagattctgtacaaattatcgggctttgaatgctattacagtgaaagatagttttcctattcctactgttgatgagctcattgatgagttgcatggagctcagtatttttctaaattggacctccgatcagggtaccatcagatactggtgaaggaagaagataggcataaaacagcctttagaacccatcaaggcctctatgaatggctagtaatgccatttggcctctctaatgctcctgccacctttcagagtctcatgaatgaggtattccaaggtcttttaagaaaatatgtcttggttttctttgatgacatcttggtatacagtccttcttgggatttacatttgcatcacttggaggtagtattaaaattactgctccaacacaggctgtttgcacggttatcaaaatgctcttttgggttgcaacagatagactatttaggtcacactgtttctggtcaaggtgtggcaatggataaagacaaactgaaaggattcctgggcctcactgggtactatagaagattcattaagggctatgcaactatagcttcccctttaaccaatttattgaagagggagaattttttgtggaatcaaaccgctgtagcatcatttacaaacctcaaatctactattactcaagctcctgttctcagccttcctgatttttctcagacttttatccttgaaacagatgcttcagaattttatgctattactgaggccattgccaagtttagacactatttacttggccataagttcatcattagaactgatcaacaaagcttgaggggtttaactgatcaggctattcaaactcccgaacagcaaaaatggttgcataagctattaagatatgatttctctattgaatatatgcctgggaaagaaaatatagttgttgactctctatcaaggtccttctttatggcttggtctcaaccacagttatctattctctctaatcttagagaggctatactagccgatcctaagttgaaagccattgttgacttatgcatcacaaatcagcctcataatcccaattattctgttcgtgatcaccttcttttttggaaaggtagactagttctccctgctgatcatgagatagttcagaaaatcttgcatgaatttcatagttcaatgttggatggtcatgctgggtttgctagaaccttagctagaatctctgctcagttcttttggcacggtatgaatagggatattaaagcatatgtacagaattgtcttacttgtcaacaagccaagacagaaacagcccttcctgtaggtttactacagccattacctattccagatcagatttgggaagatatcgcaatggactttataacaggacttccctcatcgggtggctatacagtcatacttgtggtgattgacagattatctaagtatgctcatttttctcccttaaaggcaaattattccagcaaggtggtagccgagaccttcatgaaatctgttgtgaaattgcatggtttccctaagactattgttttagacagagacaaaatcttcaccagtcagttttggcagcatctttttagattgagtggcacttctctcaacatgtctactgcataccatcctcaatctgatgggtag

SEQ ID NO: 20231 - DNA, 996 bp, Glycine max
  Peptide Sequence Number=SeqID_137009
atgactaaggggcatgtgtgcgataatttctttgtttgtgaggattggttgcacttgaatcttgctaatgggaagggtattatcaacaaagtttttaggttggctcaggattcggtggttgctcttgaagtcagcatgttggattctaaatccacgattaggcgtgttggagacgactatggagtttatatttgtggctttgcaattaagctcggtgcttgctctatggattcttttcgtggagttgtggggtatttttcatggtctaaagttggcttgggaaaggggcttcaggaagatttgtgtttttgctcgaattctagatgtgtgaggcaaatcaggttgcagatcaaatggcaagttatgggatggtgtcatccactcaaaggaggacaacctcttcatccaacagtagtgcggcttaacgctagtaacttaaatgtattttcaagacattttggtcaacctgcgaggaaagaggaggaggaggaggatgtagaggaagtggaaattaatcaaagaagtctcccagctgattttgatcctgctacatttgatcccaatgatcatcgaggccctccatcagagagagttttcaggcttgttgatgaggtcgcttctcttacggtagctgaagctgcagaattgggtctcactctgatgaagaaaatgggagtgaaggagatgcctaatgtgggatttatgaaagcaggagctggaaacctggctggaatggcagcgaaagcaccaacagcagcaaaggaggagcaaaagccagaaaaaactgtgtttgaattgaaactcgagtcctacgaagcggcttccaaaattaaaatcatcaaggaggtccggggctttactgatttaggtttgaaggaggcaaaggatttagtggaaaaaacacctgctgttataaagaaaggtgtttcaaaggaagaaggggagcagataatagagaaattgaaagctcttggtgcaaaagttgttatggaatga

SEQ ID NO: 20232 - DNA, 549 bp, Glycine max
  Peptide Sequence Number=SeqID_137010
atgaggataaatcagtacatcagggacattggaaactttgtgcagagggagaaagagagtcttcctgaagcttgggaaagattgcaagaaaagattagaagttgtcaacaccatgaaattactcaacaaaggctagttcatagtttctatggtgaagtgtcctcacacaataggacaagtttgaatgtttcttgtgggggaaatctcatgttaaagccccctgttgatgccatcaaaatcattaaagacatgtgttctaacccttacaacaactcaagggatatgaggattaaaaagagaggtgcccaccagatgcaagctttatcattgaagattgagacactcatgagaactcaagctcaagtccccattactacacctctattcccaacttgtgataaatgtaggattatgcatgggccaagaaaatgcactattgatgataagttagctgcaaccatgaatgagatcaactttgttgggggtgaggaaatgattcttataactaataccataacaatttcaatcaaggacaaagcttcaggctga

SEQ ID NO: 20233 - DNA, 906 bp, Glycine max
  Peptide Sequence Number=SeqID_137011
atggagacaatgactgaaacgggtggtttcccaggaacgcttactgaggatgaactgaagcaactagctaagagtgagaggattgctgttcatgtatcaaatatatgtaacttggtgctgtttgtagcaaaggtttatgcatcagttgcgagcagatcattggcagtcattgcttcaaccatggattctctcttggatctcttgtcaggcttcatattgtggtttactgctcatgccatgaaaaacccaaaccaatatcgctatccaattggaaagaagcgcatgcaacctgtgattttgattgaatctggtcgacaacttatttccaaggtcaagcctgacatggattcagcaaaactgcattggatgatggggattatggtgtttgtgactgtagtgaagttcattcttatggtctactgtcgaagatttaaaaatgaaatcattagagcatatgcacaggatcacttatttgatgtcattactaattctgttggattagctgctgctgttctagctgtcaagttctactggtggattgatccaacaggagctattgttatagcattgtatacaattaatacatggaccaagactgtcattgagaatgttggttcactcattggaagaacagcaccacctgattttctggccaagttaacttatctcatatggaatcaccatgagcagatcaagcacatagatactgttagagcatacacctttggtgcacattactttgtggaagttgacattgtgttgccagaagacatgcttctccaccaagcacacaacattggtgagacactccaagtgaagctagagcagcttccagaagttgaaagggcttttgtgcacatagattttgagttcactcataggccagagcacaataccatggtatga

SEQ ID NO: 20234 - DNA, 923 bp, Glycine max
  Peptide Sequence Number=SeqID_137012
atgaggatcaccagccaagggagccaatacacaaagcaattaaacagaatcaagctcaagctagctagctggaagggaaatttgctctcttttatgggaagagttctcttagttaaatcttcatccaaagatcttgagtgttgggttcgtaacttcatatggagtggggatattgattctcggaaatgtgttacagtagcgtggcataatggccactatgctgaagttagagttttgaggaatcaaaagcctattaatggtcacatttcttcttccttatggaccggtataaagcccagttttgccttggtgttggagaatgctatttggggaaaagggtctatgagtttctggtgtgataattggttgggcactagcgttgctgatactcttaatatcccttataagaacaagagtcttataaaagcttctgtttgggacttttggaatgagggcatttggaaccttcctaacttcctcacccagaacttttctcaactggtgggtcatattctgcaagtcactattcccatttctcagtctgaggataggctatttgctctaattgtggtcatgattatgagacaattgatcacttatctctcttgtcactttgccagacaggcctctgacattgtcccggcagctgtaacttttgctatattttttatttggtctgctcgtaattcttgcagatttgataaccagaagttggatttcacttctttcgatacctctattcacctctcaggaaacttctctgttggaaccatgaacaactctatgctagatttcagaattcttaaaaattttgatgttccaactaatcctaggaaagcagattccatcaaggaagtcatttggagaccgcctagacgcacttggattaagtgtaatactgagggaagcgagaggaaaccctg

SEQ ID NO: 20235 - DNA, 327 bp, Glycine max
  Peptide Sequence Number=SeqID_137013
atggccaaaaatactcgtctaaaggaactctcctcagacatcaaaaggttgttggacactatggaaacccgagacaaggaatatgctcttcggtttgaaacgctggaatatgttgttgatggtatcctcaagaaaaatctcggctccgaatcgagttttgccgctacctccgctaatcaaccctttcagacaaagaagttgttccctggtatcaaatgttttcacgcaccaatccctttcattcatgggttgcttttacacaagctcttgaactggaatttggaccctctccctatgaatgtcccagagcacatctgtttaaattga

SEQ ID NO: 20236 - DNA, 168 bp, Glycine max
  Peptide Sequence Number=SeqID_137014
atgtggtaccattttccagtgaaaaacctcgtcgggcgcctaggagtacatgacaagacatgcctcacaatgggcttacaggagtactcaaaccggatgacccccaaggcctacactccgaagagtccgtcagggcctctccctcctgattcagtgcgcctcaagtga

SEQ ID NO: 20237 - DNA, 309 bp, Glycine max
  Peptide Sequence Number=SeqID_137015
atggcatttcgtatgctgcgtctcaatggctatgatgtatcttcagatccattttatcaatattctgaagataaatttgctgaatccttgaaagggtacttgaaggatgtcagtgctgttatagaactatatagggcttcacaagccattatacatcccgatgaatcaattttggtcagacaaagtttgtggacaaaacatcttctgaagcaggaatcctccccttacagattatatgctgataaacttcgtcgttatgttgatctagaggtagtttcttgtcttctttcaaaaactctggttacatag

SEQ ID NO: 20238 - DNA, 498 bp, Glycine max
  Peptide Sequence Number=SeqID_137016
atgagatccttgttgaagctgacagtccaaagatcagagaacagaatgcaggaagttcaagccattatagaactcctgtaccccatgatacgcacctcatggatgaacagcagtgctttggttcataatttgaggaatagcattgagatgacttgggaagcactgaaaactgaattgttgcagaggttttcatgtagtggtgctgcaaacccatatgagcaacttgatgccttgagccaaaatgtgaaacctggttctgtttggtcaaatcagacagttcagggagcaatagccaaatgcatcaaggttgttattttatgtcagggcatggattctggatataatctagccccagcaagttcaagccaaatgggagatacctgcctgaaccaaactcaattagccaaatatgcttcttctgctgcaaattccaatagcagtgtgggtagcaatagccaaacagggaaccaatccagaaacaaagacatgaggcattag

SEQ ID NO: 20239 - DNA, 255 bp, Glycine max
  Peptide Sequence Number=SeqID_137017
atgaaaaataagacttctctactaaattcttggcaccgaatcacaaagatcagaaatattttgaagacaggaaaaatcttgaaatacatacaagatatagcctgtaacagtcgtaccaaaaaaatgcaagtaaagggaggaacagagaattttattactgaaaagcaaggatctcaacggaatcccgcaattacagagacaacaatggcagaaatgtatgatagaaaaaggaagaacagattcccaaaggagtag

SEQ ID NO: 20240 - DNA, 1023 bp, Glycine max
  Peptide Sequence Number=SeqID_137018
atggcttggaccgggctcactccctggcccaatgcggcttcgcgggccggcccgcctgcgccgtccctcgccggaggaggagcggcgtctccggattccggttgccggaaggcaggtcgatccggggtggggagcttgacggaggatgggttgtcttataaggagaagttcattgtgaggagctacgaagttgggatcaataagactgccactgttgaaaccattgccaatctcttgcaggaggttggatgtaatcatgctcagagtgttggatattctactgatggttttgcaaccacccctacgatgagaaaattgcgtctcatatgggttactgctcgcatgcacattgaaatctacaaataccctgcttggagtgacattgttgagatagagacatggtgccaaggggaaggaagggttgggacaaggcgtgattttatactgaaagactatgcaactgatgaagttattggaagggcaacaagcaaatgggtaatgatgaatcaggacaccagacgactccagaaggtttctgatgatgttaaagaagagtatttggttttctgtcctcgagagcccaggttagctattccagaggcagatagtaatagcttgaagaaaataccaaaattggaagaccctgctcagtattccagacttggacttgtgccaagaagagcggatctggacatgaatcagcatgttaacaatgtcacctatattggatgggtgcttgagagcatgcctcaagaaatcattgatagccatgagttgcagagtattaccttggattacagacgagagtgcggacaacatgacatagtcgattccctcactagtgtggaagcgatacagggtggtgccgaggcagttccagaactgaaaggtacaaatggatctgccacggcaagggaagacaaacatgaacaccagcagtttctgcatctacttaggttgtctactgaaggacttgagataaaccggggacgaacagaatggagaaagaaagctccaagatga

SEQ ID NO: 20241 - DNA, 1593 bp, Glycine max
  Peptide Sequence Number=SeqID_137019
atgcgcgagttcttgtcgcagatcaaagctctttccaattctcttgcctccatcggaaggacaattatgtttcaggaacacattgattcaattcttgaaggccttccaccagactatcacttcatcattgcaattattgagagcaaatttgaacctcttccaatcgagcaagtcgaggcccttcttgctcacgaagcgcgtctgaattttttattttttttgtctgattcaccttccatcaattattcgcaagcacaacacaagtcttccgcaattagctccgatggatattttgtgccaaacaagacagatcaagagagtttctcggctttccgtggcggatctggctgtggtggtagttctccccatggccgtggtggtgttggccgtcgtggtggtggcagtggttgcggccgtcgtggtggccggtttgctaacttccagtgtcagaatagtaacaattctggtgatactagacctgctaatgtttggactaataccagttacaagtctaccagtaccaatcatcagtcaaatcctggtgctatgctcacagatgctcagccccaatctaattccaataattggattcctaattctggtgcttcattccatgttactagagaatctcgaaacattcagcagctagagccttttgaaggtcctaatcaaaatcttcatacgcaatggtcaaggttaccaatgaagtcttacttcaaagaaatgttggttctaatggtctttacagttttcctcacattcaatttcaaccttcaactgggaggggaatttcatccattggcacctttgtcctcacacacatcattagaatgggttgttgaaaggaaacataggcatgtgatagaactgggtcttactctgttgcaccatgcttctttacctctaaagttttgggactttgctttcacaactgctgtttactttataaacagacttcccacagcctcactgaatttctcagtgccttatcatgtacttttcaacatattttctgattacaacttcttgaaaacctttggctgttcttgtttccctttgcttagaccttacaacaatcacaaattggattataggtcacatgagtgtcttttcttgggttattctacttcccataaaggagacaaatgtctttctccttctggcagaatctttatctctaaagatgtttcgttcaatgaatccaaatatccttattctgccttgtttgagtccccacttccttccagtcagtcctcttcttctactagcattcagtttccttccatacctatcattgctcctaatctgaattttcctatttcctccactcagcctactcagtctgaacattcagaacctgctactgtttcttctcagtctgtacctagtaatgtttctgttccatcagaaactgctactgttcctctccaatcttctgacactgagcaaacagcttcaccagtagctgatgatgctgccataccctcaccttccatttcttccccattcaacaccaattcaacaccatcttcttcttcaaacatctctccttctacacctagaccagccaatactcaccctatgattgattag

SEQ ID NO: 20242 - DNA, 771 bp, Glycine max
  Peptide Sequence Number=SeqID_137020
gatgaagaacataataataaggtaacttgggttagttgggaggacatttgttctagtaaggagagtgagggcttaggagtgaaaaacattgctttgtttaatgaggcattttttggggaaaatggaggtggaaccttttccaccaaggagggttgtgggttaagcctaaatggtgaaaggtggttcgataagggtagtgagtggaagcttggtgatggagggaagatgacattttgggtagatgattggattacttggaggagagaagggtttgagtgggagaaggagctaatccaacaattacttcacttgtttgacacttttcggatacacaaagttatagcggactcttggttgtggaaagctagcccttgtggaagctacacatcaaagtcaacttatttgctttacttgggtggatctaattttcaggttgtgaatgatatcttttcattggcttggcagttgaagatacctcgtaaagtttcttttcttctttggaaacttttgagaaagcgcctcccaacaaaggataaatacacaaaaggaacatcatacctcaaaacgtgtatgcttggaaagccccagatttttccactactctccctctctattgaggcactttttaggcaaaataatgctatgaggccgtacagaaaactcaaggattttggaatgtcatatggtgtgcgattatcttatgtgtatggaggaagaggaataacatcattttcaataggccttgatggaaataagtggcttaatggatga

SEQ ID NO: 20243 - DNA, 522 bp, Glycine max
  Peptide Sequence Number=SeqID_137021
atgtccaccatgctcatggcgtcagggtgtccaccgttttatccgctccagcgcatcacggtggtgctccgccatcttcgccagtcaacctggctgacccacctccatcgctaccacccacatccccagagccgccaccaggtggaccggctctttcgccacattgatcatctccaagattatattacccgccacaggctcctccctaccacgctgagtcaccgtcctcgtcgaactcccaacaaccacaacaaccaagagcaagttcttcaacttcaccaccagttcgtggagcttcggaggacccaccagcaccagctccgcgagtcactcaccagaatccgccactgcataaggcccctccgacagtaccttatacaagagatatcatatagggcactaattgagatttctgatgtagctgagtacgtggcaagtgtggaacaaccgaacaagtgttttttttctaaggggcagggggtacgcatattgtgctcaatctcaatcatcgcacagaattga

SEQ ID NO: 20244 - DNA, 540 bp, Glycine max
  Peptide Sequence Number=SeqID_137022
atggcgatcttctacgctttggtggccagaggcacggtggtgctggcggagttcagcgccgtcaccggcaacaccggcgccgtctcccgccgcattcttgagaagcttccggcggagtccgactccaggctctgcttctctcaggatcgctacatcttccacatactccgatccgatggcatcacctacgtctgtatggccaacgacaccttcggaaaaagacattcccatctattctctctatcagctagttcagaatcgtcagatttgttccaaccaaggagaatccctttctcgtacttggaagatatccaaatgaggtttatgaagaactacagtagagttgccaattatgcaccagcatatgcaatgaatgatgaattttcaagggttttgcatcagcagatggaatttttttctagtaatgcaagcgccgataccctcaatcgtaaagttggtaagcgaagcagaggtggtatacctcttgacttggagtgttccagtgcctttataagctgcttggctcatcccaaggagtga

SEQ ID NO: 20245 - DNA, 1932 bp, Glycine max
  Peptide Sequence Number=SeqID_137023
atgtatctatctacccttcactatcaaacattgttgacaacttatgaaaggtgtcccagccttgccaaagttttcacaaatttcaaaagggtcttgcatgagaaggacttagtgcgctggcatggtaataacaaacaacaccgttttctaggctgcggcaggttttgtgaaggagggaaagcagcaatggaagatgaggctttgattgattataagagtgaaggtgttgaaagaagcatagaatgtgaaaatggttgcagtgatgagagttttgctgatttgattaaagaaaagggtggagagagcagttccaactctgaaattctattatctgagatgacagaacttgatgatcaaaattttgatttgaatcatttgattaaagaaaagggtggagagaagagttctagctctgaggtgatgacagaacttgatggtcagagtcaaggtagtgctgaagattcatcctcatcaacttcaatgatgtggcaggttcaggaaatgcctacatctaatagtccaagtccacgtggaagggaagatgcagagaaaaagggcatgtgtaatgagaattttgaggagaaaatctcagggttaccaatgtcagtgctagagcttgaattgatgaaggagaggtttgcaaaattgttacttggagaagatatgtcaggttctggaaatggagtccctgcagccttgactgtatccaatgccatcactaatctatgtgccaccctctttgggcaactttggagattggagcccttggcaccagagaagaaagcaatgtggcgacgagagatggagtgtcttcttagtgtcagtgattatattgttgaattgaagcctacatggcaaacatttccagatggaagcaaacttgaggtcatgaccactaggcctcggtcagatctttatgtcaacctgccagctttgaggaaattagataacatgcttctggaaatactggatagttttgttaacccggagtttaggtatgtagaccaaggggttttggccacagatgcagatggctcatcttcattccgccaagctcttcagcggttagaagagaaatggtggctccctgtacctcaagtccctccttgtggtctacgtgaagattccagaaagcagttgcagcacaagagggatagtacaaagcagatattaaaagctgcaatggcaatcaacagcattactttagctgacatggagatccctcatacatacttggaatctcttccaaagactgcaagagccagcttgggggatgtcatttacagatatattacaacagataatttttctcttgagtgtatgccagcttgccttgatttatcatctgaacatcaagccatagagattgccaacagagtagaggcatccatttatatttggcgaaaaaagacgaactcaaggcctactacaggtcgcactacaagatccagttcaagatcatcatgggaaatcttcaaggatctgattgtggagggagacaaaatggaaacacttgcagaaagagcagaaagccttctgctctccttgaagcagcgtttccctgctcttcctcaaacagccttggatatgagcaaaatccaatgcaacaaggatgttggaaaatccattttggagagctactcacgaatattagagagtttgtcatcaaacattgtagcacgcattgacgatgtgctctatgtagatgaactgacaaaacactctaatccaatctcatctttcccaaaagttggtgtaattgctcacaagagcatttcagttccacactcattgcctggccaaagcattcctccacataagtcatcttttggcacaccaagcttttctcctgcacaatgtgttagcctgaaggggagcaaaatcatcaatcatcaacaaaggcaaccttccccaaagaggggtaggagttaa

SEQ ID NO: 20246 - DNA, 438 bp, Glycine max
  Peptide Sequence Number=SeqID_137024
atgacagaatcacacaatctctttacctcctcttccacattccctaattcgattagtgagaaacttgatgactccaattttctgctgtggcgacagcagattgatctggtgatcaaatcacaccggcttcaatgtttcgtcgtgaatcctgtgattccgccgcagtttctctcggatgctgatcgtgaaatcggaaatgagaatccggcatatgagatatgggagcaacatgatcaaatccttctcgcgtggctgcaattgacgctctcgaatttggtcatctctatcaatgagagtaaattagaacctcttccaattgcagaggttgaggcgcttctcttagctcatgaagctcagcttcgcaagtttgatgagttgccagatccaccgtctgtcaatctgactcatacgtacggagctgatacgcattctgcttaa

SEQ ID NO: 20247 - DNA, 732 bp, Glycine max
  Peptide Sequence Number=SeqID_137025
atgtgggagcaacaggatcagtacttaaccatcactagaccagagataagccttgctgtaaacaaagtttatcaatttatccatttggacactcactggatggcagtaaagaggattctaaggcatttgaaaggaatagttcttcatggtcaacatctaaagcctgctgttttaggacttccctactccattagggctctttgtgatgcagactgggcatttgatgtcgatgataggatctacctcttgtgcagtttggtagatgctctcatcaagcctctttctccgaatatatttggttttctaagaggcaaactcaatcttgcagcaaagttccgtaacagtggacaaacatgtgtttgtgcaaatagaattattgtgcaagaaggtatatatgagaagtttgcaaatgctttacgtgatactgttcagaatatgaaagttggggatggtttcagtgaaggtgtggcacagggtcctctaatcaatgaagctgctgtcaaaaaggttgagtccttaattcatgatgctacatcaaagggggcaaaagtaattcttgggggtaaaagacatagccttggatttactttttatgaacccacggtcatcagtgatgtcaacagtgatatgcgcatatcaagactaactgatattaataactatactgtctatacttcacagcttggttatgttatattgcgttgtaagttggaagttgatgctgcacattaa

SEQ ID NO: 20248 - DNA, 177 bp, Glycine max
  Peptide Sequence Number=SeqID_137026
atggcggtagatacaatcacagtggtgcacgcggtcacggtggtcgctttgcaaactttcagtgtcaaaaatgacagaactataaccgcggggaagacattcaagcagtcatatgctcttgaggagatatcagacttccaactgaagcaagagaatcagcgatctcttgaactttga

SEQ ID NO: 20249 - DNA, 345 bp, Glycine max
  Peptide Sequence Number=SeqID_137027
atggttcaacagataaacttgacagtaatacaactttcaggacataaccggcacatgggccatttagcttgggccgatgcatttgttgtcacagcagattcagttagcatgataagtgaagcatgcagcactgggaagcctgtttatgttctgggagctgagcattgcaaatggaagttcactgaattccacaaatcattgagagagcagggagttgttcggccttttacaggttctgaggatatatcagaaagttggagttatccaccccttaccgatactgctgatgctgctaaaaaggttcatgaagcacttgctgcccgagggtggaaactgaaggtatag

SEQ ID NO: 20250 - DNA, 471 bp, Glycine max
  Peptide Sequence Number=SeqID_137028
atgtgtcacctaactacatatgtttgtgtttactacgacggccaaatttgcaacactaatgagggcaccaccttcgttagtaacaacacaaaaactttcatggtcgataaggtcataacctttacacaattgcttgaacttgttcaccaaaaactaaacattgacccagaacaacatatccaacatctccattttcggcgccctatatttgagtcaggacaacgttatatgtacacatcttttattctgcgagatgatgctgatgttcgacaaatgttcaacattttttacaacaacccatcactaccatttgtggagttatttgccataatctgtcacaataatgacccaccaggcaaccaacatggctcaacctctaatcttgaggacttatcaggtgaatacgagacttgttggctcacaatccaaattgacaatactctgcaatttgcacacgtctctaaaaattaa

SEQ ID NO: 20251 - DNA, 717 bp, Glycine max
  Peptide Sequence Number=SeqID_137029
atggtcagtgtcacttgtgagcttcaatggctcacttacttacttgaagattttggtattcaattcagtagacctgctttattgtactatgataatcgttcagcattacatattgcagaaaatcttgtctttcacgaaagaaccaaacatattgagatcgactgtcacattgttagagagaagattcaatttggattgctcaagctactacctatagcttctgttgatcaattggcagacatttacaccaaagctctcccacctagtgcattccaatttcttaattgcaagctaggaatgtcgaacatacattctccaattcccgaagtcttctggaatctcgccgcagagctgattattgatgaggtcgagtttgccgacatcggcggggatctcaccggagaccttgttgcccatgaggtccaggatgtggagggagggaagcgtggtgaggcaggcggggatctccccggcaatgtcttttcaatcagcgatgacgagggtggtgaggccggagcaaccggctttctcgaagattgggtcttcggactccccgcggaggttgttgtcggtgacgcagccagtggtggtgtcgcagctgatgtcgtaccagttgaggtagcagttggagcccgtccacgagttgaagaggccaagcacacaatggcaggaatggcagtcgctaataagaggaacgagtggcaagccattgagtga

SEQ ID NO: 20252 - DNA, 372 bp, Glycine max
  Peptide Sequence Number=SeqID_137030
atggaagatatttttaagagatggactgagtatcttgacagcacacgatcaagggtcaatcacccatcaccggagttacacccttacaatcaatatgaaagaactcctaatcttgagagtgtgtttacagaattcatgacatgccatcctagctctacaactaatcaaaactcaatgcaaaaccaggaaattcaggaagtcactgaatctactcaacaagcatttaaaagtctagaaattcaagttggtaagctagtagaagaagtgactaaatttgtggccagaagagaagaaaactctgtaaaggttgaagctcatgaggaaagccttgtagaagagttagaagagcatgattcaaaagaaaaaagatga

SEQ ID NO: 20253 - DNA, 411 bp, Glycine max
  Peptide Sequence Number=SeqID_137031
atgagtgaagaattggatcaatcactcaacatacatagtccatactacatgcatccaagtgaaagtccagctacaacattggtttcacctcaattggatcccataaattatagttcttggagtagatcgatgctcactgccttgagtgcaaagaacaaggtctatagttctctaagccagctacgactcatgcattcagtatcaacatcaactcgacaaagtattctttggatggataacattgtggatatatggaaggatctaaaggcaagatactcacaaggtgatctttcgagaattcttgacttacggcaagaacttgcttcaattaaacaaggtgacactagtattactgattatttcactaagtcgagggttatttgggatgagcttgagaactatagactataa

SEQ ID NO: 20254 - DNA, 357 bp, Glycine max
  Peptide Sequence Number=SeqID_137032
atgtcggaaatacatcagtcaaaacaaaaatttaaaaacaaatcaaaatgtactagaaatcttcgaccaacatcggcctccttaatcttcttccaacgtctccacaacattcaccccaacaaatcaagagtccagagcaagcatcaaagtccaaacgcaatgatagacatagagagaacctcaagatctaccaaactcaaaggcatcaaacccgatatcaagcctgaaataacagttccatatgcatcatcgttggaaatcgtcactcacagtggaggaaggcgccgcacagtggccaaaaatcgcctaacggcagcggagcacggtggccgaaaatcagcagcacgaaggcgatga

SEQ ID NO: 20255 - DNA, 381 bp, Glycine max
  Peptide Sequence Number=SeqID_137033
ggaaccaaacaaaggcatgatgatagtaagttaccatcgaatcctgaagaagtagaagatctacggcgtgacacagctgcaaatcctttgatagcattcacttatgatgagttaaagatagtcacagcaaattttaggccagatcgtgtgttggggggaggaggatttggaagtgtttacaaagggtttatttctgaggagttaataaggcaagggcttcctacccttgctgtagctgttaaggttcatgatggtgacaacagtcatcaagggcacagagaatggctggatactttacaaggagatctcaacttgattcctacaaaaagtatctttttggatgggggaaatacccatttggcttcagcttctggactgtga

SEQ ID NO: 20256 - DNA, 654 bp, Glycine max
  Peptide Sequence Number=SeqID_137034
atgactcgcgttttggttcagaggggttcttccggtggtggttcgacttcgtccaacccgaaccggagtggtggtgggtcttcttctaattcctcggcgcgggcggagccgcaggttccggttttgccggagaatagcgacgaggttgttgttggtgttgtgtcggatgaggttttagagagtggtgataagggaaaaagtgacgagagtgttcattttgagcagggtgatggatcgtgtgacgatggcgtggctgctgctgttgttgttgagagtgatgttagggaggagattgtgaaggggttgagtgggcttagagttggtgaaagggttgtttcggagagtgaggtttcgagtggggattcttcttccctccttgttggtggtggtggttcgtgtcccccgccgcctcctgtgccgcctcccaagccttccgtgacggggaacttgaatccgaggaggagtgtgtccgggagtttgaattccggcattgtgggatcctcgaggagggcgtggccggttgtttcggctaggacttcgcctgctgggtctaggccgtcttctcccaggtcacataatgaaagtgaggggtacaacagtgctgatgagcagaagccttgcctggtttcatcttatgatgattttgtaagttga

SEQ ID NO: 20257 - DNA, 1314 bp, Glycine max
  Peptide Sequence Number=SeqID_137035
atggaggtgaccaaccttgtagtcttgccagcagtttcggcattctttgtcctttgtctatatttcatcattaaagttttcagactcgggaaacatccaaacctcaatcttcctcctggaagattaggatggcctgttgttggagaaaccttggagtttctgcgcacaatgaatgagggcaacgtgttaaggttcatacaagagagaaaggagaaatatgactccagggtgttcaaaacttcaatgtttggagatcctgttgttctgttttgcgggccagctgggaacaagttcctattcagtaatgagaacaagaatgtccaagtgtggtggcctagttcggtgaggaggttgttaaggttgtccttggttaataaggttggtgatgaggcaaagatggtgagaaggttgctcatgagctttcttaatgcagaaacactcagaaactatttgccaaaaatggatagcattgctcagcgccatatagatacatattgggaagggatcattggttttcccctcaacgttcctggaacaaggttttatcgggcaatgaaagctgcagatgtaataaggaaagaaattaaaatgattctaaagaaaaggaaagtggatttggaggagaagagggtatcacctactcaggaccttctatcacatatgcttgttacatctgaccccagtggaaggtttatgactgaaatggagattcttgataacattcttcttctactttttgccggtcacgatacttctagatcagtgttatcattggtcatgaagtatcttggacaattgcctcaagtttatgaacatgtcttggaagaacaacttgaaattagtcaagggaaagaggcagggcagttgttgcaatgggaagatgttcagaaaatgaaatactcttggaatgttgcatctgaagtcatgaggctgtccccacctgtgagtggtgcttacagagaagctataaaggatttcacctatgctgattataacatccctaaagggtggaagctgcattggaacactggttcatcacacaaggacccaacgctcttctcgaatccggaaacttttgatgcttcaaggtttgaaggggcagggcctacacccttttcatatgttccatttggaggtggcccccgaatgtgtttggggctagagtttgctagactagagattcttgtgttcatgcataatatcgtgaaacggttcaagtgggatttggtgattcctgatgagatgttcaagtatgatcccatgctagaaccaataaaaggacttgcaattcgacttcatccttcccatttctag

SEQ ID NO: 20258 - DNA, 1209 bp, Glycine max
  Peptide Sequence Number=SeqID_137036
atgtcattgcctaccactactagtggtcactcatctatttactctgcacttacattgccaagaaccacccaaattcacccaaccttgttttctcccaccaccaagttcttttcttccaaaagcccctcatattcaggtctttccaattgtttctcaaacacccttttgtcaagacctttgctttttgctgtcaaggcttcatctggggttggctcagaagcatccaaacaggagagtgacaagagtgaagaagaagaagaggaggaggaaccgtatgaagagtatgaggtggaaattgagcagccctttggactcaaatttgcaaagggtagagatgggggaacttacattgatgctattgcaccaggaggatcagctgataaggctggagtcttcactgttggggataaagtaattgccaccagtgcagtttttgggaccgaaatttggccagctgctgaatatggaaggacaatgtacacaattcgccaaagaattggcccgttactcatgaaaatgcagaagagatatggtcagttcaatatgtatgcatttttgctatgtttcgagtgctactctagaaaaaacattgattctggtggtgagttaactgaaaaggaaattatcagagctgagaggaactctgggtttatcagtaacagagtgagagaaattcaaatgctaaatgctttgaggaaaagggaacaaaaagagcgcagggaaaaggatttgagggaaggattacaactatataagaatggcaaatatgatgaagcactagagaaatttgagtctattttaggatcaaagccagaacctgaggaagcagcagttgcaagttacaatgttgcttgttgttactctaagctaaaccagattcaagctgcactttcttcactagaagaagctctgaatactggttttgaagacttcaagagaataagaactgatcctgacctggctaacgcaagggcatcagaggaatttgatcctttattgaaaagatttgatgaatctttcatcaatgagaatgccatcaatgccatcaaatctctttttggatttggtatgtatgagaggcttgaatcaagaggattgtgcttgttacatgtcatggactattgtcctcttagttcaaatggttacgatttacgaagcaatcctgggcatgacttgagttatagattatgcagcttgtgttattgctag

SEQ ID NO: 20259 - DNA, 504 bp, Glycine max
  Peptide Sequence Number=SeqID_137037
atgctgaatcgagtaaggcctgaggcaagtcctagcttcaatgttgttagctacggagccaagggggatggcaaaactgatgattcacaggctacattaaacctatttggcaatactacttgtaacgtgtgcggtgcaactcaggagactgcaacacttgacataccagggggaaaaacattcatgttgcaacctgtgtcgtttcaggatattgtggttgttggggttaagaaccctctgattattaaccaaaactattttgggcttgaagaagaaagtagtggagaaggaaatgcagtgcaaataagccaagttacttaccgaaatgtgaagggaacttctagtgtgaaggatgcagttgtactgaattgtgatcccactgtattggacgatatttgcataaccactgaagatggcatgaaaacacaaggatcatgcaccaatgcacaagggatgtgctctcactgtcatccaattgtcccatgtctttccaacaaagattaa

SEQ ID NO: 20260 - DNA, 1080 bp, Glycine max
  Peptide Sequence Number=SeqID_137038
atgcgcgccatcttagcacaggcagagtgggagttgagtgtgagtgagttaccggtaagcgaggtactgcctgcattgctggccgcgctggcgcagtcgccacaggtgctgctggcggccccgaccggcgccgggaaatccacctggctgccgctacagctgctgcaacaggcgcagctgccagggcaaatcatcatgctggagccgcgccggctggcggcacgcaacgtggcacagcggctggcggaacagctgggtgaacagccaggcgagacggtaggttatcggctgcgcggggaaaactgcagcagcgcagcgacgcgtctgttggtggtcaccgaaggcattctgacgcgcatgctgcagcgcgatccgctgctggagggcgtatcgctggtgatcctcgacgaattccatgagcgcagcctgcaggctgatctggcgctggcgctgctgcttgatgtgcagcagggattgcgcgacgacctgaaaattctgctgatgtcggcaacgctggataatcagcagctacgcacgctactgcccgacgcgccgtttattgcgtcacaggggcgcagctttccggtgatgcgacattacgcttcgctcaatccgcagcagcggtttgaagaggcagtggcgcgcgaggtggcacagttgctgcgggatgagcccggttcgctgctgctgtttctgcccggcgtggcggagattgaacgggtgaagcgtgaactggcgtcgcgcgtcagtgatgaggtggatttatctcctttatatggtgcgctgtcgctggaggcacagcggcgggccatcctgccggccgcgccgggccggcgtaaagtggtgctcgccaccaatatcgccgagaccagcctgacgattgaaggtatccgcctggtggtggacagcgcgctggagcgcgcggcgcagtttgacgtgcgcagcggcgtgacgcgtttgctgacccagcgcatcagccaggcatcgatgacgcagcgcgctggccgcgccggtcgcctggcgccggggatctgcctgcatctgctgccgcaggagcaggcgctgcgtgcggcggcgcaa

SEQ ID NO: 20261 - DNA, 447 bp, Glycine max
  Peptide Sequence Number=SeqID_137039
atggccacgcaacgactgttttttgccctcgaattgcctgatgccctccagcaacagctggtgcaatggcgggccgattgcttcgccgcagacgcgggtaaaccggtggcggcggcgaatctgcacctgacgctggcgtttctcggtgaggtcagcacggaaacggcggagcagctgcagcagctggcggcacgcatccgccagcctggctttacgctggatctcgatgacgccggtcactggccgcgtcccggcgtggtgtggcttggctgccagcgcgcgccgcgcggtttactgcagctggccaacctgctgcgcgcccaggccgcgcgccatggctgtgcgcagagtacgcagccgttccatccccacatcaccctgctgcgccacgctgcgcaggcccgtggcgctgccgccgcgcggttttcacttggcgcattgacgtga

SEQ ID NO: 20262 - DNA, 375 bp, Glycine max
  Peptide Sequence Number=SeqID_137040
atgtcgtcagagaaggaaactgagagtcggaagttgggttcggaagagatttcacgcgagttcaaaaccctagtcagctccaatgatctccactcccttaaccacatgcaacacaccatattgggaaggttgcaggacagcaatgcggtgttgtcgcatttcaatgacttctctcagcactgcttcgctgagatttccggcgacatcgctagaaacacgcgtgttttgaagtctgtcaagtctgaccttgattacatctttcagaaactcaggaaggagttcaacattgagggtgcaagagtgaaagatatgaaggcaaaaaattatctcttccaaagcaacgagatcaattctagagaccattttgaacaatga

SEQ ID NO: 20263 - DNA, 2292 bp, Glycine max
  Peptide Sequence Number=SeqID_137041
atggatttaatcaaaacaatggtttccatcttttgcccaaaccccgcatctacaagattcacaaggggtctcactaacatcacccaccgccttaaagaaacaagcacgacagaccaacaacgacccgaccgtagaaataatttacaaagaagaagtccagtggagaggcgccacgtggctggatccaccaatgggagaaggaaaatgagatcacagagtgacctgcggggttttctcaactcttcgatttggggcttaaaccctctccgattcagattcggatttagggcttccctttctctattccgcctccaaagaaaaacagatctcgtggttgaagcaactgatttgctacagaagctatcgttagaaactcagcccaagcccttggagattcctgagcctaccaaaaaggccactgggaatcagtatggatcagttgattcaggaaatgccgcgaatggccagatccagtcgtatgatcggtctgtaactcccgtgttgcaggattttattgatcctactatgtgttacctcccaaatggttacccatctactgcctattattacggtggttatgatggaactggtaacgagtgggatgagtattcaagatatgtgaattcggaaggagttgagatgacttcaggagtttatggggataatgggtctctactttatcaccatggatatggatatgcgccttatggcccctattcgccagcagggtctccagttccaaccatggggaatgatggtcagttgtatgggcctcaacactatcagtatcctccatatttccaaccgttaacaccaaccagtgcgccattcacacctactcctgctgtcctacctcagggtgaggtttccacctctgtagctgctgatcaaaagcctctccctgtcgatgcagccaatggaaattctaatggtgttgcgaatggtgggaatgcaaaaggtaataatgctgctgcttctattaaacaggccaatcagaattcatcttttagttccaaagcatcgaatgaaagggttaccatgccaggtcggggtccaacttcaggttatcaggatccaagatttggttttgatggagtacgctcacctatcccctggctagatgccccactattttcagatgggcagccaaggcctgtaagtagcacaaccatcacttcttcgatatcaggtggcaacaacactgcctcaaggaacccaactttccgccctaattctcagtttatgggcttgcaccacccaagaccaatgcctgccatgggagccacccatagcttcataaataggatgtacccaagcaaactatatggtcaatatgggaacactgtcagatctggaatgggttatggtacacatgggtatgattctcgcactaatggacgggcttggttagctgttgacagtaaatacaaaactaggggaagaagtggtggctactttggctatggcaatgagaacgcagatggtttgaacgaactgaacagagggcctagggccaagggtggcaaaaaccaaaaaggttttgcaccaactattctggcagtcaaagggcagactttgcctgcaactttaggcacagatgaagagaaagacaagactagtaccattctggaatgtgatcaatataacaaagctgattttccagaagaatatactgatgccaaattttttgtcatcaagtcttacagcgaggatgatatccataagagtattaagtataatgtgtgggctagtacacaaaatggcaacaagaagcttgatgctgcatatcaggaggcacagcagaaacctggcggcacccctgtttttctctttttctcagttaataccagtgggcaatttgtggggcttgctgagatgattggtcctgttgattttaacaagagtgttgagtattggcagcaagacaagtggaatggttgctttcctcttaagtggcacattgttaaggatgttcctaacaatttgttgaggcacattaccttggacaacaatgagaacaaacctgtcactaacagtagggatacacaagaggtatgggaagggaaacctgctgatgagaagattgagataaatggggaagttaatactcaaaaatctgaagttagctcggaattgctcaaggagtctacccttgctgagaaggatagtgatgaccacaaagttcccgagaatggatctgctacaaaaactggagatgccccaaagggtgctaaaccagttgttcccgagagtaagattgtagccaatggggttgtttctaatggtgtctaa

SEQ ID NO: 20264 - DNA, 114 bp, Glycine max
  Peptide Sequence Number=SeqID_137042
atgggatggataatggtgctggctttaaatgcggctgaagatccagtgggccccacttccattaatgcaagtgctgcattgtggtgtgagaaagtgtttatggccatagggtga

SEQ ID NO: 20265 - DNA, 843 bp, Glycine max
  Peptide Sequence Number=SeqID_137043
atgccgacgccggccagaattaacacaatcaggaacagattcaggataaattcccggataaaattcagcacccgccagctccagcggaacaggccagcaataattcgccacaatgtgcgcataaactctccatattcacgtagccagggcagccggtatgcggtctgccccgatgtcgggattagcccacgctttgttaatcacgggagaatcaagatggatgcactggaattactggtaaaccgtcgttcagcgtcgcgtctgaccgagccggcaccggccggtgaggtgctgcagaatattctgcacgcgggtatgcgcgcaccggatcacggcacgctgcagccgtggcgcttcatcatcattgaaaatgaggggcgcgaacgctttagtcatctgctggagcaggccgcacgcgacagccaactggatgacaaagccattgagaaggcccggatgtcaccgttccgcgcgccgatgatcattaccgttgtcgcgcactgcgaagcttccgccaaagtgccgcgctgggagcaggtcgtgtccgcgggctgcgcggtgatggcgatgcaaatggcggccgtcgcgcagggctttaacggcatctggcgcagcgggccatggaccgatcatccgcaggtacgcgccgcctttggctgccgcgagcaggatgcaattgtgggtttcctctacctcggtacgccgcagctgaaagccaataccaccgtgacagcagcgggtttctgcggcaaggtgcatgcaacgactctgattgcacagtcgctgtgcgaaagatcgcgcttagcggcgacagcgcttaccagcagcgggcagccaggctaa

SEQ ID NO: 20266 - DNA, 327 bp, Glycine max
  Peptide Sequence Number=SeqID_137044
atgtacatcaagtatggcccaaaatacatcatgaagcatagccaacaaaacaagttgtccaatgaaacaaaaaccccccatacttattcccaaaacaattccaaagctccaaaattccttaaggatatggtgatatcatggaaagggaaacaaggctcaaaagggctatcaaaggaattaattcaaggtaagtccatttggctagaagcttataagaacaaaattgcctcaatcatttccaaatatgcatgtgaattaggacgcatcaacaagaatcaagccaaggctattgtgcaagcaatcaatggggcaaaacacaccaaatga

SEQ ID NO: 20267 - DNA, 1320 bp, Glycine max
  Peptide Sequence Number=SeqID_137045
atgggcttcgacgccatgacgccgattcaggccgcttccctgccggccatccttagcggacgcgatgtgcgggcgcaggcgcaaaccggcagcggcaaaaccgccgccttcggtattggcgtgctgaaccgcatcgacagcgggcgttttcatacccaggcgctggtgctgtgcccgacgcgtgaactggccgaccaggtcagcaacgtgctgcgtcagctggcgcgcttcacccgcaacatcaagatcctgacgctgtgcggcggccagccaatgagtgcgcagcgcgactcgctggtgcatgcgccgcatattgtggtcggcacgccggggcgcatcctcgatcatctcaagcgtgacaatctcgatttaagtcagttgcagagcctggtgctggacgaagccgatcgcatgctggagatgggtttccgcgacgatatggaagccatcattggctttacgccggattcgcgtcagacgctgctgttctccgccacctggcccgataccattgccagcctgagtcagcgctttcagcgcgatgcgctggcagtagcgaccgaagcgaagtcggaactgccggcgattgagcagcagtttattgaaaccagcgccagcgagcgtatcaacctgctcagcgccctgctcagccagcagcaaccggcttcctgcgtggtgttctgtaacaccaaacgggaatgcgatgagattgcggccgcgctcaacgatcgccagatcagcgcgctggcgctgcacggcgatctggaacagcgcgatcgcgaacgcgtgctgattcgctttgccaacggcagcatccgcgtgctgatcgccaccgacgtcgccgcgcgcggcctcgacattaaatcgctggcgctggtggttaacttccagctggcgtgggatccggaagtgcacattcaccgcattggccgtaccggccgcgccggcgaacaggggctggcggtcagctttgtggcggccgacgaaatggtacgcgcccatgcgctggaagattacctgcagcagaagctcaactggcagccggccagcacgctgaaaggcaaaggcgcacagccgctgccggcggcgatgatgacgctgtgcattgacggtgggcgtaaagccaagatgcgtcccggcgatattctgggcgccctgaccggtgaagccggtttcagcggcgatcagatcggtaaaatcgatctcaccccgacccatgcgtatgtcgccatcgacgccgcgcaggcgaaaaaagcgctgatcaagctgaaagagggcaagatcaaaggcaaaagcgtgcgcgcgattctgctgaaataa

SEQ ID NO: 20268 - DNA, 288 bp, Glycine max
  Peptide Sequence Number=SeqID_137046
caaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgcgaaaccacagccaagggaacgggcttggcggaatcagcggggaaagaagaccctgttgagcttgactctagtccgactttgtga

SEQ ID NO: 20269 - DNA, 459 bp, Glycine max
  Peptide Sequence Number=SeqID_137047
atggctgaaatccgtgagaaaaacaaatgggataatgatgattacatttgcatgagacacattttgaatgggatgagcaacaaattgttcgatacgtatcagaattttggattagccaagaaactttgggaaaaacttgaaatgatatttctcttgaacaattgggcaatcactatcagtcatttagaagaagaatatcgtaaacaagatgatactaaggaactttatgttcaagaaaaaatgcatgtaacagaagaagggaatcaaacacttgaaaatgaatgtaggctcctgaagaaagaaaacaaaaagaaggaatctagagcaacaaaagataaccttgtagctgtcatttccgaaatcaacatgattgaagatgttggatcatcgtggattgacattggtgcaacctgccatgtgtgtaagaacaaatatctctacaagacaactaaggaataa

SEQ ID NO: 20270 - DNA, 165 bp, Glycine max
  Peptide Sequence Number=SeqID_137048
atggttcctttaggaaggggtcctaaggaagtaaggaagattcattgggtgagatggagaaagtggaggtggaacttgtttcaccaaggtgactctttatgggtcataatgcttgagtctaagtatgagaggtggaagggtctcttggaaggatatgccatatga

SEQ ID NO: 20271 - DNA, 447 bp, Glycine max
  Peptide Sequence Number=SeqID_137049
atgaaaaagtgtgttgccagagaccaagctaatgaagataatgccttgaatctatttggcattgccaacaaattggacaagatcatgcaagagcaagcaaataagaagaaaactacaagacatactcaacaagaatatgagcaagagatgatcaagaaagaaaaaagaaccaagaagaatcatgagcaagttggcgtgtctaaccctcttgagattcaaagcatgtgtccaaagattgtttttgcacagaagagttcaaggaagcaaactaagaatatgactacaaaccataagctaagggatatgagtgaaaccgatggtgatgcttcacctatcctaaggaagcgaaaagtaaaagtatggatgccaccctcaccctacaatgagtctactagtgttgatgcttcaaactctcatcatgagcgtccacctatggctcctatatag

SEQ ID NO: 20272 - DNA, 168 bp, Glycine max
  Peptide Sequence Number=SeqID_137050
atggtgagattagataaagcaaggttccttgtgaaggtgtgggggaatcaaagtaggtccaatgatgatcggttgctcgaaagtgtgataaggatggacttggcattgttgacatccgaggatataaaagcaaaggagaccagagatgaagaactcaatcatgaatga

SEQ ID NO: 20273 - DNA, 255 bp, Glycine max
  Peptide Sequence Number=SeqID_137051
atgtggtatcatgtaaaaaggatgaaatttgtgaaggctagcagctggtgtctcgctaagcgaggcttgtgcgcttacgagaatcatgtgctaagcgaggcactaagcccgcttagcaagttgggagaatcaggaggagaatctgagaagcatctatgtgctcagcacatcaacagctcgcttagcaagacgtttgtctcatcctacgctaagcacgtccagctcgctcaacggatgttcacttactcgcactaa

SEQ ID NO: 20274 - DNA, 219 bp, Glycine max
  Peptide Sequence Number=SeqID_137052
atgagtgagggagggagtgttccagctctacaggcttttgctgaaacttggattgatatggtgaatgaatttcagaagggtgttgtatcagccaagcttggaattccaatgttttatgggattgatgttgttcatggccacaacactatatacaaagcactttcagggaagaatcatgtgctgaactttaaaggagggacaaagttgaaacatggctag

SEQ ID NO: 20275 - DNA, 138 bp, Glycine max
  Peptide Sequence Number=SeqID_137053
atggatggtggggattcattggaggatggaatggatgagatgactagtgaagtacccataatgatagataatgttagtgacttcagtgacaaggagcaatggcacaatgtttatgaacatggagaaccaagaaattaa

SEQ ID NO: 20276 - DNA, 2421 bp, Glycine max
  Peptide Sequence Number=SeqID_137054
atgactatcatacaatgttatggtaaattgtatgggaaagatgacctactctacctgccttatactctgccaattttcttctgtagatgtcgtgaaaagcagcggaaggaagcctctcgtctgcagacagtgaatagaaagctgtcttcaatgaacaagttgttaatggaagagaacgaccgactgcagaagcaggtctcacagttggtttatgataatggattcatgaaacaacaaatacatactgcatctgctactactactactactactgacaatagctgtgagtctgtggtagtgagtggtcaacaccaaccgcaaaaccccaaaactcagcatccccagtgggatgccaacaacccagctggtcttcttgctattgctcaggagaccctagtggagttcctttccaaagctactggaactgctgtcaactgggtccagatgattgggatgaagcctggtccggattctattggaattgttgctgtttcccgcaactgtagtggcgtagcggcaagagcctgtggccttgtgagcctagagcccacaaaggttgccgagattctcaaagatcgtccatcatggtatcgtgactgtcgatgcctcaatgtattgagtgtagtctccgcagggaatgggggcacaatagagcttatgtacatgcagacatatgcaccaacaacattggcagctgcaagagacttctggactctgagatactctactagtttggaagatggaagtcttgtgatttgtgagaggtccttgacttcttcaactggtggccccacagggccagctgcttcaaacttcatacgagctgaaatgcttcccagtggctatctaattagatcctgtgagggtggtggatctatcattcacattgttgatcatgttgatttagatgtttggagtgttcctgaagtacttagacccctctatgaatcaccaaaattcttggctcagaaattgactactgctgcattgcgacatgcaagacaaattgcacaggaatcaagtggagatgttcattatggtgggggtcgtcaacctgctgtcttgaggacatttagtcaaaggctttgcaaagggttcaatgatgctgtcaacgggtttgtggatgatggttggtcactgatgggtaatgatggggtggaagatgtgaccatagccataaactcgtctcccaacaagtttttcggttcccattacaatacatcaatgcttccagcatttggaggtggggtcatgtgtgccaaggcatcaatgctgctacagaatgttcctcctgctttgcttgttcgttttctgagggagcatcgttcagagtgggctaattatgaagttgatgcatactcttctgcatgtctcaaagctagtccttatgcagttccttgtgcaagacctagtggtttcccaagcagccatgtcattataccacttgctcatactattgagcatgaggagttcttggaggtagttcgtattgagggtaatgcatttccccctgatgatgtagcttgggcatgtgatatgtatctaatgcagctgtgcagtggaattgatgaaaatgcaattggagcgtgtgcacagcttgtgtttgcacctattgatgaatcatttgcagatgatgctctcttactgccttctggtttccgtatcataccattggatcctaaaacagatggtttggcttcaactaggacattggacttagcatcaacactggaaacaggatctggtaatgcccgctcagctggtgaaagtgactcgaataactacaaccttaggtcggtcctcacaattgcattccaatttacctttgagaaccatttgcgggacaatgtggctgttatggctcgccagtatgtgcgtaatgttgtgcgatctgttcagagggttgccatggcaattgctccctctaggctcagtacacagttggggccaaagtcatttcctggtccaccagaggctcttaccttagcaagatggatctgcagaagctacaggctccacacctgcacagagcttttcagcgttgagtccacatctggtgatgcaatcttgaaacaactttggcaccatccagatgcaatattgtgctgttctgtaaaaacagatgcatctccggtgttcacctttgcaaaccaagctggacttgacatgcttgaaaccactcttgttgctcttcaagacataatgctggataaagttcttgatgaagctggcaggaaggttctctgcattgagttctccaagataatgcaacagggatttgcatatctgccagcaggaatatgtgtatcaagtatgaatcgaccagtgtcttatgagcaggccattgcatggaaagttctcgatgatgatgattccaatcactgccttgccttcgtattcatgaactggtcttttgtctga

SEQ ID NO: 20277 - DNA, 369 bp, Glycine max
  Peptide Sequence Number=SeqID_137055
atggaagaagaaccacaagaggaagaagaagaaccgcaaccacgaagaagaagaagaaccacaacgatgaaggagatcacgaggagaatgaagaagaccatgacgtgcgtgaaagagaacgaagaaagtcactacattgctctgaaagttggaccagtgcttatcgtagacgagggcttggttgaggcggcagtcgccgttgaggacctcgatgatggtgtagttgacgtggttctcgagtttgaggaggatgtcgaagttgcagaagctgacgtcggcgtcaatgtggaggagaggggaatggaggcgaaggaggaatgtggggttaggggcgatggtgatgccggggagaaggtggagagagggtaa

SEQ ID NO: 20278 - DNA, 1208 bp, Glycine max
  Peptide Sequence Number=SeqID_137056
atggagagaatgttccctcccaagaagccctctactatgaattcccatgacagacccatgtgtgttcaaggagactcgggtcttgtcctcaccactgaccctaaacctcgcctccgttggactgttgagctccatgaacgctttgttgatgctgttactcagcttggagggcctgatagtactcttctctccccttattccctctcacccttcttcttttcttcattttttttagtaccaaaggccactcctaaaaccatcatgagggttatgggggtgaagggtctcaccctttaccacctcaagagccaccttcagaaatttaggcttggcaagcagccccacaaggaattcaatgatcactcgattaaggatggtatgagagcttcggctttagaactgcagcgaaacactgcttcgtcttctgccatgattggccgcaacatgaatgataactcacacatggttgatgcgattaggatgcaaatagaggtgcagagaagattgcatgaacaacttgaggttcaaaaacaccttcagctaaggattgaggctcaagggaaatacatgcaaagcatattggagaaggcttatcaaacacttgctggtgaaaacatggcatctgctgccactaacttaaagggtgctattgtacctcatcaccaagggatccctgacatgggagtagtgatgaaggagtttggttcccctcttggtttttcttctttccaagaccttgaaaacatttatggaggtgaccaaattgaccttcagcagaacatggagaagccaccccttgatcatggtttcatgccaatcaatgagaccttgtgtctggggaagaagaggtccaacaacccttacagtgggagtgggaagagccctttgatttggagtgatgatctaaggcttcaagatttgggagggccagcctcatcatgccttggccctcaagatgaccctttcaaaggtgatcagattcagattgcaccaccaggatcattggatagaggagctagcactgacattgatcccatgtcagagatctatgactcaaagcctgtgcttcagagtgaagagaaaaagtttgatgcatcatctatgaagcttgaaaggccatcaccaagaagagcacctcttcaggctgaaaggatgagccctatgatcagcactggtaccatggcacaaggtagaggctcaccatttgg

SEQ ID NO: 20279 - DNA, 1476 bp, Glycine max
  Peptide Sequence Number=SeqID_137057
atggtgagtagagaaaagcctacggaggatgagttgcatagtgatgtcctcgatgaagtgggcctccctgtggctcaatactcttgtgttggagaagcgaattggatcgagtttggggaagtttctaaagcactacggtggttccagcgtaggagaagcaacaacgtacaggtgatggtcgtgattccttctcaggaagtccaagatgatgaaagggctgacgtcagcaatccaaacaaggagaatcgctttggagtatggatgattgcggggaaatcaaacttcaagaagcaatctcaaccaatgattaagcataagggtcagtttgaacttgttaaaattccatgggaaaggcaaggtgaatgggtagccatcagtgacttcaacaatacgttatcctctagcgaaagaactagaggctcttcgaatagtcacatagattctagtaccttttggaatttcttggacgaaggcaacttgatggatatgggcttccaaggtaaagctatgacttggaagaatggtcgaatcagggtgaggttggatcaatgtttaattaacctcgaatggagatttagattttcaaatgctattattgtccaccttggtccttggatggatgaagtccgatcattagccgttattgttgcgaatgaagggcagagtgcaagttcgtcgtcttgcaatattgatggtttcactcaaaagctcaagcgctggaatagagatacttttgggtgcatttggaagaaaaaagtttctctcaagatcaagattgattggctggatgaagaagaaatacattggtatcaaaagtcaagggtcaagtggttattcgtggaagatcgcaacacgaaatacttccatggagtgatgattattaggcgcaaaagaaataagtatcatatgctaaaggatgccaatgataactggatttctgatcatacacagcttgacgtaatgattacatgtttttataaagctttgtattttgatgatgacttgtatattccatttgtggtggctggtgcttttccgcaacgggagggccagacgggtatcaagctattttcttccaaaagaattggagggatgaggtctgtttcatcaaagactttagacctatcagtctctgcaatgtgctttgtgcttaattgtcaaagcggggataatatcatcatggctcaagagatctttcactccatgagaaagaaaggggagaagaaggggcaaaggctggatggctatgactatttagaaaaatcttgtgtttatttctctaataatattggccaagaccagcgaaagcatctgagtgaggagattactctagctaagcctgttctccaagctcttcctacctatgttatgcagtccactttgttgcctaagtctatttatgatgatgtggacaaggcttgtagaaatttcgtgcggggtcatgattcagatacacggaaaaatgcatctggttga

SEQ ID NO: 20280 - DNA, 363 bp, Glycine max
  Peptide Sequence Number=SeqID_137058
atgcggaagggcaggggtggaggagcctcggcgacggcgacggtggatgtgaacggatccattttaaaggagcctcggtactggggcatgaggaagagactgtgggggagattcacggtagagattagagacctgttgaagaaagccagggtttggttgggaaccttcgattctgctgaggatgctgctcgtgcctacgacattgccgctcaaactctccgagtagaagaagaagaagagaaggtggtaccgccttcaattctctttttctctctccatttctcatcctcatcatcttattattccttttccatctccattctccataacacccaacacaccacttgtgaaaaaccccattaa

SEQ ID NO: 20281 - DNA, 2634 bp, Glycine max
  Peptide Sequence Number=SeqID_137059
gtggaggagattggtgccaatggtgacagggagattaatggttcggtgtcggatgagaagggtgatggagtggtgtttggaagcacggatgctgccaataagttcctggaggatttggaattacagcaatcacgtgccagcgggagttcccgggatgatggccagattgttagcgattcggatgaagaagaggagactgatgatgaaggagatggcaaggagctgtttgatactgctacattggcggctcttttgaaagcggcgtctggtgcggaccaggatggcggcagtatcacaataacctctcaagatgggtccaggcttttctctgttgagcgccctgctggtttgggatcatcgctctcctcaggtaaacctgccatgaggcaaactcgtccgagtctttttactccttccattagtagagctagtgccatttctgatagcaatttgagcgaagaggagaaaaagaaactggagaaattgcatgaaattagggtcaaatacttgagactggttcataggctgggttttactaccgaagaatcaatagcagctcaggtactgtaccggatgacacatgttgcggggaggcaaagtggtcaaatgtttagcgtagagtctgcaaaggagactgcttcccagcttgaagctgaggcaagagataattttgatttttctgtaaatattctggttcttgggaaagcaggtgtgggcaagagtgctacgatcaattcaatttttggtgagacgaagaccagcattaatgcttgtggtcctgctactactgctgtgacagaaattgttggggtggttgatggagtgaagataaggatttttgacacaccaggcctcaagtcctctgcatttgaacaaaatttcaatacaaaagtcctgtccgcggtgaagaaattgactaaaaaatctccccctgatattgtgctgtacgtggatcgcctggacctgcaaactagagatatgaatgatctgccaatgttaagatcaattaccagtgtcctgggttcatcaatatggcgaaatgtcatagtcactctgacccatgctgcctctgctcctccagacgggccatcaggtgccccattgagttatgatgtatttgttgctcaaagatctcacatagttcaacaaaccattggacaagctgttggggacctacgtcttatgaatccgagcttaatgaatccagtttctcttgttgaaaatcatccttcttgtcggaaaaatagagatggccagaaggtgcttcctaatggtcaaagttggaggcctctcttgttgctcttatgctactcaatgaagattctttctgaagccagtaacgtttcaaaaactcaagaatcaccatttgaccagcgcaggctgtttggttttcgtcctcgctccccaccacttccatacttgttgtcttggttattgcagacacgtacctacccaaaactccctgctgatcagggtggggctgacaatggtgattctgatattgaaatggctgatttatctgattctgatctagatgaagatgaggatgagtatgaccagctcccaccatttaagcctatgaagaaatctcaggttgctaagcttactaaagagcagcagaaagcatattttgaggagtacgattatcgggtgaaacttctacagaaaaagcaatggagagaggagttgagaaggatgagagagatgaagaaaaaaggtaacactaaagaaaatgactatggttacacggaagaagatgatcaagagaatggaagtccagcagcagtgccagttccattgcctgatatggccctgccaccatcctttgacagtgacaatccagcctatagataccgtttcttagagccaacttctcagctcctgacaaggccagtcttagacagccatgggtgggatcatgattgtggttatgatggtgtaaacattgaacagagtctagccatcatcaataaattcccagcagctgttactgttcaggtaacaaaggataagaaagacttcagcatgcacttggattcctcagttgctgcaaaacttggagagaacggatcagccatggcaggctttgacattcaaaacattggaaagcagctagcttacattgttagaggagagaccaaattaaaaaatttcaaaagaaataaaacttctgctggtgtgtctgtgacattttttggtgaaaatgtgtctactgggctgaaagttgaggatcagattgctgtcgggaaacgcgtggtattagtaggtagcacaggggttgtgaagtctcaaactgattctgcttatggtgccaatgttgaagtgcggcttagagaggcagattttccaattggccaggaccagtcttcactgagcctttctcttgtgaagtggagaggagacctggctttgggggctaatcttcagtcccaattttctgttggacgaggttataaggtggctgttcgcgctggattgaacaacaagctcagtggacagatctctgtgagaacaagtagctcagaccagcttcagattgcccttattgctattcttccgattgccaaggctatctacaaaaacttctggcctggggctaattatgctgttattgctgatttctttgctttataa

SEQ ID NO: 20282 - DNA, 966 bp, Glycine max
  Peptide Sequence Number=SeqID_137060
atggctgataatagtgataatacttcactaccgccggaaaaaaccgaaagcacgtcgagcctcgccacgctccactccgacatcatccacgcgcacatcctcacacgcctcgacggcgccacgctggcatccgccgcatccgtatcgtccctcatgcaccgcctctgcacccaagacgatctctggcgcgaaatcagcaccgccacgtggccctcgctccaaaaccccatcgctcgccacgtcatctccgccatccccggcggctaccggtccattttctccgacgccttcccttccctccacaactcctccttccgccgccaccgcccgcctccgccgacgccggagctcatctccgccgtggacatgtactaccagggaaaacccgtgttctcgcgcgtgatacgcacggaaacgcagaagaactggttcttcgcctcgccgctgtggatagacgcgcttcaacacaaagaggaaggacgaggaatggctgaagcacttggaggagaatctgagcgtgagctggattattgtggaccccacacggaagcgtgcggcgaacgtatcgagccggagggcggtgttggcacagcggcactggctgacgcgggaggtagaggtggtatacgcggcggagatggcgggggagcgggggggcgcgacggagagggtgcagtgcctggtgaaggggagttgcacgtgagggaggtgaatttggtgatggaggacacggaggggaggcgagtgagtgggaaggagagtgtggagattctgcagagagccatggagaacggagagaggaagagagtggatcacgtgagggataaagataggtttatgaaattcacgtgcttgatgaaggagagaagagaaaggaagtttaggagggagaaggcacgcgatcttgtttctacgttcttggctttagttgctcttctcttgttctgtttcctcgctggattctga

SEQ ID NO: 20283 - DNA, 759 bp, Glycine max
  Peptide Sequence Number=SeqID_137061
atgggttctaaagcccgttggcgccagagttgggctccacagcctttgacacccttaatggaaggccctggccctgaaatgcaagaggaaggaaccaagaaagagagctcttgggaagtcataagggaatggttcaggactcagaagatctccccaggtggaagcttttcacaatcatcatcattctatggaaccattcatgccaagacacaagatttgaggttgttgcttggtgtcttgggttgccccttggctcctattccctcagcacatgatcccactcttagtattcacatcaaagacaccccatttgaaacttcaactgccaaatacattatccagcagtatttggcagccacagggtgcctaaaacaacaaaaggacacaaagaacatgtatgccactgggatggtgaagatgatttgctgtgagacagagatttcatctgggaaaaatgtcaagtgtttggggacaagaagcagtgataatggttgctttgtgctttggcagatgctacctggtatgtggtctcttgagttggtggttggtgaccacaaggtggttgcaggcagcaatggcaagaccgtgtggcggcacacaccatggctaggcacacatgcagccaaaggcccccagagaccccttcgtcgcattattcagactttatttgatggaattgaggcttgggggggacatggccctagggttcaaagcatgttgtaccaaacaaatataaagattgaagaaacaacaaattga

SEQ ID NO: 20284 - DNA, 972 bp, Glycine max
  Peptide Sequence Number=SeqID_137062
atggattcttcttcttcttccgacccttctcttccccaaacctctgttctcctctctgaccaatcgccctctctccctcccgcttccgactctgagaaccaccatggcttcgtaagcgctgaagatggcgctttggaggcccaaccctcccgcccccttctcgtcaactcttctgagcccgtcctcgattctcctcccgacgatgcccacaggcccgttgcgaaggtgtccggggacgatgatgaagacggttccgttgttgagggcgcggacgacgtcgttgaggttgcgaacgatgtcgttttggaggaaggcggcgagaaagaggaatcggggcaggcaatgaaggagggggattttagcgatagtaacgaggtctttgtggaggcttctggcggtgatgatgatattaaagagattcagagtggtgttgttgccgtggagaatggagtcgaactgagtggtactgataaagggtttgaggctgctgctgttgaattgaatgaggaagaggcgaaagagaaggaggtggaggagaaagttaacgacggtgggaccgacaattcggattctgtggtggatgagaagagtgagggtgttgatgttgaaaaggacgatggtggtggtgtagatgctgttgttgatagcgtcgaggttaatgtgttggggtctggggttgctgttgttggggatgagctgggggttgatgagtctgagattaaagggctagaagagccggagagtcgtggggtgagtctggataatggttttgagcccattgagaagggtgaggaggaggttgttgataagcttgttgatgggggtgatggtcaatcgggtgctgaaggtgttgtcgttggtggggatgatgtgtctggtgagaatggagatgatggagatgggttgaagagtgacattgttgttcctcccgaggaaggtggtggaggttcggagtttgttgagaaagatgag

SEQ ID NO: 20285 - DNA, 1061 bp, Glycine max
  Peptide Sequence Number=SeqID_137063
gacctgatagtggaaattctaacatgggttccagtgaaatctctgatgcgtttcaggtgcgtttccaagtcttggaattccctcatcttccatcccgcattcgtcaaattgcaccttcaacatcaaagggcttccaaaaacacccacctcctattaagaacccatcatccactgttgatgatgcttgccaccaattacaccccggatactttttcataggttcctgcaatggcttggtttccttgctttatcattctcgttctcttgttagacatggatccatagaataccgggtccggttttggaacccggccacaaggatcatgtccctaaatttgtctcacttaactttccattcatcccaggatcatgatcctggctttgggtttggttacgatgatttgagtgacacttacaaggtggtgcttctccttttggacattaaaacaaacaattgggaggtgagagttcactgcttgggtgacactgacacttgttggagaaatactgtaactgtaacttgccctgatttcccactttggggaggacgcgatggaaagcttgtgagtggcactcttaactggttagcagttcgctgggaaaccgatactgtgaatcagttggtaattttttcgtatgatctaaacatggagacatataagtatttgttgttgcctggtggtctttctgaacatgctgacaaccctagtcttggggttttgaagggttgcctgtgtctttatcatggtcaggagcaagtcagaacccgttttgttgtttggctaatgagggaatttggagttgaaaactcttggactccgtggctgaatatgagttttgagcttgttcaactctttccaccttggcaattattggcagcgcctttgtgtatgtttgaaaatgatgatgtcatgttgctggcaaactacccgcgttcccaatacattttctataatcggagagataatagaatagtccgtactgaagatttcaacgacaaagtgccgctgttctcccatgatgattatgttcaaagcttggttctaccctatcgaaattaa

SEQ ID NO: 20286 - DNA, 144 bp, Glycine max
  Peptide Sequence Number=SeqID_137064
atgaagctgactggttatgttcctgatcttgaatttgtgttgcatgatgcgggagaggagctgaaagaacaacttcttttatggcataatgaaaagttggcaattgcatttggacttccaaaggaaatgttacaaggtttttag

SEQ ID NO: 20287 - DNA, 162 bp, Glycine max
  Peptide Sequence Number=SeqID_137065
atgcccaaaacagcagaccaagcaactgcaaattcgcccgcaaagaagtcaagaagaaacaaaccacttcaaagtcatgctccttcctacaatttcactgttgaggattcaatggtcaagattgaagcatcaaagaagaatggatggcgctgctccaactga

SEQ ID NO: 20288 - DNA, 318 bp, Glycine max
  Peptide Sequence Number=SeqID_137066
atgcttcccaaaaatgcggtggaaaaatgggaaaggactgttcaacgacgtgcttttgtagcatcgtcgttgatgaagaagctaatattacaaaaatcccaccgtgcaaacaactacgacggtgtcagccatggtattgaatacaaaaagatgcagagaagaagacagagtcacaaaaaaaatgcagcaaaatacctgggtatgatggtgaggtgtcacggtgatgacctgtcatggtggcgggctgtcacggtgactgcaaagggagataaagtcacaaagatgaagcttaggcgaagaagaagaaagcacaagtaa

SEQ ID NO: 20289 - DNA, 474 bp, Glycine max
  Peptide Sequence Number=SeqID_137067
atggaacgctggaagacgttgttcgtgcaggtgttggtaacagtggtgaattggtggatggaatgggtaatagcggatgtcgagagcttgaagaagctcctacaactgacgaaggtcgaaatgtccttcaactgcgttatcttgaagatccagcctgtggcgtcaaaaccgtcaaatcttggaacatcgagcttcatccgatgcggtgctgtgtgcaatcctgatgccgagaatgatgtagtctccggttgtgtttgttgtggattgtaccgatttgcttcgaggtgcgacattcattctgcaaggttctccatctttgcctcgaacgacgctgcaaattttgtgaacaattcctccattttttccgatgacagagctttcgaccgcatgccttccgccatacttgctacgaaatgcgtcaatgaaagcaccaatgatgccaagctttcgagggctagggaacctccttgctga

SEQ ID NO: 20290 - DNA, 618 bp, Glycine max
  Peptide Sequence Number=SeqID_137068
atgacaaccaccttcgcgaccgtcgcaggactcggtggcgcattactgtcatccacctcatctcgtctcacctcagggtttgtgaaatccccagtgattgctaggaatcccttgaggcaagctgtggcaatgggaaatgggaggattacatgctttgagaggaattggctgcgggcagattacagtgtgattgggtttgggttgattggttggctagcaccctcaagcataccggctatcaacggtaaaagtctgactggcctcttctttgagagcattggtgctgagcttgctcactttcccagccctcctgcccttacttcgtccttttggtttgtcacttcaccctttgtattacttttctttcattccgtattattattattattattattcaatggttctttacttcacaacaacaactataatcatattaatattaagagaaagagaaagaagaagatgatgatgaggaatgaagagaaaaatgaaattgaaatgagtcacttggatgtgttggaccttgcacaaagagaaaacctaactagtatgtgtttggattgttgtttagaatttgttaagccaataatcacactttcaaatgttaaaaacaagtaa

SEQ ID NO: 20291 - DNA, 270 bp, Glycine max
  Peptide Sequence Number=SeqID_137069
atggttttaaattttgaccgagaccaacaaactacacgactaatagtgtccaccatttcgaatacagtggttgttaatctcagagccaccgacgctgcttctatcctaaagcaatccaaattcaagggcaagtttgtgggtgagagagatggtcttatatctgagttgatgacgaagatggttcttccaccggcactggattatttggttgttcatcttagagccattagcgatgctcctattatgaagcaatgcaaattgaagaactga

SEQ ID NO: 20292 - DNA, 1989 bp, Glycine max
  Peptide Sequence Number=SeqID_137070
atgccctcttgtcattacaccaccaacaacaacctcaacagcaagactaggaaacgaggttgttcctcctcttcctcttcctctttggtaagaagataccgtttcaagagagctattttggttaggaagaaaggagggtcgagtactccagttcccatgtggaagaccaaaacaagttcttctccttctgttcctactcaacaacaacaacaacacatgaagcctttgttgcattcttctggctccatgttaccctccaaggacaaagaactttctgtttctgccagaaaactcgctgctacattgtgggaaatcaatgatttgcctccttcgagggtgaagaaggagttcgaggttgatcaactgagaggcttcaaggagaaggttagaggcagagagaagaagagtgtgcggttgtccagatcgggcctgttaaggccacagatgtcagatccgtcgcatagtcctgcctcagagagaatgaaggggcttgaaggggataatagctgcaagagaagagtatcagggttttctcatcagcttctgtctggtgattactatttggatgctcttgatgctcatagcagtgccaattttattgaggaggtagaaaatcagccaagaagtgagaagaatcgcggaaaaggcacgggtggtgttaagaatcgtctgaaggaggctagaagtggcctatctacatcaaagaagcttctaaaggtgctaaatcaaatgtgccttagagagcagcaaacatcaagcatgcctcttgtcttggctctggggagtgagcttgatcgagtgtgccaccaaattgatcagctgatccacgaacagcgctcgaaccagaacgatgttgagtttgtcatgaagcattttgcagaagagaaggctgcttggaaaagaagagaacgagaaaggattcatgatgccataaaacacgtggctgaagagcttgcggtggagaagaagttgaggaggcaaactgaaaggctgaacaagaagattgccaaagaaatggctagtgtaaaagcttcccatttgaaagcatccaaagagcttgaaagggagaagcgtgctaaagagattcttgagcaaatttgtgatgaacttgccaaaggcattggggaggacagagcacaggtggaggaacttaaaagggaatcggctaaagttcgtgaggaggtggagaaggaaagggagatgcttcagttagctgatgttttgcgcgaggagagagttcagatgaagctttcagaggctaagtatcagtttgaggagaaaaatgctttcctagaaaagctgagaactgagcttgaggactttatgaggactaaagatggacaaaatgaggatgtttctcccgaaagtaaaaaaatcaaggatcttgagtcttatttcaaaaatgtctgtaggggattccagaatgaagagaaggaggatgattcggatgttgaaaacgatgtagggcatgagggagatgatgattcagatgacagtgatctccattccattgaattaaacatggatgatgacagcaaaggctacaagtggagttttgcttgtgaaaatgttgctcaagataagaggttttcaattggcaaagaaagtatagggaggaagtctttctctgagaaaattcagtggggaagtatttgcttcaacaaggggacatcaagtggtaggaagagggacttttctataaatattcaggaagtttctgatcattttgatcctgataggtcaattgaatttctctcacaagctctgatacaagatgataaagatgaaactcagagcaataggtctaatcaggggctccacgacactatgtcatgtgccaattcggataagagaaatagtctactattaactttgcagtgtgctggtggagaagctggggaaaatgctcttgccttggaggttgacaatttgaagcatgaagttgcaggaaaaaatctggatgttaagaattttgatagtgttagttag

SEQ ID NO: 20293 - DNA, 195 bp, Glycine max
  Peptide Sequence Number=SeqID_137071
atggggttttttgatgtggagcccaggaaacggttcaacgtggcttttagcaaatctaatggtcgtaaaggaaacagacagaatttgttgtatgggaggcccccaccaagggtgtggtttcgtttggacatttggccgttatgtctggaagtatgcgggaacttgcacggcactcgcattaataccaagttataa

SEQ ID NO: 20294 - DNA, 975 bp, Glycine max
  Peptide Sequence Number=SeqID_137072
atggccgattcgacccgttcaaagaccaacattatcagaattgaggatgccatttcacggcttacctctaatcaattctccctcactgctacccagaactccatgtccttgaaattggatgaacttttgcagaaaatggccacccttgaaactcaaccccactccccgtcccattcaacatcgccaccccagccttcccccactctccatggccctcgcctgaagcacgagattccgcgatttgatggttctgaccttcttgggtggatctttaaaatcacgcagttcttcgagtatcatgcaactcccgaatctgagcgtcttactctggcttctttctccatggaaggacaagcgctaccctggtttcaatggatggctagctctgcaacccctgaccttggctcaagcggccgacctagccaaattgcaggaagagaagtttcgggacctgcatcgttccctgcatggtcactcctcgtcgcccttctctctgccagcacttgcaccctctttaaacccacccccttgccctccgttgcttccatcaccaccgaaaccacccctccattgcccattcgaaggctaaccccaaatgagattgcttcacgccgagaatggggactttgctttaattgcgatgagaaatttcatcgcggtcaccggtgtgcatctaagatttttcttctgattgcagatgaggaagacgattttgccttgggtacccctcttctggaccccatcacggacccaatggttacacccgacccagcccaaacacatattactcttcacaccttatcaggccatctcgctctagaaactttgcataacggagcccactacccccttacgcgtcatggtgggcaacgatcaccagctttaatgccatctctggtgcaaagccgtccagtccaatggcttcaatcgttaggtgttctgctcttcggcaagtgtaccgattcgctcaagtag

SEQ ID NO: 20295 - DNA, 813 bp, Glycine max
  Peptide Sequence Number=SeqID_137073
atggcggccattaaaaattggtgtcagtatttgttgggtcaccccttcgcaatcttaacagaccacaagagcctcaaggagttgatgactcaagtggttcagacacctgagcaacacatgtaccttgccagattaatggggtatgattatatgattcactatcattctggtgcttcgaatatggtggctgatgcattgtcacgaatatcggaagcctcgtccggcatgcttctatccctttcggggattcacttgggtgccctccctcagagtcatacttctctaatgttggcctctctgttcatggacatcatcagaaaactccatggaatgcccaatagccttgtgatcaaccatgtgatcgagcaataccttctcactttcatgcacaagagaccttcctcttgggcaaaatttcttcagtacgcggaatggtcatacaacacttccaaacactcaagctcgggcttaacaccttacgaggtatcatttggtaagaaaccccccactatcatgcactatgttgctgggaactccaatgctgaagcatttgatgattttctgacaagtcaagaagaagtgtatatggaactacgaaagaaacttctaaaagctcaagaacaaacgaagaagtatgcagatgaaaatcctaatgcttttgctttgttacccctgccagccaagatcactgaaaatcaaccaaccattactcctctagtgatcttaagcacacagcaattgaaggctgactactaccttgaggaaaaggttcttttagatggcgtagggagtgataggaagaaggaagtgtag

SEQ ID NO: 20296 - DNA, 345 bp, Glycine max
  Peptide Sequence Number=SeqID_137074
atggccataacaagttcaacagagactatagcatcagttaataggcgcggtggtggtgatcatacaagcagcatgggaatgcatggtggtgagaatggtgaacacggcaatttgcctcgcccactagatcatggtggcttaatccctttatatggtgctgctgcaggatctgctctccagagaaacaacaatcaccaccatgatagaactgtgcaagagtaccaagtagcccgttgctgcaatagcctagaagaagaaagcgcagaaggaagaaacatgtctcctaaggcccaaaaggaaaatagctccaccaaaatacctcaaggacgatgcatagctaagtag

SEQ ID NO: 20297 - DNA, 394 bp, Glycine max
  Peptide Sequence Number=SeqID_137075
ccaagtcaacaatgttgcaccggttggtcacaatgaacttgatgattacaagcgtcttccctgcgacggccattaccagacatcagcgctaaaccaagcttatagataccgtgtacaccaacttcaacactacaccaagcttaacctaagtaacaaagatcaacgtagcttttcttcttctttttctattgtccaacgcctaagagctagctctgttgggtctcgtctaaagcgcctcggtccagctcctggagattccgattgcgctcgccgtttgtggcggagtcggtcgcgtgaatctctagcgggcctccccacggatctccagctagggttcgatttgcaacgaagagaggctagggttcaagctgtacgacctccaggtttcaaatga

SEQ ID NO: 20298 - DNA, 240 bp, Glycine max
  Peptide Sequence Number=SeqID_137076
atggctcaacctctagacaattttgaagaacatataaggtctcttttcttggaattaatgttaaaatctatacaatttcagcgcgtatccagcgtggttagcgtgaagaaggaatctggaagagcacctgaatcaaagcagcacgctaagtgcgagatcaaatggctaagcgagtcatctgtctcttgccaggctcagtgtagcattggcgctaagcccaaatccacttactcacgctaa

SEQ ID NO: 20299 - DNA, 447 bp, Glycine max
  Peptide Sequence Number=SeqID_137077
atgaaggggtgcatcacttcttcaacaatacccgttttggtcaatggaagcccgactttcaagttcactccacaacatgggctaaggcaaggagatccacttgctcctttccttttcaatgtggttgtggaggcacttagcaaattgatgggacatgcaagaaataagaatgcctataaaggctgggtgggaagaaataaggtagcggtggatctgttgcaatatgcagatgacatgctattcattggggttgcatgtttatccaatatggtagctatcaaagcaatgatgagatgctttgaaatggcatccgacctaaaggttaatttcaataaaagtttctttgtggggattggggtggagtttgaagtgcttgaaagatgggcgaatgttcttaactatagatggatgacaattccttttacttacttggggccacctatcatg

SEQ ID NO: 20300 - DNA, 504 bp, Glycine max
  Peptide Sequence Number=SeqID_137078
atgcaggaagcctcagggcttttgtgtggcagcatctctggtgaagtggatcaccaattgtttaggcttgctcaggcttttgtcagtccattgtatgcacacatgttgctcccccttgcttgcatcaccaatctcaaaccggccttgatccattatcccttgcagcaaatcctctgccatagggcatgcctctacatcatgtgccttcaatataaaccacctagaggttaccacatctttcatttgcttcggcctctaagttccgcactcctccaccacattaaccgttggccccccatgactgggaaaggagactggaaaatcttcccgggggtcaccaccgccatttggttggcgatcaaagatggtggcaagtctgtgtatgacattgggatgggagcgaattccgaaagtttctttaccggaaaattcattcccggattggtgtttatgcttggattggagttgccgatggggcgaggttgtgtaggagccaagttttga

SEQ ID NO: 20301 - DNA, 597 bp, Glycine max
  Peptide Sequence Number=SeqID_137079
atggcatatactcaaggtgtttatgatgaagcatggagagtaaatgtccgtatacaaggatgtgaccttgagcatgggtatttgtgtggcaccatggaagctcttaatgttcctatggcagacacaccagtagtaacgttctgggaaggggagatagttgatacaaagaactatactttcttcaccggtaaatgggaggcatctccagaggatgatataaggcactggtctaaatttccatctttttctcccttattgggccaagtggaggctgatggtggcaagtctttggacctgagcaactatccttacatattcatgaggtggaaggagcaatacttcgtgaatgttggaacagactgtggattaaccatagccggattttactacatttgtttctcttgcagcaatggctctatcagtggattctattatgatcccaatagcagcccttaccagaagcttgagttgaaatccaccaatgatggaagatcaggcacgttgtttgtgctagaaagttcgctgccagggatgcttcaatttctaagcacacaggcatattcacgttttctggaggagtgcaaaaaacaaacatga

SEQ ID NO: 20302 - DNA, 396 bp, Glycine max
  Peptide Sequence Number=SeqID_137080
atggtggaagctattcaggctattagggagatggttgcagttatgttgcaacaaactaatcaaaggaatgaagaagtagccgaatttcaaggtttatctgaattcagaaggaacaatccttcagaatttgcaggaggatatggtccggagaaagctgatttgtggattcaagaaatggagaaaatattttgtgcaatgacatgcacaaataggcaaaaggttacttttgcgacctatatgttggtcgatgaggccaagtattggtgggatagtacaaggagacttttagaagtagtaggagtggaaggaaatatgactgtaggagaatatgcaacaaagttggatgaattggcaattactctgcttactttctgcttcatcccgatgaaaggatga

SEQ ID NO: 20303 - DNA, 246 bp, Glycine max
  Peptide Sequence Number=SeqID_137081
atgagggttcgggagttgcttacgcaaggggaaggttttgatgatgccagagagaatttacctgataatgattgtcatcatcaaaaagcttttcaaaatggttttgatgatgctgaaaagaattcacttgataatgattgtcatcatcaaaaagggggagaatgtgaatgcgccctaagcacaattccaacctgggaaggaattgcgttgagcgagaaattgcccattgagcaagacctagtgtag

SEQ ID NO: 20304 - DNA, 741 bp, Glycine max
  Peptide Sequence Number=SeqID_137082
atggttcatggcaccccacaacaacttgaatttcttggccatattgtttcccaagaaggtgttgctcctgaacaatccaaagtgcaagccatgctcgattggcatcgccctggcttcggacgtcctattcatggcttcctgggtttgacaggcttctataggcgttttttcaaaggttatgctttgattgaacctcctcttacaaacttactcaagaagggcttctccatcccattctttgttgaaactaatgcatccgacattaccattggagttgttttgatgcaacagaactatcacattgtctacttcagtaaacacttatatcctcgattaatgtgtgcttcaacctacatccatgaacttcattatatcacaaccgtcgtcaagaaatggcgacaatacctgcttggccacctctttgtcattgtcacaaatcataaaagccttaaggaactcatgacccaaagcattcaaaccacggaacaacaggtgtatctctccaagcttttgggatacgattacatgattcagtattgtgttggccaccacaacatagttgctgatgcgctttcccggccctctgagaactctgttgcccaattccttgtcctctctatgccttacttcctctttatgcatgtagcactgtcatccttatcattgtggatatatagatttttgaaaggggctcatttcagagcacttccaccacacttcattgcttttcagcttgcttaa

SEQ ID NO: 20305 - DNA, 305 bp, Glycine max
  Peptide Sequence Number=SeqID_137083
atggcatcggagagttcgtttgtgcagcccgctataccgaagtttgatgggcattatgatcattgggcactgctcatggagaatttcttacgttcaaaggagtactggggtctggtggaaaatggaattcctgaatcagtggaaggaacacctcttaccgaagtagagaggaagcatattgatgataagaaattaaaagatttgaaggcaaagaactacctatttcaagcattagatcgttcagtcctggcgacacttcttaacaaagatacatcaaagaatatatgggattctttgaaacagaa

SEQ ID NO: 20306 - DNA, 147 bp, Glycine max
  Peptide Sequence Number=SeqID_137084
atggggatgtggattaaaattgttaccatgcagatgtgggattgggttttgtacaaatcagaacgcatgatggtgttgttagaacctgaattgaagttcgtcatgttccagagcttaagaaaattcttgtatctatgggtgccatag

SEQ ID NO: 20307 - DNA, 657 bp, Glycine max
  Peptide Sequence Number=SeqID_137085
atgaaacaggttgagggcatactagaaagccatattaagtcattcctggagcaactcataggtttcataggagagacaactgacacgatagaatatgcgtacttgctaaccctttttggagatggaagggggtcaaagtcaatcatgatcaagtaccttagagtcgatgctttaaccttttataatatattaataggatgtcatttgctcaacgagttaaggagcatcattttgacttcccatttggtgatgaagtttttaagtaaggatgacaaaactaacgctgttagagtctaccagataaagacattggaatgtaacgttgcaggccttaatatttctataggaaagaaggtggtagaactgcaagtaaagctagtagcatgcacctctatcaacaacaacttaggtaatacaacgctcgacttaagaaaggtagagttgaaggtaaagcccactaaagaagcgaatcctttccaagtcggtaaaaaaccatctttgtacaccaaattaggatgccaaatgagtacgaaggtagaaatccatagcccaagtattgacaaaaaacgccaacctctttgcatagttagcataagacatgctaggaatcgatctcgagttccatggtcacaggctagccatctgtccaaaggctag

SEQ ID NO: 20308 - DNA, 237 bp, Glycine max
  Peptide Sequence Number=SeqID_137086
atgattcacattcatccatttccatttttgaaggaggtgttgagcctaagagtttgtttcacttacacctgggaaatcgtcatgaatcccgaagatggtgttacattcataagtggtaacaccaagtcttttacaattcctaataacattagtctacacgagcttaaggagagatctatgcctctttggaagacaaccaagcataaccacatgctgaggcaattgcaaaagtggtag

SEQ ID NO: 20309 - DNA, 1362 bp, Glycine max
  Peptide Sequence Number=SeqID_137087
atggtggaactaggcaaactcatactaacccaccacccttcactttccatcaccattcttttcctaactccaccccccaaccaagacacccccacctcccccaccgccttcacctgcgatgctaccgccaaatacatcgccgccatcaccgccgccacaccctccatcaccttccaccgcatccctcagatctctatccccatagcgctccctcccatggcccttaccttcgagctctgtcgcgccaccacccaccacctccgccgcatcctcaactccatctcccaaacctcaaacctcaaagcaatagtcttggacttcatgaactacagcgccgcacgtgtcactaacacgcgtcagatccccacttacttctattacactttgggcgcctccaccctcgctgttctcctttatcaaactatctttcatgaaaactacacaaagtccctcaaggacctcaaaatgcacgtcgaaatcccagggttaccaaaaattcacaccgatgacatgccagacggagcgaacgatcgtgaaaatgaagattatagggtttctgttgacatagccacgtgcatgaggggaagttacggggttatagtaaatacgtgtgaagccatgggagagagggttgtagaagctttttccaaagggttgatggaaggaaccacgccgaaagtgttttgcattggacccgtcattgcttctgctccttgtagaaaggatgataacgagtgtttgagttggctcgattcacaaccgagtcaaagtgttctgtttctgagtttcagaagcatggggagattctcgaggaagcagttgagagagattgctattgggttggagcagagtgagcaaaggttcttgtgggtagtgaggagcgagtacgaagatggtgactcggtggagccgctgagtttggacgagttgttgccgaaagggtttttggagaggactaaggagaagggaatggtggtgagggactgggccccacaggcggcgatactgagtcatgactcagtgggcgggttcgtgactcactgcgggtggaacttggtgttggaagcggtatgtgaaggggtgccaatggtggcgtggcctctctacgcggagcagagattgaatagggtggttttggtggaggaaatgaaggtgggtttggcggtgaagcagaacaaagatgggttagtgagttccaccgagttgggtgaccgagtcaaggagctcatggactcggataggggaaaagagattaaacagaagattttcaaaatgaaaataagtgccaccgaagcaatgactgaaggtggatcttccgtagttgcattgaataggttggtagaaatatggaaggagcattaa

SEQ ID NO: 20310 - DNA, 735 bp, Glycine max
  Peptide Sequence Number=SeqID_137088
atgcacttgacaaagacagtcagaaaagatgggagttcatacaaagttttgttgaaaacctttgctgggatatgctatcatagcaagatgaaattgtcgtatggaagaaaactagtaaaaggaattgctatagttaaaggtagcacctctgtgacatgtattgatgaaataaagaatagttatccccctcctttatgtggcaaaggctatgatgtgaagtctccgtattatcgagaatggcaaaactacatagaaggaacacatagcagccgctggatttctatcaaagagagagaaacttggccttccagagatcacttgaacaaaaagaagcttgcaatctttgggttgcaatctaataaatttgctaaggactctaaaagctggaaagcagcagttcaaatttattggtctcttctgtcacctttaatattttctgatcatccaaagaaacctggtgataagaaccctccaccaccttataacaagctaagaaatgtgctagacatgaatgctcatgttggtggttttaattatgcaatgttgcaagctgaaaaatccatatgggtaatgaatgtggtctctctgattggactcaactatctttccttgatccaggatcgagcaagggaatctttgcattatgatgacacaaaaattgagacttccattgaacaaaaacccaagcccaagactgttgctaaacccattgtcgctgagcttgctcaaaggtga

SEQ ID NO: 20311 - DNA, 225 bp, Glycine max
  Peptide Sequence Number=SeqID_137089
atgaggaggcttaggaaccaatgggcacttgagacccttacatctagggttgtcctagacttccttaacactccaaagaaaaagaagagagtgcttgctaggactgcttgttttctgagttttgagcttcaagtccttcatcctccaccattttcatgcttcaagccaaggtatggaggagttatgtttcttgctcttgcttgttcatggagtattctccattag

SEQ ID NO: 20312 - DNA, 261 bp, Glycine max
  Peptide Sequence Number=SeqID_137090
atggggtttggattggggcttagggtttccagtagcgagagacacgaatttgctatcgttgaaaacatttattttagtagtgtctataggggaaaaacaagtggtatcggtcaccaaattgatgtttcaacacttgatgtgaacaagatgcctgctttctacccacagatgccttccataaatgctaaaaatgaggacgatgatgtacatgcaaatcttaatgatcatggtgaaggtttatgggagaatacgcctacgtaa

SEQ ID NO: 20313 - DNA, 771 bp, Glycine max
  Peptide Sequence Number=SeqID_137091
atggaggagagaagtagaagaggaaaacaaatgcaatttggagataatgagaaagagtctaaggaggcgataaagattgagttatccaaaatgatatcgcaacactcacccccagttaaggtgccagatgtacatgtattagctgcacgggtgaacaccaagggaagttgtgttgaagctgctgcaaatccattagataatgtggttagggtgagtgttgtaatagtttatgatggtgacgctcagatcccttttccaacgtctaagattaggtttgtgagggaggttgttaacacattcattggatggctgacccatcttgtaaaagctgtatctgatgaggactcacacaatcgtgtgccgaaaccagctggagttgatctgttgggagaattgatgaagaacttgtttgatgtttaccaaaagcttgttgagttgccatgggatgggatgaaattttggattcctaatgtacaagcatccttttttgtcacacatgcagatagtacaagcaacggtcatggttcagtctatggtttccttgagcctcagtctatacacaatgcaaaggatagatgtcaagaatgtcggcattacattgaagcatgggtcaaggaatcacaacgagaagtgtacttaggagcttacttgaattatgcaatgaagacattaaccactactttcgaagtggttttgtggtggatcaactttagacatagaggtcatgacaacacttcgcaagaaatgggcaacatattttttacaagttaa

SEQ ID NO: 20314 - DNA, 198 bp, Glycine max
  Peptide Sequence Number=SeqID_137092
gcccttaacctagtggtgaaggttttcatggtggttagtctcgaagaggcctatagaatagatgggtgggtcaggaagatgactatgttaaggggtgcatttgggttaatcgctcatgtggtgaaaatctccatagagtcgagtctatctttgatgtcgatgatggatgaactgatgatgatggtgtttaatggttga

SEQ ID NO: 20315 - DNA, 288 bp, Glycine max
  Peptide Sequence Number=SeqID_137093
atggtaatgagtattggcagcgatggcacggaggtagcaatcttgaacgaagccgaaagcggaggcccaatcggcacccttgttgtgggagagggaagctttggcggtaacgtcaaagagatcgacatcttccttagtaggatgtcttcaaggaagggagagggcatgcgagagagagtaaaggcagagcctagagtggcgctaaggtggtggcttgggaaccttagagagagagagtcgaatgggaagtcgaagagtgagagcacaagagcgtggagggagaaatga

SEQ ID NO: 20316 - DNA, 597 bp, Glycine max
  Peptide Sequence Number=SeqID_137094
atgacctccattgcgcctcttgtcctccctatctccaacccccaaaccaccgcgggaacctccagtgcaggcggcggtgccatcgaggttccaacgaacaacctggccttcggcgatcatcaccctccgcggctcgcgtcggtgttcaggaacgacgtggaggggttatatgagaagcttctcgctggtgagagcagcatcacccccatcgaccgcttcgacgcctccaagttccgcacgtgctttggcagccaaatccgcggcttctccgccgagggctacatggacgacaagaacgatcgccgcttcaacgactgcctccactactgcattgtcgccggcaaaaaggccctcgaaaatgccgacctcgccccaaacaagcactccaagcgtcctccatatgaagaacccctggattggccaactcggaaaagagtagctttgggatctgcaatgggtctttcatatttgcatgatcattgtgacccaaagattattcatcgtgatgtgaaggctgccaacatattgctggatgaagagtttgaggctgttgttggggactttggattggccaaacttatggattacaaggacacg

SEQ ID NO: 20317 - DNA, 135 bp, Glycine max
  Peptide Sequence Number=SeqID_137095
atgaacacgaaagacacaaagcaacaaagggtgttgggaaatgtttcacccattcccatagtgggtgccaaagtgttccagaaaaggcttccttatatcggagatgacctaatccaaaacactcgtgaggtgtaa

SEQ ID NO: 20318 - DNA, 189 bp, Glycine max
  Peptide Sequence Number=SeqID_137096
atgcttcgcaatcgaatgctggttgatcccgcatttcttttcaaaattggctcagaggtctatcctaaaggaactcacttcataatttcgtggtttgaaaggccagttatctatgatattcgtgcacgaccccatctagttaagagtacatctgggagtcgtgatctacagatggactttttgcattag

SEQ ID NO: 20319 - DNA, 279 bp, Glycine max
  Peptide Sequence Number=SeqID_137097
atggacaaggcagaggcaattgaggctctaatatcaaatcaagttatcattgtcaacctggacgaagtgttcttaggaatgaagctcactgtgagggtgatgatcccttctcggtatggcagcatagttgcaatggctagcatttgtggacgcataggtagcgtggctttgcaaacctacatgagctcgaaacacaacatcgtggagcttgtgcgaaacgctgtcgtggaccttggacccttaaggattcgagtgaatattgtttctccttatgagtaa

SEQ ID NO: 20320 - DNA, 525 bp, Glycine max
  Peptide Sequence Number=SeqID_137098
atggggaaaatgtatgaacatatacaaacaatacctacaaatccaaatagcaatagggtttctgattccgagaaaaattccattgatgagctgaagaagctcctgaaagaggaattagaggatgaggaggtttccatctggggcgtccctctcttgaaggatgataggactgatgtcattctcctcaagtttgttagagcgtgggagctcaaaacactctccgatggaggaaggacttcaacatcaatgcccttttggatgaagatctgggtgacgacttggagaaggtggtgttcatgcacggacacggtagagaaggccatcccatctgttacaacgtctacgacgagttccagaacaaggacctctaccacaaggccttgtcctctcaggataatcaaaaaaagtttctctgatggcatattcagttgttggagcacattatttgacacctcgaggataatgaagaagaagctacagtgtttcacgaaacgcacactagggttcaagcggttcacgaaatga

SEQ ID NO: 20321 - DNA, 219 bp, Glycine max
  Peptide Sequence Number=SeqID_137099
atggagagagacagaaaagaaaggcctaaggaagtgaaatcttatttctctccttttcaaggaaatcaaagtgcaccagagagaagttcctatggagaaagaaagccatataccattacggtaaccgcaagtttcatgttatggagaaagtgctacactcctattgttaattccaactttgaaaagctgcccaggtacctttattgcggggaaggataa

SEQ ID NO: 20322 - DNA, 294 bp, Glycine max
  Peptide Sequence Number=SeqID_137100
atggcaatcagattatttaattttattggctatgcatacgaagacacaaaaggcaaaaagtctttaaaacattaccaaacacaaattttagggtttcaccagaggcttcttagaagcaaatgtaagttcaagtgtaaatctaatgagacaaacaagaatattgccttggagattgataatgacaagaatgagaacgaagggaaagataaggagattcctcctccacccataccaaaggaggatgctgagagatatcaagaaattcctatctctaatgaggagtttaatgattga

SEQ ID NO: 20323 - DNA, 1347 bp, Glycine max
  Peptide Sequence Number=SeqID_137101
gcgccagaaaaacctgtaattaaagaagtatatgataatcaaggtgataagcagggtgcactcaatccgggtgaggtgacggatgacgcccagccgaccgtgcgcggcgaagcggagccgggtagcctggtcaacctgtatgacaatggccaactggtgggttcagctgtcacgaatgctgaaggccaatgggaattcacgccaacccgaccgctgctgaacggcgcgcattcactcactgtggaagcagttgatgcggccggtaacattagcgaaccgtccgacagctttgacttcatgctggaggccggcggcgcgccgaccgcaccggcgatcactggcgtagtggacaacgtcggagatgtgcagggcgcaattgaaaaaggcggcgtgaccgatgatgtccgccctggcattaacggtaccgcgcagccagacagcgtagtcaccgtgtatgccgatggcaaagtgctggggaccgtcctgaccgatgccgcaggcaaatggtcattcacgccagatagtgacctggccgaaggcctgcgcaatctgagtgccaccgcgaccaacgcggccggtaatatcagtccgtcaactggcctctatccgattgtgattgacaccaccgcgccagatgccagcagcgacaatcagctgacggatgacgttggcgacattcaggggccgattaatagcggcgatactacggatgacgcgcaaccaaccttcagcggtgtgaccgagccgggtgcgaccattattatccgcgacaacggccagccgattggcagcgcggtcgccggtaaagacggcaactggcgctttacgccggaccagccgctggcggatggcgatcacagcttcactgcgcagccagttgataaagccggtaataaaggtacggaaagccagccagttgacttcattgtcgatacctctgcggtgctggtgaccatcaatagcgtttatgacgatgcaggttctgtcacaggcaacctgaccagcggtgcggtcagcgatgacactacgccaaccctcaacggttcggcgacgccagacgcgctgattcacatctataacaacggcacgctcatcggttccgcaaaagccaactacaaaggcgagtggagctttaccccggatgttgcgctggcggaaggtgaacatcacttcacggcgacggcgacaaacgccgccggaaccagcgccgagtcgtcaccttttgacctcaccatcgatctgaccccgccagtcgtgggcggtattgatagcgtactggatgacgtgggcacggtgcagggcccggtcgacaacggtggcattactgacgacaccacgcccacgctg

SEQ ID NO: 20324 - DNA, 231 bp, Glycine max
  Peptide Sequence Number=SeqID_137102
atggggccctgggcccatctaggcccatcaggaagtttctacatgaagcaaccagctcgcctgggtgagctgggcggcaagctcctcccctattttggctataaaatagcatgggaggctgaggggaaggggttcaacacccttggcaagcatatttcacttaaaattaatgaaaagaaggagaaagaagaagaaaatcaaggccgaggtacttccgtaacgcttccgtga

SEQ ID NO: 20325 - DNA, 792 bp, Glycine max
  Peptide Sequence Number=SeqID_137103
atgactaagcatcgacttgttccgttgatgaagtattacagcaggctgctgatcggtagcctgctgctgtgcatctgctggccgctgcatgcggtggagctgcgcctgcacggtacgctgattgagaatccgccctgcacgctgaatgacaaccagagcctgatgattgagtttggcgatgcgctgagcgtgaaaaagatcgatggcgtcaactatctgcagcgtaaggcgataccggtcaagtgcaccgaggatccgggtgcggcattgcagtgcgctgctcagcagtgtgagtgcgctgggtattcgcttttatctggccagcaagccgctggcggtcaacagcacgttgccgattgttttccccggcacactcgatctcggcgcggtgccggtacagcagccgggcgtgacgctggagggtggggagttcaccgccagcgcggcgctgctgctggaatatcagtaaggagaggcgatgagagcgggagtaatgctggtactgggatggctgctggtgtcacaggcacaggcgatagagatgcagctgcacggcacgctggtggcggaaccctgttctctggagccggatcagcagcagctggagctcaactttggcgatatcgttgcgaaatcgctgtatcagaatccgcgcacgccggcgcgtccgctgacgtcgagctggtgttcaacggtcttgccgatgccgagcagcccgatctgctggcgctggccggtgatgccggtgccaaaggcgtggccatcggcctgagtgatgcggacggaacgctg

SEQ ID NO: 20326 - DNA, 272 bp, Glycine max
  Peptide Sequence Number=SeqID_137104
atggggtcctcagggggtggtaagccatttcaggccgtggaaaaacagcccggccagaataagaaacagggcggtgtcgaacagcgggcgctgcgcgacccagcgatagacgcctaccgcgttgagcgtccaggaaagcgccatgcgcgagaagaacgcgcacaccaggcacagcagcaagggcgagatgaacacgccgtcaatgttgatttcaccgatcatgtcagggattccagtgcaaagccgtggggaagtgcagcagccgcagccgg

SEQ ID NO: 20327 - DNA, 876 bp, Glycine max
  Peptide Sequence Number=SeqID_137105
atgtttcgtgaacgtacccttgttctgctgcgccccgcgctgaccctgattgccgttttgatcgcggcaggcgtgctgtggcagctttatctctattacacctatgccccgcaaacgcgcgacggcaagatccgcgccgacgtggtgccgctggccacggatgtttccggcaaggtggacgccgtgcacattcacgacaaccagctggtgcataaagggcagctgctgctcagcctggacaaagtacggctgcgcaatgcgctggatcaggccgaggccgccgttgaacgcgccaacgtccagttggcgtcatcccagcgcgaaaaccggcgctatcaggcgctgcagtcggctatttcacagcaggaacgcgacaatcgccgcgatgcccaatcgctggcaaaggccaatctggatcaggccctggcggatcgggcgctggcgcgcatcaacctgcagcgcgccgatctctatgcgccggtggatggcgtgatcaccaacttctccctgcgccccggcgcttacgcgaccgccggtcagccgatcatggcgttggtggattccaacagtttctacatcgccggatacttcgaagagaccaagctgggccgcatccagaacggtgacaaggtggtgatccgcatcatgggggaacggcagccgctgtatggccacgtcgacgggctttccgccggcatcaacgacagcgagcgcaccaccgccgccggcaatctgctcgccaacgtcaacccgacattcaactggatccgtctggcgcagcgcatcccggtgcgcatctcgatcgacaccattccccacggcgtcgagctgatcgccggccgcacggccacggtcagtttaatcgaaactcattaa

SEQ ID NO: 20328 - DNA, 273 bp, Glycine max
  Peptide Sequence Number=SeqID_137106
gatataggtaggaaagggtgtaatatttttcagtggcatgatccagttggcaacaatcgtcaaaagaagatcattgtagccttgatgaaggaggttgatgaattaaagttgagggaaaaggatttgcaaagcaggatcagtgacatgaagatgaaggaaaaatttataggaattgtattggttggaccagtcactagagccatgagcaagaggctccaagaggattgggctagagctgttgaagaaggccctaggattctcatgaacctcagg

SEQ ID NO: 20329 - DNA, 705 bp, Glycine max
  Peptide Sequence Number=SeqID_137107
atggttaggactaaaggcttaggccgtgccttaggtagggttgttaacagaggtcttggcagaggggatcatgatgatcctgatggtgctccccagtggcgaagtcctaccgcatcggcatgcaagcaatgggtgtcggtcattgttgtcgatgatgagccagtggtacctgtggtagctgccgataagccgatggtagatgctcacgctgctgcagatgagtctgagggatttcctggtggaccgaccgacccatccatgcttaccgagtatgctgagcatgttgtagccatcgtatggacgggagaggaacgtcctgagttaaagttgtcctcccataggaggaaggtgcagaaattaggtaggcctatccctacaattgaggggctagttgctaggacaggactaagtcctttgatcgcgtgttcagtagacactggaaatcggggacttatatcctcgtttgtggagaggtggcatcgggagacgagtagtttccatcttcctgtgggagagaggcagccatggccgagacaggacattgtcatggaccatacatacgcctgtcttagctacgagacatatatcaacgcagatgtcaaaccaaacactggacaactgcaactcgtgcctatcttcttcatcttctgggttgcactctttttgctaataagagtgcaacccatgttcatgttgtgttcttag

SEQ ID NO: 20330 - DNA, 819 bp, Glycine max
  Peptide Sequence Number=SeqID_137108
agaaacatcttgcctaagaggaaggtggagctctaccacactgagctagatgattttaagactgaattggagaggtgtaatttccataaacgcctcaccaatttggttgatgggagcatagacttggctttggtgaaagagttctatgcaaacttatacagctctgagggccgttcaccaaagcaagccagagtcagaggccatttagtgaagattgatgttgacagtctcaacacattcctggagacacctatggtattggcagagggtgagactttacccacatactccagatactgtaggctgcccacagattatagagagattgaggttgccttgtgcataccgggccgagggttcattttgaatgctgatggccatcctgggaggattctcaagaaagatttgactaatttagcccagatgacttctatagcccagtctagaacttctagacttgagtttcctgctctgatcaccaccctatgtagagccagaggggttgtctctaacagccttacatttgaatgcctgagcccggtcattaacttggcctacatcaggaagaactgttggaatcccgaggatctaacagtttctatccgagggactaggagggcgagagcgaggccaactgagcttccatccacatctacaactcctactccagcatccacttcagcagctccttctgtcccagctcagacagattctcaacgctttaaagccatgcttcaaagaattcatcagggacaaatcattttattacagagtttactggtggtggtgcctccaggatctattccttcagttgagtag

SEQ ID NO: 20331 - DNA, 699 bp, Glycine max
  misc_feature (490)..(490): n is a, c, g, or t
  Peptide Sequence Number=SeqID_137109
atgaggacacgtagccctctaaaggtgagggcgtgcagccctctcaaggcgaggatgtgtagtcctttggaggtgaaggcgtgcagccctctgatggcgaggacgtatagtcctctcaaggtgagggtgtgcagccctctgttggcgaggacgtgtagtcctttcaaggtgagggcgtgtagccctacgaaggtgaggacatgcagtcctctgatggcgagggcgtatagtcctctcaaggtgagggcgtgcagccctctgttggcgaggacgtgtagtcctttcaaggtgagggcgtgtagccctacgaaggtgaggacatgcagtcctcagatggcgagggcgtgtagccctctgaaggtgaggacgtgtagtcctctgaaggtgagggcgtgtagccctacgaaggtgaggacatgcagtcctctgatggcgagggcgtgtagctctctgaaggtgaggacgtgtagtcctctgaaggtgagggtantagtacccaaggcgagggcgggtagccctcttaagattgactgtccttttgaaagaggtgataattcatgcaacctcatcctatcttttgcaaatctctccgggaactccctcagagagggaacctattgggtgagaacttctaatctactcctaggttcgcttgaagttttcgcatggtgcctttcgttgccccagtgtagggcttag

SEQ ID NO: 20332 - DNA, 414 bp, Glycine max
  Peptide Sequence Number=SeqID_137110
atggacgaagatcagtggatgtatgaaaaagaatgtggtgtgaatgaaccacatgttgattgtttggatgcgctcaatacttctcaggaaactgaaattatatgtactgtgattataaggtctgacacaaacgctggtaatagaggaaggatttcgtttgtgttaattggctgtgaaatgagtgctgagtataggtgtaggaagaaagaatttgttagaagagatactgggactaggatatgtgggtgtcccttcaagcttcatggcaagccagtggttagaggacaaggctggatggtgaagttgatgtgtgggattcataatcatgaatttgccaagtcattagttggacatccatatgttaggcgattgagtaaagctaaaaagacacttattgctgatatgacgaagtga

SEQ ID NO: 20333 - DNA, 138 bp, Glycine max
  Peptide Sequence Number=SeqID_137111
atgggattcctcatctgcaataaggcagccatgattattgtagttgcagctgttaatgatgttatgctcatctttgggatgtctgaattgttgtttctgaagagtcaaggttgcaagggcgttagaatcattcgcaag

SEQ ID NO: 20334 - DNA, 532 bp, Glycine max
  Peptide Sequence Number=SeqID_137112
atgcctccattctaccatgaacagtgggcaccgcattaccccgaatttgcccgttttgactatgatggagcctcataccagatacgacttagacagtatcgaggaaaattgttctttactgttggcctcaaacagttgaggaaccacttaaatatctacgagttagtaaccatcaattttatggcctgtgaacacaaatggattttcaacctccatttcactcctctactggaacaacaagcatgcggcagacccttacccgtatttagaatgcatgtcgggactattgaactcactcaagccctgcttggtgatcctaaaccattgagacttccacctattgcagcagtacaccttccttcttgcggtttccatatgaccattttaagaaagttcggccctccattacaatggcctattgtcctggttagccctggctttcatggcaagtatgttgcgcaaccatggtaccggtttcttgctgaagatgattttgttcatggagacgagcttttattctactacagacctc

SEQ ID NO: 20335 - DNA, 387 bp, Glycine max
  Peptide Sequence Number=SeqID_137113
atggctgtattggcaacaggacctggtaaaggaggcggggtgctggaaaagcccgttattgaaaaagtcacccctggccgtgagtctgaatttgatttgaaaattttctgggatatctcatttgggaaatcacggaaatcagcaccaccgtatcgtgtaatattgcacaacgacaactttaataaacgggaatacgttgtccaagtactgatgaaggtcatccctggaatgacccttgacaatgcagttaatatcatgcaagaagcacactacaatggattgtcagttgtgatcatctgtgaccaagctgatgctgaagatcattgcacgcagctaagaggcaatgggttgctcagttcaattgaacctgcaagtggaggctgctga

SEQ ID NO: 20336 - DNA, 1074 bp, Glycine max
  Peptide Sequence Number=SeqID_137114
atgaggagatggtgcttcccttcctttaatacgggggttgagctaacagcttcgtcagctactgagagatataagagtaggggtatttctagccgggtcgagtcaagacaggcagaacctagacaaggatgttggtctatcgttcaacttttggacttcctagacgttggtaggactgtgcatctccagtatagatgtgcatttgtcggggttggcttctattccccgatgtgtgatcataaagcccaggaacttgcctctaccgaccttgaaaatgcatttttctgggttgaggcgcatgttgacatcaattgtgcacctgtgcttatggctggtgaggtccctgctgagttgtgtacactgcccggacccttcgtccatgctcatgacttgagtatcgccaccaactgtggggtgaggcttagtaggctccctagtggaaggatagagcgtaactttcaggcttttggcatagcactgtcgtacctgcttttgatctaccttgacagtcatgatctctcccgtcaaggtgggaaacttcatcttgagatgaggcatggagagaatggctttaagcttgttcaacattttccttccaatcaaagtaaagtaagagagctagtcttgaccgatggtggtcatgaagtcaacgtagcctctagtctctactctttctcatgcaaagccgatgagtggactaaagtgaggcaggatagttttgatggagctgccttggccaatgaggaccttggacaccatgaagttggcgattatgacggagacaaccatagggttgacacaactgatgtcgatgccccggatggcatggtggttgtcgatcgcgtctttgcttgtggtgtctttgtcttctttgatcttttgatctgtctctttttctgtcggcatcatggtttctgtgtcttcttggtgtccttcgggtatctccgtgttgaaggcctcctcgaggattgtagtgctattgctatcagggcgtgtaatgctcatacttgggcccttatgggagaggctgacgcttgtccgacttgtgcattttgtccaacttatgtgagttag

SEQ ID NO: 20337 - DNA, 696 bp, Glycine max
  Peptide Sequence Number=SeqID_137115
aagctcaatttgcctgtctcgacttatgctgtggatgatagctggaattggaacctcttgaacattcttctgccccctgaagtttgcgctaaaattgctgtgatccaccctccttttgcaaatgggcaagatattccgacacttttccacatatttgggattaggaaggtcctcagcgaggaagggtctttatgtggaagctattacaaaattagcttgctggttcctattgcctggaaacctccacgtgatggttattgtaaagtgaatatcaacgacaacgagtctttttatgcccattccttccaagctgcttgtggaggattaataagtaattctatgggtgttcctatttcgaccttccacgttaaattaggctactacaactccttgtgtgcagaactttgggctttgaaacatgggataaaaatagctagagatcttcaagtgcaaaatgttgattttgagatggattctaaggcagttgtttctattatttcaaaggctacgtcggatgtgaagcaactttttccgtttattgctaagatatcaaagcttttaaattgcactggctggagagtttcgttggcccatatctacatagaggctaacaagtgcgttgattttttggcttatttagaccacactggctcatttgatgtctcttttcttgatgtgtatcctcccccctcttag

SEQ ID NO: 20338 - DNA, 228 bp, Glycine max
  Peptide Sequence Number=SeqID_137116
atgcatgcttttgtaaaagattcacaagcttcagtgaagatgatagttcatgcttccatattcgattgcgatgcgggtatcgttgctgttggagaagaagcagaaaagagagatgcaagggattttctgcttcatattatcagtggacctaacaaccgtatcttatgttttgaggtatatgatatgaagactgacaccgaccgacagactgaacacggacacggataa

SEQ ID NO: 20339 - DNA, 495 bp, Glycine max
  Peptide Sequence Number=SeqID_137117
atggttgaggccctgagcatttacaagaagtggaaaggttacagcttagactacgaaggatcagggaagcttgttttcagcttgagagaatccaattcttgtttggttaagaacaatgcaatcagaatcttcactaggaacagaggcagtgactttaagatcaatgcggatcaacctaactacagcagtgcaaaagtagaagaaatggaaacggcgcttaccttgacggtggacagtggcgaagctcttcacgggaacctcctcaatgcacctcactgtaactccacgtcactgcaaatgacaatgccccggaagaagaataccaaaattgcgcaaggaaacaaagaccatggcacgcagggaaacgaaaagctgggtgaagaagaagaagaatatgaaagccgtgagagagaaagtgaagcgctgggtgaagaagaagaagaatacaaaaagtgggagagagaaagtgaagcgctaggtgcacaaatgttttaa

SEQ ID NO: 20340 - DNA, 1806 bp, Glycine max
  Peptide Sequence Number=SeqID_137118
atggagcagtatgaaatacttgagcaaattggaaaaggtgcttttggttcagcgcttctagtgagacataagcatgaaaagaaaaaatatgtgttgaagaagattcgccttgctcgtcaaactgagcgctctcgtagatctgcacacctggagatggagcttatctctaaattaagaaacccattcattgtggagtacaaagattcatgggtagaaaagggttgttatgtctgcatcattataggttattgtgagggaggagatatggcggaagctataaagaaagctaatggtgtcctgtttcctgaggagaaactttgtaagtggctcgttcaacttcttatggctcttgactacttgcacatgaaccacattcttcaccgtgatgtcaaggttgtgggaactcctagctacatgtgccctgagctccttgctgatataccttatggttctaaatcagatatttggtccttgggatgttgtatatatgaaatgacagcgcataagcctgcattcaaagcatttgatatacaggcattgattaacaagattaataagtccatagtggctccactgccaacaaaatattctagctcgtttcgaggtcttgttaaaagtatgctgcggaaaaatccagagctgaggcccagagcttcagagctgcttgggcacccacatcttcaaccttatgttcttaaggtccatctcaaaattaacagccccagacgaagcacattgccagttcactggccagaatccaactacatgaagaaaactagatttttggtgccagaagatgatcctgtttccatctatagggataagcgacattctttcaccaatgatcggactctaaatcctagtgtatctggagctgatcaagattctgtatgttctactctggagatagattgtactcctgaccatttgaatcaaaggttagcagaactacgtattggagatagccatcaagtgaagtcaatccagaagcctgttgtttccagaacttctagcattgttaagactccaaaattcgcttcctcaaaggtctcagccaccaacaagaaatcaatgaaatcctcaaagaattgtaagacgactaggagggagcttcttgatatttggtcaaacctcaagcttcctctttcacaaaataccacaaaatctgctaatactaatcgcagagcatcattcccactgccaacaaggggtggtaatcggcagcctccttgcaggtccgtcagtttgcttagtcacgtgtcttcaccagatatctcagtcaattctccacggattgataagatggctgaattcccattaacttcatatgaagattctttgttccctatcaataaaacatcatcctctgcacgaggttcctcaggcttcccatctcatagcaaccattcaactgtgatagacaaatgcacggtagaggtatatggtagagcctctaacaagcctggtagtatggatgcgtggcagggaatcaagcagagcgtgttaaaggagattgatgaggataaaagtggttcctcagatcaaaatgcaactgcaggtgcttcaagccacacctcttctgacttgcgccgtcgacaatttgacccgtcatcattccaacaaagagctgaagctttagaaggcttgcttgaatttagtgcaagattgctacagcaggcaaggtatgatgaacttggggttctgttgaaaccatttgggcctggaaaggtttcccctagggaaactgctatttggttgagtaagagcttcaaagagaacactttcaacccagaagaatccatgtaa

SEQ ID NO: 20341 - DNA, 330 bp, Glycine max
  Peptide Sequence Number=SeqID_137119
atgatggcaaagcttatcctattggtgtgtgtacttgctttggcctctgcgcaaagtgccattgtgcagtttacgtatcatttataccaacctgagcagcataactattgcgccacttgggatggagaagcaaatatggttggacagccttctgtggacctgttgggcctcaaggcccaccttcttgtggcaggtgacaaacactcgaacaggagatcagcaaagagagaattgtggatcaatgcaaaaatggggcgttggacttggacgttggtgtgttccaaagactcgactcggacggaagtggaaatgctcaaggccatcttatag

SEQ ID NO: 20342 - DNA, 807 bp, Glycine max
  Peptide Sequence Number=SeqID_137120
atggcaacaagaacgagaacaagagtgttagtgagtggtgagagtgcgaagaacgtgagggctacatatcatttatataaccctgagcagattggttggaacttggtcactgccagtgcctactgcgctacatgggatgccaacaagcccttggcttggcgtaaaaaatatgcatggactgctttctgcggacccgttgggcctcgtggcagagaatcttgcggcaagtgcttgagggtgacgaataccggaactgggactgaggctacggtgaggattgtagatcagtgtgctaatggaggcttggacttggacgtcaacgtgttccgacaattggacactaatggagtcgggaaccagcaggtctttgggtccagtttcgtcaaagatgaggggtttttgagtcatgacgaggtagtacttgacgttttctctgaacttggaaacactcttgagatcgaccttgatgccctccttgagtgttataacgacgtcgccccactctctgatgaagcgttgcacgatcagcacgtccttgatcacgttgtagccgaagtcagtgtggtcctgccccgtgaggctcgagatcagggtcaggggaagtcaaaagagggtgaaatcaagaaggaggttcgttgtaaggttgccgtagtaggccatgccatcaaagaatatggtcttgccaaaggtggtggtgggggaggggtggaggaggtgagagaggacacgtggagctgtgtgacggaagcaatggagggtgtggggtttgaaggggaagagggaaagctggaggttcgaaaaagataa

SEQ ID NO: 20343 - DNA, 333 bp, Glycine max
  Peptide Sequence Number=SeqID_137121
atgatatctcatcccttcatgagtttgacacagcatggggatcctcctagacatctgcccatgcaacacgatgacacatttgttgaactagatgttactccgcactcggtggcgacagcggttatggacgaaccacctgaagatgcacatactgatgtagggcagcctcaacatgcagttgaggcttgccaagccatagttgaaaggttgggcaaggctgctcaacctaggatagtgatcgaaggaatagaagcatacactgtcaccaaagaatctctgaggatcgcaagaggtgtcactgggcaacgaaatgtctatgttcgatcgagatga

SEQ ID NO: 20344 - DNA, 711 bp, Glycine max
  Peptide Sequence Number=SeqID_137122
atgaggggagcgccaacggaagagagcctctcgcctttccttgtgagagattttggcgtgcaaagtctcaaggttgtacaaaaagtccacaaggcgtggagaagtccgttgaggaaagataaagaacttaggggcatccgtaatggcatcatcggtggttatcatgaatggctaagggttcatacgcgagggttagattggctctccaagttgaaagttatcaatgaggagaactttgaagctccggaagaggatgaagaagtccaagctctaaaattagagctaggaaaggcaagactcgccaaagaaaaattcaagtcagccgctacaaacatccggaaagagtgcaccgagttacgagaggaaaacgcggccactgcaagagcccttgaacaagaaaccaaaagggcccgcaacgaggaacatggccgggataaataccgaggagctttgtggggcagcaataatgagctcaagctccggagagaggaaagggaccagtcacgggtgcatggcatgatcttaaaggaagagttaactgcttgctctagatctaagaggagtttggctcaacacttggaagcaaatcatgctagctatcatagggcaattaaaggaagagttaaaccagtcgttgacccacgaacaaaaactagtagaggacttcgcacaagcgtacgccgagaaggaagcaagagggagggtgattga

SEQ ID NO: 20345 - DNA, 3191 bp, Glycine max
  Peptide Sequence Number=SeqID_137123
aaccaccaagaatcttgatcctttccaacaattggcaccagagctacacgatccacgacagcgaaacccaacgaaactaacaatggtgatgttgaagaacaaagaccaaatcccagcgaaactaccaatctttgatggaaccaactataagaggtggacgacgcagatgaaggtggtgttcagatatcaaggcgtgcttgatatcataagcaccagcatcacaccattagagatgaatcccacagaggcacacagagcaacccactgtgaacagatgaagaaatatgataaagcgatctttctaattcatcactgtgtggattcaaatgtcctagagaaaatcattgactatgagacggccaaagaagcatgggatgtgttggctacaacttacacaggtgacaagcaaaccaagaagatgaagagctgtggtgaggtggtgacagattcgatgaaggttgaaaaggtactcactggcttaacgccaaactttgatcatattgtctctgcaattgaacaatcaaaggatctagaaacattgaaattggagcaattactgggttctttggaagcacatgagttaaagatgaagaatagagaaggtatcaagaaagaggagaaggctttcgagaaagccttatttgctaaaaatcaaaagaaaggtggtggtgattcttggaagaataagaaagggaaaggcaagtggaagtataacaaacaagaaagtagtggttctaaaagtgagaatcaaaagaaagaaggagaaaacaatggaaagggaaagaagaagtcaaaggagcacattcagtgctataactatcgaaagtatggccattatgcagatgagtgcagtaatcctaaagtgcctaggaagaggggtgaagaagcaaaactcgcgtgtgactctaatgatgaagaagcagtgatgttaatggccactgttaacggtgaaacaagcattgaggaggaatggtggtatttggacactggttgttcaaaccatatgacaggacataaagattggttatgtgaaattgatgaaacagtgaaaagaaacatcaaatttggtgatggcaagtcagtaatggctaaaggaattggcaaggtggccataagaagagtagatgggagcaaggtgactatcagtgatgtcctatatgttcctaacatggaaagcaatttgctaagcttgagacaattgctagagaaaggattctcaatgcatatggaaggtgaacacatggaagtagttgattctaatgggaaatatgtcttgaaagttgttgtgtctaagaacagaacattcaaggtgggtgtgagcaccattgagcagaagtgcttgactgctcaaagcaatgacagaaaacaaccaaggaaggcttacaatgcaacaattccaaccagggccaaagagaagcttgcagtgattcactctaatgtgtgtgacccatttgaaatcaaatctcatggaggaggaaagtacacttcacttgaatttgagaatttctgcaaggaagaaggaataattcatgaggtaatggctccatacactcctcaacacaatggaactactgagagaaggaatagaacagtgttgaatatggtgagatgcatgctgagagagaagcatcttccacatgatttctgggcagaggcagtattcacaactactcacatcttgaatagatgtcctacaaagaggcttgacagtttgacaccagaagaagcttggagtggactcaagcctagtgtgaaacacttcaaggtatttggctcactctgttacagacatgtgcctgagcaaaatagaagaaaactggacgcaatggctcaaaccttgattttggtaggatatcacagtattggggcctataaactgtttgatcccttgagcaagaaaattgtgataagtaatgatgtgattgtggatgagacaaaggaatgggactggaacattggtatagaaagacaaaccaatgaaacagtagaagtggaactggaaggagaagaaatacaggatgaagttcagattgacaatgagcaatatgtgaatgatgagcaaaatgtgaatgatgggccagatataactccaccagtgaggtttcaagactatgatgtcttccctgatgctgctatcaatgttaatggtgagctgatgaacttagtgctgttagcagaagtagaaccagtttcacttgaagaggcactagccattccacattggagaaaggccatggaagaggaattgagatcaattcagaaaaacaacacttgggaaatggtgaatttaccaagtaataagaaagccatagaagtgaagtgggttttcaaaaccaaagtcaagccatctggtgaaattgccaagtataaggcaaggctagttgcaaaaggtttcttgcaaaagcctggtcttgatttcaatgaagtatatgcccctgtagctagaattgaaactgtgagactcatagttgcaattgctagcatgaggaaatggccagtaagtcagctagatgtgaagtctgctttcctcaatggtccattagaagaagaagtatacacaaggcagccacctgactatgagaagataggcatggaagataaggtaatgaagttgaacaaggccctatatggcttaaagcaagctccacgagcctggaataagaggattgatggatttctgcagaagcaaaagtttttgaaatgcaccactgaacatggagtgtacttgaaagactgtggagtaactggtgtagtgatgctatgcttgtatgtggatgatcatcttgttactagagataacaaacaggagattgacatgtttaagaaggaaatgatggatgagtttgaaatgtctgatataggcataataacttatttcctaggaataaagctgtctactgatattacctatgaagttggcttggttagtagattcatgaagaaaccttgcaaggatcatctacttgcagctaagagaattcttagatatatgcagattggagtcgagatgttggtgatagaaagagcacatccggctgagtatatctcagctgcttttggtgcaagccaagccctctggctaggaatgttactggaagagcttaacatcaagtgtagtaatgtaatgaagctcaggattgataacaaatcagccatagaccttgctaagcatccaataactcatggacgcg

SEQ ID NO: 20346 - DNA, 177 bp, Glycine max
  Peptide Sequence Number=SeqID_137124
atggtgattcacagactcgaattgtgcataaacatggttcaactcgccatagagttcgtcgtgagcgtcgcggaaacagtggtcatagttcagcagagaaccgtggagcctctcggaatgttgaatcgcgcaataaaattcgaagacagagtttataatcacttacacatctgttaa

SEQ ID NO: 20347 - DNA, 781 bp, Glycine max
  Peptide Sequence Number=SeqID_137125
atggctgataccaaatctgcgatggtatcagggaagagctctgctgtgcaactcactgaacaacaacaacaaggtcaatctctcaatgtacacagtccttattaccttcatccaggagaaaatccagcaatagctttggtttctctgacctacatcagatcatgcgcttcatacagcttggaagaggtgcaactatatggtggtttcgcgcatggataccctcatggtcgtaaatatcataagccccaaggtccatcaatcaataatgaaaatgctataaatgaggaaaatgcaaattcaaatgtagaacagaatcaagaggcacaaggtttagatgttaaagtgactactcaacaatacaaagccttaatgacattgctgcaacaacaaggatcttcaactcacaatagttcacatgtgaatcagattggcacgatgactggttctggtcatgcacttacaatggctaaactgactacaatcaaattgttacttgctctagctgctattaacaaatggaacttaaagcaacttgatgtaaataatgttttcttacatggagatttaaatgaagaagtttacatggtgattcctctagtggctcgtacatctaccggtatcaatctttgccagagaaagtatgcattagatgttcttactaatactggcatgttgggttctaaaccagtatccacttcatttgattacactgctgggttgtatcaacattatggttctcctctctcagttgaagatgcctcttcttacaggagattgatag

SEQ ID NO: 20348 - DNA, 255 bp, Glycine max
  Peptide Sequence Number=SeqID_137126
atggttatgtcatttgggctaaacaatgttggggaagcatatcagcgggccatggtaacattattccatgacatgatacacaaggagattgaggtttatgaggatgatatgattgtaaaatctagaatgaaggatgagcacatagttaatttgcaaaagttgtttgagcgattatgtagccaaaaggggataaaggtggatcaagataaagtgaaagccattctagtgatgcttgagccacttacagagaaatag

SEQ ID NO: 20349 - DNA, 258 bp, Glycine max
  Peptide Sequence Number=SeqID_137127
atggctgtgaaaaagaggctaagtcaggaagtgctaaaagtgacagttgagcttagctcatcaaagaatcaaacaaggctcatttgcttcaagattaatacaagattggttcaacaagtaaagccttgcttcaagattatctcaagatcaagccttgccattgaaacaaagtgctttcaagacattcaaggctctggtaatcgattaccaggcagtgtaatcgattaccagaagacagggttgacaaagagctgttga

SEQ ID NO: 20350 - DNA, 348 bp, Glycine max
  Peptide Sequence Number=SeqID_137128
atggagagttttcagaaaatctgccaacaatcacatcttttcaatggatttgtgaatggccatcaaaggcctataaatagcctatccctcttacgattattgaggccacaaggtccaacaagagcatcaacatcaaggtcgtgccctaagcatgagatcagtgcgctaagtgtagcagacttgtgcacattattccaaagtgcctatttcgagaaaagagccctacaagcaacaagaagaacagcttgtgcattgaagcctaggttttgtaaattgagagagattagtgagtttgagagtgagtgtgagatgctgagaagaggaggaggaatcccctttcttgtgtaa

SEQ ID NO: 20351 - DNA, 531 bp, Glycine max
  Peptide Sequence Number=SeqID_137129
atggcaagagctggtgacaatggtggtgtatatcatcaactggacgaatctcaacgcttatttctggacgcgtggactacacaaatgcaacgtttgttgaaccgtaacaaagaaaagccctacagacgaatagccaaatcttcctcatttactcttaaacctctatcccctagagaagtgtgtgatgaccaaatcagaatgggagaaaagagagaacaagagaaagaaaatagtgaggcaccacaaaggaatatgaaaaagaagagtgatacacccgaggaaaagagtgatacacatgagagaaaatttaattattttgcagaggcgagtgaagtgaggaaagtgttacctgctcatgaaccactcaatccacagtattgcaaagacagtcggctaggttttttcgttcgagctcaaccgaagttgcgtttcggccgacaccggcatgttttcatttactcggcaaggaaaacattagcccacctcggaaaaaaaacaagattcaccgatattgatcggaagaaatgttag

SEQ ID NO: 20352 - DNA, 201 bp, Glycine max
  Peptide Sequence Number=SeqID_137130
atggagatgacaaggaaggaggaactggtgttgtgggtgcttcagatggtccgtggcgtcgatggccagcagcaacggtggtggtggaagagccctttcgctttttcatcgattcaggcatttgaggaagtttttgtagatttcaatcaatggaatcaaaagaggattgaaatgatgaagtttgggctttatgggacgtga

SEQ ID NO: 20353 - DNA, 307 bp, Glycine max
  Peptide Sequence Number=SeqID_137131
ggatcgcgcccgcaggacacccagtggaaccaaagaagtccaacagggtcctggggtttccagctctgattacgggcctctatcagttctacgtagtgcctgtcaccccagcaaggtcatcaggcctcctactaaccgagctttcatcaagaagtattgcgcccccatgcaggcagagggcgagacaccacaacagcctggggatggccagcaacaggcaacaaatgcaccgccaccacctccagagcccctcagctcatccataaaaaggttagagtattgcctacgacacatggccgaccaatag

SEQ ID NO: 20354 - DNA, 909 bp, Glycine max
  Peptide Sequence Number=SeqID_137132
atgaacgtgcttagcgtagaaaacctcaccatcagctaccgctctggcgggttgtggcgcgaagtggttcaccgggtcagttttacgattaaacgcggcgagatgctggcgttcgtcggcgaatccggttcgggaaaaaccaccaccgcccaggcgattatcggtctgctggcggaaaacgcccgcctcgatgccgggacggttcgtctcaacggtgaagagattagccgctggtcaggcaaacggctggataacctgcgcggggccagaatcagcctagtgccgcaggatcccggcaactcgctgaacccggtgcaaaccatcggcgcgcaggtcagcgaaatactccgcctgcatcaaaaaagcagtaaaaccgagcgtcgacagcaggttatcgccctgctggaaaaagtcggcttaagccatccagagcagcgtttcgaccagtatccgcaccagctctctggtggtatgaagcagcgggtgctgatcgccattgccatcgccctgaagccggatttgattattgccgatgagccgaccagcgcgctcgacgtgacggtacaaaaaagaatcctcaatctgctcgatcatttgcgccgtgaatccggcaccgcggtgctatttgtcacccatgacctcgcgctggcggcgcagcgtgccgaccggctggtggtttttcgtcacggtgaaattcaggaacagggcaatacgggtgatgttattcgcaccccgcagcacggctatacccgccagttgctgtgcgatctgcagggacagaacctgcacttaaccaccacgattcgcccgtttgttacgccggcaattcgggttgaaggctacccatgcgctggtcggcgaatcgggttcaggaaaaaccaccctcgcccgtatcttgctgggttttga

SEQ ID NO: 20355 - DNA, 713 bp, Glycine max
  Peptide Sequence Number=SeqID_137133
gcattgccaaagtgctggcgcaggccggcgcgcagctggtgttgaatggttttggcgacagcacgagcgcgcgagccgaggttgccgcgctgggtaaaattcccggctatcacgatgccgacctgcgcgacgtcgggcaaattgaagcgatgatgcgttataccgaaagcgaatttggcggcgtcgatattgtgattaataacgccggtatccagcatgtggcgccagtggagcagttcgcggtggaaaaatggaacgatattctggcgataaatctgtccagcgtcttccacaccagccgactggcgctgccgggcatgcgcgagcgcaactgggggcggattattaatattgcctccgtgcatgggttagtcgcctcgaaagagaaatccgcctacgttgccgccaagcatggggtgattggctttagcaaaacgctggcgctggagaccgcgcgtaccggcattacctgcaacgcgatttgccccggctgggtactgacgccgctggttcagcagcagatcgataaacgtatcgctgagggggccgaccctgagcaggccagagcgcagctgcttgccgaaaaacaaccctccggcgaattcgtgacgcctcagcaactgggggaaatggcgctatttttatgcagcgacgccgccgcgcaggttcgcggcgcggcgtggaatatggatggcggctgggtggcgcagtaa

SEQ ID NO: 20356 - DNA, 393 bp, Glycine max
  Peptide Sequence Number=SeqID_137134
atgaaaaaagcatggatatttgtcgcggcagtcgttgcgctaagcggttgtgcgccgctacacccgtcggattgtcataaaacctctgccctcggtagctgtgattccgggcgttttagcgatgaggatgagtatggtcagcaggcgagggggatcaaagaagccttcgagtcgcaacttgctgaccgctacgcgtggcggggaaaaaagtgccgcctgcatttagaattcgcccaggatggcactctggaaaagatgaatacggctgagggaaataaagcctattgtgccgcgctgcgtgaggcggcaaaaagtgcgaccttcccgccgtttactaacgataaagtctacaaggcctttgctcaatcgcggtttgatatgaagggtgaatag

SEQ ID NO: 20357 - DNA, 201 bp, Glycine max
  Peptide Sequence Number=SeqID_137135
atggcggaaccatcgaagaagcacaaaggttcttcaagtagaagtcaaaggcattctgaggttcaggatactccaattccttcctccatttcatcctcctcattgttctcatctgaagaacaacatatacggtacacaaaccttttctcctctccttctatcatagatcctaagttcatagatttggatcttctgttctga

SEQ ID NO: 20358 - DNA, 632 bp, Glycine max
  Peptide Sequence Number=SeqID_137136
gactgagggatggcggtcgcccccagcgcggcggccacgcgcgccgcttcgcggtagtattgatcctgcaaatcgcgggaaagatgggggttgcggtagcgcaggtggctggccagaaaacggctgctctccgcgacgtgtacccaggtcagcagcgccggatcgctggcggcataaggcgtgccgtcgctgccgacgccggtcacccgcagatggatggctttgactttggcaatcagccgctgcgcctcggcggtcgggccgaaggtggtaaccgacacgaactggctggtgcggcgcaggcggccaatcatatcttcgcggaagttggagtgatcccacaccccggccagcgccagcgggtgcagcatctgcagcagcaaggcgctgacaccgccgcacagcatcggggtgaaatcgcggtgaacctgccagatgaccgactgcgggccgaacaagcccggatcgccgggcgggttctcaaaatcgacgccgccgagcgccagcccggtcaggctgagcacctgtttttctatcgctgcgcgtaccgcttccatcctgctgcctccgctgttcacccggcggccagtgtaccacgcgtcgggcgcctcattgcgccctgcggcggttga

SEQ ID NO: 20359 - DNA, 395 bp, Glycine max
  Peptide Sequence Number=SeqID_137137
atgctctccaagccttagctcaggctatgaggaatcagaataagggagaagctactggagttgttgagtatcaaggtgttcggaggggtagaaggttgcttttgggcaacctgattgtgggtgaatatgcaaccaagtttgaggagctagtgaggtactttccttgctaccaaggaagagatggtgaaagttcaaaatgtgcgaagtttctgaacagcttgcgacctgaggtgaagcaagctgtgaactatcagggtgtttgtcagtttccacttctggcaaaaccatactcgacccctcctaagcaacatggtaatctccccaacaataagaggactgttgttatggggtttgctggtggtagtggttgcaaacccactactttctccatctag

SEQ ID NO: 20360 - DNA, 286 bp, Glycine max
  Peptide Sequence Number=SeqID_137138
tcctctcccccctcctccttccgccgcttctcccagccgctggaacttcctcaaatacgccgtcgtcggcgctctcaccggaggcactgcctttgccggttacgcctcttacgcttacagtttggaagaagtagaagagaaaacgaggtcgtttcgtgaatcggccaaatacgctgctggtgatggagccactgctctcgatgtcagtattgactacttctcaggctttcttcattttcattcttctttgctaattctatgttttagaatcatattgggggtttaa

SEQ ID NO: 20361 - DNA, 939 bp, Glycine max
  Peptide Sequence Number=SeqID_137139
atgaactgcgtgccagtgtccggcatctgccgtgataagagcatcatcccgcttaccgaagcaagcgcagaaacgcggaattccgttcagtcttcgatgttcaggaacgtgcgcaccgcgctcacgcgtgggcgaagtcgtaggccagcacatcggcgatacgcggcgtgcggttcatcgccatcagcaaccgatcaacacccaccgccacgccggcgcaggcgggcatcgagggcaatgcggccagcaatgcttcgtccagcgccggctgcacctggccgcgctcatggcggcgctgcaggtcgcgctggaaacgcgcacgctgctcgtgggcgtcgttcagttcgtgatagccgttggccagttccactgcacccaggtacagctcgaaacgctccgccagcggcggcgcgccggcacggatgcgtgccaatgcggcctggctggcgggccaatcgtggaccacgatccagccagtcatcgcgggtcagcccgaccgggtcgatgtgcacctcgcccagcgcggcacgcagcgcagcctcatcggcatcgaacggatccacgccccacgtactgctggaacagctcgcggtagctgagcacacgcagcgtcgcactgcgcccgaccagggccagcgcctggccaaccagctcggcggtttcctgcaccaggcgatggtggtcccaaccgacccggtaccactccagcatggtgaattccggattgtggcggccgcccgcctcgccgttgcggaacacccggcccagttcgtaacagtcacccacgcccgccgccagcaggcgcttgagcggatactccggcgaggtgcgcagccagcggcggcgtccgccggcatcgacatggccggtgaaatcggatcggcgtctccacctccagcacgtcgcgctcggcgaagaagcggcgcaccagcgcattga

SEQ ID NO: 20362 - DNA, 528 bp, Glycine max
  Peptide Sequence Number=SeqID_137140
atgactagaacacgaggtttaggtcgtgtcataggtagacttgtaggcggagatagacatgatgatcatgatgtagctgatgttcccgagagacgtatgcctattgtctctgcccgtaggcaacgagttcatcagatgactgcggatacacgtgatttggctgaggacgttgctgacatggctgacgatgtccctgatctagctaaggaggcacctgagatgcgtgcggacatagatggtgctgatggtgctgaggggtcagatgctgatgatgctgagggattccctggtggaccacgtgacccgtcagtgctgacatcatttgcagaccatgttgcacacgctgtttggagtggacatgaacgtcctgatttgaagttggtgtcacatgggaggaaggtgacactgattgggaggccagtgcctcagatcgaaggactggttgctgccacaggattaagtccactgatcgatttttcagttgttactggcgatcctggactgatattcgcatttgtggagaggtga

SEQ ID NO: 20363 - DNA, 301 bp, Glycine max
  Peptide Sequence Number=SeqID_137141
ggaggtggttgccgcccagctcgcccaggcgagttgggttgcttccactagaaggcaccaccttctgttggaacatcctggaaggcctaaaatgttgcggaactttacggattgcccaacaatgcttcctttcgacttccggcatgtctcggaactccacggattgcctaacgatgggttcaatatccctaccagcggaacctccgccattgcactcgatcgtccctggatgacaaaaggtgcagaagacgatgttagtctctgcgcgtcaacgggctcgtttgcccttgatcgacgaaag

SEQ ID NO: 20364 - DNA, 528 bp, Glycine max
  Peptide Sequence Number=SeqID_137142
acagaaatcgagaaagcccaaatagtcaaagaaaagttcaaatcagcagctcttaagatccgaaaggagaatgccgaactgagagacgtaaatatagccaccaccaaggccttagaacaagagaccaaaagggcccgtagggaagaacatggccggaacaaattccgaggggctctgtggggcagtaacaacgagcttaagctccggagagaggaaagggaccaatcacgagtagacagtttgatcttgaaggatgaattgaggatttgcctaaggtccaagagaagcttgtctcagcggttatgcgagaccgagaccaacatgttagccatcatcagcaagtaccaagaagaattaaatctagccacagcccacgagcacaaagtggcagacgaatatgctcgagtgtacgtggaaaaggaggctagaggaagggccaaagtgatgtcggacgcctactccgcccctaaggagatccacaaacttctcagctattgtcagcatatgatagacattaggaaccgctaa

SEQ ID NO: 20365 - DNA, 282 bp, Glycine max
  Peptide Sequence Number=SeqID_137143
atgggggccggcgatgtgtccggtcggatgtggaacggtgagagccggtccgccgatcgactcgggacattgaccgacgcggattgcgatgcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtgggttgcaccgccgaccgaccctga

SEQ ID NO: 20366 - DNA, 825 bp, Glycine max
  Peptide Sequence Number=SeqID_137144
atgctgcaacatggcatcatccgtcccagcacgagccctttttcctcaccaatttttctagttaagaaacgagatggttcatggaggttttgtgttgactataaagcacttaatgccatcacagtgaaggatagatttccaattccgacaatagatgagttgttggatgaacttggaggagcttgctggttttccaaactatatttgctccaagggtatcatcagattttgatgaacaaagacaatgtgcaaaagatttccttccgcacataccacggacactacaagttccttgtgatgccctttgtcctgtgcaatgctccatcgtcctttcaggccaccatgaacaaaattcttcttgaagctgtgcaaatgctctgttgcccaaacacaggtggaatacttgagccacatgattttggagtcaggcatcgaacctttgcaagagaagggatatgcgactattgctacccctttaacgctactgctgacgaaggaccaatttacatggacacccgcaacctagagttaccagattttactttgccatttgtggtggagaccgaaacatctggtgtcaaaatgggagcggtgctttcccaacaaggatggccaattgtgttctttagtaagtctttttgccctaagttgctaagatcatccacctatgtcagggagcttgtagccatcaccatgatgacagatagacagcttgttggtcttcctactgggtggactgatgttactaaggatgttctctacctaacattgttcctatgttctatgttgtctcctggactactaaaccctgatgtctatgtttag

SEQ ID NO: 20367 - DNA, 102 bp, Glycine max
  Peptide Sequence Number=SeqID_137145
atgaccgtgaggctttgtgccaaagtggttgtcacgctaagcgaactcagtgggcttagcgcgtatccatcgctaagcgcggcttcagcacgcttagcgtga

SEQ ID NO: 20368 - DNA, 147 bp, Glycine max
  Peptide Sequence Number=SeqID_137146
atgggggccaataaaagccatagtcaagcactttgcgagctgtcctttgaacacccagatgacctcccaatgcggaagaatgacaaaactgcaggactaagtgacgacgttagtgaggtgcatgggtggcaattcagtgccacatag

SEQ ID NO: 20369 - DNA, 579 bp, Glycine max
  Peptide Sequence Number=SeqID_137147
atgcactacatcattgttcgcattctattacctagatcatcaaacttagctcaagcctcagaagaggatttaatcttgatgtgggattttctcatcggtcgtccgatcgactgggcccatttgatcagataccgcatgcataaggcattgcggtcaaatgcacctctgccttatccacagcttgttactttgtttcttcatcattttcaaactcccttggataatgagccctttgtgaaagtcaaacgctcctttgcaattggtgccggtgtggtaacctccttcagctaccgtaaggacatggatgggcaatggttgaagaaggatgcgcaacctccgcaagacgaacgtactcattctcctccgcctcaacgagatgactactcagccctcatgaatgaagttctttcggagttacgcggtctctgcacctatgttggagagcgctttgattccttggatggtcgtatcaatgctattgatgctcgctttgcaggcatggatacccgcatcactcagcttgaggaggatataagttatgttcgtcagtgcttcgatcttccttcaccatcttcatag

SEQ ID NO: 20370 - DNA, 309 bp, Glycine max
  Peptide Sequence Number=SeqID_137148
atgtggataaacccaagtggttatccgtacaaacgatttatgttaatcctcacccgtgaagtcaggggcaagcaaaagactaacgtcgtcatctgcaccctttgtcaatcaggggcaagcaaacccgttggcacacggagactaacgtcgtcttctgcacctttgtcatccagagacagcgagtctgatgacatgcggatatacccaagtggttatccgtacaaacgatttctgttaatcctgacccgtgaagtcaggtggcatgcggtgatacccaagtggttattcgtacaaaatggtttctgttaa

SEQ ID NO: 20371 - DNA, 267 bp, Glycine max
  Peptide Sequence Number=SeqID_137149
atgacgacgttagtctctgcatgctaccagactctgagtctgatggatagcgaaagagtgtttatacggataaccacttgggtatctcctcctgccactgacttcacggataaccacttgggtatctccgcatgccacctgacttcacgggtcaggatagcgaaaggtggggcggtcaacaaaagcgaagcttttgctcctacgtatcctcaatctgtgatgaggaactcagacctacgtagttcttgctttgagagacttaaatag

SEQ ID NO: 20372 - DNA, 273 bp, Glycine max
  Peptide Sequence Number=SeqID_137150
atggcgaacatccgcataccaagttgcttcataggctattcctcacaaaactatgcccaaatgccattgaggcatttcacccagcacttgatgggcgcatatatacatgttctctatgggtcggtgttcgcttgcttgaaacccctagggcatgaatttaaaggactaggctgccccccagtagcgcttcttgatcgtccggagccggatgcgggacgacgatctgctgatcacgggcctagcgcccattcgtacccgtccccgagcacctga

SEQ ID NO: 20373 - DNA, 585 bp, Glycine max
  Peptide Sequence Number=SeqID_137151
atggctccgaagaaactcttcatgaaaaggtctagaaaggacaccacaggagaaggctccagtgctgccttggagtttgatagtcatcagttccagagtgccgagcaccagcagcgcttcgaggccatcaagggatggtcattccacagggagaggcatgtccagctcagggaagacgagtaccctgacttccagggagagatagctcgtaggcattgggcacgactagtgacccttatggctaaattcgacctgaagatagtcatagaattttatgccaatgcctggcctactgaggaagaggaggaccagcaatgtgaattcagccagaggaggagccaggcagacggcttcgatgaggaagccatcgcccaacagctgtgcatatcggggcaggatttctcccgaaccactgcggggaggtgggtgcggatcatgcgcaccagcatgactaccctgacccaaatatggatgacactactgctcagcaatgtcttgcctagtgaccacaacttcgaccttcctctgcctaagtgccagttggtgtatgccatcctgacacggatgagcgttcacgtggcccag

SEQ ID NO: 20374 - DNA, 228 bp, Glycine max
  Peptide Sequence Number=SeqID_137152
atggttaaggaggattttaaggaggtaagtgtctcctccaagagcattgccacacctcttgggcttgaggttattcctcaattaaaggagttattggatgaggctttggttcgcaaaagcttaaatccttgtgctttgttggtgtccaaaataggggttcccacgaaccctaagagaataaaggccactcctgagtggcctactccaccaagtataaggaaaatttag

SEQ ID NO: 20375 - DNA, 267 bp, Glycine max
  Peptide Sequence Number=SeqID_137153
atgacgattcaacggttaatgagtttgagatcattgttttacgaagacatatttgagtgtatgtgggaaaaagagaaagttttgggaggaggagaagggaaaatgaatttgagaagaaaagaaagcgtaagtgttacactccaagattatgagctgtgtttcactgttctgatttcaaatgctaagaagtttctattcgattattgttggaatactaaaacaatggttatgattgctcaagcaaggattgcttgggagattacttag

SEQ ID NO: 20376 - DNA, 1221 bp, Glycine max
  Peptide Sequence Number=SeqID_137154
atggtttctcctcagcttgccacatggccttgctcaatggttttgctacaaatctttgttgtggctcaaaccagaagtaacaaaatcattggtcactctcttcttaaaaaaactagcaaagcctcatggatggtttcacctcatggtcaatcaagaagaaacatagttgttggtgattctcttctagccgaaacaactagcaacaataacaacctctcatcatgggtggtttcacctcttggtgactttgcctttggatttgtcctacttgaggacactaataatttcttggttttcatttggtatgctaagattcctgagaaaattgttgtttggtataccaatggagagactcctgcttcaaaggggtcaaaggttgaactcactgctgatgatgaatcagtgctcactgtcccaaatggtgagctattgtggaaaaatgataaccataatggtaaaactttaaaggatccaagggacaccttgttgccctcacaacctcttgaaaagggtgagaagcttttatcgagatttctagagtcaaatttctcaaaggggaggtttgagttgcttcttcaaatggatggtattctttcgattcatgctttgaactcaccctctgagtatgccaatgaaaactactgtgaaactaggactgaagagtccaacacatcgagtcctggaactcggttggtgtttgaaccattaggtttttgcacgttgggaggtgatcaaaggtcaagttgtcaatgcccaaaatggtactctttgcttgaccctaatcacccctatggtagcagcaagcttgatttcatacaaggatgtgcagaagatgagctgattggaaggaaagaagatgtggctgaatatgattttgaagtgttgataaatacagattggcctctttcagattatgtgcttcttaagccttttactgaggaacaatccttttcctttcccacagaaacccagagatgtctcggtaaaactatgatcccgaccttcatcgttgggatttgcgaaataatattcgtggagggagaaaaaggaatcgcacaaagacagtacaaatggaggcttcaatctcttctcattctctctaacatttgggaaccctatcagagcaaccagaggaagaaattgaggaatcctaggaacttgctagagatgctgctatcgctttttggaagacacgtgagtctgcttagaggtaagggatga

SEQ ID NO: 20377 - DNA, 567 bp, Glycine max
  Peptide Sequence Number=SeqID_137155
atgaccataatttgtctccgcgtgtcatcggccccgccgcctgtggatcacaaaagacgcagaatgaccataatttatctctgcgtgccatcggacatgattgtgtctggaaggcaaaaggtgagcggaatgaccataatttgtctccgcgtgtcatcaggcccgccgcctctggatgacaaaagacgcagaatgaccataatttgtctctgcgtgccatcggacacgattgtgtctggatgggaaaaggtgagcggaatgaccataatttgtctccgcatgtcatcgggcccgccgcctctggatgacaaaagacgcagaatgaccataatttgtctctgcgtgccatcggacacgattgtgtctggatggcaaaaggtgagaggaatgaccataatttgtctctgcatgtcattgggcccgcagcctctggatgacaaaagacgcagaatgaccataatttgtctctgcgtgccattggacacgattgtgtctggatgggaaaaggtgagcggaattaccataatttgtctctgcgtgccattggacacgattgtgtctgaatga

SEQ ID NO: 20378 - DNA, 405 bp, Glycine max
  Peptide Sequence Number=SeqID_137156
ggcaccattgttgatgactggaaatttgactattctagtcatgatgctcaccgtatagtttgtaatgaccaggttgaaataaccgcctctgaggaggacttgattttgatgtggggtttccttaccggttgtcagatcgactgggctcacttggttaggtatcgaatgcataaggcattacgggccaatgcacctcttccatatcctcaattggtcaccctttttctccgtcattttcaaattcctcttgatgatgaaccttttgttcaagtcaatcgatcctttgctataggtgctggtgcaatcacttcatttggttaccgtaaggatcgtaatggtcaatggctgaagaaggacgcactacctccgctagacgagcgtactccctctccttctcctcagtga

SEQ ID NO: 20379 - DNA, 135 bp, Glycine max
  Peptide Sequence Number=SeqID_137157
atggtagctttcaccttgatatggcagaggtttgagcaactaaagaatcctaggaaaaagagtgtgccacatactagtaattcaatgattaacaatgaagatcttttaaccatatacatatactttactaattaa

SEQ ID NO: 20380 - DNA, 493 bp, Glycine max
  Peptide Sequence Number=SeqID_137158
gggttgcatcagttacaatcccgttcttgccataagacagcttggctaccctatgagaggggcaccactaaaggaagaagagctcgcacctattattgcacgaggcagtaacaatgggcccatcggcggctaccataggtggttgaaagcccacatgcaaggtttggattggctcccgagtttgagaacctctaaagtggtggaagttgaagcaccggaggaagacgaagaggtgcaggcccttagggcagaactcgagaaagcccaaacagtcaaagaaaggttcaaatcagcagctcttaagatccgaaaggagaatgccgaactgagagacgtaaatatagctaacaccaaggccttggaacaagagaccaaaagggctcgaaagggaccaatcacgagtagacagtttgatcttgaaggatgggttaaaggtttgcctaaggtccaagagaagcttgtctcaatgtttatgcgagacaaagaccaacat

SEQ ID NO: 20381 - DNA, 648 bp, Glycine max
  Peptide Sequence Number=SeqID_137159
atggtgagcactctggactttgaatccagcgatccgagtgtcttccggacacgtgccgcagactacctcgtggagaaacaaaaccagatcgaaaacaaagtaaagcattgcgtctcaaccagcagaggtcaacagcgtcgaagtgcaatgacaccgtctcgccctgagggaaccgccttcgtgatcacggttaacccctgcgccaggcgtgagcgccacctgtcgccggctctcgccaccagtcggttgcgggtgatgcgtgggcgggcgcttgcctcaaaaaagggaagggtgttccggtaccgggaatcgaacccgggccacctgggtgaaagccaggtcgtggcgcagagacgcgcatcccgggcggcagcggcgcggggaggcgggcggcggtgcccggcggccgcattcaacttgtcaggatggccgagcggtctaaggcgccagactcaaggactctcccttgcccgatcgacccgggttcgagtgttctggtcctcgtctgagggcaggtcacggaactaccgcaatgacaagcagtaccaacaaaaagtattccgtccgctgactacccctggagggactcgaaccctcaatccccggtttaggagaccgatgccttatccattaggccacaggggccgg

SEQ ID NO: 20382 - DNA, 130 bp, Glycine max
  Peptide Sequence Number=SeqID_137160
atgggacccgcagcgatggttcggcgtggcacaccgccgcgacccgcgtcaagctatcctgcggccggcagctcgctcgcgcggctgacaacggctaccgcctgggtcatgcggaccccacatggccccg

SEQ ID NO: 20383 - DNA, 310 bp, Glycine max
  Peptide Sequence Number=SeqID_137161
atggccacaatgatggaggccatgatgagcatgaagaagataatggaggtcaatacggttacagttgccactgttagtgttgtttcggggaacaagcatgttttcccgccatatggtttgcctctgaactatactccacccaatgagaatgtcaataactccactcctatactcattgagagccaacaacctcaaactgatcatgcacatgtctctcaacccatgggggagacacatgaaatatcccatcgcaatctagcagacttcgagcctcacctcggatatgccactaaagggaaagcagttggtg

SEQ ID NO: 20384 - DNA, 2784 bp, Glycine max
  Peptide Sequence Number=SeqID_137162
atgtcgaaggaaactcgaacctccgctcgaagaaaccctcaaaccgaatcaaacgagaacgaattcgaaccatgccccccgaaccaaatcaacttcccacctccccgaacccccttcagctccatacctgacccctctcggttcggaaacgccactcccaggctctccgttaggttcgggaagccgcattccgaacctaactcggcgcagagcacgccttctagaaacacttccaggctttcactcggcggaggaaggttaagttcgtgtgcgttcgttaaagagaccgaattctgcgtccacgttccgcatttcgacctcaaagacgacccgtcgttctggacggatcataatgtgcaggtgctgattagaattcgaccgttgagtaattcggagaaggtttcgcaagggcatggtaggtgtttgaagcaggagagtgcgcaaactttggtctggctcggtcatcctgaaaccagattcacctttgatcatataggatgtgagaccttatcacaggaaaacctgttcagagttgctggagtgcccatggtggagaattgtttgtctggttacaacagttgtatgtttgcttatggtcagacgggtagtggcaaaacatataccatgatgggtgaaattaaggaaacagaaggataccttactgaagatagtgggataacaccaagagtttttgactatttgtttacgaggattaaagcggaagaagagagaaggaagtattacaagctgaaatacagttgcaagtgttcctttttggagatatacaatgagcaaataactgatcttcttgaaccttcatcaactaatctgcaactcagagaagatttgaagaagggggtatatgttgaaaaccttaccgaacatagtgtggacacagtttatgatgttctcaggcttttgttacagggcactgcaaatagaaaggtggctgctactcacatgaactgtgaaagcagtcggtctcacagtgttttcacttgtattattgaaagccaatgggagaaagattctatgacccactttaggtttgctaggttaaatttagtagatttggctggttctgaaagcttggtcataatgactttggtggacttagcccatgggaagcctaggcatgttccgtacagagattcaagacttacatttcttcttcaggattctttaggtggtaattcaaagacaatgatcattgcaaatgtcagcccatccatttgctgtgctaacgaaacactaagcacactgaagtttgcccagcgagccaagctcattcaaaacaatgcaaaagtgaatgaagatgcttccggtgatgtaagtgcactgcagtggcagattcaacagttgaagggtcaactgtcctttctgatgaacaataaaaaatttccaagctctgttccaaatttagagccaaatcctgaaagctgtaggttgagtgaagtgtcagaagaatatgaatctttgggagaaagagtaacaacagatcaccaactacttattccaagcaaagagaacaaatgcatgaaaactgctttggttagtgccctgaggagagaaaaaatggctgaaactacgatccagaatttaaaggctgaaattgaccacacaaattgtttggttcgacaaaaggaagaggaaattcaacatacttcaagtatgctgaggcattataaggagaaaattaaacaacttgagttattggtagatgggaaactgtcagctgagaagtatctaatggaggaaaacagggctttacaggaggagattcagttgcttaaagtgaatattgataaaaattcagaatcatccagacttgctttggagaatgatagacttttgcaacaacttcaactatttcaaaacttctatgagcatggagagcgggaaagattgctgactgaactatctgaattgcgtgatcagctccttgtccatctccaagaaaaatttacatactccatgaaaaatgaaaatcaggatactgatactgcacaagagttagaagagtgccagaatatgaattctaaattacttagagaagttggtatattacaagcaaatcttggaaaatatttgaactacaatcaaattctgaattcttcttttgagcatcctggtgaaattctaaagactgataaatgttcattggttgagacaatatcaatgagaagtgattctggagatgaaattccgtcctctacatgggaagctgatgatgctttagcaaatataattgaaggaaatgctttgcgatcctcaataatgcttgctaaagataatgaatataacaacgaagagttagaggccaaattggaaaaaatgagcaaggatcttgaagaagcgaggttagttaatgaccaatatcaagagaaatgggcattacaattatatcaaaaacgacagactgaaacaatctgtcaagaggttgagatggagacaaccaatacaattcttcatttacaggaagaggttgcccatcttcagtcagagtttgaagagaggttatgcaccattgctcaagaaaatacagagctaagaaatatggttgcagaaaaagaagaggaaattaggtcacggtgtttggactgggaaaaggcaatcttggaactgacaactttcctcctagaaggctccagatctctcaaagatgcctgtggtcaggccaatgcttggattagcgaacatgttgacatggcggtcaaaaagtatattgagaaggaggaaacaattcagcagctacaaagtagcttgaaggatgcacagaagatg

SEQ ID NO: 20385 - DNA, 588 bp, Glycine max
  Peptide Sequence Number=SeqID_137163
atgaaggctgaatggggaattgatcaatttattcctctgagagacttgaaccttgcctctaaaggttatctagtggatgatacgtgtgcttttggagcagaagtctttgtttgcaaagaaagaagcacaggcaaaggagaatgcttggtaatgatgaaggaagccattacatacaagtacctctacgagtttgacaatctaaagttggattcagaatgttataattccaaaccattcaatgctggaaactttaagtggaagataaaactatatcccaaaggaaaaggtgctgaattgggcaattatctttctctgtatctagccttagctgacccattagccctttctacttgttccaaaatatatgcacagataatattactcatacttgaccaaaagcaagccaatcatcactttggaaaagctaactactggtttagtgtctcaagccaagaaaatggtgcagccagatttatgcctatcaataacttcaccaaccaaaacttgggttatgtggtgaaggacagttgcttggtagaggcagagtctgatttggccaagactcaagttgatccaagaattgattaa

SEQ ID NO: 20386 - DNA, 3540 bp, Glycine max
  Peptide Sequence Number=SeqID_137164
atgaatgatgatattcaagatatttccattcctgaacttgatgtgcaagccagacttggaaattgtactatttctgagaatcaagatgttcaaaataatttgatactgaatgatcttatggctcaagttgagttaacaaaactagaggtactggagatggagaatgctgtaaaagcctcttttgttgatacagaaacacagatagaagctttccaaactggtgtttcaggcctttattctgcttacaggaacttgattcaggacattgtcaaggaaactcaggatacaaagaaagaaataagggatttaaagatttatcatagaagttccaagggttatagagtagactccttaacatcaaatgcaaacaaatgtaaggagtatgcaaaccagcatcacacactacatcagataaaagagcaacttgttgaagtgaatagaagattgaatgtcatagacaattttatcagagcagaaaatatgtctagctttcaactactggatgaagatctcatagatgctgatgatttgagcgctgatagttcttcagtctctgatttatcaactgaaactgacagctttgcttctggaagcaagtcacatgaatccacatatacttgcaactttaagttccctggaaaaacaactgaacaaattgtacacctaaaatccgaaagatgttctgtaattcaatctcatggtagttgcaaatcatcaaatacaggaaagcttgtggaaaggcgaattcataatgaagcagtagtgtgctgtctgagtaaagaattaaatgtcacatatgatagttttcaaagattgtatcttcgtttgtctgcactcctccaagaattggatgatggatcctgtttttacccaaaagaactgaaaaaggtggctccatatttccagttggagatgcagaaagacaaagcaggttgtgagaatgacaaagagatattgggttatatggaaattaagcctgatgatggcttcttgaccaaatttatggaagctcatgcaacagtgcaggaagctgatcttacactgcatgccttgacggaagcttatgaagattcaaaacagttgactgctatgtggaagcaagctggtgaagacttgatgattgagagagcgagcttggtagaagagattcaaaaactcaaattttcaatttttcataaagaagaagagaatcgattactgaaggaccacatacatttcagtttgatggatatgacaaattcagtttctatgctagaagagcatttcttgcaaatgcaaattgatgtggagaagaaattcttgacaatgtattctgatattcttgtgactgggcaggagatgctatactttatgcacaacctgaggtcatcagtagaagatatttgctctcaaatggtgggtgaagggtttatatcttttgttctgtacaattgctgtgtaacagagcttgtcagtaaatttgcctgcactagtgtgaaccgtgatttacaatcagccagaccaggggaattgcataagttgccacaaatttgctctagtgttgcagcgccagcaattagtacaggtaaagaaggtgcagagaaaagagatcaatgtgtgctaatccaaaaggtgcaagagcagccagacttgcccaatgtcaatgtattatatgaaaatatggctcttagaaaggagttagagaggaagcaagagctattagagggcttactttttgactttaggctattgcaggaacaggcttctaacagcaaggacattaaggatcagactgagaagttaatattttctctaacccaagttcggtatgagctagagattaaagcaagtcagcttgatgatatactggttcaaaacagaaaacttgaaggttctcttgctgacactgagaaggccttaactacatcaaattatgaccttcaacttgctaaagaatcaattgagaagctttctaatcaaaatgtggagttaagggagcttctgaaagaactatatgccaacaaaactgaagctgatgggaaattggaggaacataaagaggtgattagaggtttggaaaaagaaatttctaatttgacagcttcacaggaaaatcaatcacttgccttgtttgaaagcattgaggatgaactaaaccaggtgataatagagagagaccaactccatgaagaagtttgcgtcttgaatggtaagcttgagatggcttattccttggctgacgaaaaggaagctattgccatggaagcgcgtcaggagtcagagtctagtaagctgtttgctgagcaaaaggaagaggaagtcaagattctggaacattctgttgaggagcttgagtctaccataaatgttttagagaaaaaggtacatgaaatggatgaggaggtgggaagacatcggttaattagtgattcactgagaatggaactccaagctttgaaagagagattattgttagttgacaattttcccaagaatgcttattcagaaagcacaagtggtcaaactgatgagcatatatctagacaacccagtaaaatactggaacttcgcgaggcactaagtcggataaggtttcttgaaaaggaaaatgcagaacaagataaagagattaaaaagtgcaaagagtatatatctgaaattgtgttgcatgctgaagcccaagcattgcagtaccaacagaagtacaagtgcctggagtccatgttccatgaagtcaaaacagaagtgtcaaattcaacgtcaatggtatcagcatcagagaaaattgagaaaagttcagtaaggacaagaggttcaagctcaccattcagatgcatttcaaatattgttcagcagatgaatcaggagaaagatcaagaactgttagtgtcaaggctccgtgtggaagaactagaagcacttgcagctagccggcaaaaggaggtatgcatgctacaaacaaggctggctgctactgaaagcatgactcatgatgtcattcgggaccttcttggtgtcaaattggacattaccgactatgcaaatttgatagacgaaaaccaaattgtgaaattagtggaggaggctcatcatcatagagaagagttcattgcgaaggaaaaagagaatctcgatttaagactgcagataaatgatctcattgaagaaagagaatgctgcatatcggaactgaaaaccaaagaggcagatatacttgccactcagatagcaatgcagcaactgcaagagcgagatcaattgctttctgcacaaaatgaaatgttgaagatggacaagaccaatctcatcaggaaggttgcagaattagatgacatggtgaaaacactagttgggacacgaaatacccaacctgctccacagtcatcaaagactaaggcatgtctacttatctttttgtttttggacaagggtgcattaaatttgggtaacggtggatacaataaaaggttgtctttgtctcaacccgaacgacgcctttctcgttttaatgacgagccttctcgttaccgcaaatttgctggtaataattcgcaaggctaa

SEQ ID NO: 20387 - DNA, 183 bp, Glycine max
  Peptide Sequence Number=SeqID_137165
ggaaacagaaatcaacccagtagaggaaaaagcaaagcaaagcaacccagaggtgcaagatccgaaattgaggcaatcttaaagaaagagaaggttgcagcaacagagggaaagaagagtaccttgaaaggtagaagaagagcagaaaggggtagcgtgaacgaggagaggtgtggtggttga

SEQ ID NO: 20388 - DNA, 2997 bp, Glycine max
  Peptide Sequence Number=SeqID_137166
atggagaaactaactgataatggtgataatagaactcagttagctaagttagcttcaccaacgcaccaaaggaaagaccttgatcgttatatatgttttgcctgctacgaggatggagtgttaattttgacatcaaattgttattcctttttaccagctggatcactattcttgtttgatcgaaaagcacttcgttactttcgcaaggatggtcaccggtggaggaagaaaaaagatgggaagactgtaagagaagctcatgaaaagttgaaggctggtagtgtggatgtcttgcattgttactatgctcatggtgaggataatgaatacttccaacggagaagttattggatgcttgacgagcagttagagcacattgtccttgtgcattatcgtgaaattaaagagggctgcaagtctggcatctcacatttgcctgtagttccagtaaccctggttggtagttctcaaaatacttcagtgctttcctctaccaaaataaattcaccaatatctctagttcagacatctttcacatcaagtgcaaataaagtttatcagaatggacgagcctcagagcatgaggatgtcaattcaaagaatggtcctcaagcctcctctcatgctcagcctatcagcaattatgtacttcacagtgcaccttggcttacacatgaagctgcagggttttctgagttgttaaggaaccccttgatttcatcatggccatcttctttccctagctactctcctggtactggcttgtctccctggacctcaattcagaactctagcagaaacacaattaatatgcatgatggaaagcatcatgttgaagcctctgaagcagacttaactgttcgtaagctaagcaatgctgggttagattctgttcaccgaatgcaagatggtgtaattttcagagataggctcatcactgacatgtgcgtccagccagttatagatttgcctactgttaatcaggtgaaaaacgagcatggtctggattcatttcatgctcaagtccatgatcataatgatcatccagttgttgcaactactaaaatcctagttgaacaaaaacttcaagatggtggtttatacaatgatgaatcagaacaagttgaatatggagaaatgaagaaacttgatagttttggaaggtggatggataaggaaattggtggagactgtgataattccttgatggcttcagattctggtaattattggagcacacttgatgctcatagtgaggataaggaggtatctagtttacgccacatgcagttggatgtggattcattaggtccttctctttcccaagaacaactatttagtatccatgacttttctcctgattgggcatatactggagttagaacaaaggttttaatagttggcacatttctggggagtaaaaagccctctagtgagaccaaatggggatgtatgtttggtgaaattgaggtttcagctgaagttttggcggataatgtcataaggtgtcagactcctttgcattcacctggacgtgtaccattctatattacctgcagtaataggttagcctgcagtgaggtcagggaatttgaatttgatgaaaatccaaccaaatttttaggtcctgagggtattaaaatctcaccagaagaagaggtacgacttcaaatgcgacttcttaaactagtagacttgggacctgacaataagtggttgaagtgctccgtttcagaatgcgaaaaatgtaaactcaagggaacaatgtattccgtgagagatgatagtggagtatttgaagaaactttccagattgatggaattggtcatataaaccatagagatatattatttcagagattagtgagagacaagctttatgagtggttgatatataaggttcatgaaggaggaaaaggaccacatgtgttggatgatgaaggacaaggagtaatacatttggcagcggcacttggttatgtgtgggctatggccccattagttgcagctggtatcagtcctaacttcagagactctcgtggaagaacaggacttcactgggcatcatattttgggagagaagaaactgttattgtgctagttcagttaggtgcaaccccaggtgctgttgaggatccgacatcagcatttcctcgaggacaaacggcagctgatttaggttcaagtagaggacataaaggcattgctgggtatttggcagaggcagatctgacaaatcaattatctgtattgactgtcaaggaaaatgaaactggcaacattgccacaacaatagcagctaacagtgctcttcagtctgttgaagatgactcatctagtatgacaatggatgagcaacattatctcaaagagtcacttgctgtgtttcaaaaatcagctcatgcagctgcttcaatcctagcagcctttagagcaaggtcattctgtcagagacaattagcccaaagtagcagtgatatttctgaagtacttgacgtagttgctgattctttgagcaaggtacagaacaagggtcactttgaggattatttacattttgcagctttaaagattcaaaagagatatcggggatggaaaggaagaaaggattttttgaagatacgtgaccgcattgtaaaaatccaggctcatattagaggacaccaagttcgtaagcagtacaaaaaagttgtgtggtctgttagcattgtggaaaaagcaatcctgcgctggagacggaaaggggctggtctgcgaggattccgggttgggcagccagttggtgttgtggttaaagatgccgagaaaagtgacgagtatgaatttcttagcattgggaggagacaaaaatcagatgatgtaaagaaagctctagatagagtcaagtccatggttcgtaacccagaggcaagggatcagtatatgaggctcatcatgaaatatgaaaagtttaagattgatgatggaggaagcagtcaatcacagcatgtcggttag

SEQ ID NO: 20389 - DNA, 341 bp, Glycine max
  Peptide Sequence Number=SeqID_137167
atgactttcaaggaggtcaccaatcctagtactactctcgcccaagcacgcttagcgtgcggagttctgatgggatccggtgcattagtgccggtcacccatcctagtactactctcgcccaagcacgcttaactgcggatgctggtatgatcgcacctgataagtattgcacaatcaattactatattccttctgcctacccagacgggccgactttcgatcgggtcgacggtctcgataagcctgatgcgacgcagacacatgccgactcttgtctctccccgaaatcagtcttcttgtcatacctcagcaaaggcacgcagaaacagacgccactcag

SEQ ID NO: 20390 - DNA, 620 bp, Glycine max
  Peptide Sequence Number=SeqID_137168
gtcaacacgtccacctcttcaaaaggctacactccctcgccttcagaggacaacacatcctcgccttcacaggactgcacgtcctccttttcagagggctacacgccctcaccttcagatggctacaggccctcatcttcgaaggactacacgtcctcgcctacagagggctacaagccctcaccttcagaggactacacaccctcagcttcagtgggctacacatcctcgcctttagaggagtacacgccctcgccattagaggactacacgtcctcgcctttagagggctacatgccctcgccttcagaggactacacgtcctcccctttagaggactacacgccctcaccttcagatggctacacgctctcaccttcagatggctacacgccctcacattcagaggactacacttcctcgcctatagagggctacacgccctcgccattagaggactacacgtcctcgccttcagaggactagaagtcctcaccttcagaggactacacgtcctcaccttcagaggactacacgtcctcctcttcagagggctacacaccctcaccttcagatggctacacgccctcacattcggaggactacacatcctcgcctag

SEQ ID NO: 20391 - DNA, 228 bp, Glycine max
  Peptide Sequence Number=SeqID_137169
atgagtatcaaaggtggtgccggtggagctggcggaggagatagtatctcaacctccggagaagcaggtagctgccccctgaataagctctgcaacataggaattatgggtggtgcttgttgggcatctggttccatggttgctgtcagaggagatgggttgaatgatgaagggatgtcttcaactcttgctctctttcttgaggcaatctataagaaaagaatgtga

SEQ ID NO: 20392 - DNA, 168 bp, Glycine max
  Peptide Sequence Number=SeqID_137170
atgacaaaggtgaaagcaagagccatttctaggcttggaggggttgatggggacccggtgctgagaggagcgaggataagggctacatgggaatgcgtgagctcagttgaaaggtgggcaactgaggatggtgtgtttatgtttgacttgtggaagtgggagagttga

SEQ ID NO: 20393 - DNA, 693 bp, Glycine max
  Peptide Sequence Number=SeqID_137171
atgtatgatagcacggaattcccttttgaatgcaagaaatggccccgaggaagcttgcctcaaagagatctaggaaggataaagcggctgaaggaaccagttccgttcccgaatatgacagccaccgttttaggagtgctgagcaccagcagtgctacgaggccatcaagggatggtcagtggatcccgttcgatgcggatgctctcagccagttcctgggataccctttagtgctggaagagggccaggaatgcgagtatggccagaggaggaaccggtccgatgggttcgatgaggaggccatcgcccagttgctatgtataccggggcaggattttgcccggacagctgctggaagacgggtgcggatcatgcgcaccaacatgaccaccctgactcagatctggatgactttgctgctcagcaacatccagcccagcgatcataattccgacctccccctgccaaagtgtcagctggtgtacgccatcctgacacggatgagcattcacgtggctcagttaatcgctgatgccatctatctatttgcaggtatggcgcctaccaggcaccctctggacccggataagtccaacagggacctgggatttcccgctttgatcacaggactctgccagtcgtttggagtccccgtcgcacctaacaaagtggttcggccgcccatcacctga

SEQ ID NO: 20394 - DNA, 201 bp, Glycine max
  Peptide Sequence Number=SeqID_137172
atggataattatgaatgttatgaagaatttgatagggaagttcaatggcaaaaagaaggagattcgttagctcgttatttagtagttttagcgaatgaggtcccacgagaggttgaactcgaagtacttgtcgatgatgtcgagcatgaggttgaaggtgttggtggagtgatgaaagtagggaggaactcttggacctag

SEQ ID NO: 20395 - DNA, 339 bp, Glycine max
  Peptide Sequence Number=SeqID_137173
atggcttgtacaagtggagatcctactcaaccatccccaaaaactgcaaggcttatggcagagattattaaacttggtgatcaaatgagaagaatgagttgtgaaaataaagaaaggatggagagaatgagaaaggagaatgaggagaaatatgaggggtatgaagatgatgagggaggaaggataaatgagaggtataaggagagaagaaatcatagaagatatggaggtaggcaaagagaggaagagatgaaggtcgagcaagtctatgcttgctacaactacaatgaagagaaaaagatcaaattggcctccctagagtttgaggatatgccttag

SEQ ID NO: 20396 - DNA, 603 bp, Glycine max
  Peptide Sequence Number=SeqID_137174
atgaaaagcccttgccaccgagcgatccgtccggtgagagtgggattttcaaaaatatacttgacttggtccatcttggatactgttgcaacctacccttcggtgggagggcgatgcgaggctcatgggtgcgtcttccaagaaaggaatacgtgctccaccaacgtttattcaaggaaaacgtcggaaaaaccggaaaaggaaaaagggggaggaggttgccgcccagctcgcccaggcgaccttagctcgcccaggcgagctgggttgctacctcctcaccctttttcctataaaaaggctgtagggggcggttcaaaggatccctcagccccctggctatgtatttcagctgtgttgggtgaaaaaaattgtttccgtgaagaaaatccaagccgaggtgcttccgtaacgcttccgagatgtttccgtaagcaaatccgtgaaggtttttgtccgttcttcatcgttcttcatccgttcttcggtcttcaacggaactacgtaggtctgatttcctcctcgcaattgaggatacgtaggagctataagccccgcttttgtcaaccaccccaagagatcgttaatggtccaatgccttaa

SEQ ID NO: 20397 - DNA, 534 bp, Glycine max
  Peptide Sequence Number=SeqID_137175
atgcataaggcattgcgattgaatgctccattgccatatccacacctagtcacccttttccttcaacactttaacatccctcttgattctgaaccctatgttccaatcaagagatcctttctaataggaacttctgtcattgcatcctttggttatcaaaaagagcatgatggctcttgggtgaaaaagggtgctcgacatgttgatgaagaaggacatggtggagaagattcatctcttctttcaaagattttggataggttcgatggtcttcaaacctttgttggtgaaagaagttgtcatcatcaaaaagggggagattgtagaagcaagcttcatgatgaatcaagaccgattcaaagagtcttgatgataacaaagatgatgacaaaaagcaaagctcaaaagtcaagaacacttcatgataacaaagatgatgatcttcaagaatcaaagaatgagttcaagattgaatcaagaacacttcaaggttcaagaggaaatttgatttcaagaatcaagaatcaagtttaa

SEQ ID NO: 20398 - DNA, 564 bp, Glycine max
  Peptide Sequence Number=SeqID_137176
atgcaggaacttgccggccatttggcacacacccttcgcacgctgcgcgcgcagcgcggctggagcctgacgcaggcggcggaatacaccggcgtcagcaaggcgatgctcgggcagatcgaacgcggcgaatccagcccgacggtggcgacactgtggaagatcgccaccggtttcaacgtggcgttctccgcctttcttgaggcgtcgcccgcgcagcagcaggcgacgctgcaccgctacggcgatctgccggtgtacgatcaggacaacgccgatatgcgcgtggtgccgctgtttccgtacgatcaccagctgggtttcgatatgttcgtcatcgatcttgcaccgggcgcgctcagcgagtcgtcgccccatgagccgggcgtgatcgagcatgtcatcgtgatcagcggccggttggagttggcgatagacggcgaatggcacagcctggctgccggcgaggcgatgcgctttcaggccgatcggccgcacgcttaccgcaacgccagttcacaaacggtgcgtatccacgatctgatccactatcctcaatcctga

SEQ ID NO: 20399 - DNA, 219 bp, Glycine max
  Peptide Sequence Number=SeqID_137177
atgcccggtttgaatcttgacattgtacaacatcggttaccgctgaatcccagttgttccccggtaaaacaaaagataagaagaatgaagcccgaaatgtccttaaggattaaagaagaggtgaaaaagcagtttgacgttggctttttggctgtggctcgataccccgaatgggtggccaagatcgtgccagtccctaagaaggatgggaaagtatga

SEQ ID NO: 20400 - DNA, 333 bp, Glycine max
  Peptide Sequence Number=SeqID_137178
atggtggtgagcttgttcttgactcatcttctccttgaagtggcattcccaatcatctttcttcattctccattccgctgccatgatcttcaagaagcaaaggactccattgatgaagaatatccaaggcttacaagctccacaaggagctacgtcaccccagcttcgcttttcttccttcttcctcttctttctctctttctctttctttttccaacttctgagcccttaaacccctcccccagcatggctatttataggaaaaagccattttggagcaggggaagctcgcccaggcgagctggagctcacccaagagagctagttacttag

SEQ ID NO: 20401 - DNA, 315 bp, Glycine max
  Peptide Sequence Number=SeqID_137179
atggataagagcttgaaggtaggagaagatgagtggagggagagggagagaagaggcacaaaattttgtgcctcaaatgagcatgaaggacatgcacaagatcctaatgagagagtgtaccacacaggctatgacagttataacaacatccttctctttatacatacttatacacacaacaatcctatgaatcagtcacacatccatgctcaagacaagaaggcagaaatacacacaatgtgtgacttaacgtcactccccgaaacctacttccaagtttcagagatacacagcattcacacagcaagaccataa

SEQ ID NO: 20402 - DNA, 552 bp, Glycine max
  Peptide Sequence Number=SeqID_137180
atgaccaaggagttcctcttcttacaaaagcctctccttctggaaaaggctatacagcttttgtcctgttatcaggaccgcataaaggtgtttataccaatttcaaagacctttgccttgcaaaggagggtattcaaagcccaatctacaaagccaagctagacatggaccagtttaaatctttcggatatgaagacttagcaattactgcaaaatgtctattggactacggatgtttggaatcaatcctgattccttcatctgatagattcgaaggatttaatccgtcaatcaatgaggccataaacttaatccaggcagaaatgatggactacattgccatcaagataactacctgcccgagcaacttcactgctcagaattatccttgccatgttatgaaactcttaccagaggatcatagagattatccctgcctattcaatgatgagtatgagagctgggatgtacaaggcaatacacaataccagtacaaccttatgagggcacaaattcagggctatcaatggttcttctcagaagaagacaaac

SEQ ID NO: 20403 - DNA, 724 bp, Glycine max
  Peptide Sequence Number=SeqID_137181
tctcgagggaccttcacctaaacaagtcagaattcggggccacttaataaggattgatgcagacagcctcaatgcttttctagaaacacctgtggtgcttgctgagggtcacccggggaagatcctcaaaaaagatctaaccacccttgctcaggtctggagtgttctatcctactccaacctggctccgacctcccacacatcagatctgactgtggatcgagctaggttaatctttggcctagttactcaactggacatgaatgtcaaagccctcatttctgggcagattacttctatggcccagtctaactcctctagactcagatttcctattcttatcacagctttatgtaggaccagaggagttgccttcgatagtcttatctttgcttgtttgagcccggtcattaatttggcctacataaggaagaattgttggaaccctgatgatccaacagttattattaggggggccagaagaccaagggcaaggccagctgagactccttctacatcaacagctcctcatccagcttctacatcagcaactcctcttctagctcgtttgacagcagctccttctaccctacctcctatagattttcaacatttcaaagccatgcttcaaagcatacatcaggggaaaattattttgctccaaagtctccagctggtagcacctccaaactccatccctacagtagagcaatttaatgaatgg

SEQ ID NO: 20404 - DNA, 191 bp, Glycine max
  Peptide Sequence Number=SeqID_137182
atggggtgttgtgacgggggtgtcaacacccttgtgaagatcattgcgattaccggtcggagttccttcctggaggaatcaggggcgagcttcagggccggattacaggcaaaaaaaatccccgccgaagcgaggagttttttcggtggtgcccaggagaggactcgaacctccacggttttaccccgcta

SEQ ID NO: 20405 - DNA, 311 bp, Glycine max
  Peptide Sequence Number=SeqID_137183
tcgctggaattgcagcgcgaggagctggtgcaggctttggggctggccttcactgtgtcgacgatttcgctgaccaccggcctggtgctgcatggcgcattcggcatccagcagctgaggctgagtgcgttggcggtgctgccggcattgctgggcatgtggctggggcaggtgatccggcagcgcatcagtgcacgggtgttccgggcttgcttcctgggtttcctgctgctgctcgggctggagctggtgctgcggccgttgttgtgatgccggccgtcgatcgcggcgatgccgaatcacgggcatga

SEQ ID NO: 20406 - DNA, 747 bp, Glycine max
  Peptide Sequence Number=SeqID_137184
accaatgatgacaagctttcctggcctcgccgaatcatgactcttgacccatctgacattgtttggtaccaagcggctagtgatgtcggagagattattgtgggttgtggtgaatatcccaacgtacctcttttgggtatgcgtggtggaattagctacaacccgcttctcgctcgacgaaaattcgggtacccgataaagacaaaaccaaacaaccttgccttgactaatgaattctatcttaaccatggagatcactcgaacaaaagggaaagattcgcacaagcttggagcgctatccgcagactcaacagaagtcagttgggaaagaaatcagactatgtgcacgaatcttatacccagtgggttattgataggaccaagagctttggcctaccctaccgcttacctagatacctatcgtccaccatcccaccatcatccttgcctatccccttcgatactaaggaagagtttcatgaacaattaaccaaagaaaggcaagaaaaagaaacttggaagaggagatgccaggagctcgagcaagagaatgagactttgaaagggaagatagcccaacagagccgtgagctttttatccagaaccagaggatgattgagaaggacgacttgcttcgtcggaaagacgccttgctccaccgagatgctagaaggaagaggaggtttatggatttgttctcccgtgcacattcagattccgaggacccatctactccgggagtttga

SEQ ID NO: 20407 - DNA, 147 bp, Glycine max
  Peptide Sequence Number=SeqID_137185
atggatatagttgaacaagaaaatcagagtctcagggaggaggttgccactttacgagagggaatggataggttgacgactatgatgagtgcactcctatccgcccagaactctcaagctgccgccgctgctgtagagcagcctttg

SEQ ID NO: 20408 - DNA, 348 bp, Glycine max
  Peptide Sequence Number=SeqID_137186
atggatgagtttagggtttgcctaaggtccaagaagagcttgtctcagcggttatgcgagaccgaaaccaacatgttagccatcatcagcaagtaccaagaagagttaaatctagccacggcccacgagcacatagtagtggacgaatatgcccgagtgtacgcagaaaaggaggctagaggaacggtgatcgactcgttacatcaagaagcaacgatgtggatggaccgatttgctcttacattaaacaggagtcaagaacttccccaattgttggccagggccaaagcgatggcgaacgcctactccgcccccgaggagatccacgggctcctcagctattgttag

SEQ ID NO: 20409 - DNA, 165 bp, Glycine max
  Peptide Sequence Number=SeqID_137187
atgtcgacttacgtacgtctcgttgaccaaacgatcagtctcaacgtcctcgttgagagtcgctctgcgagacgtccagtagtctctgacttggtcttagaatcgccagtttcagcccgttcccagcttgcctcggtctcaggttggcccttctactttgactaa

SEQ ID NO: 20410 - DNA, 603 bp, Glycine max
  Peptide Sequence Number=SeqID_137188
atgttttttctatacggatttggaggcacaggaaaaacattcatatggagaacattaacaagttcattgagagcaaaaaatcagattgtaatcattgttgcttctagcggaatagcctctctattattaccaggaggcagaactgcacattcgagatttaaaattcctgtaccaatttttgaagactcaacatgtaatatccatcaaggcaccgaattagcagaattattgaaccagacaagcctaataatttgggatgaagcaccaatggcccacaaattctgttttgaagcgcttgatcaaagtttaagagatattatcatagataaatcaaagtcaaatcaaatatttggagggaaagttatagtattttgtggagatttttgccaaatactatcggtcatcccaagaggaacgcgctcagacattgtaaatgcagcaatcaattcatcctatctatgggattcatacattggagatggaattatagatgatgaaaatgatggttatgctacaattcaaattcttgctcatctactcatcactcaatatgatgatccaatcagtgctatagtcaaatcaacattcccagacttagattag

SEQ ID NO: 20411 - DNA, 246 bp, Glycine max
  Peptide Sequence Number=SeqID_137189
atgtcgagccgacggggtcaggtaccagtagtgacaatggcaaaggggggggagctggacactgctgaaccggaagagattgctcaggatgagtgtctggcgctctcagaaagcggatcaaaggcttcctattcaacggattcggattattctactttagatgcttcggatgcttcctcggccgcgcagtacgtacttctgtttggagagtctgttccttacttagctaggactttgagtgactag

SEQ ID NO: 20412 - DNA, 99 bp, Glycine max
  Peptide Sequence Number=SeqID_137190
gagaggggtgaagcttgcttacttgttagagtaaggggaaagggctttcgaaagctcaatcccttgcttgttgttttcgagccggagctcgctgggtag

SEQ ID NO: 20413 - DNA, 234 bp, Glycine max
  Peptide Sequence Number=SeqID_137191
atgggggataagcttcatcgtcgagagggaaacagcccggatcaccagctaaggcccctaaatgaccgctcagtgataaaggagagggaaggacccgcgcgagcagtgctggacgaagcggaagcgagaaatgtcggcttgagtaacgcaaacgtttggggagaatccaatgcctcgaaaacccaaggggttcctccgcaaggtccgtccacggagggtggagtcagggcctaa

SEQ ID NO: 20414 - DNA, 468 bp, Glycine max
  Peptide Sequence Number=SeqID_137192
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtattctcggagaaatggaggttgatgaaccttggatagggttatggctaccattgcgttatcaagtagatatgggagcaagctttctcgctgcaaaattcacttcttggttggtgtttttggtttgtgctaaaggtggtgttcgtcattggaagtgcggtagacagactttgtggaatggcagtcacaacatgggcttctcccttattctcaccctcttcatttgccccagttttctcattcgtccaagtgggatgattaaatttgcctcttttcagacccgctttgatccttccgctggcgaagtccaaatccgcaaagcttga

SEQ ID NO: 20415 - DNA, 861 bp, Glycine max
  Peptide Sequence Number=SeqID_137193
ctcaccttcagaggactgcatgtcctcgccttcagaggactgcacgtccttgccttcagagggctgcatgccctcacctttagagggctgcacgccctcaacttcagaggacttcacgtcctcatttgcagagggctacaccccctcatcttcagaggactacacgtcctcactttcagagggtggcacgcccccaccttcaaagggctgcatgccctcacctttcgaggactacatgtcctcaccttcagagggcttcacgtcctcgccttcatagggctacatgccctcaccttcaaaggactgcacgtcctcaccttcagaggactacacgtcctcaccttcggaggactacacgtcctcgccttgagagggctacacgtcctcaccttcagagggcttcatgtcctcgccttcatagggctacatgccctcacctttagaggactgcacgtcctcaccttcagaggactacacgtcctcaccttcggaggactacacgtcctcgccttgagagcgctacacctccttgtcatcagagggctgcatgccctaaaccttcagagggttacatccactcaccttcagaggaccagacggctacacgccctcacctttagaggactacacgtcctcaccttcagagggtcgcgcaccctcaccttcagaggactatacgtcctcaccttcggaggactacacgtcctcgccttaagagggctacacgtccttgccatcagagggctgcacgccctaaaccttcagagggtgacatcccctcaccttcagaggaccagacgtcctcgccttcagaggactacacgtctacaccttcatagggctacacgccctcacctttag

SEQ ID NO: 20416 - DNA, 198 bp, Glycine max
  Peptide Sequence Number=SeqID_137194
atgaaggctgatatggaggccatgaaggaacagatgacgacaatgatggaagcaatgatgaacatgaggaagatgatggaggataacactgctatagttgttgatgcgagtacttctattgagatggacctgattcacccgactggttttaatcaagtgaatcatccagtctcagatgtagtaggtcaaggagatgag

SEQ ID NO: 20417 - DNA, 324 bp, Glycine max
  Peptide Sequence Number=SeqID_137195
atggtgggttacacaccttcgagctttgcggatttggtcttcgctggcgaaatgatcgaagtaggtctgaaaagaggcaaatctgatcctcatgctttgataaatgagaaaactgaggcaaatgaagagggtgagaatgaaggagaaacccatgctgcgactgccgttcctacatggccaagtttcccaccaatccaacaatgtcatttctcagtcaataacaaccattctccttatccaccacccagttatccacaaaggccatccttaagtcaaccacaaaacccacctaccacacaaccaatgcccaaacaccacccttag

SEQ ID NO: 20418 - DNA, 328 bp, Glycine max
  Peptide Sequence Number=SeqID_137196
gcttttcgtcttacagacagcaaaaaagaatgtttatacggataaccactcgggtatctccgcccgtcagcgtgactcaaatgtcagtatgacagatcttgtgagcgcggaagatgacgtaaatctccgcgtgtcaacgggcttgtcggccgcgattgacgaagggcttttcgtcttacagacagcaaaaaagaatgtttatacggataaccactcgggtatctccgcccgtcagcgtgactcaaatttcagtatgacagatcttgtgagcgcggaaaatgacataaatctccgcgtgtcaacgggcttgtcggccgcgattgactaa

SEQ ID NO: 20419 - DNA, 789 bp, Glycine max
  Peptide Sequence Number=SeqID_137197
atgactcaatctcttgctttctcaaaagggtggacccttggagggttgcacgccctcaccttcagagggcttcacgccctcgccttcagaggactacacgtccttgcctttagaggactgcacatcctccccttaagaagaccacacgtcctcgccatcagaggactacataggactaaacatcctcgctttccgaggctacacgctctcaccttcagagggctacacgccctcgccttcagggggctgcacgccctcaccttcatagggctacacgccctcaacttcagaggactacacatcctcgccttgaggactacatgtcctcaccttcagacgactatatgtcctcacactaagagggctacacgccctcgccttcagaggactacacgtcctcgccttgaggactacacatcctcgcattccgaggactacaaggggctgcacgcccacaccttcatagggctacacgcactcaacttcaaaggactacacgtcctcgccttgaggactacatgtcctcaccttcagacgcctgcatgtcctcacactcagagggctacacgccctcgccttcagaggactacacgcactcgccttgaggactacacgtcctcacctttagagggctgcacgccctcgccttcagaggactacaagtcctcgccttcagaggactgcacatcctccccttcagaggactacacgtcctcgccatcagaggactacacgttctcgcctttaaagggctgcacgccttcactttcagaggactacacatcctaa

SEQ ID NO: 20420 - DNA, 177 bp, Glycine max
  Peptide Sequence Number=SeqID_137198
atggcaatggaggatttccgtgtgcaacaatccgaagtttactttgaacctttttctcacgcgatggtggggtctttaactattcacgcaagtctagctcaaattaatgtgcggccgatttcacattccatctcaacaccaacaaccaaatatgggaaaaagaaaaaaggcatctag

SEQ ID NO: 20421 - DNA, 198 bp, Glycine max
  Peptide Sequence Number=SeqID_137199
atggaccttgaaagtgttgtattattctatataattaagcgagcaaatgagaccggggaggatccattgatgttgagcaaccgtttttgtgatgaatataatgctgatatggctgatctccagtgcgagacaccatctagggaacctcgtgtttctgaacaccttaacgagataaaggacatgataacccaggtttaa

SEQ ID NO: 20422 - DNA, 309 bp, Glycine max
  Peptide Sequence Number=SeqID_137200
atggctgagaagacaaagaaaagactggaagaagctgcccagtccagaagcactcaggccatcattgaccctctatctcccatcagatgccacgtgaagtggaagttggcccgcaccaagaaaactgggcagatgacgtctgaggcagcaaaggaaataactgagaagattgcgtcacagggattgttcgtgccccatggacgtcaagatgccctaactgctgccattgggcgaccagagcaccctggccaggtccgtgctgttggagctggtgtcacgataaagcaatacttcggatcagctccatga

SEQ ID NO: 20423 - DNA, 693 bp, Glycine max
  Peptide Sequence Number=SeqID_137201
atgtcgtcgacgcgctcaaggagcgcgcccggcgcaattcccgctcgatggaagccgaggtgcgcgatgtgctcacgcgcctcacccaggagaacgcgagcggcatcgagtcacacctggaggcgcgggtccgcggcaggcggcgctggtcggtccccgccgtcgagatcatggcaagagtcgaagcgaccccgtccacacccgatcaggacgcgatgcgggaggaatgggtggccgagttggatgccgaccggcaggatccgttcttcatcgatgggttctcggacccgtgggagagccgtgatccttcttgacacgaacgtggtcatccggctcgacagcgtgctgctgcctccggatgacgtggggctgagcgcgatcgtgtacgccgagttgcagctgggcgtcgagcgcgctgccgatcgcacactccgccgacggcggcgcaacgagctcatgcggctgtccgctctgctggaggccgactggctcccgttcgatcaggcggcggccgagggatacgcgcacctggcggcagacgtgatccgtgctcgtccggcccatgctcgcagcaaggacatcatgctcgccggacacgcctatgctctcggcgcccggctgctcacgttcaacccgaaagacttcgagctcgtgtcgggcgaagtcgagatcctcgttcccgacctgcgctga

SEQ ID NO: 20424 - DNA, 549 bp, Glycine max
  Peptide Sequence Number=SeqID_137202
atgcactatatcatagttagaattttgcttcctcgttcttctaatttggctcaagcctctgaggaggacttgattttgatgtgggctttccttactggtcgtcaaatcgactgggctcacttggttaggtaccgaatgcataaggcattacgggccaatgcacgtcttccgtatcctcaattggatcgtgatggacagtggctgaagaaagacgcacaacctctacaagacgagcgtactccctctcctccacctcaacgagatgattcctcagcccttatgaatgaagttctttcagaattacggggcctccgtacctatgttggcaaacgctttgattcctcagatggtcgctttgaaggaatggatacccgcatcactcaacttaaagaggatgaattaaattgtcatcatcaaaaagggggagattgtagaagcaaagactttgactttgatgttttgattatgccatgtgatcatgcgcttctcaagtttaattcaagacaaaaatccaagaaattcaagatacatcatcaagaagatctctag

SEQ ID NO: 20425 - DNA, 745 bp, Glycine max
  Peptide Sequence Number=SeqID_137203
gaaagaacgcgctttaggatgtccttacctaacgcattccagagctagagtaatgagtgaaatagaggaagttcaggagcagatgagggttgacatagaggccatgaaataccaaatggccgccatgatggaggcaatgttgagcatgaagaagataatggaggtcaatgcgactgcagttgccactactagcaccgctgctaaggtggatccgactcacccgtctggcgtaaatcaaataagccatccagtccccgatatggtaggtcagggaggagaagcattgggaagtatagacagtccccatgttgtgcaaagcaagaactctttcccaccatacggtttgcctcccaactatgcaccacccgatgttgcacacactcccgatgagaatgaccacactttgaccgactttgagccttaccccggacatgccactgaggggcaagcatttgtgggaagagtcccttttgccatggttgaaagggaaaaattcaatcatatagaggaaaggctgagggccattgaaggaggcggagatcatgcttttgctgacatggaagatttgtgcctagtgcctgatgtcgtcatccctccaaagttcaaggtgccagatttagacaagtataaagggaccacttgtctcaagaaccacttgaagatgtactgtcgaaagatgggggcatactcgaaagatgaaaaattgttgatgcatttcttccaggaaagtcttactgggctagct

SEQ ID NO: 20426 - DNA, 174 bp, Glycine max
  Peptide Sequence Number=SeqID_137204
atggctaccattgcattatcaagtagatatgggagcaagttagcatatgacaccggaatttggggctttgtggttgatttagggatggcctttgtggataactgggtggtgggtaaggaggtgatccacttcgatcctttcactggcgaagaccaaatccgcaaagctttgagg

SEQ ID NO: 20427 - DNA, 246 bp, Glycine max
  Peptide Sequence Number=SeqID_137205
atgaaggtagtgattgctttgagtaacaaggatggctacagtggtgggtataatccacacaagatcactgggcatactaaaaaggctgaaaataacttgtggacatatcataatctattcttgttgatgcaatcctaccccgcaagggcattggatagaaaactccaagtagattgggccagagatgcaagagaaggccctagggttcttatgagccttagggtagattttgggcccatgggctaa

SEQ ID NO: 20428 - DNA, 1590 bp, Glycine max
  Peptide Sequence Number=SeqID_137206
atgtcaaacatcacaagttgtgatagtgggagcttctctacagagaataccagagaagatgcagtagttaagcagcaacctgagatacttggtcagttccatagtccacattctcatacttcaactacaacaacaacaaataatagcaatggttccaacacagactcacaatcacctgcacctgttaagaagaaaaggaacctaccaggaaatccagatccaagtgctgaagttattgctttatcaccgaccacactaatggctacgaacaggttcatatgtgaaatctgcaacaaaggatttcaaagagaccaaaaccttcagttgcaccggcgaggccacaacttgccatggaagctcaagcagagaaccagcacagaaattcgaaagagggtttacgtgtgtccagaaccttcgtgcgtccaccacaacccagcaagagcactcggtgatctcactggtatcaaaaagcacttctgcagaaagcacggcgagaagaagtggaaatgtgataagtgctcaaagaaatacgctgttcagtctgactggaaagcccactcaaaaatatgtggtacaagggaatacaaatgtgactgtggtaccatcttttccagaagagacagcttcattacgcacagagcattctgtgacgcactagcggaggagaacaacaaagccaacgaaggacaattgccaaagataggtccaaacttgcaatgccaacaaatcccaaacctcgtttcatcatcattaccaatcaacaccaacattgttcccaacccacaaatgggtggcacctcggagttcaaccatgctgatcacaagcacccactatcactcccacacgagctcatgccaatgcctgcacaaaaatccttcaacaacatggctgcaggaacaacagtgttcacgagaagcctctcatcaacctcctctccctctcttcaactaagctcaaacatgttcgaggaaaacgggctccaccttgcagcagggtcgccacacatgtcagccactgcgttgttgcaaaaagctgcacaaatgggagcaacagtgacagaaaaaacctttgtaacaaacatggcaccaccatcgtttggtgtgctgcaacagcatcatcaacaaccaaatggacaacccttcatgaaccaatacatgcacagtggccagcaacaacaagatgttaacatttctgctcagtataatagtttcggtgcaaatgggatgggtggagggagcgttgggatgaacggtgtggacatgttcaacgctattttggaccaaagcaaggctttgtcgaagatcatggagcaaaacaatagaagcagtagtggaggaccaacaaatggaggttcgaatagtagtgctattaacgttgctggaagtaaaggaggtagtggggatgttatgactcttgactttttgggcataggaggaggaggaggaggtggtggtggtggtggggatgcacatggaaatttctatggtggtgctcaacaaggggaaactggtgcaccggacgtggtttggagaaactggtctagtaagaacgcagggtttgaatcattttcagcaacgagcagcatttga

SEQ ID NO: 20429 - DNA, 1017 bp, Glycine max
  Peptide Sequence Number=SeqID_137207
atgatgcaaaaagataaagctaataaggaatcggaggcaaaagaatcagacagggatcctcaaatatcttcaggggggagttcacctgattccttacttggtacaaaaagtagtggactggaaatggactcaaaccagaataagtcaatcatggatcaagggtttgaaatttattctagtgctgaaggtaatacggccaattgtaaacttccgttcacacaaaatggagatgtctttgagaaaacacatcctggagttctttgggatgtttttcgccggcaggatgttccaatattgactaaatatttgaaaatacattggaaggaatttgggaagtcagatgatctaggaaatgaatttgttgaatggcctctttatgatggagctatttttcttgacaagcaccataaaagaaagttgaaggaagaatttgaggggagggatgttaaaaattattgtttggatgttttaagtaaaggaagtgagtggagttcttgtcctagttttggaggagtggagccttggtcatttgaacagaatttgggggaagctatatttgttccagctggttgccctttccaagcaaggaatgtccagaaaattagaaataacaccaacctgccttaccaaaaagaatccaatgttcagttgggccttgatttcttatctccggaaagcgtgggtgatgctgtaagattggcagaggaaattcgctgtctacctaatgaacatgaagcaaagcttcaagttttggaggttgggaagatatctctttatgcagcaagttcagccatcaaagaagttcaaaaacttgtacttgacccaaagtatgcaaattttacacttgtcctggcaattgctttagttctctctcttccaacgtccttgtccttaaaaatggaaaataaattgttttgcttgactgatggttcttattccttggctttaacttttgttatacttggattttggaattggccagttgtcctgttaggtcccctgcaaggtcaaccatag

SEQ ID NO: 20430 - DNA, 465 bp, Glycine max
  Peptide Sequence Number=SeqID_137208
atgaaaataaagaaaagaacagaagaaaggaaagaaggattcccaatcaaagatcgaaaagaagtgaaaagggaaaagaagcaattctcgatcaatgaaagaaagaggacaaaaattcttcaagccagattgccactcaaaatcattctcgactggaaatatcccaccccacatgaacaagaggaaaagaccgaaacacctagcttcctctccaaaaacactaacctcgagaaaatcctattggtccgaagtcgtgtgcaaaatagagtcatggtgcagttatggtatgggaataggataaaacacttgcctgtcttagcccgatgtttcccctgcatgttcatcaaaaagctaaaagttgatatcctgcccttcattctcggttacaaggaagattacccttggcacaagtggaaaaacccggtggaccgttcggtcctgccaatctttatcggagccccatga

SEQ ID NO: 20431 - DNA, 807 bp, Glycine max
  Peptide Sequence Number=SeqID_137209
atgaaagaaaatgcaagtgcaaagttggttgcttcctcatattctcctccatgtgggcttattcattttggaattagatctgctgttttaaatcctgagttgcctcagaattctcgcctccatattcttgaggaattcaatgcgggcctgtttgattatctaattgcaacagatcttagccagtcaaaggaaaaggatgaagtgcctaaggaaagtaatgttggatcatggaagtctaggcaacatgctaagataaaattagattctgaatttggagttgtaaggggaattgactttaaaaatgtatacacggttataaactttgaaatgcctgaaagtgtagcgggatatgtacatcgaattggacgtacaggaagagcatacaattctggtgcttctgtctctctggtttctacggatgagatggatactttagaagaaataagatcttttgttagggatgatgaaaacaaaggcacaaattccattgctgagtttcccctcctcaccaagaatgcagttgaatctttacggtacagggctgaggatgttgcaaagagtgtaactagaattgctgtccgagagtcacgagcccaggatttgaggaatgaaattttgaactctgaaaagttgaaagcccacttcgaaactaatccaaaagacctagatctactgaagcatgacaaagttttgagcaagaatccaccacctccgcacctacgtgatgtgcctgagtacctattagacaaaccaacaaaagaggcaagggaaatggtcaagcttgcaagggatccaagagaaaattaa

SEQ ID NO: 20432 - DNA, 700 bp, Glycine max
  Peptide Sequence Number=SeqID_137210
atggataacgcgcgatcggccaacggcgaggagaatgcggcgggaattccggacgatttgcggtgcaaaaggtccgatggtaagcagtggcgctgcacggcgatgtcgatgccagacaagaccgtctgcgagaagcactacatccaggccaagaagcgcgccgccaattccgcaatgagggccaacctcaagaaagcgaagaggaagtcgcattcactgtcgttgaacgagtccgataatgtttatttggagagcaagagcgatgatttcgaccttcctctctcctccattggcctctcgcagaagaagctctccaagaacgagtttcgctacgagcctgagcgcgacgcgcgaagaggctcgtctgcgagacgcgcttcgaacctcaacgatgatgatgatgatgatgatgatgatgttgtcgtggatgtggatggggatggggatggggatgcggcgctctatgaggaagagaattgggtctcctatgattccccgccggattcttcacgcaagaggtctcggaggagcttggaagctaatgctgtgagttggaatattcggatggaacatccggttcgtctgacgaggacaccggcgggcagacttgtcaccagtgccggaggaatgaccgcgatcgagttacttggtgtcaacggtgtgataggaggggatattgtgatagctgtttatcaacatg

SEQ ID NO: 20433 - DNA, 447 bp, Glycine max
  Peptide Sequence Number=SeqID_137211
atgaatatcttcaactccacatgcgtctacaatttcttcccgagtaattgggggacacttgattcctccaaccacaaaacgaaattcagccattgcccaatgatattgtgcgccaccataaacacgcatccctgcattctgatgaccttgttcagtcttctgccatgtcagaaaaagccagcaatagagccaccattctctgagattctagaaattgaggttcctcttctaaacattgatgaaaacacaattcaagaaaacaagctgcttcctgacgtgcaattggcaaggagtgtcagcttaggaagtttgagctcaatggattggatgcgtggagatgcaatgaagcctgatttcattgatatccctgtaatagatttcaatacagactatggcatgcagagatcatttagcgaaggagatataatgaacactcctctactgtaa

SEQ ID NO: 20434 - DNA, 447 bp, Glycine max
  Peptide Sequence Number=SeqID_137212
atgatgcctcgttctttttgcgttgctccttcagggagtggcgtgagcaaggcagatcttctattatcatatgggtatgaaaatcatataaaagcttttacgcctcatgtacccagaagttgccagtgtcttcttatgtctgcaacatcaagggatagtagtgctgccatgcttggttgtttttctgataatctttgcatcaaacatgcgctttatgctgacttagttggggctatgatggctattgaacttgtgttcaagaatggttggcaaaagtggttggattgtgattctctgctggtggttaaagtgttttcctctgataacattgttccttgggatattaggaatagatggaaaaattgtacagttttgctgaaaagtatgtatttcactactgttttgctcttgctggtcttctttagcttaaagaaaaacttacactag

SEQ ID NO: 20435 - DNA, 2162 bp, Glycine max
  Peptide Sequence Number=SeqID_137213
tacgaagaaccaagagggagggccacgtgttggtggcattcttcggtgacagcagctacgggtggtttgagccgtcggagctcatcccgtttgacgcgaatttcgcagagaaatcgcggcagataagttctagaaacttcctgaaggccgtggaagaggccgtagatgaggccagtagaagatgcggccttggattggtttgtaggtgtaggggccctgggaatttttgccccaccgatgtggaagggtattattctgttcaggtgccggattatgagcctggagtgtattctgatgctcagatcagaaaggccagaagtgaatttggagctgcggaaatgctttcttttctgaagcaattggcattgaatccacatggtggtgatcagagaagcattggtttcactaagaataggtccactgcgtttgcttttcgacgggcagtgtttgagcagtatgatgaaacttatgcgcaggctttcggtgtgcagccgaggcgcccttcggattctgccggtaatcaccttgatcggcctgtgaggcttcctgctaaagctcctttgagtggtccaatggtgatagcagaaactttgggtggtgagaagagtgcaacaaaatctgtaaaagctaagggcaatttcaagacggacaagtatctttttatgcggcgagatgagcccagtaacacctcccagttaccgtccagggagacatctgatgcagctgggagttatgtgcttcagaagaggcctttagcagtgtcagcagcccctgaggctttggagaagcatgaagacacagggtttatgagccaaggcattgcagcttcaactgtaaaaggcgaaatagctgttgcagaccaggttcaatcagatggcattggtcatgcatcccaagaaatgactaggagtgttgaaccagtggaagttgccagtaaaagcatgggtaggcctggggagatggcattgccgaacatagttaatgagacatctcagtctaccaatatggagagcaaaacttctattgatgtaaaaaatgatggagatttaacaccatcagtaccacatgaagattttcagcaaatagagcagggattcctggctacatctggtgaagttaagcatcacaaacttaatgttgatggtgtgccaaagaagataaaagttcataagcggcctgcaaatgacttgaagtccaaaacttctgctgtacagctatcagggcaatctgaaaaacctgtctcaattggattggcttctagagaggatttacgttcagaaccaatgcaggtggatgcttctaccagtaatctgatgcccatggattccattgccgaagttaatattgagttgccccatcttttgggtgatttgcaagctcttgctttggatccttttcatggtgttaaaagagggatccctgcagttactaggcagttctttttgcggttcaggtctcttgtttatcagaaaagcttgcctgtatccccacccatggtaacagagaatgaagctgttgaagatcgaagacctccatccagtattgggacatcagacagtcctgatgatcgtgctagagcttcaccacttataaagcctgtaaaacacattgttcggcctgacgatccaaccaaagctgggcggaaaagggccctctctgatcgtcaagaagaaatttctgaaaaaagattgaagaaaatcaagaatataaaggcactggctgcagagaagaaggcaggcagccagaaaacttctgaagctcgtcaaggagatggaaaagaatccatggcccaggctccacccaaggtagtgaaaccagaattgaccaggaaagtggagcgtccagccaaggcggttgaacccaccatactggtgatcaagtttcccccagaaacatcactaccatctgttgcagagctgaaagcaaggtttgctcgttttgggccaatagatcaatcaggtctccgggttgatgcacaatctgcctataaatatgctctagcaaaccaatccttatttggcaacgtgggtatgaagtgcttcctccgtgaatttggtgatgcttcatctgaagtctctgaagctgcaaaggctaggggagacaatggtgccaatgaatcacctcgggtcaaggatcctgcagtggttcagcgccagtcatca

SEQ ID NO: 20436 - DNA, 870 bp, Glycine max
  Peptide Sequence Number=SeqID_137214
atgttgctttttttttttttttttttttttgcaccacttacatttgcccatcaaccagttctgtatgcaaacctggcaaacaagccatcgcttttgcctagtcggaaaagtgaagatcagatgaaacaagcatatatcatgttgtctgattgtttcagatatggaatgaatacttcatgctgtcgagcaaagatactcgttgaatactttggagaggatttcagtcatcagaaatgtctcttatgtgatgtgtgcattgatggtccacctcaaaggcagaatgtaaaagaggaggcctgtattttactgcaaactattggagcccataatgaatgtaacaattatttggattgctcatatgatgatgatatacattttcactccaaacatagaggactgagagagaggccaaatcttcagatattggttggcaaaataaggcagcagtttcagaagtttttaaccactgatatattatggtggagaggtcttgctcgaattttggaggttaaaggatacatcggggaaggagatgacaagacccatgttcaggcaaaatacctggagccaacagaattgggattggaatttgtgaagtccatgagtgagcaagatttctatgtttaccctgaggcagatatgttgcttgcaaggaaaactaacaaaccattttcctcattctcggaatggggaaaaggttgggctgatcctgagatccggcgtgagcgcttagaaagaatgcgagtcaatagaaagccagggatgctgccaagtcccaagaagcaacgtaagagaaaagctagaaaaggttgggctggtttgaggacttctcgtggtagactggcagcaaaactctcaaaacacaagtga

SEQ ID NO: 20437 - DNA, 588 bp, Glycine max
  Peptide Sequence Number=SeqID_137215
atggctcatgattcccgaatcgcgtgttttgcactcacgcacgatggcaggttgcttgcaaccgccagctccaagggcacactcattaggctcttcaataccctcgacggttcactgctccaagagtattacagtttcacttcggtaatttatatcataaaggtacggaggggtgcagacagagcagagatatacagccttgctttttctcctactgcacagtggctggctgtctcaagtgacaaggggaccgttcatgtcttcaacctcaaggttgattccggactgttggggcatgatagatcgcacagtacttctgaggcaaatcttgctagccccaccgcgatgtcgtctctttccttttttaaaggtgtgctacccaagtattttagctcagagtggtctgtggctcaatttcgcttgcaagaaggtttgcaatatgttgttgcatttggccatcaaaagaatacagttgtaatactaggcatggatggcagcttctatcgatgtcagtttgattccgcagctggtggagagatgacccaacttgaatattacaatttcctaaaggcagaggagacattctag

SEQ ID NO: 20438 - DNA, 150 bp, Glycine max
  Peptide Sequence Number=SeqID_137216
atggagcaatcagagccagcaaacaaatcagctagctacacttctcgagggctatccccttctccactgagcactactgatcaagaagatttggccctaacacccacctacagttccttagtgtttcttgtgctcaatcacccggtatga

SEQ ID NO: 20439 - DNA, 399 bp, Glycine max
  Peptide Sequence Number=SeqID_137217
atggactttggaaacatcgttttggccataataggcttctccacgtcgttcttattttgcgtgcccataaagagatggcagaggaaacaagtggccgcagagaaactaaaaatcgttagcgaggcgttggaagctgcagaagaaagagcagtgagattccaagaaagacatgacacaatattgagccaaatatgcgcgtcttacttgaccaatacagaggtggttgaagcactagcgggtgctcgagcaaccatgagccaggcattggactttgccgttgaattgagggaaattcagtttagaatcattgcttctttccccgatgcaatcgatgttctgttggatttggatacttcaaaacacacgccctcaagaagtgctttaatgaattgctcttaa

SEQ ID NO: 20440 - DNA, 468 bp, Glycine max
  Peptide Sequence Number=SeqID_137218
atggtggcggagacatgtgaaaggtcgcataggcccttagggtttgcaatggacgacgacgattcggtcgcggcggaggcggacgcccttgacctccgagcggaaggagagctcgccgatgcagcgggacaggtggtcgtcccagatcatgaccttgttgggagggtagcgggggtcgggggaggagccgccgccgacgaaggcgaggatgttgcagcggaagagcatgtggacgaggccgacgccgccgccggggccgaagtcgcggcggaagatctcgcggaaggggtcgcagttgtagatgcggaagccgcggtcggtggcggcggcgaagcacccggagtcctgattgaaggagaggtggaggagggaaggggtttgggtggcgtgggtggtttgcggcgcctcatcggaatcgagggtttggggtggggtctgagacattattattgggaatcgaatgaatga

SEQ ID NO: 20441 - DNA, 2679 bp, Glycine max
  Peptide Sequence Number=SeqID_137219
atgggttgtggttctgagcattttatcatgatcttcaacatcaccctcttgatgcttctatcatcacaaagcacccacattttgactgtggctggttctctattcaatgcagtgggaagcttccaagttcatggcctacccgagatgtatttcattgaagagaatgatgaaaagcaagttaagaaaatctcaggaatagatgagaatgaagagaagcaagctttgatactggaaaagtttagatccttgcttggactcaagagcttccacaccaaagttccattcaatggtgattcggagtttctctctccctcaccttctccatcacctatcattgaagaaactcaggctccttctccttctcctcttccacacgtgccccatcattcccatcaccatccaccacatcataagaatctaccacttcaccaaactcatcatgaagatagaggcagggctaagagaatactaatagctgttcttgtatctgctggggttgctacattgcttggtgcttgtggcttattctgggtgtggagaaaattctcaaatcacacaaagaaacccaaaagaacaatgccactatataatagcaagagcaaaggaagtggaggtggttatcaaagttcatcaagcaaggtgagtttaaactcaggactagatctcttttatcttaatgccttaggcgaggacatagagcaacactcttgcagcttgaaaaagactcgcaaggatggtttagaatacgataatgttagtggttcttccgcgaaggaaatagcatctgttcatgaagatgcagaatcagtggaaggtgaacttgaatctggtggaggcaactcttcttctggggataaaattatccctgaagattgccattcatcagacaatgaaagttttcattcctttgttaatgattcacactccaatgcctcagcttgtagtcttagtgacaaaaactctctgtcccgtcaaaattcaacttctttaccaaaccaatttcctagttctgcacataactcaatgtcaaatatacaacttcaccattcaccaaatattccaaaaacattcacttcccctccgcctcctcctccaccaccaccacctccaccattgcgaatgccattattttctttgcattcccttacttcttcatctagactctcctctcattccccactttctttgacatctaataatttatcatctccggtaaattcagacacttcttctggttcaaatcaaagtccagaaaaggagttgccttctccacatggaccttaccctacacaatctcctcccaacattcccccaccaccatgtccacctccatttcttaaaggcaatagtgccaaaaccccacctcctccaccttctcaactccctcaatttacccctcttggtaaagatggtgcaccattgccaaaactcaaaccacttcactgggacaaagtaagagctgcaccaaaccgcacaatggtttgggacaagctaagatcaagctcattcgagttggatgaggaaatgatcgagtctctatttggttacaatttgcaaaattcaattaagaatgacgaaacaaagagtaaaacaccgtctccaggcaagcatgtacttgagccaaaacgcctgcagaacataactatactctcgaaagctctgaatgcgacagctgagcatgtctgcgaggccttaatgcaagggaaggggttgtcgttgccccaactagaggcactagtgaaaatggtacccaccaaggaagaagagtccaagctcttcaattataaaggtgacatcaatgaattggggtccgccgaaaggttcgtgagggcaatgctcgatgtgccatttgcctttcaaagagtagaaggcatgcttttcagagagacatttgacgatgaagtagttcacctcaagaactcattttcaatgcttgaggaagcatgcaaggaactaagatcaagcaggctcttcttgaagttactagaggcagtgctcaaaacgggaaaccgaatgaacgttggaacaatcagaggaggtgctagagcatttaaacttgatgcacttctcaagcttgcagatgttaagggaactgatggtaaaaccacgttgctccattttgttgttcaggagattgttcgttcggaaggaataagagtttcagatagcattatggggaaaatcagccaaagaagtaagaacagaacggaggaagagaaggaagaagattacaaaaggatgggattagaacttgtttctggtctcagcactgagttatacaacgtgaaaaaaacagccaccattgacttggacgttcttgcaagctctgtgtcaaccctatcagaaggaatgaaaaagctgcaacatctagtggagaaggagttgcttaaaaatgaaaggagcatgaactttgtgcagtgtatgaagtcattccttaactatgctgatggaaacttgaaggagttgcgaggagatgaggatagagtgttggcacgtgtgaaagaaattacggagtattttcatggggatgtgagcaaagaagatggaaaccctcttaggatatttgtgattgtgagagattttctggggatgttagataatgtgtgtaaagaacttagaaggtctaaagctccacgtagcccgaaccctcttgctatgctccctttagatagatcatag

SEQ ID NO: 20442 - DNA, 738 bp, Glycine max
  Peptide Sequence Number=SeqID_137220
atgttccatgcgctattctattccaatttccaagtgcaaatcgcggttgaagttaacaaacgcaagaaaaggagcgcggtgcggagatttttcaagaaagacatggccgaccttcttgggagttcccttgattacaatgcatatggaagggaattgctgcaagtgattcaagaaagaaccagttgccgatgttttgggagcccattattatgggttgttcaatgcaaaagtgaggctttgttaagcatggcatcagatgtggcagtaaaggtagaagttgcaacaccctgtgctattgctttgaatttggtaatctcaaatttgagtgctacaagtgagaaggcagttatggaagcattgaaagaaacagagacttccatgcgtattgttggaaatagaaaagattttgctgaaggtgcaaaaaaaattgaatattttgaagagacaacttttcttttgagcacaataacgcggcgctggcctccttctgggttccctgttggtaatgatgttatacttatgaaagtcttagcaaacatccatacaaggacagataaagcaactcttctttccaagctctttcttcttcagttccattccattcctcacaagagtctctgcattcttgatttcacaagaacataccctctctgcaagaacccgtttttcacttttctagcttcgtatattcggattctcgggagtgaaaatgttcgatgcgctattctattccaagtg

SEQ ID NO: 20443 - DNA, 315 bp, Glycine max
  Peptide Sequence Number=SeqID_137221
atgaagctgatcatggtctcttggatgaaaatatgtaggcctctgagtgaaggaggtcctggcctaaggtctctcaaagctattaacaaagcttccatcttgtctctgacttggaagttcatttcttcagcagatcattgggccgagctgatgagagcaagggttctcaaagatggttttcagctaatctccagagtaatctgcaagccacagttgcagacttcatccagcatgatcattggagtgggggaagcatttagtgctattcattgctcttgggaagattatatgacccttatggttggctcattctag

SEQ ID NO: 20444 - DNA, 601 bp, Glycine max
  Peptide Sequence Number=SeqID_137222
atggaagaggcctggacaattgatgaggttgcattcaatgttcgaggcctttcaatagattgcttcattcccactactggtttgagaacaacttctgttaatgaaacttgcaaacttcctaaggatgaaagagcaaagaactcactagcagtacatcgggccaaagttcttgcgttggagaaatcacataattgcagggatgcacattcaattccttcatctattcaaggggcagcatctataacttcagcagcatcactcgataattctctatctgacatgtatcgctctcctccaaggccattaccatatgatgcagaacccagatatttccgctcgcaacgtgatggactagtttcaaggcgtgagaagggttcaagtcattcaaatgaggaaacagaacctctaagaagtaatgcagatgtggatccagaatccttaaattcaggagacaaatggaaggaaagtgcctgtgaagctggatcaaaggaataccgttctaagtcctcactaagacttcaatcaacaaaatattcaactggagttggtcttgtctatgcatcatcagaggaggaggatgtctgtccaacttgtcttgaag

SEQ ID NO: 20445 - DNA, 432 bp, Glycine max
  Peptide Sequence Number=SeqID_137223
atgccatgctacacagatgactcaaatgcaagagcagatgcatgcatagttgaatctacagacatagtcccaaatggagttgcaaacacaactgcaagtacaactggaggcacaagcacaacaaatgcaggcacagttgaaggcttaggcagacatgcaagaacaaatgcaggcatagatgcatgcacaaatgaaggcacaagcagaaatgcaacaacttttgcagcagcaaatgcagataaatatgcaatttttgaggataaaaatattgactgggataaagtgaggaatcaacgaagcatcataacgaggaatttgctagggaatagtgaaggaattttgcgaagagttaactaccgattagcaacagacgtttgtgataaaattgtgagacatagaagcactccaagcaacggaactgtgaaggaatga

SEQ ID NO: 20446 - DNA, 390 bp, Glycine max
  Peptide Sequence Number=SeqID_137224
atggccatctgcccaaacttgaaaaagggaagaacatcaaaattttatataagaatagcaaaacgccagaacccgtccatgcgtatggttatgaagccattaaagctcattaatgaatcaacagaagcccaaacccatgtacttgctaaacagacttacatggagtttgacttaggtgttacttccaccaatggacctaaagttaatggtggtcaattagctggtggtggtcaaccaccaaccaccatgccaatgattgaaggcagccaatcatatgtggccccaacacctgatgacccacaacctgcaaaggagccttcaagtgtagattcccacaatgaagttgataggagacttgttatatttgtggaagaagttgacgacccataa

SEQ ID NO: 20447 - DNA, 267 bp, Glycine max
  Peptide Sequence Number=SeqID_137225
atgcagaaaaaattacctaaaccaagtagcagaaacaagcaaccactagaagaagttcacatgggtataggacttgagtcccatgcgggaattatgggattccagtgtgggatttgtaaggccttggtctctctaactacaaaggctagtttatgtgatgtgattctcccaaggttcttattaattggtatcaaagctttcctacatgtttctccactacaaatgagtggtgcaggtggtgacgctaagattacaatattcacctga

SEQ ID NO: 20448 - DNA, 576 bp, Glycine max
  Peptide Sequence Number=SeqID_137226
atggagcttaagacgattaataaaaagttggaggatggatcagctttgagcaggttggatcatttcttggtgactgacgcatggatgaacatgtttttgaatgtaactcaatggggttgtatgagggggctttcagatcatcgtccaattatcttgaaaaataaggagaccaattgtggaccaaaacctttcaaagttataaattcatggagtcaaatggagggatatagagagtatgttatagcacaatggaagtttctgaaatttgaagggtggagcacatttgttttgaacgagaaactaaagctcaaagagtttgggccaaatggttttaacttcggctttttaaaggagttcttgaaggacatgaagatggatttctgtgactttctgatgaaatttcattggaatgatggtgtactgattacaaatgagttggtggaggaaacaagaaggagtgggagggctttagtcttgttcaaagttgattttgagaagacttatgactcagtggattgggagttcttattgttggtgatggaaagaatgggttttccaaagcaattgtgggactag

SEQ ID NO: 20449 - DNA, 333 bp, Glycine max
  Peptide Sequence Number=SeqID_137227
atgtcatataacctctacactacttgttattatactggctcgcataagagagatggtcgtagaggcatgctagtgcaacaacttctcatgcatactcgtggcaagcatctaggttgtcgagtaatgtcatataacctctacactacttgctattatactggctcgcataagagagatggtcgtagaggcatgctagtgcaacaactcctcatgcatactcgtggcaagcatctaggttgtcgaggtattggaggcaagtacaacagtcaagacacatcatctagagtgacaatcatttctctaacggacaagtgcaaggaaggcgtctcctag

SEQ ID NO: 20450 - DNA, 3174 bp, Glycine max
  Peptide Sequence Number=SeqID_137228
atggagattcacgaaaaccaacacgagtcatggtcggagacggagagcacgggaagccgaagcaagcaagtgggcttcagcgggccactaagcgggcctcttagcgggcctttgagcgggcctttggtgtcttccaacaaaaggaacagcagcaagaacaaaagcgcgaggttcaaggacgacgaggagatggtggagatcacgctggacgtccgcgacgacgccgtttcggttcagaacatccgcggcggcgactccgagacggcgttcctcgccagccgcctcgagatgcggccgtcgtcgttctccgaccgcctcagacaggtgtcgcgggaactgaagcgcatgacatctaacaaagctttcgatagggttgaccgcagcaaatccggtgctgcgcgcgcccttcgtggcctcaagttcatgaccaaagcaggcactgaaggttggtcacaggttgagaagcgcttcgatgagttggccattgatgcaaagctccccaagactcgctttagtcagtgcatagggatgaccgagtcgaaggagtttgccggagagttattcgatgcattggctcgtcgtcgggggataacatcagcttccataacgaaggatcagctgcgtgaattttgggagcaaattacagatcagagctttgactcgaggcttcagaccttttttgacatggtggacaaagatgctgatggacgaattaatgaagaagaagtaaaagagatcatcaccttaagcgcttcagccaataagctgtcaaaattaaaagatcgtgcagaggaatatgctgcccttatcatggaggagctggatccggacaaccttggatacattgagttatacaacttggaaatgcttcttctgcaagccccagcacaatcaaccaacataaccaccgatagcaggatactgagccaaatgctgagccagaaactagtccctacaaaggagtacaaccccatcaaacggggctttcgggcactagcatacttcgtgcaggacaattggaaacgcctatgggtcatagccctgtggctttccatttgcgctggtcttttcacttggaagttcatccaatacaagcaccgtgcagtgttccatgtcatgggctactgtgtcacagtggccaagggtggcgctgaaacaaccaagttcaacatggccttgatcttgttgcctgtttgtaggaacaccatcacttggctcaggagcaggaccaaactaggagcaatcattccctttgatgacaacatcaactttcacaaggtggtggcctttggcattgcaattggggttggattgcatgcgatttcacatctgacgtgtgacttccctagattgttacatgccacagacgtagaatacaaacccatgaaacaattttttggggatgagaggcccaacaattattggtggtttgtgaaagggactgagggatggaccggggtggtgatggtggtgcttatggctatagccttcattttggctcaaccatggttccgaaggaacaggctaaaactccccaaaccccttaagaagctcactggtttcaatgccttttggtactcccaccacctttttgtcatcgtctacgtgcttttcatcattcacggatacttcctatacctcagcaagaaatggtacaagaaaacgacgtggatgtatctcgccgttcccatgatactatacggatgcgaaaggctacttcgtgcttttaggtctggctacaaatctgtgaggattctcaaggttgctgtgtacccaggaaatgtgctagcattgcatgtgtctaaaccacatggatttaagtactctagtggccagtatatatacgttaactgttcagatgtatccccatttgaatggcatcccttttctattacatcagctccaggagatgactacttaagtgttcacattcgaactttgggtgactggacatcacagttaaagggtgttttcgccaaggcatgtcaaccagcaagtgacggtcaaagtggtcttctacgagctgatatgctacaaggcaacaacaaaccaaggcatgatgcccaggctactaatcgatggaccttatggagctccagcacaagactacaaaattatgaagtaatccttctggtggggctaggaattggtgccacccctttgattagcatactcaaagacgtgctaaacaacatcaagcaacataaagacgtagaagaaggagcggtggaaaaggacaacaagagaaaaccttttgccaccaagcgagcttatttctactgggttacgcgtgaggaaggttcctttgaatggtttaaaggggtgatgaatgaggtggaagagaatgacaaggaaggagtcattgagcttcacaactattgcacaagtgtgtatgaagaaggagatgctaggtcagctttgatcactatgctccagtctcttcaccatgccaaaaatggtgtggatatagtttcaggaacaagggtcaagacccattttgcaagacccaactggcgcaatgtctttaaacatgcagccatcaaacaccctgaccaaagagttggcaatgcggatgaaataagggaagtagaagcagaagctctggcaagcaagacccttgtgctgccaaggctgcaaaaggaaagtccagaaaattcttcaaggcgtaataacgtaaccatcttcagaattcagaacaaaaccacagtccttgatccaggggttaacaacatagacattgatttgaggcaacacaaagtggtagtaacggggaacgttaacagcgagacgttgattaggagattgactaaagctgggaagcatgcggagttatggcctgaatcaaaagccaaggaattaacgaagctgttgctaaagagacatccaaaaacggcaatgaagcaaatgaaggtgagggaccacccaataaagaacaacaaagtcatgttcaacttgaaccaaatggaacacaataagggtaaactgaaggtgataatggaaattgatgcagtgattaatctgccaacacttgctggccaaacaaaaccaaacaagataaaagagaccctgaagaaacctcacgtgtctgaacaaagtgcacaatgtaacaacacggttttaataacaggagaagacgtggacactgatactgtctgtagcttgttgaactcttga

SEQ ID NO: 20451 - DNA, 684 bp, Glycine max
  Peptide Sequence Number=SeqID_137229
atggtgaagatagggcaatggctagaggcagaaaatggatcctcgaccacggtggtttggaagctattccatcctggggaaagttctaggtcatggaatattgtgggtttgttggagaagctagttttcccgaattctaatactagaaagcttacttgtggcatctattttggaacgtatccttgtgcacaagttgaatctgttgcttgtgatcacccttactgctattcatgttgggcaggacatattggcacatcaactaatgatagtctggggtgtttggtgttgagatgtcctaatcccatttgtggtgctgctaatggtcaagatatgattaaacttttagcatatgatgaagataaagagaagtatgactattaccttctcaaatcttatattgaagacaacaagaaggacacaagaattaaggagagcataagaacaaattttggtcatcaaacttggacagcttggttacctactgatgtagctccatgtggagcatgtagaccttggatcttcttcatcaatggagtcttttgcttcttgaagatcaatggcagcggaatggagaaggaggaaaggttattggagacgtcacttcaaggagaagatgattcaagaacaagctcaccaccacaggaagccatggataagagcttgaaggtaggagaagatgagtga

SEQ ID NO: 20452 - DNA, 225 bp, Glycine max
  Peptide Sequence Number=SeqID_137230
atgagaagcaatttcaacggttctgacttgttcgaaaagcatggccaatttctggctatcaacgttatggtcataggtgcgattggagttgctggcaatgttgaggcaggagaggaggcacgtaggcgagagtggatcttaaatctggaaaaaaaacattgttgttgtcgtggatctcatttctggaaaacaaacatcatcaccgataaaggtcgcattcgataa

SEQ ID NO: 20453 - DNA, 216 bp, Glycine max
  Peptide Sequence Number=SeqID_137231
atggtggcacctccagactctattccttcagttgagcagtttaatgagatggtagcctggcccagagccttctacacaaggggaggatataccctcacctcagcatgcaacagacccctccactcctcttctagagatgctagaggacccgactacattagtcctggctatggacacttctcctccagctactccagtattacatctgacagatga

SEQ ID NO: 20454 - DNA, 1065 bp, Glycine max
  Peptide Sequence Number=SeqID_137232
atggaggaggatttggaaagtggaaactttgagtgtggttttggtttggaagatgttttgaactcccttttgaaggaggatttggaaattgtgggaaggtttgagaaatttggtgttttgtgtttgggtttggactttggaatgattgaccagtttgaagaagacttggtaatggaatcgttgggtttggaggagtgtgtaaataaatgggggcgagtaggaaagaatcaacttgatccgtatgcagcttctttcatgcgtaacctttgcggatcatctctaacactattgcggatcatctcagtcctaacatttgtctactgcggatcaactcaaaggctatgcggatcatctacacctaacctatgtctagtgcggatcaactcaaaggctatgcggatcaaaagaagccatagaaaatgggacgaagaagaagaagacaccaccacgcacgctgaatcaacagggctggagaagaacgacacagggactcgaaggagaagggctgggctgctgaagaagaagaagaacagacggaagaaggagaaagcacaatcatggcatgaaaaaaggtttctggcacaaggccatgtaaacccctttatgcaactagccaaactccttcattgtgtgggtttccacataacctttgtgaacactgagttcaaccacaaccgttttgtcaagtcccatggaccagactttgttaagggtctccctgatttcaaatttgagaccatacccgatggcttgccgccttcggataaggatgcaactcaggatgttccagcactgtgcgattctactaggaaaacttgttatggtccattgaaagagttggtgatgaagttgaactcttcttcccctgaaatgcctccggttagttgcatcattgctgatggggttatgggatttgctggaagagtcgcaagggatttgggtatacaagaggttcaactttggacagcctcagcgtgtggttttgtgggatatttgcaattcgaggaactggtgaaaagaggcattcttccattcaaaggtgcacgctgtctctttgttatttga

SEQ ID NO: 20455 - DNA, 252 bp, Glycine max
  Peptide Sequence Number=SeqID_137233
atgggttgtggaaatctcaaacctgtaagtgttttgcctcgctgtcctcacctagttgattttttgaagcaaggctgtcgtcctatttgggtgtcagaagtggtgattgaaaaacgtggtcattgcctgaagcatgtcgtcaacgacgccattcccatggaaaggagttcctcattgtacaccttagagccctggagttgcgtgatgtgtttgtgtaacgtaaagggtccactggggatatcggagaactaa

SEQ ID NO: 20456 - DNA, 396 bp, Glycine max
  Peptide Sequence Number=SeqID_137234
atggccaagtcatcttccttagctatcacgttgatctgcgccgccacggtattggtggcgatgagtcggtggccgacagccgtgggcggcggggaccaccacttgggaatgggatgggtttccagcacgtgcaaggggaccattgctgagtgcctgggaggggaggagtacgagttggattcggagatcaaccggcgcatcttagccaccaacaagtacatcagctacgttgcgctgcagaggaacactgctccctgctctcgccgcggcgcctcctactacaattgccgacccggagcacaggccaatccttacagccgtggctgcagcgccattacgagttattattcacgaacatttgtggtaatggtaatccatttcgggttgctgttgtga

SEQ ID NO: 20457 - DNA, 387 bp, Glycine max
  Peptide Sequence Number=SeqID_137235
atggctgcaagtgacattgctattctcaaagatagagcccacgtaccaacaaagaaaagtcttctggaacttacatcgcaagatgctttgttggcacagaacaagttattgtccaagcaattggaagcattgactgaaacactaaccagtagtatcaacagcaaagacaatggaaaaatcaccttgttggttgctcaaccgacatcaatatcaaggtcgcgtgctaagcacgagatcagtgcgctaagcgcaacagttgtcctcagcaggctcaacgcacgattggcgctaagctcaaatccacttacttgcgcaaaggcgtgggtggcgctaagcgcaacgtcacagattcggagtctatttaaagcctattttgtgcagaattag

SEQ ID NO: 20458 - DNA, 261 bp, Glycine max
  Peptide Sequence Number=SeqID_137236
atgattaaggaagtatatggagctagattacaatctaagtcagtagtgtgtaccttgtgggagatttacaaacattggaggattctaataaatgtttgtgcagaaaggagacatccaaaacttgacttacgaaatactatctttgaggaagtgagaattgatgagaatcatgaaactgaccaaatacaggctaaaggcccaagtggagaaggacgaaggcctaagtggagaaggacaaagcccccgagtggagaaggatga

SEQ ID NO: 20459 - DNA, 195 bp, Glycine max
  Peptide Sequence Number=SeqID_137237
atgacccaagtcatgtatggagagatgttgtgccaataccgtgtggtgatgccagtgagggagagagaggaatgcgaggacgaaggtgatggagtaaggaaaaatgtcgttggggagggagggagtcacaatgaggttgtgagggagagcgttgcgggtttgtgtaagcgtgaaagagaggagcaaatagggtag

SEQ ID NO: 20460 - DNA, 120 bp, Glycine max
  Peptide Sequence Number=SeqID_137238
atgcagaggttgatggagactgaggttgcgaaggttgatggagactcaggttgtagagggatttcactggagagagtgacatcaggggcaatatggaggttaacggagactgaggcttga

SEQ ID NO: 20461 - DNA, 558 bp, Glycine max
  Peptide Sequence Number=SeqID_137239
atgaatgttagtttgccttttcatgtaactccattatccaccaccaaccctactgaactgaaaataagagccatcacaaaatgggttgttcaaggagcactcaatgtagacattggtgctaacccttctgcagaaggtggggacgaggatgagggagttggtgatcaagctgtcaaagtcgttgatattgttgacacttttaggcttcaggaacaaccatcctttgataagaagcaatttattgcttatatgaagagatatattaagttgctgacggccaaattagagggagagaagcaagagttgttcaagaagcacattgagggagcaactaagtccctcatatcaaagctgaaagacctccaattttatgtgcttcatcttttctttggttatatattggttttgtgggggagagcatgcacgatgatggaagccttgtctttgcttactacagggaaggtgttactgatccaacttttatctactttgcctatggatggaaggaaatcaagtgctgagcacatgcaatgcaggccccgtagttatcttatctga

SEQ ID NO: 20462 - DNA, 405 bp, Glycine max
  Peptide Sequence Number=SeqID_137240
atgtatacatacattcacagtataaccatcgaagggtttgtcagtggagcagtccatttcccctgcaagtcgtgggtacaaggagagaggatattgaggaaacaagaagatacattcattgagttatctaagttgcttgaagaagcaacaacaagaaaccagactgagggaaataaggatcttaaccacaatgagaaggactatttgcttcctaaagtagttgaattctctgaagagaatagacatgggggaaaagacacatctaaggtagagctttcagccaatgaaggacttaactcaaacaaagcttacaggaataaatcattgatgacagagaagtggaaccttggaaccagaggaataattcctccatgtcttttaccccttgtctgcaatccatggtag

SEQ ID NO: 20463 - DNA, 1392 bp, Glycine max
  Peptide Sequence Number=SeqID_137241
atgaacagttctccacgctggcgatctgagacctgctctccaagggacgaacacggacgggtgcagagacagaacattaaagctgctggtgctttgattctgctatggaacattgaggcaaagctcagcatcttaaaccctgtaactgtgagagtacagtctcttgcttgcgcctttgcagtgagagtgatgtcttttatataccatggtgattcgaaccacaaaatgcttcaacaccaaattgttcagtcccctgctaggctaggcctcgcaaatcctaactccccatcaattccaaaccctacccctccgaagctccctccaacacagacccatcacccccaagaccgcaactcctcaaccccttcttcagctctcttgtctctcctcccacccctccccagagcccaagcacttcttgcccaaatggcttccttagcttccaagctctttgatgtttcccctaatcggtccctttgggtcaccgccttccgtggatcccttccaactttcctctcttctcattcgtctaccccacttgacacttctccttctaatgccaaagaaatcatctccctttttactgttctccaaacccaaatctttgaagccgttgctgaactccaagagattcttgacctccaagatgccaagcaaaagattgaccgcgaaattcgctcccaagattcaacacttcttgcatttgccaacaaactcaaagaggctgagagctgcctcgatatccttgttgacgattactctgattaccgccgctccaagcgatcaaaatctggagatgatgattccatgacttcatcaactgtctcgtctcagctgaagctgtcggatatattatcatatgcccaccggataagttacaccacctttgcaccaccagaatttggagctggccaagctcctctccgtggcgcactgccacctgcgccacaagaagagcaaatgagagcttcgcaattgtataattttgctgaccttgatgttggattgcctaaagaagttgaaaccaaggagaaaattgttgaagctattgttgagcctccaccacaggtggataccaatgcagttccgaatttgtctgcatttcaaggaatgttacctccgatgccacctggctggaagccgggaatgcctgtgcaactgccaattgatttgccactgcccccgcctgggtggaaaccaggggatcctgtgccattgcctcccatggactcgcttcaaataccgagatttgcagagcaacaaatgcaacctcacattcctcagcccaaacaaccagaagttattcaagtgcaaccagttaatttggaccttggaggaagtgatactagtgattatagtagtgatgatgccagctctgatgatgaagattga

SEQ ID NO: 20464 - DNA, 267 bp, Glycine max
  Peptide Sequence Number=SeqID_137242
atggatgaccaggaaaaattaattgtgtgctgcattggtgtactgcagtgcattggtttcttggtgaatgaaggtgaaacagaatacaatgagtgcagcattttcagaggagcctatagcagaaacactaagcccccagcagagacagaggatatatccccattatacaatactaaaaaggccaacaaggaaacaattgacagaagtattcataacatgacacttgacagtgacataacaatcaagtgcaaaatccctcacctgtag

SEQ ID NO: 20465 - DNA, 1236 bp, Glycine max
  Peptide Sequence Number=SeqID_137243
atgcaggttggttacggtggtcgcaacttaggagataaaaacccgttcaccccgaaggcttacgtggcacgttattgggacaaacacgtcctcaacaacttgccaaagccgtcgtttcttctctcaaaagcatcctcaatgagcgcttccgacacgacgtcgttcgccaagctcgccgccgcgaacaaactctccacgagcctgccggagttatgctccgccgcgcacctcctctgcttccaggaggtccggcctagcctcgagaaacacaccgaagatgccggttttgaaacctacaacgacggccagaacttcaccaattacggcatctacttcgccggcggaatcgacgccttcaaaaactactccaaaaccattctagtgaacgatttccggcgctacagtcgcagctcagccggccacggcgagagcttcactggctacggcgaggacaccaacgttgccgacaagagcttccacacttacagcaccaacgccggcggaggctccggcgagttcaaaaactattccagcaactctaacgttcccgacgtgcgattcgccacctacttcgatagcatcggtgggagaacacaatcgttctcaagcaacaacgaggacgacaactacgacaggcagagtttccaatcctacggcaagaactccgccgacgcggcaaactcattcgccggctacggaacaaactccaacgttgccacgttggctttcataaattatggcgttgagatgaacgttccagaagtgactttcaagagctacgctgttagaactcacgctagcactgagagttttgctaattacagagaccaggctaacatagctgatgactcgtttcaatcttatgctaagaacaccaaagaaaggaccaaactggatttcaaaaactacgggaattcttttaaccctggttcggatactttcaaaggctatgctaaaggcgcagaaggggatcacaaggttggcttcacaacctacaacgttaacactaatgctacgtttaaggattacgccaaacagggcgtatcctttgctagttacaacgtatctttctcttcctcttcagaatctaaaactattagacgcagtttttctccttttctgatagagataaattgtttcaccctttggaagaaaaccgtgggggtggagacgtggagtggtgaagcaaaagtagagagtcataaaagagagaaaagaaaagctaagtttcaataa

SEQ ID NO: 20466 - DNA, 729 bp, Glycine max
  Peptide Sequence Number=SeqID_137244
atgttaagtctcatatatgctagtcttttagaggctagccatgacaagaagcttctttctgctgttgtggttggcagtgtctattgtgacacatgttttcaacagaatttctctacgagaaaccatttcatttcaggtgccgcagtagctgtagaatgcaaatttgggaaatcagtaccaagtttcaagaaagaagtgaagacaaattatcatggtgaattcaaagtgaagctaccattcaaagtgtggaaacatgcaaagagaatcaagggatgcactttcaaattgataagtagcagtgagccacattgttctgtggcctcacttgctacctcttctctagtgagtcttaaggcaatgaagcaaggagaacacatattctcagctgggttgttctcattcaagcctaccaaaaagccaaacttttgcaaccataaacaaagtgttccaaactccaaggcacatgcaaaaaatgaatttcctccaaatacaaacccttctagattagataaaaaattagctgaggatacctttttccctttccctccaatcccatttctacctccaattccatttcttccaccaatccagtttcctccaatcccattcctacccccaatcccatttctccctccaaatccttttctccctccaaccccatttctccctccccaggttcctaatccattgcaaccattaagcccaccaccactcttccccccagtctag

SEQ ID NO: 20467 - DNA, 177 bp, Glycine max
  Peptide Sequence Number=SeqID_137245
atgtcggaagctaagacccaaattgaatccataaggaagtgggtcgtcgagcacaagctccgtactgttgggtgtctatggctcagtggtattacgggttcgatcgcttacaattggtctcgacccaacatgaaaactagtgttaagatcattcacgcaaggtttgtcttgttataa

SEQ ID NO: 20468 - DNA, 774 bp, Glycine max
  Peptide Sequence Number=SeqID_137246
atgagcgggcggtcaagccgcacaatttatgttggcaatcttcctggcgacgttcgcttgagagaagtagaggatctattctacaagtatggtcctattgttgacattgatttgaagatacctccgagaccaccaggctatgcttttgtagagtttgaggatgctcgtgatgctgaagatgcaattcaatatcgagatggttacaattttgatggttttcggttacgagttgaacttgcacatggtggacggggatattcatcatcagtagaccgttacagtagctatagcggtggcagtggtagccgtggagtttccaggcgttctgactaccgtgttctggtcactggattacctccgtctgcttcatggcaagacctgaaagatcacatgcgtaaagctggtgatgtgtgtttttcgcaagtcttccgtgagcgtgggggtatgactgggatagttgattataccaattatgatgatatgaaatatgctatcaggaaacttgatgactcagaattccgcaatgccttttctcgtgctttcatacgggtgagggaatatgatcgaggttattctagaagtcctagtcgtgattcaaggaggagctattctagaagcctcagccgcagtccatgtatctcacgaagccgcagccatagccgcagcagaagtcatagctatagtgacaggagcagaaggttcactttggttgccttggtgaactatgattcagtttatatttttggtagcttcgaagaattgactaagtcttaa

SEQ ID NO: 20469 - DNA, 168 bp, Glycine max
  Peptide Sequence Number=SeqID_137247
atggatgtgaatcacgagcaaattgttgttgacattggatcggtggtggaagccgtttctgctgacgacggtcacgctcctctctacagcatcgaaagtctctgcatgcgttgccatgaaaacggtgctggttgcggcagcaataatagcacccagcaacacccttga

SEQ ID NO: 20470 - DNA, 207 bp, Glycine max
  Peptide Sequence Number=SeqID_137248
atgcagagggaaaaactgctgcaagagagagagacaagagtgagaaactttgcaagaatgaaggaggtttccgatgctgtcaaactttccgttgcagtcaagaatgaaggagcacaaactttccgatgcagtcatcggaaaccaccgtcggcagctgagtgcggaggttttcgggagaagccaagagagagaatagtgaaaggatga

SEQ ID NO: 20471 - DNA, 252 bp, Glycine max
  Peptide Sequence Number=SeqID_137249
atgacaccacatttgaatccccagaggatatgggttgatctgctgtcttatttcaagttgcatgcacaggctcttacactgggagcattagccggagctgcactagtagaatattatgatcttatcggaatagggtacaagcccttggctgcagaaagattagacgttcggagaaagaatggagttaggaatttgaaaagaaatggaggtattgtaaggaaccaaggagagggaaggggaacatttttttag

SEQ ID NO: 20472 - DNA, 852 bp, Glycine max
  Peptide Sequence Number=SeqID_137250
atgggaattatcacttatgactattctggatatgggcagtcgtctgggaagcctagtgagcagaacacttatgcagatatagaagctgtttataaatgcctgcaggagaagtatggggcgaaagaggaagatattgttctgtatgggcaatctgttggtagcggacccactatagatttggcttctcgtttaccaaaccttagggctgtgattctccacagtccaatcttatcgggccttcgtgtcatgtattctgtgaagcgcacatactggtttgacatttataagaacattgataaaatccccttagtgaattgtcctgttcttgtgattcatggaacagctgatgatgtagtggattgctcccatgggaagcaactttgggaaaattgtaaacaaaagtacgagcccttatggattaaaggaggaaatcactgtgatttggagctttaccctcaatatataaagcacctcaagaaattcatcacagtcattgagaagtcaccgcatcaaaaaactggatctgatcttattccggatcaacttgacaaacctaggaacagcatagactttcgagagaaatccagactcagcatggatcaaaaggagaatttgaagagtattgatcagaaagaaaagcctagtgcaagcacagaccgtaaagagaagtcaagagccagcgtagacaggagagataaatcaagaaacagtatagatcaccctgagaagtcatttaatggatcagatatacccgaaaaagctagaaatagcattgaccgttttggggagatggtgagatcggttggattatgcaatattgattgtttcaggcccacagcgactcatgcataa

SEQ ID NO: 20473 - DNA, 249 bp, Glycine max
  Peptide Sequence Number=SeqID_137251
atggattctgagagttcccacctgaaatccaaacacatcatatctacccaagctttgcagctagatgtcattggaggaaatagattgcatgcattccatggaagttatcttagcatgaaaaccatgatgttcttaaagaaaaatgaaagaagcagatgccacatgggcgtgacaactccctgcagcagtgtgggtgttcctgactgtcaatttctcttccagtgctctacctacacccctgtggattga

SEQ ID NO: 20474 - DNA, 762 bp, Glycine max
  Peptide Sequence Number=SeqID_137252
atgcagcctggctttacaggaaagagaacaaaaaacagtacaagaaaggctgctgctttacgtggatgcagttttcttctcgacgaatcaataaagaaggaacaaacaaatggtgatgataatatggattctcccatgcctgagcattctaagaagcataagccccatgaagatacagagaacagtgtgcaacatacagaagggaaggttgatctttggacaccactgaactgtcttgttgaagctgccaacagaacaaagtcctccaggtcaaattcacaagcaactcctcttgccaaattagagtccccaactactcctcatggtggacaggatgcatctgaaactacaaccaaaacagacctacctgcttctgcccagagtgaattaaacattccaaaatccaaaaataaggatactggacttaaaccaatatttggagatgacaaggatgcaaacagcttgccttcaggaccagtgaagcgaagaagattgcgtcctgctggtcagaaaagggttgcagcatctgagatgtctgcctcatccccagccccactcgatgcaacagggggcaagtgcaacagaaaaaacagtcctatttggttttcattagttgcttcagaggaccaggatggtactgtgcctgtctcatttattcaaaagtaccttatgaagaaacttaatcttgccagtgaagcagaggaagtcaagcaacatattgcaagccttgtggacattgtctgggggctgaggctatcttga

SEQ ID NO: 20475 - DNA, 219 bp, Glycine max
  Peptide Sequence Number=SeqID_137253
atggtggttggcaagaactccaacaacaaaggcaaaggaaaatatgcaccaaaaagaaagcctcttggacccaagggtgatatgatcaaacccaagaaaatagggccgatgttggccaaattgatgttggatatttcttttgtaaagagaaaggatactaaaaaaattatacaagcagtatttttaacatttgcaatacattgtaggggatgtagataa

SEQ ID NO: 20476 - DNA, 369 bp, Glycine max
  Peptide Sequence Number=SeqID_137254
atggcagaatcatcaaagaggcgcaagggctcatcatcctccgccaccactggcagccaccactaccacggtccttccgttgacttttcggcaccacccaatccatctctttcctcaccacgctcactcactctattttccattgatatccaaagtgagaggtattactcatcattttcgaatcgtgatattattgaccctaaataccttgactctgaattctttgaggaagaaaactttgattgctatcaagtgtttcaaaattctgaactagtggatttcatgactctgaaattgccttattaccctgaattggttcgagcgttttataacaacttggaaattcatgaaggagtgatattttctaaa

SEQ ID NO: 20477 - DNA, 324 bp, Glycine max
  Peptide Sequence Number=SeqID_137255
atgggcttcgcatacataaacctcattattttggtaaggcaaaacaacacaaaatgtgtggagggcaaaagaacaagcataatagtgttgcacacagaggaatatgggtcaaagaaaagtggttcaaggaggttcagttggaccaaatggagctggaaagcatcagaacaagaggaatgtgctgtgtgcttggaatcattcagagttggagagacactgatccatcttccttgtgcccataggttccatgacagatgcttgaaaccatggttggaaaataattcttattgtccatgttgcagaactaccattcttcccctctag

SEQ ID NO: 20478 - DNA, 345 bp, Glycine max
  Peptide Sequence Number=SeqID_137256
atggcgttggtagagaggctcgtgaggtctcgaagcaacaaattcgggagtgtctcgcgaagggctgccacgctgaagaaagtgctcgagaagtcgacggtgtttgtgtttgtggcggcgaagagcgagatggcattggtagagaggctcgtggatcggaagacagagatagtggagtcattgctagtgaggattggtactgctaggaaggagatgaagcatgttaagaattttgattatgttgtggccaatgctaaagggaagcttgataatgcagtcaagttgatggagtctattattgatgctgagaaagctagggtttctcaaaggagtcctcttttgtaa

SEQ ID NO: 20479 - DNA, 1035 bp, Glycine max
  Peptide Sequence Number=SeqID_137257
atgcaagattttttatgtaacaatctggacaagccaatgcaattagaaattctcaatcttgcatcaaataatctgtcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactcgccaattgatatccttggatcttggagaaaataatctttcaggatgtattccaacatgggttggagaaaagctctcaaatatgaaaatcctccgccttcgatcaaacagttttaccggtcacattccaaatgaaatatgtcagatgagtcttcttcaggttttagaccttgcaaaaaataatttgtctggcaatatacccagctgtttccataacttgagtgccatgacactagtgaaccggagtccatatccccaaatctattctcatgcaccaaatcatacagaatactcttcggtatcaggtatagttagtgtgctactatggctaaaaggaagaggagatgagtatggaaacattctgggtttggtaacaagtattgatctgtcaagtaacaaattattaggagaaattcctagagaaatcacagatctaaatggattgaactttttgaacttgtcccacaaccaattgattggtcctattccagaaggtattggtaatatgggatcgttacaaaccattgatttttcgaggaatcaaatttctggtgaaatccctccaaccatttctaatttgagctttttgagcatgctagacgtgtcttataatcatttgaagggaaaaattccaacaggaactcaattgcaaacctttgatgcctccagctttattggcaacaatctatgtggtccaccactgcccataaactgcagctcccatgggaaaactcatagttatgaaaggaagtcatgggcatggagtgaattggttttttgttag

SEQ ID NO: 20480 - DNA, 288 bp, Glycine max
  Peptide Sequence Number=SeqID_137258
atgagtattatacggattgggcttaacttcagtgcagcgcagcacattaaagtgcttaaagaatgtaataatcaagtggtagttgcacttccctttgacattggaattgtgcatgttaatgatgtaagagatgacgtgaggatgacagctcaaaagcaaagttccaggaagaagaagcactggacctgggactgggagttcgccttaggaagtgggggacttagttatcgctgcctcaatttagtttcgcataaaagggaaagaaacttcattatggtgatatcataa

SEQ ID NO: 20481 - DNA, 135 bp, Glycine max
  Peptide Sequence Number=SeqID_137259
atggtgaggtgtcaattccagctgcctagggaagttgcggtggagatggaagcggggtgggatagtagtatttttgggtcaacggtgagaggtggagccgtgaaaggagaaaggaaccttactcatggtgattga

SEQ ID NO: 20482 - DNA, 1413 bp, Glycine max
  Peptide Sequence Number=SeqID_137260
atggcttcacttctagaagggagattctatcttcgtgaaatgcatctcagtttcttaaatatcacttataatgaactacaaggagagatcccaaagtgcattggttcatgtacttacaaaaatctggagctgacacacattaggagggatgtgcttaaggtaggctcttggactttgcacgttagactgagagtgacctttgttaggaggacaagatgggggaactgcaaaacaaaggactccaacactcaaggttcaaaggaacctagttcttataggagtggaatgaagttgcagtacataagacccccaagctttgagtcgacttgtgggcgaaagaggttgtccagtgtcgaagattgtataatgtccggggtagtagccttgacaaataaaagagtgacgagtttattgagccctcaagcgtggacgaatgttgtccaatgtcgagctgcttttgtcaagttgcccgagatggacatgcttttgattttgcaggctaggtctgatgtgtattttttcgtgacaatgccttcatttttgtctgattccgccatcgacatgggtggttgtgactcaaacgtctttcatagcttcaaggaccatttcttcaaggtcctgactactgatgtcgtggctaatggatttgttgacccttatggagagggtcgacaaagctattttggaacaattgtcggcctcgctggactcgtgagccattctgtctcttccttcaacgagcgatcccctcactgccttggacgtaggtcgatcctattggtgggaccatgccaccatctgttgtcccctctactgttggagaagggaggtcaacctgttggtgaggttggccctgttactgttgttgctgaggtcacccccggtgctccttcctctattttggcaaagaggaaactagatgatggtgttgggctgtttggccacaaaaattcgagggcccctatgagccttcccgccccgaggcaagctgtagggttgacgcccgttgcagtggctcctgcttctgccactgttgttactgctactcctgctcctccacctcctcctgtcgtacctatttgggaggttactcttgctgctggagttgatgcgccgactactttgacaagttctgttgtggcgtcttcatccaccgttgccatccctttgttgagtcctggtgtggcaatcactagtgctgtggagaaaaatgatgataaagaacattcctcctttgaagagaatagtcctatccccgaatctactattggtgcagaacatgttaaagattctgatactccagaatgctctgataatcagccgcttgtagcatcagttccacctgtggtgcgaaagacttcctggtttagttgctgtggactgtttgatgttctgtcaggctccaacagataa

SEQ ID NO: 20483 - DNA, 165 bp, Glycine max
  Peptide Sequence Number=SeqID_137261
atggagatatactctgcactggccaatgcagagcagcacatgtcttccttagctgcagacctaaccaccaatcatgaatatggtgaaccatgcattgctgtgctgagagagaagcagaagctggtgcatttatatactgctcgtcaagagagagttgctgggtga

SEQ ID NO: 20484 - DNA, 1398 bp, Glycine max
  Peptide Sequence Number=SeqID_137262
atgactattggaagtcttgaatataaggcaaagaacacaaaatcaaggaagaacaaattagttgttgatgagaaggcgcctttgatacctaagactcatgatgctgatgctgaaggttttgatgaattcaatggtgcttcattttctggggcagttttcaacttatccaccacagctattggtgctgggatcatggggttgccagcatgtgtgaaaaagttggggatggtgcctggtcttcttgctattatcttaactgctttgttgacagagaagtcaattgggttcatgatcaggaattcccgggcagggaatctttcttcttatgggaatctcgtgggggattcatttggcaaattcggaaaagctctggtgcaaatatgcgttataatcaacaacattggaatgctgattatttacatgattattattggtgatgtgatttctggaacatcttcttctagtgaatttcatcattctggtgtacttgaaggatggtttggagttcactggtggacaggtcgtacatttgttcttctttttacaacatttgctgtgtttgcacctttgtcatgcttcaagcgaattgattcgttgagatacacttctgcattatcatttggcttagcagttgcttttcttgttattgctgtgggaatctcaattttcaagatttcaattggaggcattgggatgcccagactcttcccaatcattactgacgtagcctcagtttttgaactgttcactgtaactcctgtggttgtgacagcctatttatgccacttcaatgttcacagcatagataatgaactggaggactcctcgcagataaatgggattgtgcgtacttcccttgctctatgtgcttcagtgtacttgctaacaagcttctttgggttcctcctatttggtgaaggaactcttgatgatgtgcttgccaattttgacattgatcttggaattccttttggttctgtgctcaacgatgctgttcgttttagctatgccgcacatcttgtgcttgtatttccagttgtcttctatgcagtgcggatcaaccttgatggtctcatatttccatcatctaggcctttggttctagataacttcagatttgcatcaattactatggtccttattgttgcttcctttttgggagcaaatttcatacccagcatttgggatatattccagttcaccggagcaacagctgctgcatgtttatcattcatatttccatctgccatcaccctaagggatcgatacaacattgcaactaaaaaagacaagattctatcagtgtttatgatagtcctcgcagtcttggcgaatgttgtggctgtatacagtgatgcctttgccctgatcaagaatagtataactaaacgtgagtga

SEQ ID NO: 20485 - DNA, 243 bp, Glycine max
  Peptide Sequence Number=SeqID_137263
atgtgtcttcgaagaactgggtttttaagatctgtcttcaaagtcgtttttcaccacacgctcgtcatcgccgccttgctctcactgctggcgacaaaaacagagaacgtgttgaacgaggagaaagcggagagagttttcgaagagcaactcaacaacgatcccgccctaggaaagaaagaagaagaagctgtcgtcatcggagaagaagttgccgatggagaaagaaagttcacgaactag

SEQ ID NO: 20486 - DNA, 1113 bp, Glycine max
  Peptide Sequence Number=SeqID_137264
atggattgtggcttcctgcttttgctcctcttcttccatctcttccttcctcactcctctggtgttgatataaaggaaaaagggtcctgtggaggttccaaattttacatcggacaagctttctccagccaactaggaaccttaattttgttgggaacttgccttaaactggtgttatacaatttaaaaacacatgtatatcattttttcattctagtttctgcacactttttgtttcatcaactaaagctaggcaattgggcaagcttctcattactgtatgcacgtcatatagtaactagtaaacccagtggagtgtgtgtttctcaaggaggtcgttttcctcccttcaaatccgaaggtggtgctcccaaaaatggtcctaaagatttgactctttgccggatttttcgcaaaaagacttgctgcgatgtaacccatactcatcctgcacttctgtctgtaaggaagcttgcttctactggggaagctacccaagagtgcttacacttatgggaactgttggagtgttccatatgcgatccacgtgttggtactcagcctggaccccctcttatttgtgcatctttatgcgagagaatttatgaggcatgctcaaatgcttacttctctatggatgtgaaaacacaaattctagcaccttgtggagtaaatgactttgtatgtggtagggctgctgaatgggtctccaatggtacagatctttgtcttgctgcaggttttcgagtgaaaccatccgatattgtagatattgcctcagaagaaacttcttgctatggcgataaagcaagtctaggttctgttgtcgattcatggaaggcttcacagtttgagttgaccgagaaaggtgagagcttgaggatgttggatgatttccagcaatgggcaagggaaatgccatttggtgaaagagtttcttgggctataggggggatggttctaacagcaggcttgatgtttataagcaaaaggaaaagccataaccaacgccagaaactagcagctataaagcgaactgcaaggaagcttgaaagcaggatgatggaacaacggccttctaatgctcaagaaaatagaagagtttctagataa

SEQ ID NO: 20487 - DNA, 276 bp, Glycine max
  Peptide Sequence Number=SeqID_137265
atgaagcaagatttgggaggcggttgttcgttgtgtgattttggtggatcagaatcagacagcggaagcgtgaaatcgtacggtgaggattcgcccaagaatgcggtgagagtgacgcgaagtataatgatcgtgaaaccacctggtaaccagagtcccagtggatccgctccggcttcccccgccggttctactcctccggtgtctccgttttcggaccttggattggctttgggaactgtgaatgtctcccggggaagtggagtgacactgtga

SEQ ID NO: 20488 - DNA, 249 bp, Glycine max
  Peptide Sequence Number=SeqID_137266
atggatttgggaagggcatgcatgcgtacccttggcggaggcagatcggaaagcgaaggagtggtgctttcggagcttgccgaggccgttctccgggcgaggaccggcgagggtgtcatcccacaagtgatcgaggaggcccatggtgagaatagtgaggaaacacgctgcatgagatctggaccgtggattcgatcgggaagcacgtgggcgcacatgacgtggctttatggatctggattctcctag

SEQ ID NO: 20489 - DNA, 2139 bp, Glycine max
  Peptide Sequence Number=SeqID_137267
agctacccaacagtgtattgtgaagatttgaaagcattagttatagaaggtgatctggagaaggtggcaactctgtctgaaaaggtgaaggaaaaggagtttgaagaaaccaagaagttgtgggatagggcgttcaatcaaccttatgagaaagctggtggagaggtgcctttgacgttggagggtgttatctcaatcaaatcccctgtctattgggaggattcgggcaccgatgcctgtgtgtttgtgaggcttaagcaaagaataacaacatcgcagaaggatgtaaaccgtgattttctacgtctccaaataattaggtgtcatagtgaactaaagttagataaagccttctccaatttcaccaatgattcgtggaaaaaagcttggcacttttactgtgagtttgggactaagggagttatgtttgactatcgtcgtcatggtggtaactgtctaagaggaagtagcctgctagatactgtgtcgttccgctggaatgatttattgagagcagattctttaactttggaaaaggaagttagtcaacaggttaatgttgttacgtcaataaccccaccagttcaagcaccatacttgttgaaatgtgtgcctgatcgagtcactgatgattctggggctatgatatctgatgtgattctgaagatgaatagttatcgtccacaagaaggccgatggttgtctcgcacagttcttgatcatgcagggagagtgtgttttgttattagaattagggtaggaggaggattttggagaagagggggtgaagctccttcagctgtaaaatgggaagataggattatagagatacgcgaaggatcttggtcttatgttgccggttacattggtagagcccctgaaaaggtggtggccactgcaacaccaaaggaacctactgaacaatgtaaagctgcatggtgcttttcaacaggagatgaactgacaatacaatgggactcatcacaatcagtgtcaggtctcacctttagcttgctaaatcaaacatctccagagtcatcggtactgctattgagagggaggcagatgcaatatcaagtaaagaaaacaaagtcaaagagaaaaggtgaagacatgaaaaccgagttagaggagaaagaggttgacgaagaggaagacgaggagagttttataacagtagtacgtttcacagaagataacccagatggaaaagcaactgctcttctaaattggaggctattggttgttgaagtattgccagaagaagatgcagtactgatgcttcttctttgcctttcaatactcaaaagcgtatcagaaatgaagaaacaagacgtgggagggttgttggtgaggagaagattaaaagaagcaaggcttggaagtagggattggggttctgtgatacttcatccatcttcatggtcctcgtccattgattcaacttatcttcaaccttggcattggaatgctggggttttgatgaaatctgatgcagtagatcagcttaaaaggtatccaacattaagtcaatcgccagtggaagctgtagttggaaaaggttttgttgcagtgaacataacatttcgcaacactgcggcgtccagcaagcatcaagcggtggctgtgagaaacggggcagacatgtccacgttctacagttgtagttttgaggtggatttcatatttggcaatgcagcggcagtactccaggattgtaacatgtatccaagacttcctatgcaaaaccaattcaatgcaatcacagcacaaggccgaaccgatccaaaccaaaacaccggcgtctccatacaaaactgttgcacaatagcagccagtgacttgggtgatgctactaacaattataatggtataaagacatatttgggtcggccttggaaggagtattcgaggactgtttacatgcaatctttcacggatggcctaattgatccaaagggtggagcgaatgagtttgctaactggggacctggttctaacactagcaatagggtaacatgggaagggtaccatctcattgatgaaaaggatgcagatgatttcacggtgcacaagtttattcaaggtgacaaatggctgccccagacaggagtgcctttcaaagctgggtttcagtga

SEQ ID NO: 20490 - DNA, 393 bp, Glycine max
  Peptide Sequence Number=SeqID_137268
atgacaggaaaaatgtgtatgttccaatgtctgacctctatgcatggtggaaaagtcattttcaatggaaatcagaaagggaagatagcaggagttggaaagataaaacagtctctgccagtagaaaaagtatggtctggtagtagtgaacgactactcaagatgaacatggttatgttgtttgcttacaaggatgagtcctttgaagtcttctttaaattctttgaaatggttcaaaatgaaaagggagtatgcattactgcaatcataaacgatcatggtggagagtttgaaaatgaaaatttccatttacaaaatggtgtggttgagagaaagaatagatcattgcaagaaatgactataaccatcctcaatgataacttctatacctaa

SEQ ID NO: 20491 - DNA, 252 bp, Glycine max
  Peptide Sequence Number=SeqID_137269
atgacatcagaattcacaagcgtttctcctcctcaaatcttagccaacatgcatcaatcagaccttgcaccttatgtttcaaggtcatacaatgctcaatggaatgccccgaaactccctcatgataagcacatgccgcattcgagttgtatcctcgaggaaatggaggtagattttgtggtcaatttaggggtggcctttgtggcagattgggtgttcttgcttggtagggtggtgggtgtcataccttaa

SEQ ID NO: 20492 - DNA, 204 bp, Glycine max
  Peptide Sequence Number=SeqID_137270
atgaaaatgggatatgttgttcgaaattcaattgcacacactttcactgttggtatttgtgagataatattcatggagggagaaaagaaatcgcatgaagacagtacaagtggaggtttcaatctcttctccgtctctctgacgtttgggaattctatcggagcattcggaggaataactggagaaatctcaaggaactgctag

SEQ ID NO: 20493 - DNA, 659 bp, Glycine max
  Peptide Sequence Number=SeqID_137271
atgtctctaagtctagccatcaaactacacctggcttcttcttctccttctttttccctccttaccctcaacaaccaccaacatgcaaacaagttaacaacttccgaaacttgttccaacaccaaggttcgtcccaaacccatttatagcaccaaccctttgatcattcccacgtgtaaagtgaggccaagagtgcaatactgtggcaccatgatcaagagttctttgatagagcctgatgggggggcattggtggatcttgtggtgcctgagggtgagaggggtgctaagatcaccttggctgagtcactgcctaaggtgcagctcacaaggattgatcttgagtgggtgcatgtggtgggggaagggtgggctagtcccttgaaagggttcatgagggaggatgagtatcttcagagtttgcatttcaattcccttagggtcaaggatggttctgtggtgaacatgtcccttcccattgttttggccattgatgatgagaccaaagagagaattggatcctcttcccatgtggggttgctcgggcctgatggagattgtgttgcaattcttcgaagtccggcgattttggtcgcaacattaaggtttttgaactctgtgactgcaattcgggccacattggctgcatttgtcccctg

SEQ ID NO: 20494 - DNA, 315 bp, Glycine max
  Peptide Sequence Number=SeqID_137272
atgtccccagtcgaaacgtgcccttcgcaggcgagcgagggcgaggctcacgggtgcgctttccaaaggaggaaaaatgcgcggagtcgccaccaacgtttatttgtggaaaacgtcggaaaaaccgaaggaaaccggtcgacaaaagcggggcttttgctcctacgtaccctccatcaaagaggaaatcagacctacgtagttctttcttttatgcgtgaatcaagtgattctttttacttgaggggtgatcattttaaggtgttgtaccttaaaaatgatcctttttacttgattaagcgagaaatgacttaa

SEQ ID NO: 20495 - DNA, 264 bp, Glycine max
  Peptide Sequence Number=SeqID_137273
atggacgaaaaacagtggatgtatgataatatcatgtctgaaaaagttgatatgaatgttggaaatgaggaaggtgttagcgtgaaagtagaacacgttgattgttctgatgtctttgatacttttcaattgtttgctaatgacattggatttgttgtcatgataatgaggttagacaccaatactagtgttagaggaaaggtctcatttctattaatagcttgcaaaaggaagggtgagtataggcctaagaagaatgattag

SEQ ID NO: 20496 - DNA, 216 bp, Glycine max
  Peptide Sequence Number=SeqID_137274
atggtgtccccttctatgcaccatcttgaggaagggtggtgcagagaaggggacaccaagatgccgccggttttaaggttgtgggaaatggacatgaacgcggcggtcgtcgtcggaacggaaggaatgatatatgtatataggtacccaacaagtgtgaggatgaggattaaagttgttatctgcttgggtatgagaccaaattggtggcaatag

SEQ ID NO: 20497 - DNA, 1818 bp, Glycine max
  Peptide Sequence Number=SeqID_137275
atgagcactgaaattgctgaacatgatggccgtgttgttgatcttgaaggtggtgttgtttcatcatccagtgggaatgtgatgggagatctggttgatgtttacagcacaatgctcaaaaaccttgatttgggtttggcttgtttctctgagaaagttttcaacttgagcaattttttgatgcatgtggaaaccatggagtgtgagtttgaggccttggagaaagaggatcacattggttatttggaaaagggcctggagtttgatctgttgtctggggtgtttgattcagaggtgagggagttggagggagtgttggacacccttcaaggtggggttggtgaggctagagactgggtgagttcttgcactcatttgggagaggcttttgtggcaatgcaagagaagttggttggttatgaacaacggttgaagcagtctgaagaggagtttaatgacattaagatgcagtcagtcagttttcagaggactttgccttccttaaagaaggaagaaaatggtaatgatgatgcaagtgaaatcatcacagaggatgataaatctttgagtgcaaatgcagagataagactgcaaacagttgagcaacaaagacatattctgagaatgctagagaagtcgttggcaagagaaatggatcttgagaaggatataaatgattcgagagaaattcaagaaaatctaagactaaggatgttcttttcagagcaagagcttgataacatggaggaagaagcaattgatgtttgggaaagatggcttgaggcagacaatacaagtgagattctgttgggaatttcgcaaggccttttaggtagactccacatttctcagttcagtttgaatggtctaagtcaccgtgaatctgagcttcgagctaatctaaaagatgcagaagataaactaaccttttccaattctgaggcctctgctttaagtaataaggtctcttcacttgaaaagcaactaaaagaatctgaatttcagctactgaatgcaaaggcctctgctgatgaatatcagaagcagtacaatgttcaatgttctgaagcaagagacatggggaatattattgttgaactgaaagaagctgtatctaatgcagaaagtagggctattagtgcagaaactaagtgtcagttattgacggagactaattcaaaactcgatgaggagctggctcttttgagaggtgcaaccacgagagcagaattgctagagaggaagctgaaagaatctaatctacgattgcagaaaacggtagcatctgctaaagctagtcaggagaaacaaagtaatttgtattccacaattagagatatggaaaatgtgataaaggatcttaagtcaaaggtttctaaagctcagggtagggctgacagtgcagaggacaattgtatcatattgtctgaatctaatgctgagttgaatgaggaactcagctttttgcggagtagattggaaagcctggagggctcccttcagcgagaggaggaagtgaaaatggcaactgtagaggacattggaaagcaagccaaagtgtttaaaaaattggtaacacagctggctgttgagagagagcgtcttaagcagcagattattgatgccctggtatgggataaacatcaatgttatagtgcacatgcatatttcaccttacctttggatatcttccctagcaagagagaacaaaattttggtattgaagttaaagcaaacatgttaaggatccctcataagaagctagtgagacttcagccactgaccatgaggttgattggcaagaatccctttaactaa

SEQ ID NO: 20498 - DNA, 960 bp, Glycine max
  Peptide Sequence Number=SeqID_137276
atgtggaaaaccaaagaggtgttgagattatcagaagaagttaggtttggaggtattgaaatctacaagcataacaaggaagaaagaatagctagaacttggggaacaactgctcctggattgccatatgttgaggaggtgattactccggcaggaaattggcttattggaggagatttggaagtgctaaaacctatcaaatataatgatggcctagataactacaggctctctcccaaacaactccgtgaagaatttgacaagcgtcaagcagatgcagtttttgcctttcagttaagaaaccctgtacacaatggtcatgccttgttaatgaatgatactcgtaagcgcctattggaaatgggctacaaaaatcccattttactgcttcatcctcttggaggttttgtaaaggctgatgacgttcccttggatgtcaggatggagcaacatagcaaggtcctagaagatggagttcttgatcctgagactaccatagttgccatatttccatcacctatgcattatgctggtccaactgaagtacagtggcatgcaaaggcacggataaatgcaggtgcaaatttctatattgttggtcgtgatccggctggtatgggccacccaactgagaaaagggatttgtatgaccctgatcatggaaagaaggtgcttagcatggctcccggtctggagaagcttaacattttgccattcagggtggcagcttatgacactaaggtaaacaagatggcatttttcgacccaacccgtgctaaagatttcctctttatatctggaaccaagttaggtgccgtaagagacatgcgggcttttgcaaaaagtggggagaatccgccagaaggtttcatgtgcccaagtgggtggaaggttcttgtcaaatattatgaaagtttgcaggcagaagagccatcacaacagcctgtgctatctacttag

SEQ ID NO: 20499 - DNA, 3006 bp, Glycine max
  Peptide Sequence Number=SeqID_137277
atggtacaagatgacgaagaacctgatgatggagctgtgcctttacaccatgaagacagtgttaaaaacagatatgttccatctgttgctgctctatcaataatccgtccatcaataggagggcagcagacaattgcagatagagccaaagtcgcaatgcagggttatttgaatcgattcttgggaaacctggatattgtgaattctcaagagataatgtttagcagaccttcagatatatgtagggtctgcaggtttttggaagtctccaggctatcctttttacaggagtatggtcccaaactgaaagagggatatgtaatggtgaagcatttgtcaaatatttcacaggattcagatgtatcatgcttcccatgcaattggtttcactgttgtaataacagctggaagaaggtatggtctgttttgaaacctgggtttttggccttcctggatgatccctttaacaacaaaccactggatataatgatttttgatatcctcccttactcaaatggagatggagggaccaaaatatttttagctgatcctgtaaaagaacgcaaccctttgcgttacacattcaaggttactagtggaaataggagcatattgttgagaactaccagcagtgctaaagtaaaagcttgggttactgcaatcaatgaagctagtctaagacctcttgagggctggtgttgtcctcatcgctttggttcctttgctcccataagaggtttgactgaagatgggagccaagcccaatggtttgttgatggacaggcagcatttgaagcaattgctacttcaattcaagatgcaaagtcagagatcttcattacgggttggtggttgtgcccagagctatatctgagacggccttttgatagcttttctacctctcggttagattcattactagaagaaaaggctaaccaaggggttcagatctatgtgcttctctacaaggaggtttctctagctttaaaaatcaacagcttgtacagtatgagaagactgttcaaaattcatgagaatgtgagggtattacgctatcctgatcatttcgctgctcgtgtgtatttatggtcacaccatgaaaaacttgtaattattgattacaagatttgctatatcggaggattagatttatgctttggtcgatatgacacacctgaacataaagtgggtgactgtccttctgtaatatggcctggaaaggactattacaacccaagagaatctgagccaaattcatgggaagacaccatgaaagatgaattggatcgcaagaagtatccccgtatgccatggcacgatgtccattgtgctctttggggacctccctgtcgtgacattgctcggcactttgttcaacgttggaaccatgctaagagaactaaagctccaaatgaacatggaattccgctacttatgcctcaccatcacatggtcctccctcattacatgggaagaagcaaagagatagacattgatgaaaagaaagacaaagacaagaggaaaggaattggcaggcaggattcattttcctcagagtctccaatgcaggatataccactacttttgcctcaagaagctgatggactagatacttcaaatggagatcatacaaatttaagtgaaaattttccattgtcccaaaagctggagcatgaaactttagtttcagacacccagatgaaagggtttcaagatgaagttgttcctttaaacttgggggcacaacctgttgccaatgctctagatgattggtgggaaacaccagaagaaaccaatgatgacattactttggaatatggagaagttggtccacgtactacctgtcactgtcaggtaatcagaagtgtcagccagtggtctgctggaacaagtcagcctgaagaaagcattcacactgcatattgttctcttattgaaaaagcaaagcattttatctacattgagaaccaatttttcatatcaggtctagcaggggatgacataatactcaaccgtgttttggaagcactatacaggcgtattttgcaagcccacaaagatcagaaagattttagagttataattgtgatgcccctcttgcctggtttccagggtggtctggatgatggtggtgctgctactgtaagagccttaacacactggcagtatcgaacaatttctagagaaaatcactccatattagacaatcttgaagctatacttggtcctaagacacaagattatatttctttctatggtctacgatctcatggcagactttatgaaaatggccctgtggctacaagtcaggtatatgtgcacagtaaattgatgataattgatgaccgtatagcttttattggatcatctaatataaatgaccgtagtttgcttggattaagagactctgagattggagtgcttatagaagacaaagaatatgttgactcgttgatgaatggaaaaccatggaaggctgggaaattttcctacagcctccgctgctccctatggtctgagcaccttggtcttcatgccggagagatcagtaaaatcagtgatccggtggcagatacaacctacaaggacttgtggtcagcaactgcaaaggaaaatactaggatataccatgaggtctttgcttgcattcccaacaatcagatacactcaagagctgcacttcggcaaagcatggttcactggaaagaaaaacttggtcataccaccatagatatgggaatagccccagataagttggtctgtcatgagaatggagaaatcaaaataatagaccctatagataggttgaagtctgtgaagggacatcttgtttcctttcccttggagttcatgcgtgaggaagatcttagaccagctgttattgagagcgagttttatgtcgctcctcaaaagggaaatgtggaagataagcttggagacaaaggattgaacacaatggaaaagaaagctgaaggagaaaggatacacaatatggttataaattag

SEQ ID NO: 20500 - DNA, 417 bp, Glycine max
  Peptide Sequence Number=SeqID_137278
atgaagaaaagctcaaatagagactatacttctcacatagagttccagacaggaaatgactttgatcccaagtaccacaaagctaagttctctagggaaaatatccatgagatcagacagtctgaggatgtacagaaactgcaaaggattttctctgttgctgagaacactaggaaaacaatgattgatatgagcaacagggagtgtgatggaactagtaacataaccgtgagaaagaactggtttttattgaataaaacttgggaaaaagcccccaaggaaccaatgcacggctccagatatttcaagaggtctggatccactacttacactgctttctcaatcaccaaaagtcccttaaactgtttacagttattcctatttataggcagctacttgtctacagtttataattga

SEQ ID NO: 20501 - DNA, 1047 bp, Glycine max
  Peptide Sequence Number=SeqID_137279
atggggcatttttcatctgcgttcaataggttggcaaagtcattcacaacgaagaaaggaaggagttctgatgaatgtaatggaagagaagccgcggaagcaatggcaaaggaagccaaaagaaatcacttcatgttgcatagctctggcacagttaatgttgatggttcaaacaactttgcctcagttttctccagaaaaggccagaaaggagttaatcaggattgctgcattgtgtgggaagaatttgggtgccaagaggacatgatcttctgcgggatttttgatgggcatgggccatggggtcactttgtggccaaaagagtacgaaagtcaatgccgccatctttgctatgcaactggcaggagacactttcccaaactccacttcattcagatgttgattttgatatagagacagagaaaaagcaacaccggtttaacttgtggaagcattcatacttgaagacttgtgctgccattgatcgcgaactagagcagaatcgcaagatagattcattttacagtggaacaactgccttgtcaattgttagacagggtgaactcattatcattgcaaacgttggtgactctcgtgctgtgttagctacaacatcagatgatggaagtttggtaccagttcagctgacaatagatttcaagcccaatttacctcaagaggcacagcgaatacttgagtcccaaggacgagttttctgcttagacgacgagcctggggtgcatagggtgtggttgccggatgaggagtttccaggacttgccatgtcaagggcttttggtgactactgcgtcaaaaagtatggtcttatttcagtgcctgaggtgtgggatgtaatctccaatcaagaagcagtggatattgtgtcttcaacaccagacagaacagactcgtctaaacgtttggtggagtgtgcaatgcgtgcatggaaacgcaagaggcgaggcattgcaatggatgatatttcagctatttgtctcttctttcactcttcaccttcacttgaccaagttgccaccccagaatag

SEQ ID NO: 20502 - DNA, 1125 bp, Glycine max
  Peptide Sequence Number=SeqID_137280
atgtctaatcatcatcgttcctccaatcccttctcatctactcactctgattccgattccgactcagtgagttgcttcgtcaccgatctcttcgagactcgctctcgcctctgctcctgcgacgacgacactgacataaaccccttctctgacgtcgtttgcgacctccatcgcacggagcatatgttagggttagggttagggtttggcgttgaaattgatcccgaaagccaaacaaatgatcgtgataatcatcgtggtgatagggttttggaagctgatagagttttcaatttcacggtgggggatggttcgggtgggcttagggttgtagggtttggctcggaatccgaatcgagtagcgaggagggtgggattcgtgatggtggcgggtttgatgatttcgatgttcggttgtgttgggatagtctctgtttggaggatcagaggacgctgaacgaggggtttgagtgggaggaggtggaggagagggtgaatgagagagaggatttgggtttggtggttgatgaggttgaaattgaaagtgatgatggtgatgggaattcggtggcgtcgggttttacaaatgccgttgaggaggaggatgccggggaagaggcactgaggtacctcgaatgggagatcctcttggcggttaacaatttggagaggaatgtgaatgatgtgttggagcacgagggcaatgctgttggtggtgctgatttgttaacaattcaggatggttatgtgtacgcagccgagtatgatgttttgttcgggcagtttcttgagaatgagagtgccttgaaggggagccctccggcctcgaagagtgttgtggagagtctcccgttggtggagttgtccaaggaggagttgttgcaggggaagaacgtggcatgtgccatttgcaaggatgaggttttgttggaggagaaggtgagaaggctgccttgctcccattgttatcatggggactgcattttgccgtggttgggcattcgcaacacgtgcccagtttgccggtttgagctacccactgatgatccggactatgagcaggggaaggtccagagggcagcacatggtctgttggagcttgcggcagcacggatgcaattttga

SEQ ID NO: 20503 - DNA, 357 bp, Glycine max
  Peptide Sequence Number=SeqID_137281
atggctgcttcaaaagctacatatttggaggcatatgaagagaaaatgaaccaaatcaaagagataaacaataaggcatatgagtggctcgctactgaattccttaagaagacatggtgtaagtatgcttttagtgtgtactccaagtgtgatgtaacaaacacattgctcacacggaagttcatcgtgaatctagcaactaggaatgcttgtaatttttggggattggttgggataccttataggcatgtcccaattgttggatttcaagtcccaacagaagcacaaggggctggatctcaagtgccaaatgttggatctcaagttgggagcaagtctacaaagcatcaaacgaag

SEQ ID NO: 20504 - DNA, 630 bp, Glycine max
  Peptide Sequence Number=SeqID_137282
atgaaggtcaacaaggaatgcgatgccctagactgctacgggaactgcctcacaaagatggtgacaataaagggagtcctcctcaatgccatcatcatcatcaacgatgagaaggaaaaccttagaggcgcatttgtggccgcggtggaacttctaatcgcaattgaagcaaaggccgtgctcgtgccagcttctcctcttgaagacgagcgagtctcgctgcttgaaccaacgttaatggttgtaaggcctggacctcaaaacggatttccggcggcttgtaggaagactgaccaagatatccaatcgagggggtcactgtcatcaaatcgcggaacatcaagtttcatgcgatgggagttcactgaagtggctgaagaaggagtagtagtcgaagaagatggggaagaagtggtagagtccttggtggctaaggtatggatctattcatcaagcttcagtgtcatggtgtggatggtctcactcagggataagtggttcgaagtgagcttcacaatggcatcctcaagcctgtcagaggacacctttgaacgggtggattcgaccatgggagagggacaaggagagcaccaaaatgttaggctcatcactcacaactctggactttga

SEQ ID NO: 20505 - DNA, 303 bp, Glycine max
  Peptide Sequence Number=SeqID_137283
atggatgaagaagtggctacaaaagccaaatccagcaaagtggaagtggatgtgtccattcttgcccttgctgctgaaacaccagtggaaaaggctgataaggctgtgactaaacaaacctcacatgaagccacatctaaggacacctctactgtgaaggacatgattggacaagccataggcagctttgctaacagacatagagctgaaaatgaggagttcaggcactccatgcaagaagtcatcactactcagttcagcagtcttggtgcctcactcatccaaaatctccaacagacttaa

SEQ ID NO: 20506 - DNA, 603 bp, Glycine max
  Peptide Sequence Number=SeqID_137284
atggttagctctgctagggttttgaaacaaagcgatactagttcaaccatacaggaggatgatctacacttgcaaagtacaaagaaagtcaaggatcacacagaagctagtgtgggtgaggaagcattatcttatgtagataaactccttacgacaatggggggagttactggtgatgatgtctctatggagggagtgacggtgaatggtgtgatggaagaagtgccaataatggagcatcaaaacagtgtggagcaaaatatggatggctcagctattcccttatccgatgtagaattgatgagatgggcctcttcatggttgaatactctcgtgatcattgaccttcatgagggattctatcaagtggttttcagtaacgaagatgattataatatcgcgttgtttgaaggactgtggatgattacagtccattatctcattgtgcaaagaaggaggccatttttccttataaatgcggaaactacgaagaagatggcaatttggatcaacatttaccgtcttccaattaagttttataatgatgtcttcttcagaggattggcacgagtcttggcaaatttctcaaggtggataaattaa

SEQ ID NO: 20507 - DNA, 1092 bp, Glycine max
  Peptide Sequence Number=SeqID_137285
atgcagtttttccatgatggccatctcgtagagctcaaggaagggactcatttgcctagtaccagccctttctcctcccttgttctgctagttaagaagcatgacgacacatggtgcatctgtgttgactaccgtgcattgaatgccataacgatcaaggatcattttccaatccccaccatcgatgaacttcttgacgaactgagaggtgccaactggttttccaagctagaccttctacaagggtaccatcaaatcctcatgcatgaggaagatatatgtaaaactacctttcaaactcatcatgggcactatgagttcaacgtgatgtcgttcggactgtgcaacgccccttcttctttccaggccactatgaatgcaatctttcgatcatatcttcgtcattttttcatcattttctttgacgatatcttaatttatagtcgaacattagacgagcacttggatcacttggagaaggcatttcaagttatgttggacgaacaatttgttcttaagttgtcaaattgttcactagctcagaaccaggttgagtatttgggtcatcgcttcgtcatcctcactgaccatcaaagcctcaaggaactactgacccaggtggcgcagactccagaacagcaaatgtatctggctcgactcatgggttatgactattgtattcagtattgtgctggtaatactaacttggtagtggatgctttatctaggcttcctgatccttcgaaaagcacaatgttgctgttatcaattccctatccgacatttttagaggaacttaagaagaacgtatctcgggatcctaattttattcaattccgtcaaaatatcactaccaaactagaggctcatcctgagtgtgtcgttaaggatgatctaattctaaaaagggggcacatttggttaccaaaatggtccaatttcatcccaacattgcttaaggaatatcattcaacacccatcggaggttatatgggcatagccaagaccatggctcgattaacagagaactttgattggcctgggtttagaaacgatgttgaacattttgttgcggcttgtcttgattgttag

SEQ ID NO: 20508 - DNA, 1166 bp, Glycine max
  Peptide Sequence Number=SeqID_137286
atggagcgtccagtaggcaatggaatgtgtccagacttaacaccttcaaggaagagatccattatgggaatagtgcttgtcttaagcaaggatggatcttctagttgtgataatggactatccagatctaacattgattgcttaaagaaagaatttgagatgaaggatttaggaaggacaaagtttgcttgggattacatagagtattttaataaaggtgtttttgtgcatcaagagacttatataatgatggtgcttaaaaggttctatatggacaaatcacatttgttatgcactttagatgtggataaagatccttttagacctcaagaaaaagatgaagaactacttggtcctgaagtaccatatcttagtgttataggagcactagtggattctactactgctactacctatcctttcaatatcttcaacctttctagaatcttcttcttcttcttcctcgccacactcgtacatggatccaacgagaagaagctgatcttcgaggtagcgatgcaacagccccttctcctcctcccgctcctcttcgcagcacccttcctcgcagcggcggaggcgatcggcggcgtcaccgcgacggaggagcttcccccagaggctgccgcggcgacggaggcagagctcggcggcgcagaggaagggcaacgcggcacagacgacgaggaggaggagtggcgagcagaggacgaggaaaaagtaccggatccggcggtggcgcagccacgaggaggcggcggcggcggcgcgggtcaccatgcacgaagggggctcatggccgcggcggtggaggtggtaggtatctgcggctgtggcggtggtggatgtgatgatgtgtctgtgcccccacatgggagggtgttccggttcgagttgcttgttcattgttgtgttctctttgatagaggtgcattgtttacggtggttcgtggacaagtgatggttgtagtggtggttgatttggccattaacggtggaggtaagatggaagaagatcaatggatgtatgacagtataatgtctgaagaagttgatataaatgaacaaaatgaagatgaagctgatgtgtttgccactcgcgatgatgttctacattgggctcgatctattgcttatgaaattggttttgtggcggtgattatgag

SEQ ID NO: 20509 - DNA, 249 bp, Glycine max
  Peptide Sequence Number=SeqID_137287
atgaaaattggcagacaaggtggtctaagacaaggtggtctaacgcagtggcagacaaagttgtcagctcatcactatgccgttaaacaaagtcctttagacatggcaatgggacggggcagggacgagtattgtctccccaatccccgaccccgactccccaacatgtccccatacccgtatccgatacccgacgggttaaaatttattatcctatcttcgtacccgttgggtatcgggtatccctga

SEQ ID NO: 20510 - DNA, 390 bp, Glycine max
  Peptide Sequence Number=SeqID_137288
atgttattaatcaataactcatctcccacttctgaggtcgagaatgagactgctgctgccactaataagaggaagagaaggcatgcaggaacaccagatccagatgcagaagtggtgtcgctctcacccaagacctttgctggaatcagattgttatgtgtggcgagccctggtgcagcagtaaagttgtgccttggtgacttgttggtcatgggttcgaatccggaaacagcctctttgcatatgcaagggtttcttctctgtgctgtcgtcgctcatattgctcgtgagcgtaagcgcaatcgtcgtcgtcatctttcgtctctccgtcgtaaatctcagtttcctctttgtcgttcggtggcgtctttggtcgtttgtggttgctga

SEQ ID NO: 20511 - DNA, 1107 bp, Glycine max
  Peptide Sequence Number=SeqID_137289
atggttagaacgggaggttcgggttggactttggacagggttataagaaaagctttagttgcacctgttgttgagcatgtggatcatgctactaaagaggtccatgaacaacctcaagaggcacctggcgggccttatgacacattagttttgatggactatgcttatcatgtgactgtgacagtttggaataaagaggaacatcctgagttgaagttgtcctcccatgtaaggaaggtagagaaatttggtaggcatgctcctgagattgaaggcttagagaggtggcataaggaaactagtagtttccatataccgataggagaggtgactatcaccctggatgatgtgacatcgttgctacatctgcccattacaggcgccttccatagctttgagactcttcatgtggacgatgtcatcttcctcttagttgaattgcttaaagtgagttttgaagaggacaagagttgggacggtataatgccacaaggcatatgttgcacactatttgctaacaagagtgccacacacgtgcatgtggtattcttggacgcatttcgtgacctgacgcaaagtggaagttatgcatcaggagctgctgcactggtccatatgtatgacattttgaatgatgcgtcaaagagcagcgctagacaacttgcaggatatatcacacttttacagcattttccttcaattgtttttgctattactgcaagagattatgatgagaggaaaccacatgcttgtcgttggaagtctgggaaagcattgtcaatgttgacgtattgtaagcatctggatgtattggtgtcttatgctatttgttggattccctatagtgaccatcgtgcattcagagagtttgagctgatatctttatttttcagacacatgtgttggggtccatctatcatcatacaccgaccagaaagggttatgcgacagtttgagtatgtgcaaaccattccaccacaccctgctactccatgtctatctgtagaagaaattgatgatagatggattcaattttttgaataccttgcactggtgggtcaagcatgtgttgcgcccagacagtgtgcaacagactacatggagtga

SEQ ID NO: 20512 - DNA, 1663 bp, Glycine max
  Peptide Sequence Number=SeqID_137290
atggggcttgagaaagaatctgggttcttttttaacatgaagtactttgaggaaaaagtgcaggctggcgagtgggaagaggttgagaagtacttatcaggatttaccaaagttgatgataatagatactcaatgaaaatattttttgaaatcaggaaacagaaatatctggaagcacttgatcagcaagacaaggcaaaggccgtggagatattagtgggtgatttgaaaatgttctccaccttcaatgaggagctatacaaagaaataacccagttattaactcttactaatttcagggagaatgagcagctatccaagtatggtgacaccaaaactgctcgaagcattatgttgatagaactgaaaaaactcatagaggcaaatcctcttttccgtgataagcttatcttccctacccttaagtcatcaagactgcgaactttgatcaatcaaagtctaaactggcagcatcagctctgcaaaaacccaaggccaaatccagatattaagactttattcacagatcacacatgtgcacctcccaatggtcctctggcgcctacacccgtcaatcttccaattgctgcagttgcaaagcctgctgcttatacttcacttggagctcatggtcccttcccacctgctgctgctgcaactgccaatgctaatgctttggctggttggatggccaatgcctcagcttcatcatctgtccaagcagctgttgtcacggcatcaactatgcctgtcccacagaatcaagtgcctatcttgaaacgtcctagaacacctcctgcaaatcctggcatgattgattatcagaatgctgatcatgaacagctaatgaaaaggcttcgtcctggtcattctgtagaggaggtttcttatcccttggctcgacaagcctcttggtcgctggatgatctaccaagaactgtgactatgacattgcatcaaggatcctctgtgacgagcatggattttcatccttctcatcataccttacttctcgctggttcaaataatggagaaattagcctctgggaactcagtttgcgagaaaagttggtctcaaagccattcaagatatgggatgtgtctgcatgctcattaccatttcagctgagaatttgtcaggctgctgcagtcaaggatgcacctatttcagtcagtcgggtcacatggagccctgatggaagttttgtgggtattgcttttactaaacatttgattcacttgtatgcttacactggaccaaatgagctaacccagcgtatagaggttgatgctcatgttgggggtgtgaatgacttgtcatttgctcatccaaataaacagatgtgtattgtgacttgtggagatgataagttgataaagttcatattttcaactgccattgatgggaaaataaaggcatggctatacgataacatgggttctagggttgactatgatgcccctggtcactggtgcactacaatgctttacagtgctgatggaactaggttattttcttgtgggacaagtaaagatggagagtcttttcttgttgaatggaatgaaagtgaaggagccattaagagaacatacaatggattcagaaaaaaatctactggagttgtgcagtttgacacaacccaaaatcgctttttggctgcag

SEQ ID NO: 20513 - DNA, 516 bp, Glycine max
  Peptide Sequence Number=SeqID_137291
ggtaaacggatatggatgatagttgggatcccaggtaggagagccagccaggagaaagaggtagccgcccacccattcttcctttccgaccttagcttagctgctcacgccaatgctcatgggtatggggccataactgctgctactgttatactcccacactctaagagagtcctaccgtcggctcatcttctatctaagacctcctcaatgagaggatgcctgaaagtctttttctcaggtctagttgcggtccgctctttttctttcacttatgggtacacttcactcctctcccagcaagaggatgcgcgaaccattgttccaaagatcggagaatctagggaaccggaaaagcgaaacctttgtcaggaagaaagtgaagcaggctttctccccaaagcatatgattgcttgttcgccatagctgatcacactgtgacgctgagcacttcggataaagcaagattcgaaactttagccattaaggacctcgagccgactctcgtctgcgag

SEQ ID NO: 20514 - DNA, 720 bp, Glycine max
  Peptide Sequence Number=SeqID_137292
atggcattagcaaggagaaataggcccaattttgccagagccatagagacccttcgtgggagatgtgcagaaaaaggcacaggccatccagaagcaaaacattaccctccacgtgttgtctcgtggggcactgacatcatgattgatccttcttctcccatcagacgacacatcaaatggaagatggccctcacgaagaaaactggtcagatgacgtctgaggcagcaaagcaattgctgacaagattgagcaggcgtcacaggattcctttgtcgcccatggacgtcaggatccggtgtgatgatcaagcaatactttggacctgctccatgaacctcccacacttcttcctccatggctcccgaagacatagagcagctgactcaacaaatcagggaccagctggaggagtcgatcacaaaaaatcacagatgcaatcacatggacttgtactgcctccagagcctgaggtttgtcctttagctgctcgtgtcagcacaaatgagagttatgttgatcccttagggaacgatccagacacgggaagcactgagtgtgggtattacgtgatgcactggatgtcaacaataatcctaggaagtttcaagaataattgggaaacgtatttcaatgatgctagaccagtggaactagagagattgaaggcacttcgcatccagtgggcaaagtattatttgaaagttagaaatgaaacttag

SEQ ID NO: 20515 - DNA, 768 bp, Glycine max
  Peptide Sequence Number=SeqID_137293
atgaccaaaaggcttcttgccggatcattggcattcgaatgccgcatcatgcactacatgattgtgtgcatcctacttcctagatcatccaaccttgcacaggcccatcttgttagatatcgcatgcataaggcattgcgatcaaatgctccacttccatatccccatctgatcaccttgtttctgcatcattttaatgtccctcttgactttgagccctttgttaaagtcaagagatctttctttatcggtgcaaatgtggtctcctcgtttggataccgcaaaaagaggggtggttcttgggtaaagaaggatcccgcacaggccctagaagaccgctctccatcaccacctcctcagagagatgattcttcatctcttatgcacaacattcttgatgcaatggatgctcgatttgcaggaatggatacacgcatcaccaagcttgaggaggatgattgtcatcgtcaaaaaggggaagattgtggaaacgtagcttccaagcctattttgatgatgccaaagactcaagtcaagaatcaagagtcaaacaagtttcaagaatcaaagagttgttcaatcaagaatcaagattcaagtaaagaatcaagagaagactcaagatatgcaagaaccattaagataacacaattttgttcaagagaattttttgaaagaaaaatcatttaccaagagttttactttctggtaatcgattatcagaaggcagtaatcgattatcagaaggcagtaatcgattaccagtag

SEQ ID NO: 20516 - DNA, 204 bp, Glycine max
  Peptide Sequence Number=SeqID_137294
atgaccgggaaagccgacggtccccacaataagaagttaaaaacatatttggggattgtcgctcgtgataagctcaatgtcacatacaagaattggaagcaagtctctgctactcagaaggatatgatatgggaggatattcagtgtttccaagacatccaaggctccggtaatagattaccaggcagtgtaatcgattactag

SEQ ID NO: 20517 - DNA, 198 bp, Glycine max
  Peptide Sequence Number=SeqID_137295
atggggtcttatggtggtcatagctcgaccagagagggtggtgaccagccgagagatgcaccagctgcagaccctgaggagtacatacaaccgcccaacccccaggttccagtggcatttgacccccctccacatgtggatgattacgagggatatgaggcgattgcacagaggttggagcgtgtgctcaaaccttag

SEQ ID NO: 20518 - DNA, 330 bp, Glycine max
  Peptide Sequence Number=SeqID_137296
atgtcacaagaagttgatatggattatgattatgataatgaagaagaatgtggtgtgaatgaaccacatgtcaattgttcaaatgctattaatacgtctcaggtatttggtactcgagatgatgttttgcagtgggctcgaacagttgcctatgaaaatggatttgttgtagtgattatgaggtctgacacagataccgatatcagaggaagaagttcatttgtcttaattgggtgtgaaaggagtgcgtctctgacgagccctgacacttccatcagcactggctccccctctgacaatcgtcaggcagtcctgcataatctcatataa

SEQ ID NO: 20519 - DNA, 220 bp, Glycine max
  Peptide Sequence Number=SeqID_137297
atgtattttatgttcaagatccttgtcatgaatgatggtcactggcacatggctacaccacccaactcacctcctcctcctcctgagtcagcaacaccttcttcaccgtctacgtcaaagaagacaagaaaagcaacacgactcagatcattggctactagaccaattggggtggagagaccagtggttcatgttcatcctgaaattgggaaattcgatg

SEQ ID NO: 20520 - DNA, 579 bp, Glycine max
  Peptide Sequence Number=SeqID_137298
atgtcccacattcccaccgccggctacggcaccctcgccggcgccactcccactcccactcccaccggaattactccatccaccgccgccacctcctcggtgactccccgtccatggcgcgagtttctagacctatcagccctctcccgcccctactcctacgacgacgccatgatccgagtccgaagaaacctgagctacttccgcttcaactacgccgccgtcacgctcctcatcgtcttcctcagcctcctctggcaccctatctccatgatcgtcttcctcctcgtcctcgtcgcctggtactacttctacttctcccgcgacgtccccctcgtcgttttcaaccaaaccctcgacgacagaaccgtgctctgcgttttgggattgctcactgtcgtttcgctcgtctccactcacgtcggcctcaacgtcctgctctcgttaatcgtctcggtggttctcgttggcttgcacgctgcgtttagggttaccgaggatttgtttcttgacgaggaaagttcgttgctttccgttgtggggactcagcctatcagaacaaattatacccccatttga

SEQ ID NO: 20521 - DNA, 807 bp, Glycine max
  Peptide Sequence Number=SeqID_137299
atggcgaatcgcacggatccagcagctaagagcataaggggcacgaaccctcagaacctggtggagaagattctccgatcgaagatataccagaacacctactggaaggagcaatgtttcgggttaacggcggagacgttggtggacaaggccatggagctcgaccacctcggcggcacctacggcggaaaccgcaaacccacgccgttcatgtgcctcgtcatgaagatgctccagattcagcccgagaaagaaatcgtcattgagttcataaaaaacgaggattacaagtacgttaggattctcggtgctttttacttgcgtatcactggttctgacattgacgtctaccgctacctcgaacctttatacaatgactatcgcaaacttagacgaaagctcgctgatggacagtttacattgacgcacgtggatgaggttatagatgaacttctcacaaaggattattcttgtgatattgctctgccacgcgttaagaaaaggtggactcttgaatctttgggttcgttagaacctagaagaagtgcacttgaagaagattttgaggaggaagaagagaaagaggataatgagcagcctgttgatgagattgaagataaggcctatgagaaggaccattatcgtgggagaagccctactagggaaagagacagggatagaaggcacgatagtcatagacacagtgtaggagtgtatctggactgtttcccatttctcagtctctattatatccctttgtcagtacagtctactaagggttatagtcttcagtctccaccatcataa

SEQ ID NO: 20522 - DNA, 1576 bp, Glycine max
  Peptide Sequence Number=SeqID_137300
atggcactccagaacttcgttgatttttctacaaactctgcgaatccatactatctgcatccgaatgagaatccagctctagttcttgtttctccttctttaacggccaagaactaccacacttggtcccgttcgatgcacatcgcgttaatttcgaagaacaaagacaagttcatcgatggatctcttcccaaacctcccgtttccgatccgttatatgcaccgtggatccgctgcaacactatggttctcgcttggattcaccgatcaatttctgattccatcgcaaaatcggtactttggatcgataccgctgctggtgtttggaagaatctacgtattaggttttctcagagtgatatcttccgcatttccgatctacaagaggatctgtatcgtttccgtcaaggaacgcttgatgtatctgattacttcactcaattgaagatctactgggacgaattggagaattatcgtccaatccctcactgtaaatgctcaattccctgttcttgtggtggaattgattctgttagggtttattgcgaacaagattacgttattcgcttccttaaaggcttgaatgaccggttttcgcattctaaatcacaaatcatgatgatgaatcctctcccggacattgatcacgttttctccctggttattcaacaagaacgtgaaatgctaggctctaattctgattcagtctctgaagctacttctgactctgctatggctatgcaagtcaattccaatcagagcaatttcaatggtaaagggggatattacaacaaaggcaagggctcttctaaaggtggtaatcgagtttgcactcactgtggcaaaacaaatcacatcgtcgacaattgttttgagaagattggctaccctcccggatacaagaccaataagtccaagaattcatcatcatcatctcaggccaacaatacctcaaatgcttctgctctggaatcaacccaacaaggttcttctgcacagtccagttttcagtttacacaagagatgtaccaaggcattcttgaagctcttcaacagtcaaaagttggttctcaaccaaaggccaattcagtaaccacatctccctttgctttgcattccccttcctccaatccgaatggtaagaatccttctctttggatactagataccggtgctactaatcatattacttttgatctttcctctcttaccacttatcaaaacattgtccctgtccctgtttctttacccaatggatcacaggttctagcttccatctctggtagtgtaattatctcacctttaattactatccatcatgttctttacattccttgctttcatgtcaatttgatgtctgtcacaaaattagctagtacaaataattgccatttaagtttcactactgatttgtgcaagattttgcagaatcattctctggaaacgattggtacagctaagcttcaaagaggattgtatgtgatagatactgctgatatgattcgttcttgtaattcactttcttctcattcttttgagctttggcattccagattaggacatgtatcacattctg

SEQ ID NO: 20523 - DNA, 817 bp, Glycine max
  Peptide Sequence Number=SeqID_137301
atgaatcaaaagatagaaggagatcaaagattcaatagaaaagggaagaataacaattttggaagaagtgcaacaatggctaccagaactcatgtgagctctgataccatgttgacaagaggatcaagtaatcaattaagtggaaagatacctgaaggcatcggcttaccatttcatttggaatctgtgtcaatccaatcaaactctttagaaggtggaattccaaaatcatttgggaattcatgtgctttgagctcactggatatgtctcataacaatttgaatcaagagctttcagtgatgattcatcacttgtctggatgtgctagatattcattggaacaattatatctaggcatgaatcaaatcaatggcacactacccgacctctcaatattctcatctttaaaattattaaatctcgatgaaaacaagctaaatggagagattcctaaagatattaaatttccgcctcaactggaggaactagttatgcaatcaaattccttacagggcgtgctcactgactatcattttgctaatatgtctaagttagatttcttggagttatctgacaactctttgttggccttgacatttagccaaaattgggtcccaccatttcagttgagccacataggattgcgatcttgcaagctaggtccagaatttcccaaatggttgcagacacaaaatcaatttgggaatattgacatttccaatgcaggaatagcagatatggttccaaagtggttttgggctaatttagcatttcgagaatggatttcaatgaatatttcatacaataatctccatg

SEQ ID NO: 20524 - DNA, 552 bp, Glycine max
  Peptide Sequence Number=SeqID_137302
atgatcctgccaggtttctctgcactgacagtgtgcagtgagaagtatgatgggtcaaacagctatgttgcattggtagatggtgctccacaaatattattaagggaccgtgattatgacagagactatgatagggattacgatcgagagcggggacgtggccgagacagggacagagatagggaaagggacagggacagggaccgatatcgtctaagggaagaaaaagattatggtcgtgatagagagggtagggagcgggagagaagagagaaggatcgtgaccgtggaaggcgaaggagtcactcaaggagtcgaagtagaagtagggatcgcagggaacatgatggtggggactacagaaagagacatgctcggagtagtgtaagtcctagaagacatggagatggacttgaggatggtgagccaaagaagaagaagaagaaagaaaagaaagaaaagaaggatgatgggactgaccaccctgatccagagattgcagaagcgaacaaactacgagcagccctgggtttgaaaccactgagggtctga

SEQ ID NO: 20525 - DNA, 699 bp, Glycine max
  Peptide Sequence Number=SeqID_137303
atgaattctatggcggtgagacttgtgaagcatctccaactctctgcaccgacctcatcttcattcggtggtgtgccgagaagtggagcgtcatggtattcgacctctctatctggaggtgaatatcagccttcacaagataatgttgcacctaagaatgaagcattggatggtgaacttgatgattttcttggcgaaaaggccgagctacagttgcaaggtgtggatcccaagaagggttggggatttcgtggcgtgcacaaggcaattatttgtggaaaagttggccaagcccctgtacagaaaatactgaggaatggtagaaatttaaccatctttacagttgggacagggggcatgtttgaccagagaattcaaggaccaaaggatttgccaaaacctgctcaatggcataggattgctgtgcataatgatatactgggggcctatgcagtacagaaactctttaaaaactcttcagtttatgttgagggtgacattgagattagagtttataatgatagcatcaacggtgaagttaaaagcattccagagatatgtgttcgccgcgacgcttatattagttttttaaggcaaatgctaactggtgcccttagggcactggttaaggaggtaaaagggaaaggtttttattgggatgcagaaatgcagaaaaaggcactcccctatgatttttaa

SEQ ID NO: 20526 - DNA, 552 bp, Glycine max
  Peptide Sequence Number=SeqID_137304
atggccattcatcatagaattgtgggtccatggttgatgctcggtgattttaacgatattctagcttctaatgaagttagagggggctctttttccttatccaaagcatctctctttgcaaatatgagaaagaatattcagaatgggattcatgttcgaaagaagttagacagatgtttgtctaactcggattggcgcctctcctttccttatgctctagtcgagattcttcctacttacaactctaactataatcctattctcatgagctatttgaaggcaaaatctaagaagaatttatttcacttccagaaagcttggatctctcttccagaatatagtaacctggtggattctacttggaaaggttcggctggtaatatttatcataaacttgataagataaaatcaaactccaaggattttaatgagaaggtttttggtaacatttttagtaaaaaaaggcaacttgaagcgcgtttgaagggggctcatagggagctggattttgcttatgatagacaattagagaattttgagaaagagcattag

SEQ ID NO: 20527 - DNA, 595 bp, Glycine max
  Peptide Sequence Number=SeqID_137305
atggctgaatctaatcctcatccttctgctcctcttccttttcttcatcttctgcttttgcgcattcaatcactgagaagctcactgattcagacttcttgttgtagaggcatcaactatgcgaatgaagctgttcaggattcaggcaccgtgaatcctgcatacactacgagggagatacaggatcaaatgctcctcacatggcttcaatcatctctttgtagatcaattttatcacgcttactagagtctgttcatgcgtttcaagagcaacatgttgatattattcacaaaggactaccttatgattacaactcaggttgcggtgaccagaacaaccgtgatgctggtcgtggtcatggtcgtggtcctggcagttgcaatttcctcagcagaatcagcaatctcagcctcaacaatcgtagtgttatgatcactaatgctggaatacttatattagtgcatgtcctacagctagtagcacttggttcccagactcagaagcttcctatcatgtcactgcaaatcataataacatctgccaactcagctcttttgaaggatcatcgtcaaatattcattagtaatggacaag

SEQ ID NO: 20528 - DNA, 852 bp, Glycine max
  Peptide Sequence Number=SeqID_137306
atggcgtttctgaaccctttctctctccacattcccatgtccttgttgctcttcctcctcttctttttttgcttctgcaaagccagtactactactaccacctctactacaacaaagtcactgtccccttcttcttcaccctccaccactacttcctcctctgatgttcaacttctcttgggaaagatcaaagcttcactgcaaggtagtaactctgacaaccttgttttgtcttcatggaactcctccaccccactttgtcagtggagtggcctcaaatgggtcttctccaatggcactcctctctcatgcactgacttgtcctctccacaatggaccaatctcactctccacaaagacccttctcttcacttgctttcccttcggctcccttctgcaaacctctctggttccctccccagagagcttggagggttccctatgctccaaagtctctaccttaacataaactcattggagggtaccatccctcttgagcttggttatagctcctccctctctgagattgatttgggtgacaatatgctaagtggggttcttccaccctccatttggaacttgtgtgagaggcttgtttcccttaggctccatggtaattccttatctgggtcagtttctgagcctgcattgcctaactcttcttgcaagaatatgcagttgcttgatttgggtggcaacaagttctctgggagtttccctgagttcatcacaaagtttggtggcctaaagcagcttgacttggggaacaacatgtttatggggacaattcctcaaggcctaactgggcttaggcttgaaaaattgaatctttcacacaataactttagcggg

SEQ ID NO: 20529 - DNA, 207 bp, Glycine max
  Peptide Sequence Number=SeqID_137307
atgtttcttgaagaaaagtgttcgaggataggatttcgggaactttcaggtggaagagaggatgaagaaatgtggagacatcaaccttgtcagttaaggataaggaggagaaggcaaaaagatgcgagtttgttcaagggctgttgctgtccaccatacttgatgataatttatgaaggaaattcatggaggtggctgcttcagtag

SEQ ID NO: 20530 - DNA, 480 bp, Glycine max
  Peptide Sequence Number=SeqID_137308
atggctatcactctggatgatgtgtcttgtctgttgtacatacctatgacaggcaagaccattgatcatgtcccttcactctttgatagagaagcgatgaagatcccaatgatgactcatctaggcattccaacatatgcagaggctgcaacgaacaaacacaagtgtcaaaatggggttggcgtggttgacacactttcctcgactcatgtccatgttgctctcctccagtactttaacaacttggatgcttttcacaagtacgcatggggagtagctacattggagtacctgtacaacaatctctcctatacgagccagtcaaaggattatgtggtggaggacccaatagccaccagatggaaggcattgcgaggtaccgggcttgcctttccgaccatatgcgagattgatgtgaggccttattgtccggagaaagtgttgaggcagtttggccatatacaggaaattccacgctag

SEQ ID NO: 20531 - DNA, 1080 bp, Glycine max
  Peptide Sequence Number=SeqID_137309
atgacgcaaatacctgttctcaccactccagacttttctatcccattcaccctcgagaaaaatgcgccaagttccgctatggatgtcattcttctccagaatacccacccaattgcctattatagcaaagtcctttgcccgcgtctccaacgagccttcacatatttctgtgagttacacataatcacggtgtcagtctgcaaatggcgtcactacttacttggcaattccttcactatcctcacgaactacaagagcttgaaggacatcatgttgcaggtcatacaaacccccaaacaacagacgtatatgtctaaaattttggggtacgattacaccatcaagtataaagttggctccaccaacgtcgttgcaaatgctttatctcggattttggcaccagaggaaatgcacctcttctcgttgtctatgtcgaactccgtcatccttgggaagttccgccaagcgcttgtccaggaccccaatatgatgctctattacgacaaatccaccagcaacccgagactcgcccagacctctccatgcataaagatgtcatcttccggcaaggaaatatttggttgcctttcacgacgtgattcacatatgtattattggaggaatttcactcttcccctctcggtgacaaagtatgagacgaagaaatccgtcggcttgcttcaaccactaccaatagcatcgaatgtgtgggaaaatttgtcacctgatttcatcattgggctaccaccttcgcatgggtccaccgtcattttggtcgtggtcggccgctattccaaggaggctcattttagtgctctccctcatcaccattcaacttacaaggtcgctcttttatttctggatatggtgtgcaagctccatgggttcccacgaagtctcatttcagatagggacccaatttttgtcagcaacttttggcgggagcttttccgtttaagcggtaccaagcttcgaataagcaccgccaaccactctcaatcagacggccaaacggaggttaccaatcgcattctagaacaataccttcgctcttttgttcatgatcgcccatctcactag

SEQ ID NO: 20532 - DNA, 567 bp, Glycine max
  Peptide Sequence Number=SeqID_137310
atgacaattatctccgcaactcgggatccccgtagggactaccctattctgggccctacggtcgagaaaaaattctccgcgggaacggggatgaaaaatcccttgcagctaatttggggacggggattatgctctccacctcgcaggatccatggctttcatcaaattcgaatggctgaagatgatgttcataaaaccgctttccgcacccaccatggacattacaaatttaaggtaatgctcttcggcttatgcaacacaccttccaccttccaggccaccatgaacgacacccttcgaccttttctccgcaagtatgttgttgtgttcttcaacgatattctagtctacatcccttccttgtcttctcatgtcgaacatttggaggtcattttgtccacactctctcaacaacaatttctcctccaacaatccaaatgtgttttcgctcaaaaccagctgaattaccttggtcgcatgttatcgacaaaaggggtggctctggatcccgacaaagtccaggcaatgtcggattggccaattcctgcaacccctattgccttgtga

SEQ ID NO: 20533 - DNA, 1620 bp, Glycine max
  Peptide Sequence Number=SeqID_137311
atgggtttggaggagaatgtagctaagacaagcaccaccaaggacgatgctagccaaatgttgaccttatgcacacatgctttctatgatttaactcatgtctccccggtggtatttctgttcctgctgaaaaaatgttattactatgatcacagtcaaggatttactcatctgataatatcagctcttcgccgattcctgaaaagatcaacaatcactacagaagactcattggaagtgaaagacctggttgcccatctacttgtagatattattaggggccagatccatcatgatgaaaagatagtcatgaagctactcgagatttttgatgtaaaactaacaaatgttgaaaaagcaatgtgtcaaattaaggaaaaacacgaattaagttatggcacagcaaacgaatttgttgaacagtatattgttgaattggtaaaatcccagttctacatgacagctgtcactttaatagagcaattctctatccaccagtatggccagtcttttctccttgatatgatacagagtaatcaattcaaagcagcagagaagtgggcaacatttatggggaaaccaatgttatccacacttgtagaggagttcattgagaggaacatgctaaagaatgcctatgagattataaagaaaaataatctaaagcaggattttccagatgtatacaaaaggtgtaaagaaagctcactaaaaaacttggcagaaaaaggatgttgggatgttgctgaggcaagaacaaacaatgatagacagcttatggaatatctggtttacttggcactggaagctggttacatggagaaagttgatgaactgtgtgatcggtactgcctagacaggtttttggacatcaaagatgataaacacaaatttgctttatgtcctgcagtacctgaaacaagtaatctgcaagggcgttatttacatcttgatgaattattggttgatagcatcatttgggttgatgaagttgaaggtttgcttgatgcaacaaggcatattaagggttttaaagttataggtcttgattgtgaatggaaacccaattacgtaaaaggcagcaaacccaacaaggtttctatcatgcaaattgcttctgaaaagatggtttttatctttgatctgataaagttacacaaagaagtgcctgacattttagatgattgtctatcttgcattttgctgtcacctagaattctaaaacttggctataatttccaatgcgatgcaaagcaacttgcttattcatatgaagagttgagatgtttcaaaaactatgaaatgttgctggacatccagaatgtttttaaagaacctcggggtggtttggctggacttgcagagaaaatactgggagctagtttaaacaagacaagacgaaacagcaattgggagcaacggcctttaactccaaatcaattagaatacgctgctctggatgctgttgtacttgttcacatattccaccatcttcctggtcaaggacatgataaatctgagtggaagtcttgcatcgtgtcccacaccgaaaacgccaagaaattcaagaaatgtgtaccaaaggttgtagacactgacatggagaccagcaagcattga

SEQ ID NO: 20534 - DNA, 2526 bp, Glycine max
  Peptide Sequence Number=SeqID_137312
atggttaggggaggaaggtttagtggcaaacgcaatttcagaaaaagggttcggtcgaaggagggagtttctgatgattcggatgaagactatgtggtttcagatgaagaggagggttttgatagtttaatggaagaagaggaggaggaatttcgaagagtgaggagtttaaatagatccaagtcagaaaagggcattgctggtcggtggaaaaatggcattaaaaactcatacaagaggggaaggattacatatgaagaagaagaagaagaggaagaggtagaggaagagtttgaagaggaggaggaggaggaaattcaagaagtgaggaatttcaataggtcaaaggccaaaaatggtgtatgtagtaagaaaaaacgtgcaggtaaaatctccccaaagaggggaaggaaaatacgtgcagaacatttggaagaagaggaggaggaggaagaggagaaacaagtggtggaggatgaggaggaagagaaggtggagagaagtggagatgaggaagaagaaccagagggagatagagatggagaggatgaagattttgaatatgatgatgaggatgatgaatttttgccagaggaagaagattattcagatgaggaagaagaaatgggggggagaaagaagaaaaacgatggcgtgaaaatggagaaggaggttttgcagaagaaaagggcctctgtggtttctactaggggtcggaaaaggcggagttctatagcatcaaagaagcccttgagaaacaaaagaagaaagaatgggaggttaaggaagaaagaaaaatgtgaagatgattttatagataatggcacaaccatagggacaacgactaggagaaagcagggccagaagaggagaagggtgcttctttcagattcagattatgcatcttctggatcatctgattttgagtttaccatatctgaagaagagagagaacaggtgagagaagccaagagattgtgtggaaatttgagaaataacttgaggagttcatcccatctaataaataatgaagaggttggagtccatgagtatcaacatccgcagcggaagcctccagctcggaagggtaaggaaaagatagaagaacctctgggaagaaagggtaaggaaaaggtggaggatttaaaaagtaagggaaagcaaacatgtggaatttgtctatctgaagaagataaaagaagagtaaggggagtactaaattgttgcactcacttcttttgttttgcttgcattatggagtgggcaaaggtggaatctcgctgccctttgtgtaaacagagattcaaagcaatcagcaagcctgcacggtcaacgacggggattgatttaagagaagtggtgatacaagtccctgaacgtgaccaggtttatcagccctctgaagaagaactaaggagctatattgatccatatgaatatgttatttgttcagagtgtcatcaaggtggagatgatggcctcatgctactctgtgatatctgtgattcccctgcacacacatattgtgttggtttggggcgggaagtacctgaaggtaactggtattgtgatggatgtagaccagttgctttgggatcttcaagctcccaagttcaagaaggtgtggctgatccaagggtatctgtccagagccatcctgttagaccaccccctgttctacatgtacgagaaagtatagacctcaacttgatttcgtcaccccgtgctgcttttaatcaaggttttgggcatcttccatcttctagatttagtggcagaagtgctgaaggagcctctcctgtatctggaggggcaccaactttatcagagagacgctggatacaccgtcagattcaacaactactttcaatagataggatggcctctacacctggcagaaccaatggtatttctgctaccagttcaactagtaacttatatagctctcactttgatcaaagtaggggaaccaccactctgcatgcaaggacacaggatgtgggaacatcataccacacattttttgatgagagattatgcaacaattcctccccattaatgcagaatggggcattatggtctggacttatggggacacccccagtaccagattgtgaacaagttcatcagttcagtagatcaaacattgttcctgatggtggcttatcccctgctgtcagagaagagagtaactttcactttgcaaaggagcagttgcagtcaatggttaaaagccacttgaagagcttgtctcaaaatattgatttaggccacaatactatcaaggatattgcaaggagttctatgcacaccatactagcagcttgtgatcttgagcacatgaagagtgaagtttgcactgtgcctcctccatctgcctgttcccatatggagctaatggctggtgggcaaacgagtctaattaaaggttgctgctcatcttgctttgattcctttgtaggagatgtggtgaagaggattttggacacaagaatttcgtcacagtggttacgattaggtctttag

SEQ ID NO: 20535 - DNA, 222 bp, Glycine max
  Peptide Sequence Number=SeqID_137313
atggcaaaaggaactaggcaaaataatatgcccagggttgacatggaacagaacaacccggatggctcatcaggagggcatcaacttaagaccatttgccagcatcatgttcagtcactgttgaccccttacggaattaaaaatggcatgcaattaccaggtttaatcaaatacagttggtatcatgccatacacaaggcatggagcaaatgcatccattaa

SEQ ID NO: 20536 - DNA, 2517 bp, Glycine max
  Peptide Sequence Number=SeqID_137314
atggataacaatagagtaaatcctagcaataatgcaagttgtgatattgattgtgccatatcaattaatagtgatgaagggtgtggggctaaagtcccagggttagtagccagacttatgggtttggattcattgccagtttcaactgtctctgggctctcctcctcatccacttcattatatggctccaactctcttggatcttctcattctcctgacgatgatgttcttcactcaatggttgactgctgttgccctgtggatcccataaatatgcgacttaagccagagaaatcttcttgggctgccatgcaatcaagggctcagaaagtgggaaacccggccatgaagagatttcagactgaaatgttgcctccaaagtctgttaaacccattccagttactcacaacaaacttttgtctcctatcaagagccctggttatacgcaacctaagcatgcagctcatgtaatggaggcagctgccaaaataattgaggcaagttcccagccatgtaggaggaatagaatgtcttcatctggatcttcatctgttcccttaagaattcttgatctgaaagagaaattggaagctgcacaatatgaattcaaattcatggatacgcacactgctaaccctctgaatggcaaacctagtgagaggagaaacaatttatataaatcctcttcaagtttcaaaggttcaagggattcagtaaagaacagttcttgtcagttggcaagcaaaggaaaatctgcttcccttgcaatgccatctaaaaccaatgctcagagccgtgatgaattgactttgaatggtaataggagatatatgaggcagaacaaacagaatgatgtaaaatcaaaccagtttcccaggagccagaagaaacaaattgtagaccgggccagggtcatgcagcagagagcttgtacaggccagagtagcaatgtgcttgggaagaataaccaaaagcagaatagtgtaaccaacaaaggtggttcagcttcaaaagtggactccaataagccaacacaaacttggtcttcagaaagttctaccggcgccaagaagactacaaaaaaggttgttgtaaatgccaacattgagcccaaaaggtttggcacaaggatcactgataccataaaggagtttcctgtttccaaaaggaagggtattttccaaaagaaaaactatagtagtagcgatgttcacaatgaggcaagaggttctaatagtgcagctaatacttatgaaaacaagtccgtaaaatgcaatattacaactgatagaagtattgaccaggatgcatttagcatgaaagggagcaatggtgtgatttcatttacatttacatctcccttgagaagaaacatgcccgagttgcagtcctctactgagcaagtgatgggaacaaggaacgaaattgaggtcaattcttgtaatagtgataagctttatccccaaaagtcatcattttctcctcccaggttacatgtaatagatggtgatgctttaagtgttcttttggagaaaaagctgcaagaattgacatctagaattaacccacctcagtgctccctcacgacagaagggtcttctactggtttaagatctagtttggaagacaaatgtcaaagtgtgttaagcaccacagtaagggaacaagacagaatctttcgcaataaattggacagcatgcatgataattgttcttcaagtgatattatgatgcttagcatgaatcagcaactgcagacatcagaatcaatggaagagcctagctgtagcagcaacagtgaaagccaaaatggaagttacttacatagtgcatatggcagcacaatttattcttccatgcaagatgaggaggtatctaatttttctccaatgaatgaatctctgtcactcgaaaacaaggcagaatggtctgagcaaagctcttccatagtgatgggggataacatggccagtgagcagttaagtttaatgtcaaattcggccgaatatacaagatcagcaaggaacatggagcttgaatatgtaaaggatatattcagcaatgcagagttgatggcagaagaatttgtggtgggtgaaacagacaagatcataatggaaaatctctttgataagttggagaatgaaggccttggggcagaaaactatgaagagtactctaagattgagaggaagattatatttgacactgtgagcgagtgccttgaattaagatgtaaacaagtttttgttggaagctgcaaagcatggcctaaatgggtggcttcagttcagaggaagaagtgtttagcagaagagttttacaaggaaatgctgagctttagaaatatggaagatggggtagaggtggatgaacttgtcagcaaggacatgagcactggatggggtagatggcttgactttgacattgaagcctgtgaggagggttcagaacttgaatttgatattgtaacatgtttgattaacgaattggtttctgatttgttgtacgtttaa

SEQ ID NO: 20537 - DNA, 184 bp, Glycine max
  Peptide Sequence Number=SeqID_137315
atgcaagtagtagaacatgttggtggcagtgttatccctacttctaatagcttttctccaatatgcatctccaatgatgatgtattttttggatcaaatagtagtggaacattagagaaacgtaatctcaatggagagctgtttgagcaactcatgggtgatagtgaaggtcatggattctaca

SEQ ID NO: 20538 - DNA, 541 bp, Glycine max
  Peptide Sequence Number=SeqID_137316
atgccgaggcaagtcttgagcaaccaaaaccacaaccatatgtcgaggcaagctttcatcacaaaccatcaccatcacgaccaccatcaccttctccatattcttctctttacactccttgttcctctttcttttgctgcaaatgatgaagttagtgcattggtttcatggatgcatagctcctccaatacagttccttcagctttttctagctggaaccctttggactcaaatccttgcaattggtcctacatcaaatgctcctcagcaagccttgtcactgagatagccattcaaaatgttgagttagcgcttcatttcccttcaaaaatctcatcctttcctttccttcaaaggctagtgatttctggggctaacctcactggggctatctcacctgacattggaaactgccctgagcttatagtccttgaccttagctcaaatagtcttgtggggggaattccttcaagtattggtaggctaaaatatcttcaaaacttgagcttgaactctaaccatcttactggaccaatcccaa

SEQ ID NO: 20539 - DNA, 105 bp, Glycine max
  Peptide Sequence Number=SeqID_137317
atggtttttgctcaaaattttattcaaaatagctctcactggcccactgctattcatgtatcaaagaacatccacgagcatgttagagataagaggaatagctaa

SEQ ID NO: 20540 - DNA, 492 bp, Glycine max
  Peptide Sequence Number=SeqID_137318
atggaaactgctttaccaagtaacacaagttccccgagagttcgatactcgattcttaccattttatactacttgtgtgacccagtgcacttgccagaagcgaacaagtttttggcgccgttgccggggaacttatttttatttggaaaatctcccacagacaatttagttcctctagacttagaaattgaagctacattgagaagggacagggccgagaggagaaggaaacttctgcaagacataacagttgcatccattcttgaggaaaaaactcatttttctgattcattatcacctgattcaccatcatcaagggaatccgctactcaattgcctgaaaccactatcatggcagatgagcagcaccagaggatcacccttgaggattattcaagcaactcagtatcgcaattctttactagcattgcacgtcctgaagtgcaagctcacaacatcaactacccacattctttaattcatttaatatag

SEQ ID NO: 20541 - DNA, 4233 bp, Glycine max
  Peptide Sequence Number=SeqID_137319
atgggttcgaggggactgttcgggtggtccccgccgcacatacagcctctcacgcccgtctctgaggtgtcggagccgccggagtcgccgtcgccttacctcgacctcggtgccgagacctccgcaactcagcctatggaggtcgaggaggagatggaggaggccgacgagattgagccgccgcccgccgccgttcctttctcccgcctcttcgcctgcgctgaccacctcgattggtttcttatgctcgtcggctccatcgccgccgccgcacacggcactgctctcgttgtttacttgcactacttcgccaaggttctccgggttccacagcagggtttgccggaagagcagtttcacaggtttaaagagcttgctttaaccattgtttatattgctgggggagtttttgctgctggttggattgaacggcagactgctgtcatcagatcaaaatatgtccaagtattacttaaccaagatatgagtttttttgatacttatggaaataacggagacattgtgagtcaagtattgagtgatgtgctgctcattcagtctgctcttagtgaaaaggttgggaattatattcataatatggcaacattcttcagtggtcttgttattgcttttatcaattgttggcagattgcattgataacattagctacaggtccatttattgttgctgcaggaggaatatcaaatatattcctccataggcttgccgagaatattcaagatgcatatgctgaagcagccagcattgctgaacaggcagtttcatatataaggaccttatatgcatttacaaatgaaacattggccaaatattcatacgcaacatcactgcaagctactcttagatatggtatattaataagtctcgttcaaggccttggccttggttttacatatgggcttgcaatatgttcttgtgcattacaactctgggttggaaggctcttgattatacatggaaaagctcatggtggtgaaattataacagctctgtttgctgtgattctaagtggcttgggattgaatcaagctgcaacaaatttctactcatttgatcaagggcgaatagctgcctatagactgtttgagatgataagccggtcatcctcatcttttaatcatgatggcagtgctccagcttctgtccaaggaaatatagagtttcggaatgtttacttcagttatctttctcgccctgaaatccctatcttgagtgggttttatctcactgttcctgctaaaaaaactgtggcacttgttggcagaaatggctctggaaaaagtagtattattcccctcatggagcggttctatgatccaactttaggggaagttcttttagatggtgaaaacataaagaatatgaaactggaatggctaaggaaccaaataggactggtcacccaggaacctgctttgctcagtttgagtataagagacaacattgcttatgggcgagataccaccatggatcaaattgaagaggctgctaaaatagctcatgcacatacctttatcagctcattagataaaggttatgacacacaggttggcagggctggtctagctttgacagaagagcagaaaataaaactttctattgcaagagctgtgcttttaaatccatccattcttttgcttgatgaggttactggtggacttgattttgaggctgagaggtctgttcaggaggctctggatctcctcatgttgggacgctcaacaatcataattgctcgaaggcttagtcttataaagaatgctgattatatagctgttatggaggatggtcaactggttgagatgggtactcatgatgagttactcaccctggatggcttatacgcagagcttcttcgatgtgaagaggccacaaaacttcctaagaggatgcctgttcgaaactacaaggagactgcaactttccaaattgagaaagattcttcagaaagtcatagcttcaaagaaccttcatctcctaaaatgataaagtcaccctctcttcagagagtttctgccatatttcggccttcagatggcttcttcaactcacaagaatcaccaaaaatccggagcccaccttctgagaagttgatggagaatggccagtctttagattcatcagataaggagccatcaataaaaaggcaggatagttttgaaatgagactaccagagttacccaagattgatgttcaatgtgtgcatcgacaaacatcaaatggttctgatccagaatctcccatttcacctcttttaacgtccgaccctaaaaatgaacgctcccattcacagacttttagcagacctgattgtcattctgatgatcttttggtgaaaatgagtgaaacaaaggatgcaaggcatcgaaaacaaccctcaatttggaggctagcagagcttagttttgcagagtggctttatgctgtgttaggaagcataggtgctgctatctttggttctttcaatccccttcttgcttatgttattggtctggtggtgacagactattatagaattgatgaagctcagcacttacaaggggagataaacaaatggtgcttgatcattgcctgcatgggtattgtgacagttgttgccaactttttacagcatttctattttggtattatgggggagaaaatgacagaaagagttaggagaatgatgttctcagccatgcttcgcaatgaaactggatggtttgatgaagaggaaaatagtgctgacaatttatccatgcgcttggccaatgatgctacatttgtgcgagcagcattcagtaaccgactttccatatttattcaggacagtgctgctgttattgttgcttttctcattggtgttttgctgcactggcgattagcacttgtggccttagcaacacttccagttctttgtgtttctgctcttgcccagaaattgtggcttgctggcttttcaaagggcatacaggaaatgcacagaaaggcatctttggttcttgaagatgcagttaggaatatttacactgttgttgcattttgtgctggtaataagtttctgctctttgcttgtaatgcccttctactttggtacactgcactatgtgtaaataagagttatgtggatctacctactgctctcaaggagtacattgttttctcatttgctacatttgcccttgtggagcctttcgggttggctccttacatacttaagcgacgtaaatctctcatgtcagtgtttgaaattatagatcgtgtgcctaagattgatcctgatgatagctcagcactgaagccacccaatgtatatggaagcattgagttgaaaaatattgatttttgttatccttctcgacctgaagtgttggtattaagcaattttagtctcaaagtcaatggaggacaaacaattgctgtagtgggagtttcgggatcagggaagagcacaataatatctttgattgagagattctatgatccagttgccggccaagttttgctagatgggagggatttaaaacaatataatttgagatggttgaggagccaccttggtttggttcagcaggaaccaattatcttctcaactaccataagggaaaacatcatatatgccaggcataatgccagtgaagctgaaatgaaggaggctgcaagaatagcaaatgctcaccatttcattagtagcttgcctcatggttatgacactcatgttgggatgagaggtgttgacttaactccaggacaaaaacagagaattgcaattgcaagggtagtgcttaaaaatgctcctattttgttgttggatgaagctagttcatcaattgaatctgagtcaagccgagtggtgcaagaggctctagacaccctaataatgggaaacaagaccactattttaatagcacacagggctgcgatgatgaggcatgtggacaacatagtagttctaaacggaggaaggatagtggaggaggggacccatgattcattggtggcaaaaaatggtctgtatgtccgattgatgcaacctcattttggtggaggcttgcatgtagcaagaatgggagtattggatcagcactcggcattggttggcataagaagagggtactgtggcaggggtagtgtaggaattaaagataggaatttggaatttggttgctttgagactttagtattgaagctgaggatgcatattcttttggaggcaagcagtttagactga

SEQ ID NO: 20542 - DNA, 3270 bp, Glycine max
  Peptide Sequence Number=SeqID_137320
atggtgggcgacggtactgacatcgactgcactagggtttgccgcaatgtcaccctcacaatccaggagcaccaatttatcgtggacctccacgtcaaggggttaggtggcgctgatttgattctcggtgtggcctggcttacccatataggcccaattaccaccgactattcacaccttaccatgcgattctctcaccagggcaagcccattaccatttacggggacgcttcccttggcccatctgagattagccacggccaagttaaacgcctggtctcaacctaccaaatagcaggcctttttcatctccagctccaggccacacaccccatcactgccgacaaccatacccctcattccccgatatgcaccctcctctctaaataccctcgtctcttccaacctctccatcaccttcccccttcacgatccacagaccacattattcacctcgaacctcattccaagcccgttaatgttcgtccctacagatacccatatttccaaaaaaccgaaatcgagaaacatgttcaggacatgttacatcgccagttgatcagacccagtcggagtccctactcatcgccggtgctccttgtcaaaaagaaagacggcacatggaggttctgtgtcgactacagagcattaaattccatcaccattaaagaccggtttcccctccccaccattgatgaactccttgatgacctgggcaattcctcctggttctctaagatggatttagctcaaggcttccaccaaattcgtatgtctgatgctgacattttcaaaactgccttccgtactcacgaaggacattatgaatatgtcgtgatgccttttgggctctgcaacgcgccgtcgactttccaggctactatgaactccctcttccggcctttcattcgcaagtttgttttggtcttcttcgatgacattttagtatatagcagtgacctccaatcccacctcaaccatttggattgcgtcctgcgtactctgcaacaagctgatttccgtttgaaagcttccaagtgtatctttggtcaacgaaggattgaatacttgggccattttgtttcacgtcgaggtgtcgagcccgattcttctaagatacaagctatgctccactggccgcctccgacaacaactaaggccctacgcggtttcttgggcctaaccgggttctaccgccgtttcgtcaaaaattatgctcagatagccgctccgttgactcatcttttaaaaaaggaccaatttgtgtggacccctgagacccaacaagcttttgaagccttgaagtcagctatgaccactaccccggtccttgccctgccggacttcaatatcccatttaccgtcgagaccgacgcctctggctccggcatgggtgcagtcctcatgcagaggggacatcccctggctttcttcagcaagcaattttgcccaaaattgctccgttcatccacgtacattcgagaattacatgccatcaccactgccgtcaagaagtggaggcaatacctcctgggtcacaccttcattattctgacggaccacaagagtcttagggaattgatgactcagccggtgcagaccccagagcaacacgtgtatctagccaagctcctcggctacgattacactatacaatacaaagccggccacaataacgccgtggcggatgccctatctcgtgtccaggaatctcctcttccggcggcagaagctttttatattttgtccattccccatttcaagttcctcgaggaactaaaaagggaattatcagcatctcttgaatttcagacactagtggccggaatccgcaatgacccccaacaatactccgatttttccttcagagacagccttctcctccataaggagcgcctctggctcaatcgcggcaactcgctcattccatccttactggaagagttccacaaatctccgttaggcggtcacatgggactatccaagacccttagtcgtcttcaacagaacttctcttgggaaggcatgcgcaaggatacccagaccttcatccgacaatgcactgattgcatgcaaaccaagtacattacccagaagccgaccggactccttcaacccattccaccaccgacacgcccctgggaagacttagcaatcgatttcatcatcggactacccaattttaagggccacacagtaatcatgaccgtcgtggaccgtttttctaagggagcccattttggtaccctccctacgcaattcacagctcacatggcggcccaattgttcctcgagctcgtctgcaagctccacggcttcccccggagtcttatctcggacagagatcccatttttatcagcaagttttggcgcgagctgtttaaactcagtggcacccagctaagaatgagtacctcctaccatcctcagagcgatggccagacggaggtccttaaccgcgtccttgagcagtacctgcaaagcttcgttcatggcaagccttcccaatggggaaaatttctcagcctcgcagagtggtgttataacaccacttgtcactcttctatgaacctttccccatttgagattacttacggaaaacccccaccagcgattctagattacctccccggagcttcttcagtggaggccgtcgatttcctcctatcctcacgacaggagatgttcgaaactttgcgcggcaaattagaacgtgcccaatgtaagatgaagaggtatgctgattcccatcgccgcgacgtatccttcgaagttggagattgggtgtatgtcagattgcgtcctcaccgtcaaacctccattgccaacaaatatcagaagctcggaaagcgctattacggaccataccaaatcacagaagtcatcggcaaggttgcgtatcgtttggcccttcctcctaccgcgaagattcacccagtattccattgctccaagctcaagccccaccatggccctttaaccacagaccagtcactaccgcccacttcgtgggacaacaatcccttgattgagtcgttgactatactagatcacaagtgggatgatcaaactccgccgtgcctatcggttttggtccagtggaccgggttaccacccgaagactccacgtgggaagattggacacaacttcaaagcatttaccaccttgaggacaaggtgttttccgatgttgtaggggatgataagaacggacctaggcccagaagaatatccagaagaccctcaggatgggaggagttcatccattag

SEQ ID NO: 20543 - DNA, 504 bp, Glycine max
  Peptide Sequence Number=SeqID_137321
atgagactagttcagcatcagcctacacagtatcccacatcagaggagttgagtattgggaggatcaagtttaaagcttttgatctcgggggtcaccagattgcacgaagagtctggaaagattactatgctaagttgttgcttgcactgttattcgcaagcattaagcatgcctggactttggtagatgcagtggtctacttggtagatgcatatgacaaggaacgatttgcagagtctaaaaaagagttagatgctctgctctctgatgagtctttgactactgtccctttccttatccttggaaacaagatagatattccatatgctgcctcagaagaagagttgcgttaccatttgggcctgaccaattttaccacaggcaagggaaatgtaaatttgtcagactctaaagtccgtcctatggaggttttcatgtgcagtattgtgaagaaaatgggttacggggatggtttcaaatggctctctcagtacatcaaataa

SEQ ID NO: 20544 - DNA, 723 bp, Glycine max
  Peptide Sequence Number=SeqID_137322
atggcttcctcagcttccaccaaactgactatgaaattgctcattgactcaaagcgtgaaaaagtgttgttcgctgaagcatcaaaggagatcatagacttcctacttaacttgctttgcttgcctctgagtgctgtcataaggcttctaaacaaggatggcatggttggcagcataggcaatctctatcaaagtgttgaaaatctgagcgacacttacctgcaaccacacctacacaaggatgtcctcttgaagccaagagctcccatttcttcccagcaattctctgcccttctccctgccattggtaataactctgctaatcataacgcggaagcttcattctacacgtgccataattcatatagctgtggttatcatgtgacttgtgataataagactctttgtcctcaatgcctgaatgctatgagtcgtaaagtaacttatgtaggtaaaaaggttgcagaagatgtgtttcccaataatagtggatttgtgaaagaagttgtaacttacatggtcatggatgatttagtcattcagccaatgtcaaccatatcaagtatcactctactgaacaagttcaacgtcatagaaattggtgccttgaaagagaaggtggttgagttggggatgactcagggtgtcgatttgcttaaggcttctctgcaatcgaaggctgttctcacgagggtttttctcaagaacaatgcagcaatttaa

SEQ ID NO: 20545 - DNA, 696 bp, Glycine max
  Peptide Sequence Number=SeqID_137323
atggcaatttctttgagctggatttcaccctgcttatcccataagctaaacttgccgcattcaaattgtttgcctcgcaacactgcaacttcatctaccagcaccgtcttttgtgcattggagacaacccccggcggagaaagtcattgccagagaagaccactactgttgggcattggagcattaactgcaaatttacaaccaacaaatttggtctttgctcaagaaaaatcagacagatgccgagtttttttagactatgaagatgggtattcttacatataccccattgattggaaggaatttgacttcagggctcttgattctgcattcaaagacagatatctacagttacaaaatgtaagggtgaaatctatacccactgagaagaaagacatccgagatttgggtcctatggaagaggttatatacaatttggtgaaacatatatatgctgcaccaaaccaaagaccaacaataaaagacatgcaggagaaaaccatagatggaaaacattactatacctttgaatatatacttacatcaccaaattattctagtgcctcctttgcaacaattgctataggaaatggaaggtactacacgctaattgttggagccaatgaaaggcgatggaaaagatttcgagatcagcttaaagtggtagcagactcctttaggcttcttgacatctaa

SEQ ID NO: 20546 - DNA, 111 bp, Glycine max
  Peptide Sequence Number=SeqID_137324
atgaaagtgtttgatctgattctgctcaaactcaaagttgtctgggttgaggctgattactgttcatccaagtttttgggccaacaagatgaagggaaggttaaaatctga

SEQ ID NO: 20547 - DNA, 300 bp, Glycine max
  Peptide Sequence Number=SeqID_137325
atgtcccacgctgttaaggataatcgaggcaagtgggccccgaattatgaaggacctttcgttgtgaaaagagcttttttctgggggggcagaatcgtcttaggccacggtcagaagtcgagacaagttgacggctggaaatcaaccaaggtacttagggacggatgcaaatgggggatagggtcacgatcaaccgatcgttgtcccttcctggcgctggacaagcagagaacttcgctggaaggcagcccagtatcctttgaattcacagtatttattactattgtttgttttaaataa

SEQ ID NO: 20548 - DNA, 495 bp, Glycine max
  Peptide Sequence Number=SeqID_137326
atgaggggttgcattaactacaatcccgcactttctataagacagttagggtaccccatgaggggagcaccgacggaagagagcctttctcctttccttgtgattgatttcggcgcgcaaggcttcaaggttatacaaagagtccataaggcgtgggaaggcccgttaaggaaagataaagaacttaggggcatccgtaatggcatcatcggtggttatcatgaatggctaaaagttcgtacacgaaggttagattggctctccaagttgaaaattatcaacgaggagaactttgaagcttcggaagaggatgaagaagtccgagctctaaaaacagaactaggaaaagcaagacttgccaaagaaaaattcaagttagtcgctacagacgtccggaaagagtgtgtcgagttacgagaagaaaatgcagctaccgcaagagcccttgaacgagaaaccaagagggatcgcaaggaagagcatggccgagactaa

SEQ ID NO: 20549 - DNA, 1086 bp, Glycine max
  Peptide Sequence Number=SeqID_137327
atgagagccaagaaggggttgacatttggaggtctgtccaatgaaggacatgatagagttgtagttgtctttcctaataaaaagaagcaactccatacaacaaggtcatgggattttattggctttccactacaagcaaatagagcaccaactgaaagtgatgtcatcattgcagtacttgactctgtaatttggcgagaatccgagagcttcaatgacaaaggatttggtccaccaccaagtaaatggaagggcacctgccaaacttctaaaaatttcacatgcaatagtaaaatcattggggctaagatttacaaagctggtggattttttagcgatgatgatccaaaatctgtgagggatatagatggtcatggcacttatgtagcatcaacagcagctgggaacccagttagcacaactagcatgttaggccttggtcgaggaacaccaagaggtgctgcaacaaaagcatgcattgttgtgtataaagtgtgttggtttgatggttgttctgatgcagacatacttgctgcatttgatgatgcaattgcagatggggttgacataataacagtttctcttggagggttcagtgatgaaaactactttagagatgtaatagccattggagcatttcatgctatgagaaatggagtgttgacagtaacttccgcaggaaacaatggtccacgaccttcctccctatccaactttttgccttggtcaattactgtggctgctagtaccatagacaggaagtttgttaccaaggttgaattaggtaacaggatcacctatgagatagactatcacatcctaagcctaggagtaccaccaaagacaaagcttaagcatcttcttgtaatcttcagtatctatctatccatccaatgtggtggaatcaaagtctttgcaactggcagaaacacacataatcttgtaacacttagtagcagtcacaaaacaaatttcagcaaagacagcccatgtggcgacatcttgcaattttcagtatctatctatccatccagagactttgcagaaaatcaaagaaagaacaaggctcttaatgtagaatcataa

SEQ ID NO: 20550 - DNA, 225 bp, Glycine max
  Peptide Sequence Number=SeqID_137328
atggttgaaactagccaaataaacactaaaagaggtgtgaaagataaggctcccaacacacttccaatgaaaggcctttttgttacaaaacttgaaagcaatgaagctcttaaggtggttggcccctttcttcttgactcaaattcttcaagggatggcaccaatcctccttccaattccctatatggcaacccacaaccaaggaaacaaagagacaagcaataa

SEQ ID NO: 20551 - DNA, 153 bp, Glycine max
  Peptide Sequence Number=SeqID_137329
atgcaatgtcccgaggcttctcgcacatcgacaactgcttcgacagcctctttttgtttttccacaacggcggcaccagcagcatgtgacggcggaggcagagcaaggggtacccaccttgcgttgcctcgccgtgaaggaatgatgggttag

SEQ ID NO: 20552 - DNA, 207 bp, Glycine max
  Peptide Sequence Number=SeqID_137330
atggataactacaatgtgggagagcatttaatttggagtcatattcgatggtattacattatagctacttgcatgatgtttatatcagcaggactggaggctatcagatgtgtgagcaaagtttcggggaaggctactgttattgctgcaataggtgtcagacagaacttttttggcactgataatgttaggtggcgatgcatgtga

SEQ ID NO: 20553 - DNA, 474 bp, Glycine max
  Peptide Sequence Number=SeqID_137331
atggtggaagccttgtcacctcgcatgcctttgatgagtattcattgtcacattgatagaagagtttcttccaactccgagcttggaggaatgttagggcctgaagttagcaggattggacaagagtcaatttttggctcttttgtgcacttatcctacttggagcataattccaaggagtatattgacaataatgttgaggaacatgtgaaaagcatctctgccggagatatggttattcttgaggaagaggatggtgtcctttatgcattcaacaaggaaagctatagtgatcgtcaagccatgttcaacatccaaacatgtactcttaaaggctttaccttgtcaaagttcacctgcatgtatgagatgctattttggaatctcgacctagcaatcccatttgacgagtttaagtgtgacgttttgaatgcattaaatgtggctccaattcagcttcatctaaatagttag

SEQ ID NO: 20554 - DNA, 180 bp, Glycine max
  Peptide Sequence Number=SeqID_137332
atgggagttgcagtgataaacggcaattcggagagcttgcaatccctactaggttggcaccccaaacactacagaccccagccactaaccaagaaattcattccaaaagatgaagaaaaaacagaagaccatggggggcatgaaccaaacccatgggagggaaatcaagagaatctatag

SEQ ID NO: 20555 - DNA, 459 bp, Glycine max
  Peptide Sequence Number=SeqID_137333
atgacgctctggagcatttggacaagaagaaacgataagctttggagtaatatcactgtgaatgattcctcggttatccatagagcagatgaattctaccaagtctggtttgatgcaaaggagatgcatgggagctctgcaagggacactactgtttctaatactggaagatggagtcctccccgcctaggcttcacgaaaagtaacgtggatgctagcttcaaacataactggaggagggatgtaactgattttatggagccttgtttgtcagtaccagaaggagaggcatgggcgcttgcagcagcaactagattcatagctgaaagagggtatcaaaacgttatgtttgaggttggctccaagagtatagtggataaaatcaatagagtgcagtggataattctgagttggatcacaagatccaacaatgaaggagtttgcttcttaataatctag

SEQ ID NO: 20556 - DNA, 165 bp, Glycine max
  Peptide Sequence Number=SeqID_137334
atggcaccccacctgacatccccaaggtctcctaacccccgcgacatatctccaggtggcgatcaggtgatggtgcaaatcaactctcccacttacacaaatcaaacattaacgtaccatccccagttgcccaccttcaaattgaggtcacgcactcccacgtag

SEQ ID NO: 20557 - DNA, 798 bp, Glycine max
  Peptide Sequence Number=SeqID_137335
atgggtagggtggtgttagcaaaagggaaagaggatgatgtaagtattgagacaggagatttagaaaaaagagatgatttgtttccacagattctaagagacgaggcagttgcaaggctttatgagcttgggaaggtgagtgatgctagtggttatttggagaggacattcttgagtcctgcatccatgaaggcaattgatcttattcgtaaatggatggaggatgctggtttgagaacttgggtggaccaaatgggaaatgtacatggtcgagttgatggtgcaaatgaaaatgctgaagctttattgattggatctcacatggacactgttgttgatgctgggatgtttgatggatcactaggaattgtctctgcaatatctgccgtgaaggctatgcatgtcaatggaaagctgcaaaagctaaagcgccccgttgaggtgattgcatttagtgatgaagagggtgtcagatttcaaactactttcttgggaagtggtgctatagctggtattttacctggtacaacattggagatatctgataagagggaggtgatgattaaagattttctcaaggagaactcaatggacattacagaagaaagtcttttaaagctcaagtatgacccaaagtctgtttggggttatgttgaggttcacattgagcagggtcctgtgctagaacaagttggtttcccacttggtgtggttaaaggcatagctgggcagacacgattgaagttgctcggatcagttatggttgttccctatgatggaacaacaagatataactga

SEQ ID NO: 20558 - DNA, 705 bp, Glycine max
  Peptide Sequence Number=SeqID_137336
atggctctcgaggttgctgttaaggctgctgttggggctccaaatgttctcggagattgtccattttcccaaagggtcctcttaactttggaggagaagaaaattccttacaaactccacctcatcgatctcagtaacaaacccgaatggtttttgggtgtgaatcctgaagggaaggtgccagtggttctttttgatggcaaatgggtggctgattctgatgtaattgtggggatactagaggaaaagtacccagaaccctctctaatcactcctcctgaatttgcctccgtgggatcaaagatatttgggtcttttgtgagttttctgaagagcaaggatacaaacgatggaactgagcaagcattggttgctgaattgagtgccttggatgaacatctcaagacccatgtatgcaattacccatttgtaatctttaaatcgtcaatgctaatatgctggaggcatggtcagggtccatacattgctggggagaaagtcactgctgttgatctgagtttggcaccaaaactgtaccatcttgtggtagcactgggccacttcaagaattggaatattccagaaagtttggtacatgtgcacaattacactaagctgctgttctcccgagagtcatttgagaaaacaaagcctccaaaggaggaatatgttattgctggatgggcgcctaaggtgaatgcttga

SEQ ID NO: 20559 - DNA, 1821 bp, Glycine max
  Peptide Sequence Number=SeqID_137337
tgagaattttgaactgagtctttatgtctctcttgatgtagtgcaagctttaatgggcataaaagcttctcttgtggatcctcatggtattctagataattgggatggggatgcagttgatccatgcagctggaacatggtcacatgttcccctgagaatcttgttattagcctgggcattcccagtcaaaatttgtctggcactctatctccaagcataggaaacctaacaaatcttcagactgtggtgctacagaataacaacataactggaccaatcccttcagagctaggaaaactttccaagcttcaaacacttgatctctctgataacttcttaagtggggaaattcccccctctttgggtcatctgagaagactacaatacttgaggcttaataataacagttttgatggagaatgcccagagtcactagctaacatggcacagcttgctttctttgacttgtcttacaacaatctgagtggccctatacctaaaattttggccaaatcattcagtattgtaggaaaccccctcgtttgcgctacagaaaaagaaaaaaattgccatgggatgacacttatgcctatgccaatgaacttgaacaatactgaggatgcttcaccatcaggcagaaaaaaggctcacaaaatggccatagcctttggtttaagtttgggatgcctcagcttgatagttcttggtgttggacttgttctatggaggaggcacaagcataaacaacaggcattctttgatgttaaagaccggcatcatgaagaagtctaccttggaaacttgaagaggtttcatttaagagaactccagattgctaccaagaacttcagcaacaaaaacattcttggaaagggtggtttcggaaatgtctacaagggaattctctcagatggcactcttttagcagtcaagaggcttaaagatggcaatgccattggaggagatatacaatttcagactgaagttgaaatgatcagcttggcagtgcacagaaacctcctcaaactgtatggattttgcatgacaccaacagaaaggcttttggtttatccttacatgtccaatggcagtgttgcttctaggctcaagggtaagctcaacggtaagccagtgttggactggggcacaaggaagcaaattgccttaggagcagcaaggggactactataccttcatgagcagtgtgatccaaagataatccatagagatgtgaaggctgcaaacatattgcttgatgactattgtgaggcagtggtaggagattttgggctggcaaagcttttagatcaccaagattcacatgtcacaactgcagtgaggggtacagttgggcatattgcaccagagtacctttccacagggcaatcttctgagaagactgatgtctttggatttggcattctgcttcttgaattgatcacaggccaaagggcactagaatttggcaaagcagccaaccaaaaaggagccatgcttgattgggtaaggaaacttcatcaagagaagaagcttgagttgctcgttgacaaggatctcaagaccaactatgaccggattgagcttgaggaaattgttcaagtggcactcttgtgcacacaatatcttccgggccacaggcccaaaatgtccgaagttgtacgcatgcttgaaggtgatgggctggcagagaaatgggaagcctcacaaagtgctgacacttctaactgcaaaccacaagaactctcttcatcagataggtattctgacctcactgatgattcttcattgttagtccaagccatggaactctcaggccctag

SEQ ID NO: 20560 - DNA, 3645 bp, Glycine max
  Peptide Sequence Number=SeqID_137338
atgtatctctacagtcttactctgcagcgccccaccggcatcatctgcgccataaacggcaacttctccggcggcaagagccaggaaatcgtggtggcccgcggtaaggttctcgatctcctccgccccgacgacaatggtcggatccaaaccattctctccgtcgaaatctttggcgccatccgctccctcgcccagttccgcctcatgggcgcccagaaggactacatcgtcgtcggctccgactccggccgcatcgtcatccttgaatacaacaaggagaagaacgtcttcgacaaaatccaccaagaaaccttcggcaaatccggttgccgccgaattgtccccggtcagtacctcgccatcgatcccaaaggtagggccgttatgattggcgcctgcgagaagcagaaactcgtttatgttttgaatagggacactgctgctaggttaaccatttcttcccctttagaggctcataaatcccacactttagtttactcaatttgtggcgttgattgtggctttgagaaccctatttttgctgccattgaattggattactctgaggctgaccaggattccactggcctggctgcttctgaggctcagaagcatttgaccttttacgagcttgatcttggccttaaccatgtttccagaaagtggtccgagcaggttgataatggggccaatttgcttgttactgttcctggaggtggtgatggccccagtggtgtgcttgtttgtgctgagaattttgttatttataagaatcaggcacatccggaggtcagggctgtgattcctcggcggaccgacttgccggccgagcgcggcgtgcttattgtgtcagctgctatgcataaattgaagaacatgttcttcttcctcctgcagacagagtatggggatatttttaaggtcaccttggagcataataatgatcgtgtctcggagttgaagattaagtattttgataccattcctgttacagcttcgatgtgtgtgctgaagtcggggttcttgtttgcggcatcggagtttgggaaccatgctctgtatcagtttaagtctataggggatgaggatgatgtggaggcgtcgtctgccacgttgatggaaactgagcaaggttttcagcctgtgtttttccagcccaggaggctgaagaaccttgttaggattgaccaggttgagagtttgatgccgataatggatatgaaggtcagtaatctttttgaagaggaaactcctcagatttatactctctgtgggcgtggtcctcgatcctctttgaggatcctgagaactggtttagcagttagtgagatggccgtgtccaagcttcctggtatacctagcgctgtttggactgtgaagaagaatgctattgatgagtttgatgcatacattgttgtgtcattcacaaatgctacacttgtgctttccattggtgagactgttgaagaagtcagtgacagtgggtttcttgacactacaccctcccttgctgtttctttgataggagatgattctctcatgcaggttcacccaaatggtattaggcatattagggaggatggccgtattaatgaatggagaactcctggaaagaggactatttcaaaagttggatcaaatagacttcaagtggttattgcactgagtggaggggagcttatatattttgaagtggatgtaactggtcagttgatggaggtggagaagcatgaaatgtctggggatgttgcttgtttggacattgctccagtgcctgaaggcagacaaagatctcggtttcttgcagttgggtcatatgacaagaccatccgcatcttatcgcttgatcccgatgattgtatgcaggctctaagtgtacaaagtgtttcttcagctccagaatctcttctttttctcgaagttcaagcatctgttgggggtgaggatggtgccgatcatcctgctagccttttcttgaatgctggcttacagaatggtgtcatgtttagaactgtggtggatatggttacaggtcagctttctgattcacgttcccgattcttgggattgagagccccaaaattgtttcccattattgtgagaggcaagcgtgctatgctttgcttgtcaagtcgaccttggcttggttatattcaccaaggacatttccttttaacgcccctgtcatatgaaacccttgaatatgctgcctcattttcatctgaccaatgtgtggaaggtgtagttgctgttgctggtgaggccttgaggatttttaccattgaaagattaggagagacatttaatgaaactgtaattccattaaggtacacaccaaggaaatttgtgctgcaacccaaacggaaacttctggtgatgattgagagtgatcaaggagcattaactgcagaagagcgtgaagctgcaaggaaagagtgttttgagtctgctcaagctggggaaaatggcactgaaagtgcagaccaaatggagaatggtggtgaggatgaagataaagatgatccactttcagatgagcattatggttatccaaaagctgaatcagataaatgggcttcctgcatcagagttcttgatccaaggacaggaaatactacttgtcttttggagcttcaggaaaatgaagctgctttcagcatttgcaccataaatttccatgataaggaatacggaactcttttagctgttggcactgcgaagggactgcaatttttgcccaaaaggaccataactgctggattcattcatatttataggttcgtagaggatggaagatctcttgaacttcttcacaaaactcaggttgaaggtgttcctcttgctctatgtcaatttcaaggaagattacttgcagggataggacctgtgctcaggttgtatgatttgggaaaaagaagattgttaagaaaatgtgagaataagctattccccaacacaattgtctccattcatgcatatcgcgatcggatttatgttggtgatgtccaagagtccttccattattgcaagtataggcgtgatgaaaaccaactttacatatttgctgatgattgtgttccaaggtggcttactgcatcataccacatagattttgacaccatggcaggtgcagacaagtttggaaatatctattttgtgcggttgccacaggatgtttcagatgagatagaagaagatcctactggtgggaggatcaagtgggagcagggaaagctgaatggagctcccaataaggtggaagaaattgtacagtttcacattggtgatgtcgtcacatgcttgcaaaaggcttctcttataccaggtggtggagagtgcattgtatttggaacagttatgggaagtgttggggcattacatgcctttacttcacgagatgatgttgatttcttttctcatttggagatgcatatgaggcaggatcacccacctttgtgtggaagagaccacatggcatatagatctgcctattttcctgttaaggatgttattgatggggatctatgcgagcaatacccaacattgccaatggatttgcagagaaaaattgccgatgaattggacagaacccctggagagatactgaagaaacttgaggaagtgcgaaataagattatttaa

SEQ ID NO: 20561 - DNA, 1287 bp, Glycine max
  Peptide Sequence Number=SeqID_137339
atgacgttcacagcggaggtagcatgcagcttcttcggcctcgcttatcgcaatcgcaaacccttcactctctcactccaaaccactctcctccctcttctacgcagaacaaccactcactcccattcccaatcgttaacattccctcttagaccctctcgccgcttctccgtccccgccaccaccactgcgccgcctcaatccgaggattccgacgtttccaccctcatccctcccgacaatcgtattccggcaaccatcatcaccggctttctcggctccggcaagacgacactgctgaaccatattctcaccgcggagcatggaaaacgaattgcggttattgagaacgagtttggtgaaattgacatagatggttctttggtcgcggcgaaagctgctggtgctgaagatattatgatgttgaacaatggctgtctttgctgtactgtgaggggtgatcttgttcgaatgatttccgaattagtcgctaagaagaaaggaaaatttgaccatattgttatagagactacaggtttggcaaatccagcaccaataatccagaccttttatgcagaggaaaacatttttaatgaagtcaaattggatggtgttgttactctggttgacgcaaagcatgctggttttcatcttgatgaggttaagccaaaaggtgtggtcaatgaggctgtggaacagattgcgtatgcagatcgtataattgtaaataagaaaataaacagcttggccaacttaaagcggacagagtatggaaaagttaacttggattatgttcttggcattgggggctttgatttggagaggattgagaatgccattaatgatgaaggtgcaaaagaagatcatgaccacagccatgaccacgagcatgagcaccatgaccatgatcatcaccaccatgaccatgctcattcccatgaccacaagcatgaacaccatgatcaccactctcatgatcatagtcacgatcctggtgtttcatctgtcagcatagtttgtgaaggaagcttagaccttgagaaggctaacatgtggcttggtaccttgttgctggatcatagcgaagacatttataggatgaagggacttctgtctgttcaaggaatgaatgaaagatttgtctttcagggagttcatgacatgtttcaaggttcacctgaaaggttgtgggggccagatgaaccaaggataaacaaaattgtattcatagggaaaaaattggatgctaaggaattggaaaagggattcaaggcctgtttactatga

SEQ ID NO: 20562 - DNA, 504 bp, Glycine max
  Peptide Sequence Number=SeqID_137340
atgagacccaacacagtggtggttagtgtattgagtgcactcagcaaagttgttccctcgtggagaatagttcccatcccagatatcattgatgtcgcctttaaagtgcctgaagtcagagaagagattagagccaaccaatattgctacaaaggaaaccctcgtttgagaacagcctacgaacttatgagggtcagtacagaaattgagcaaagtctgcatgaggtatcactaccttttctagttttacatggtgaggaagatcaagtgactgataaagcagttagcaaacaactatatgatgtggcggcaagctcagataagacactaaagttttatccaaagatgtggcacggtctattgtatggagagccaccagaaaatttgcagattgtattctcggatattattggttggatagagcagaaaactcaccatggaaattcaagattggagagagagctaaaagaagaacacgaacatttggtcaagtctgatctctag

SEQ ID NO: 20563 - DNA, 327 bp, Glycine max
  Peptide Sequence Number=SeqID_137341
atgtcattattggctaaactacgttgtgtcactatagatgtcactggtaccctaatggcttacaaaggggagctcggtgactattattgcatggcagccaaagctgcaggcaaaccatgcccagactaccaacgtatgcacgagggttttaagcttgcatataaggaaatggcaaagaattatccatgttttgggcatgcagccaaaatgccaaacattgtgtggtggaaaacctgtgtgcgagattcttttgtcaggctgcattataagctaccaaaatcgagcattgaattacaagttcatgatatttgcaatctcacctgttaa

SEQ ID NO: 20564 - DNA, 1020 bp, Glycine max
  Peptide Sequence Number=SeqID_137342
atggcgacttcttaccgagtgcagatgagtgcactagcttacttcttgcttcagagtttctgtgttgaagttggatcatgttttaagactaggaaaaacttgagagacgctttacctggttcttatcttaagatatttgattggcctacacaaaaatcaggttggagcaaagaggaacttttggagctgcaggatcctgatcttgcttccactattagaaaacagcaacaacgatccttagaattctgggagaataactggcacagtgatgtaccccttaaaataaagcgtcttgcgcgtgatcctcaaaggtttgcttgggcagtaggtattgcacagtcacgatgtattaacatgcaaacgagaattggtgctctaaatcaagaagcaaatatgctgattccttatgctgatatgctgaaccattcatttgagccaaattgttttttccattggcgttttaaggacaggatgcttgaggttcttataaatgctggacagcagattaggaagggagatgagatgacagttaattacatgagtgctcagaagaatgacatgttcatgcaaagatatggattttcatcacccgtgaatccttgggacaagatcaaattctcaggcaatgcgcgtattcatttggattccttcttgtcaatcttcaatatatctggccttcctgaagagtattaccataataattgtctgtcaaaagccggagatagttttgttgatggagcagtcatagctgcagcacgaacattgccaacttggtcagatggggatgtgcctccaatccctagcatggaaagaaaggctgcgaaggagttgcaagatgaatgtcaaaagatgcttgcagaatttgctacaacctctaagcaagaccagaaattgctagattcaatggcagatgctacgaggacacttgaagctgcaataaagtatagattgcacaggaaattgttcatggagaaagttttccaagcattggagatgtatcaagagcaaatactgttctga

SEQ ID NO: 20565 - DNA, 2751 bp, Glycine max
  Peptide Sequence Number=SeqID_137343
atgcattcctttcttagccttacccaaccgccactcccttatccttcttccctccaaacccatcccctaactctcactctccccactcctcctccgaccaccgtagaacgccgttctccgtcgcaatggatcgacctcctccgctcccaaacccactcctcctccttccgcgacgccatctccacctacgccgccatgctcgccgcccccgcaccccccgacaacttcgccttccccgccgtcctcaaggccgccgccgccgtccacgatctctgcttgggaaaacaaatccacgcgcacgtcttcaagttcggccacgcgccaccctcctccgtcgccgtggccaactccctcgtcaacatgtacggcaagtgcggtgacctaaccgccgcgcgccaagtgttcgacgatatcccggaccgcgaccacgtgtcgtggaactccatgatcgcgacgctgtgtcgcttcgaggagtgggaactgtcactacatttgttccggttaatgctgtcggaaaatgtggaccccacttcgttcacgctggtcagcgtggcacatgcgtgctcgcacgtgcgtggtggggtgcggctcgggaagcaagtgcatgcttatactctgaggaatggcgatttgagaacttacacgaacaatgcgttggtaacgatgtatgcgagattgggcagagttaatgatgctaaggcattgtttggtgtttttgatggtaaagacttggtgtcatggaacactgttattagttcgctttctcagaatgataggtttgaggaagcgttgatgtatgtgtaccttatgattgttgatggggttaggccggatggggttacattggcgagtgttttgccggcttgttcgcaacttgagaggttgagaattgggagggaaattcattgctatgcgttgaggaatggggatttgattgagaattcatttgttgggactgcattggttgacatgtattgtaattgcaagcagcctaagaagggtaggttggtgtttgacggggtggtgaggaggacggtggcggtttggaatgctttgcttgctggttatgcaaggaatgagtttgatgatcaagcattaaggttgtttgttgagatgatttctgagtctgagttttgtcccaatgctaccacttttgcgagtgttttgcctgcttgtgtgcgttgcaaggtgttttcggacaaagaagggatccatggttacatagtgaagaggggatttgggaaggataagtatgtgcagaatgcactgatggatatgtattcgaggatgggaagggttgaaatttcaaagacgatatttggtaggatgaataaaagagatatagtgtcttggaacacgatgatcactggctgcattgtttgtgggcgatatgatgatgcgcttaatcttctgcatgagatgcagagaaggcaaggagaagatgggagtgatacatttgttgattatgaggatgatgggggagttccattcaagccgaattcagtgaccctaatgacggtgcttcctggttgtgctgccttggcagcattgggtaagggaaaggaaattcatgcttatgctgttaaacaaaagctggcaatggatgttgccgtgggaagcgcattagttgacatgtatgcaaaatgtggttgtttaaacttggctagcagagtctttgatcaaatgcctataagaaatgttataacttggaatgttcttatcatggcttacgggatgcatgggaaaggggaagaagctttggagctttttagaataatgacagcaggaggaggcagtaatagggaagtaataaggcccaatgaagtgacttatattgctatttttgctgcttgtagtcactctgggatggtggatgaaggcctgcatttgttccatacaatgaaagctagccatggggttgaacctagaggtgaccattatgcttgtcttgtggacttgcttggcagatctggtcgagtcaaagaggcctatgaactgatcaatacaatgccatccaatttgaacaaagtagatgcatggagtagcttgcttggtgcctgtaggattcaccagagtgtagaatttggtgaaattgcagcaaagcacctgtttgtcttggagccaaatgtagctagccattatgttctaatgtccaacatatactcctcagctggactatgggaccaggcattgggagtacgtaagaaaatgaaggaaatgggagtaagaaaagaacctggttgtagttggattgagcatggtgacgaggttcataagtttttgtcaggggatgcttcacacccacaaagtaaagaactccatgaatatcttgaaactctgtcccaaagaatgagaaaggagggctacgtgcctgatatttcatgtgtccttcacaatgttgatgatgaagagaaagaaactatgctctgtgggcacagtgagagactggcaatagcctttggtcttttgaatacccctccaggaactaccatcagagttgccaaaaaccttcgggtttgcaatgactgccatgttgccactaaaatcatatctaagattgtggacagggaaatcattcttagagattcacttctagtcatcaatggaggtgttgacatggtcaaggatcttgcgaaatttgatggcattgacgatggtgacgatgcactaaaagttcttcacaatgtttatggctacgtgatgaatgagacatttgtagagtggaggcacaacaacggaactcaagcttga

SEQ ID NO: 20566 - DNA, 387 bp, Glycine max
  Peptide Sequence Number=SeqID_137344
atggcaaagagttccgaaaacatgaaaggtttttggtgcgggcatcccagccagagcattgagactgatctagggaatagtgctggaggaaggttcaatggtaagggagatgtcggtgtcagtggtaggagcaagacggggcttgcatcgatgattgagagttcatttctcgtcaaaatgatagcagaggcctttgtctctgcgcacctccatttcttccgatgtcaatcgcttaaaataaattttggggggtgggtttccgcccaaagatggagaaggcagagtagaggtggtaaatcgcagactgcagtgctctttgcgggtcaccgtagacgaatagagcaaaccgagactctagagcttggagcatcatgggccatgaggtga

SEQ ID NO: 20567 - DNA, 303 bp, Glycine max
  Peptide Sequence Number=SeqID_137345
atggctgaattactaaacaacccagaggtactaaagaaggcaaaggaagaaataggaaaggaccgtttggtaaatgagcaagatctgtcaaaacttcaataccttaaagacatcattagtgagacatttggtttgcatcctcctactccattactattgccacacgaatcttcaaaggattttactattggagggtaccacattccacaagacactatagtgttaaccaatggcttgccctggatcgggcctggcccaacgtacggtgggcctcacaatggcattgttgatccaatgctttga

SEQ ID NO: 20568 - DNA, 1614 bp, Glycine max
  Peptide Sequence Number=SeqID_137346
atgaaacctttcgtggctgcggctgttttgttgttgttgttggtggtggtggtggtggttgttgatgccaggtttgtggtggagaagagcagtataactgttctgtccccgcataagctgaaggcgaagcgcgatggcgccatcggtaacttcggtcttccggactacggaggattcatcgttggctctgtggtgtatcccgctaaaggctcacacggatgtgagaacttcgagggcgataagcccttcaaaattcagtcttatcgtcccactattgttctccttgatcgtggaggtatctgtctgtctttcggttctgtcttcgttgactttgatcctttcattgatcttaatttaatgttacctgatcctgtttttatggtatgttctgaaattagtcttgttatgttcgttgagtgttactttgccttgaaggtttggcacgcccaactggccggagctgcggcagttttggtgacagacagcattgaggagtctctgataaccatggattctcctgaggagagctctgatgcagatggctacatagagaagatcacaattccatcggctctgatagagaaatcctttggtgatacgctgaaagacgctttgaataacaaagatgaagttttgctaagaattgattggagagagtcagtacctcaccctgacagcagggttgagtatgagttctggaccaacagcaatgacgaatgtggagctcgttgcgacgaacagatgaattttgtgaagaattttaagggtcatgctcagattcttgagaggggtggttacaccttgttcactccacactacataacatggttttgtccaccacccttcattcttagcagtcagtgcaagtctcaatgtataaaccgtgggagatattgtgctccggatccggagaaggattttggagaaggatatgaagggaaggatgtggtgtatgaaaatttgaggcagttgtgtgttcatagagttgccaatgagagcaaccgttcatgggtctggtgggattatgtgacagatttccatgtcagatgttctatgaaggagaaaagatacagcaaggattgtgctgaggaagtcatgaaatcattagatctgcctatggataaaattaagaaatgcatgggtgatcctgaagcagatgtggagaatgaagtgctaaagaatgagcaacaagtccagatcggtagaggatctcgcggtgatgtcaccatcttgccaacgttggttataaacaatgtccagtatagaggaaaattggagagaactgctgtactcaaggctgtatgttctggatttaaggagactactgaaccttcagtttgtttaagtggagatgttgagactaatgagtgtcttgaaagaaatggaggatgttggcaagacaaacatgctaacataactgcttgcaaggatactttcaggggaagagtttgcgagtgccctgttgtgaacggtgttcagtataagggtgatggttatacaacatgtgaagcttttggacctgcaaggtgttctataaacaatggtggttgttggtctgaaactaaaaagggactaactttctcagcttgctcagttcagtactgcataacctaa

SEQ ID NO: 20569 - DNA, 456 bp, Glycine max
  Peptide Sequence Number=SeqID_137347
atggagctgaaaggtggcttcgggcacttaatagaatgtgtgagagttttgcttggacttcaattaacaacatgccccctcaagcatctcaacaagacttataaccgaatagagggcgatgtgatgatgtttcaagatagttatattgatcctatgggatcgtatatggtttatgctccaatttctgcgaaaaacgtgagcatgattatgaatgggggagattcaatggtgccaattttcccttcaggatttctgatatctgaagatcacagtcgggcagttgctgaatcatctaatagtagaccaggaggctcagtgttaactatgtcttaccaattattgatttgtagcaacaataacgcatcgattcaagaccaaaacagggaaactgtggttagaattgtcgcctcaacactccaaaacattataacctctttgaacatttccaaggattag

SEQ ID NO: 20570 - DNA, 861 bp, Glycine max
  Peptide Sequence Number=SeqID_137348
atggtggaggagaatacacatccagagaagttgaaagtttttgtgagaaaatggacaattaacatgcagtggttgcaccctatacttctcaacataatggacttgcagagaggagaaataagacaatcctcaacatgtgcaaaacatattccaggtgctaagaggaagaaactacatgataagattgaatgcatgattttgattggatatcatggtacaagtgcttacaggttattcaatccaatcaaaaggaaggttgaaatcaacacagatatgcttgtatgtgaaaatgaattatggggctgggagaaacaaaagggtcaattgagattggtaatttttgaagttgactcacaccaagaagttaaaactagaaatgaagaacataatgactcagacattgagggaacagatgatgctaacctaatgcctaagaacttcaaagaagttgctagagaacaaacctggaaacaagctatgattgaaaagctgcaatcaatagagaagaatcacatatgggaaccgacagaattacctccaaagaagaaaccaattgaggtgaaatggatcttcaagctcaaactaaactcggatggatcagtggctagacacaaagccaggttagtggctaaaggatttatgcaaaaagctgaagtagattacaaagaaatctttgcaccaatgaccataattgaaacaatcagactagctatggctctagctagcaaaagaaattggcttgtgtatcactatgtgaaatatgctttcctgaatggatctctcaatgaagatgtatatgttactcaaccacctaggtttgagataaaaggaaaaaaagaaactagtctacaagctgaataa

SEQ ID NO: 20571 - DNA, 675 bp, Glycine max
  Peptide Sequence Number=SeqID_137349
atggggggtcacagctcaagagaaggaaaaagaagtaaatgggttagtgttaattgttgtgttgctgtcatggggtttcaaggaaggaataagaagcaacaacgacgggggaggggtggcagcaacggcggtgtggagctggtggggactggtgggggtggtggtttagggggttttggagaagcacaacaacaagcagaggcagagccacagccagagccagctgctagtaggatcgttggacttccttttggaggaggtcttgttgatttgtcccttcttcaatcttatagggaccattgtgttagtcacatttggatccatcaggagcggctagaggttaggagcccttattacgacgtagtatcctactgtaatcaaaggcttgatgagtacctttttggtgagagaggcagtgaaaatcctactgatgagtcatttgggtattttgacaaagataaaggcttctgtggtgacaaacacaggcgtcaaggtgaggtcaaatctaggtggggtagcaataatgctggtggtggcggtggtgcttcttggaacatgaatgcaggcggggcgatgcgacttggatttggatggggtggggtggcacattgcaacatgaaagggagtgaaagtcataagggaaggggtgtagggatttggtgggtgggaaaatga

SEQ ID NO: 20572 - DNA, 126 bp, Glycine max
  Peptide Sequence Number=SeqID_137350
atggcgtttaatttacgatggtatttcaaggcggcaggaaagaacctccactctgcggtcagaggttgtgcttgttggctggaggtggtggaggttggtgcggcggcggaggagtgcaaattctag

SEQ ID NO: 20573 - DNA, 1755 bp, Glycine max
  Peptide Sequence Number=SeqID_137351
ttttccgcaggccagtatagtgcgttatccctccagccaggcggcgctggcggcagtggccagtggcgaagcggactatgcgctcggcagcctgctggcggcagcatttctgattgagcgcagctatgtcaatcagctggcgctggccgcgattttgccgcaggacgccctctatggcagccgtctggtggtgaaagccgataatcagccgttgttgcaagcactgaatgccgccatcgccgccattcccggcgaacagcagcggctgatttcgcggcagtggacgcagcggccggacgtctggcgcctgcaggagccgctcagcctgacgccgcgcgagcagcagtggctgcagcagcatgcgcaggtgaaagtggcgttcaatccgttctctgcaccgctggcgctgctggatgagcagggtgaatttcagggcattagcgccgatctgctgcatctgatccagctgcgcaccggactgtttttcagcccggtgccggcgtattcgtggcgtgacggcgtacagcagctggagcagcatcaggtagcgatgctggcggcggtggcgcaggatggcggccatcaggaggcagtgcgctttacccgaccttacctgaaggtgtcgctggtgctgctggtgccggaccagcctgatgcgccgcaggctctctatcccggcatgaagctcagtatcgtcaaaggcaatccggcgcgtcaggcgctgctggatcgtttccccacgctgcagctgtctgaagtggataacgccagcctggcgctgcagctattgcaggagggcaaggtcgccgggctgatcgataaccagctgagcgtgaacacattactggcgcgctacgcgcagcagccgctgaagatcgtgtcgcgtctggcgctgccgccggtggagctgagctttgccgtcagccgcgatcagccggagctgctgagcattattgataaggcgctggccgacattcagccgagcgaaatctcactgattgccagccgctggcagggcacaccgcagaccacgcgcaccacctggcagctataccgcgcgcagttttacgccatctctctgctgaccgcgctgctgctgatcgcctgtctggcgtgggtttactatcgcggcaaagaggtgaagcatcgccgtcgcgctgaagctgacctgcaggctgaactacgttttcgcgatgcgctgctgaatggcctgccaacgccggtctatgtgctggatcgcaactggaacgtggtcagtgctaacggtgcgtttcagcgcttttttgccggcgtcgacgcacagcgcctgagtttttcgctttacgatcagcgccatccgctgtcgccgctcatcagcaaactctatccgctgatgagcccggaagcggtcaacgatcctgaactggtggcgctggcgcataacagtctgtggggcgataccgcccaggatctggaaattgagatcgagaacggcagcgaagcgcgtatggtgcaccactgggcgcaggagcagcgagatgcgcagggcaatattaccgggctgatctgcggctggcaggatgttaccgcctacgaactgctgatgctggcgctgcaggcggagaaaaaggtggcggatgaggccaaccgcgccaagagttcgttcctcgccaccatgagccatgagatccgcacgccgatcagcgccatcatcggcctgctggagctggaagggcgcaaacagcgcgataatgaagccattcagatcgcctacga

SEQ ID NO: 20574 - DNA, 621 bp, Glycine max
  Peptide Sequence Number=SeqID_137352
atgggaatggatattctgttcaacactggtgacgataataaaccaaaaaaaatcattattgcgctaagctgcaattttgcactgacggggttacacgagctttgccgttcactcccgggatgtgaagtgcaaacgatactgggtgcgccagaagcgatatcagatgagctcatgtttagttatgccgatttagtgattaccgacctgcctcgtgatgcagcaggtctggcagaattacttctcatccctgagtggttcaaaggcaatacgttgattttattggatgaagagactacagcgatgcgtcgcacgcttctggacgcagacttcagtgatgtagtaatgaaaaaagaaaatttaacgacactacgtcaggtaatacataatctgttgcaagctaaacctgaatcggttgaagaacagttaatcgggaaaaacgccctcatacgtgaaaaacgcgtcatttgcgctttattacgcggagtgaaaccgtctttgattgcccgagaaatgggactgcacccacgtgaaatcagtcgtagcaaaattaattgcctggcaagaagcggtttttcatcgcttaatgccatgctggcgtgcgcatcaaggacatcacaatga

SEQ ID NO: 20575 - DNA, 244 bp, Glycine max
  Peptide Sequence Number=SeqID_137353
atggcgaactttatcgtcgtcgacgatcatcccatggcgcgtatggctgtaacttttttacttgaaaaagaagggcataccttaattgccgaaactgatgatggtcgcgaagcactcgagctggttgatcagcattacccggaaatcgtcgtaatggatattgatattcactcgataaatggtattgaagtcgtaaaaactctgcgcgccaggagttttccgggtattattattatcgtctcag

SEQ ID NO: 20576 - DNA, 486 bp, Glycine max
  Peptide Sequence Number=SeqID_137354
atgtatcatgaggagaaagattctagcgactcgtatggtggtttgtggtggtccacggtgaataactccgatagagccacgtgcatggatttggatgatcaagtcagcatgcacgcacatgatagtggcaacgacaacctgtggcaaggctggctgtcaagttggcaaaacaaacggaacaacttcggtagagaagaactacatctcaatccacagtaccataggttgcttgtagtcactaacagagtctggcctgggctccgcaattatcaaagcaacaaggcacatgatagtggcaacgacaacctcagtccaaccagcatcactatccctcaaatagaatcagacatgcaggaacttgtgcaattggtgctccaaaactcctcagacggcatgcactccaatgtcacgaattcattcctcacagtggccaagggcttctactatggagcatattgtaacccagagaccataaactctcattga

SEQ ID NO: 20577 - DNA, 498 bp, Glycine max
  Peptide Sequence Number=SeqID_137355
atggatgatcatatgcatgctctcaggcgcatcctgtgctacattcagggtacacttcactctggattgcatctttatccctcattagctacttctctgacttcttatatagatgcaaattggggtggttgcccagattataaaaaatctacttttggttattgtgtgtttcttggtgataacttgctcttatggtcttctaaacgccaacccacactatctcgctccaatgttgaggccgaatatcaaggtgttgccaatgtggtttttgagtcatgttggttatgcaatcttcttttggagttacattgtcctatccatatagctacattggtctactatgataatgttagtgcgatatatcttgtcgaaaatctagttcaacatcaatacactaaacacatcgaaatgaatattcattttgttcgtgagaaagttgcccatggacaaggaagggatagtctcagcgtacgacaaccttccgcttcaactgcaagg

SEQ ID NO: 20578 - DNA, 318 bp, Glycine max
  Peptide Sequence Number=SeqID_137356
atgaccaaacttggtctctgcttgtcatcgggcccgccgcctctggatgacaaaaaggtgcggataaccgtaagaatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcggataaccgtaaggtatctccgcgggctaccagctcttgagtcatggcaacaaaaggtggtgtggtcgacaaaagcgatgctcttgctcctacgtatcctcccatga

SEQ ID NO: 20579 - DNA, 216 bp, Glycine max
  Peptide Sequence Number=SeqID_137357
atggctggtgagcaaggtgatagattctcctccgttaccataccccttctcgatgatgaaaaattgcaccaagtgaatggttcagatgaggctttggtgtccaaaacttgtgttctgcacacacctcatgtgggtaatacctcctttttcatgacctgcttccatctcattaatgccctctcagctttaccatttggttctgtccttgagcattga

SEQ ID NO: 20580 - DNA, 513 bp, Glycine max
  Peptide Sequence Number=SeqID_137358
atggggagagaagttacaggaatgcaagttgtggacaagaagccaaatggtgttataccagcttcaaatggtagttctaatgataaagtatgtttttctcctaaaatggaagcagctaaggttcaggcaaaggatcacaaggtaaatgaatgtaccaaaactaactcttttgaggagaaaagccatgagaagatggatggtttgagtgccaaaacaacaaactgtaatactgacttgcctgaggaggagattgagatttctgaagtgcagaaaatgggtgacagtaaaaagttaagctcaccatctgcaagaaaagagcatactagtcaccttgttacacatccatctgatctggttactgaaaagcatggttcccacatacagattgttgatgctgaagctgatgcaactggtctgaacttatcaccaaacactataaacatgctctcacctatctcatcaaagaattcacagaggattagtttctccacctgtggtcatttaaacaagtaa

SEQ ID NO: 20581 - DNA, 240 bp, Glycine max
  Peptide Sequence Number=SeqID_137359
atgacatttcgcaccctaacccagcactggctccgatactataaaaaggccatcatagaccaagatccaaacggatcaatcttgttgggaggtactgcccaaggaaaaaggttacttccggatcaggaatgttcacaaattagaatagatgaattgaggtttcgtaacaagtcaatttcaaccatttacgattctcactccctgtcgttagttcccaacttccgtaactctcagccatga

SEQ ID NO: 20582 - DNA, 2532 bp, Glycine max
  Peptide Sequence Number=SeqID_137360
atgcattcaaccattgcgtgtcttttgttggtgttctgtttccctgttttcttaaacgccgtaccccccgacaaaggtggcggcgattccttgatgttggggtgtggattaggcgaaggtggcggtaaagacagcgacggaaggcaatggacccccgacaacaaatacctctcagggggcaactccgtcacttccaaagcctctttccaagacccttcgcttttttccgaggttccgtacatgacatcacgcgtttttacctccgaagcaacctacaagttccccgttaaacccgacaaacgctattggcttaggctccatttctaccctgcagtttacaacaccttcgaccccgccaattcgtatttctccgtcacatcaaacgccgttacgcttctttccaatttcagcgcctcaatcacatgccaagccctctcacaagcctacctcgaccgagagtattccctcgcgcctttggattcggacactctcacccttaccttcaaaccttctgagaaacagaacggtgctttcgcttttgttaatgggattcagcttattgaaatgcccgagttgttcgattcggctcctttggtggggtactctgaccaaaccatggatacaaaaagtttgcattttcagacaatgttcagattaaacgttggtggacaatttatatctccgaaacaagattctggtctaagcagaatgtggtacgatgatacaccttatttatacggtgctgccactggtgttaccaaccaagctaccaaggatgtcaagattgactacaaaaccatgccacaaaatattgctcctcctaatgtgtactccacttcaagatccatggggaacaataaggacgtcaacatgggtttcaatctcacgtggatcttccaagttgatccgggctccatgtaccttacaaggttgcatttttgtgactattactattccaaagtgaatgaaattgttttcaaaatcttcatcaacaatcaaacggcggaggctgaagctgatgtgattgggtggacaggaggtaaaggcgtgccaacttataaagattatgtgatatatgtgaaagatgaggcaggtgatgatcaactctggcttgctttgcaccctgcacttgaaacaaagccagaattttatgattcattgctcaatggggtggaggtgttcaagctcaatgacaccgacttatctggtcccaatcctcaaccttctgagatgttgattcaacacgaggagcacgcaaagactttccaaaacaaacatggtagtaataagacttttgttattggcagtgctgctgggggtgctgcaggttttgccttagtggctgcaatacttgttgttgttcaacaccaaaagaaaaagaaagctccaggatcatacaacacatcaagctggctacctatttacgggaattcacacaccgcaggcaccaaaacctctgggtcagggaagagtgttggtagtgccaacatatcagccatggctcaaggattgtgccgttatttctccttacaagagatgaaacaagcgaccaagaattttgatgagtcaaatgtgataggggtaggagggtttggaaaggtttacaagggtgttattgataatgggttcaaagtggcaatcaaaagatcgaatccgcaatcagaacaaggagtaaacgagttccagactgagattgagatgctgtccaagttgagacacaagcatttggtgtccttgattggtttttgcgaggaggataatgagatgtgtctggtttatgactacatggcacatggcaccatgagggagcacctttacaaaggaaacaagccattggacacactatcttggaagcaaaggttggagatctgcataggagctgcaagaggccttcactaccttcacacgggtgcaaagtacaccatcattcatagagatgtcaaaacaaccaacattctccttgatgaaaattgggttgccaaggtttcagattttggactttccaaaacgggtccaaacatgaaccaaggtcatgttagtactgtggtgaaaggtagctttggatacttggatcctgaatatttcaggaggcaacaattgaccgagaaatcagatgtgtactcatttggggttgttttatttgaggcgctttgttcaaggcctgctctcaatcctagccttccaaaggaacaagtaagccttgcggaatgggcattgtacaacaaaagaagaggaacacttgaggacatcattgaccccaacatcaaaggacagatcaaccctgaaagcttgaaaaagtttgctgatgcagctgagaagtgtgtgtctgatcttggattcgaacgcccctccatgaatgatctcttatggaatcttgaatttgctctcaatgtgcaacaaaacccgaatggtacaactcacgaaccgtgtcttgaggaaagtgagtttgaagatgtaaacttggaaaaaaatgacatggcagctcactacaaaaaccttagccttggaagtgagcatgaccttagccactag

SEQ ID NO: 20583 - DNA, 339 bp, Glycine max
  Peptide Sequence Number=SeqID_137361
atggaagaggaagaagaagaaccacagcgacgcgggaagtggaggaagaagaaggaaagaagaagaaccacagtcgtgcggaaagtgaaggaagaagaagaaccgcaaccacaaagaaacacaaaccaccaagagaatgaaggaaaccacgacgtgcgtgaagaagaacgaagaagcagaaggagaatgaaggagaccaccacgaggaggaagaaggacaacatgaaggaagaagaagcactgcgacggaattatacggacgcgcactatagtcgtatttatattaatgggatgaagggcattttagccttttcacctagggtgctgggtgtcccatga

SEQ ID NO: 20584 - DNA, 627 bp, Glycine max
  Peptide Sequence Number=SeqID_137362
atgccttatgcactggcatctgggggatggttaagcatatccctactatttgtgattgccattgcttgttgttacactggcattttggtcaaaagatgcatggatatggaccctgttatcaagaattttcctgacataggtcaacgtgcatttggcgacaagggaaggataatagtatcaattgctatgaattctgagctctacctagttgtaacaggttttctgattttagagggtgacaatctcaacaaactagtaccaaacatgcaacttgaacttgcagggttaacaattggtggtacatcaatttttaccatgattgctgcccttgttattttgcctagtgttttgttggaggatttgagcatgctatcttatgtctctgctagtggtgcattggcttcttccattttcctcctttctatattttggaatggaaccattgatggcacaggatttcatgcaaagggaacaatttttagattgagtggaatacctgctgctgtcagtttatatgccttctgttatagtgctcatcctatccttcctactctctataattctatgagagacaaaataatcaaagataggtaccggggtttacaacaagttacgcatcctgcttaa

SEQ ID NO: 20585 - DNA, 939 bp, Glycine max
  Peptide Sequence Number=SeqID_137363
atgaacagatgggcaaagctgtctcggggagaagaactagaccctaatgaaatcccgtttcttgatcgaacactactcaaattcccagacattttgttggagaaaccgagggaagtaaatactagagagattagtaaacttgacaccagtacacttcaacatattccaacatcaaaactgttagatcagtggaagaagcctgtggtgccacaaacaccagaagatgatgggatagataagccaaagaagagaagtggtgcaatgctaaaactcacatcaagccaggtggagaggctaaagaataaggctatggctaataaccatcaatcttcaaaacaagggtcaagacctaattatagcagatttgaagttgttgctgctcatatatggaggtgtgcatctaaggctcttggtgatgacctaactcaagttcggttcagtgttaattttcgcaatagaatgaacccacctctccctcataactattttggcaatgctgtggcaaacgtagccacacctgagggagatatcatatcaaacccattaggttttgctgctcataagataagggaagcatctcatgcagtcacggacgagtttgtaaagtcacaattaaacgttagtcgtttaggccaagtgcaattggataacataagggctttcttcatgcgacaaggacaccgtgtgaatatcccttatgctttgaatcataatgttttgttcctcacaagcttcactaacatgccagtgtatgaatcagattttggttggggaaagccagtgcattttggcttagcaagtagatctccagcagatagggctgcaattcttccaagcccagatggagatggtgttattgtagccttattttttcagacagcacttatgcagcttttcaaaaattacttttatgaggatatgtatttatccttgttatag

SEQ ID NO: 20586 - DNA, 636 bp, Glycine max
  Peptide Sequence Number=SeqID_137364
atgaagattgaggtagggttgggaggggtgtggaatgaggaagagaaagcgatggtggtcgaggttctagttccagggtcgttcgattacttagtagtgaattcggtttcgaacgagaatctgttaatggcatttgggatcgatgagaatctggagaagaagttgtcggatctcgtggagcgcctaaacccgtcgaacttcagagatgggtgttgtagggagccaagaaagggagaagaggttggagaagtgagaattattgttgataggaaggtgaagaggaagaggaagagggtgttgaagaagctgcacatgacttttgggggttctgatgatgacatttatgcttttgggttggaccatgttattgatacgcaaatgttctttcttgcttccatgtacttctcttttccccaagggcttgggggtctaggtaagtgttttgcttctgggaagcatttgtggattttagatatgttcaaatctcgttttgattactatgtgaggtctttcttggccaaatttgttgggattcaaactgttgttttggtgcctactaatttagggatggtggagatggtggtgcgcggtggtggggggatagaagaagatcggggagagagaagagaaagctaa

SEQ ID NO: 20587 - DNA, 333 bp, Glycine max
  Peptide Sequence Number=SeqID_137365
atggaaaacgtgctggaacgatatgagagacatgcccatataggacaacttgttggagacggagatgattcacagggaaactggtccttacaatgcttcaagctcaccggcaaagttgaagtcttagagaggaacttgaggaactttgtgggacaagatctggatcccttgaacttgagagagcttcagagtttagagcatcagcttgacacagctataaagcggatccgaactagacagaaccaagttatgaatgaatccatctcagatctgcagaaaaaggtaacgggttggggacggggatttactactggatattggcgtgtgcattag

SEQ ID NO: 20588 - DNA, 255 bp, Glycine max
  Peptide Sequence Number=SeqID_137366
atgaaaaacaatgttggttgttggatggcaaggcaattgcaagagcaaaatggcacccttacaaagaagattaaggagaaagggaagccagtggttgaacctccacactgcgggccagaaaccttaggtctaacattccctccagagctacaaccacaacaaagactagttccttctttaacactctgggtaactcctaaccgtgaggtgcatttgaaaatgagacgtgagattatgactattagtatattttaa

SEQ ID NO: 20589 - DNA, 2253 bp, Glycine max
  Peptide Sequence Number=SeqID_137367
atggccaatcacgatttgatacttggtcaaagccacaatttagcacttggtcatgatcagcaattggtgctgggccatgaccataatctgggcctcagccagaaccatgcattggaaatgggatcagcccatgagcaccatttagatctgggacaaacccatgatcatgaactgggcttggggcatgcccatgatcatgaattggggttaggacagaaccatgaacatgaaggtgatgatggtcacacttacgagcacgagcatgagcgtgagctagccatggatcaaaaacctgaacatgatgaccatgacttgccccttcctggacaaaatcatgagttagtcctatcagagaacaatgatttgactgtttcagagaaccaagaacttgatgagaacatgggactggctgcggttcagaactctgaaatgggaattgattctgcaaatgatatggatgttcaacagtcacagcttgtggtaccccctataattcaggctcgtactgcaagtcctagttatgaattgtcagtggggcaagaattccctgatgtcaagagttgccgaagggctttgagggatacagcaattgcgctgcactttgaaatgcagactataaaatctgacaagacccggtttactgctaaatgtgctagtgaaggatgtccctggcgcattcatgcagctaagctcccaggggttccaacttttactattaggacaatccacgagaatcatacatgtggaggaatttctcatctcggccatcagcaagcttcagttcagtgggttgctaactctgtggagcaaaggctgaaggagaaccctaattgcaagccaaaggaaatattggaagaaattcatagggttcatggtatcaccttatcatacaaacaagcatggagaggcaaggagcgtatcatggctgcaatgcgtggatcttttgaagaaggttatcgcttgcttccacaatactgtgaacaggtgaaacgcactaatccaggcagtattgcatctgtttatggaaatccagctgatggttgtttccaacgtctcttcatctcctttcaagcatctatatatggctttttaaatccttgtcggccactattgggacttgacagaacatatttaaagagcaagtatcttggaacattgcttcttgctactgggtttgatggtgatggagctctctttcctctggcatttggagttgttgatgaggaaaatgatgataattggatgtggtttctgtctgaacttcataacctgcttgagattcacactgaaaacatgccaaggcttactattttgtctgatagacagaagggaattgtggatggagtggaagcaaattttcccactgctttccatggattttgtatgcgccacttgagtgacagcttccgtaaggaatttaataacaccatgcttgtcaatcttctatgggaagcagctaatgctcttactgtaattgaatttgaagcaaagattttggagattgaagagatatcacaagatgctgcatattggattcgaagaattccacctcgcctctgggccactgcttattttgaggggcacaggtttggtcatttgacagccaacatagttgaatctttaaacacttggatattggaggcatctggacttccaataattcaaatgatggaatgcattagaaggcagctaatgacttggtttaatgagcgccgggagaccagtatgcagtggacatcgatactcgtaccatctgctgagagacgtgtagcagaggctcttgatcgtgcacgcacataccaggttcttcgcgccaatgatgccgagtttgaagtgataactcatgaaggaacaaatatagttgatatcaggaaccgttgctgtctttgccgtggctggcagctctatggtttgccctgtgcacatgctgtggcagcacttctctcctgcaggcagaatgttcatagattcacagaaagctgtttcacggttgcaacttatcgcaagacgtactcacaaaccatacacccaattcctgataaatctctctggaaggagttgtctgagggggatgccaatgttagcaaagctacagaagttgttatcaatccacctaaatcactcaggccacccgggagaccaagaaagaagagagttcgtgcagaagaccgtggacgtgttaagcgagtggtgcattgtagtcgttgcaatcaaacaggccactttagaaccacatgtgcagctcccatctaa

SEQ ID NO: 20590 - DNA, 174 bp, Glycine max
  Peptide Sequence Number=SeqID_137368
atgacccaatgcacaaggctcccacttagacttgagaaaggcacactagacattgtgcaagtcagcttcagtgtgtcccagtatgcaggacaacatagaaggggggtggggtggggccttgggggggcggaattcaaagagacttatatgaaaattttaaaatgtaaagactaa

SEQ ID NO: 20591 - DNA, 216 bp, Glycine max
  Peptide Sequence Number=SeqID_137369
atggcaccgccatgtggaaaacacactattagaagagcaggatctttggagattattcttacttttcttcaactgtttttgcttgcagaatacactaaagagaatccaaagataatgacaaaatgctctcatcattttcaccttggttgcatttatgagtggatggagagaagtgacaactgtcctgtctgtggaaaggtgtgtaaagtttgctag

SEQ ID NO: 20592 - DNA, 699 bp, Glycine max
  Peptide Sequence Number=SeqID_137370
caagcaaagaaggagcgtctgccaactggttcccctgatggaaagaaggaagaaccggggggttgcatcatttacaatcccgttcttgctataagacagcttggctaccctatgagaggggcaccactagaggaagagctcacacctattattgcacgaggtttcaataacaccaacgtggaggcgcttcagaaggtccgcaaggcatgggagatggtgcaaaagaaggacaaggaactcataggtagtaacaatgggcctatcggcggctaccgtaggtggttgaaagcccacatgcaaggtctagattggctcccgagtttgagaaccactaaaggggtggaagttgaagcaccggaggaagacgaagaggtgcaggcccatagggtagaactcgagaaagcccaaacagtcaaagaaaagttcaaatcagcagctcttaagatccgaaaggagaatgccaaactgagagacgatgagttgaaggttttcctaaggtccaagagaagcttgtctcagggtttatgcgagacagagaccaacatgttagccattgtcagcaagtaccaagaagaattaaatctagcaacggcccacgagcacaaaggagtcaagaacttccctgattgctggccaacgccaaagcaatggcggacacctactccgcccccgaggagatccatgttcttctcagctatt

SEQ ID NO: 20593 - DNA, 165 bp, Glycine max
  Peptide Sequence Number=SeqID_137371
atgtccggggaatcagccagcgctgctattcacaagggttttcaagatatggtctctaaatccaagaaaaagaaaataaagaagcaagctaagctctccaactcagttgaagtagtagcttctaaattccccaaagggataaggcacagacctctatccaaatga

SEQ ID NO: 20594 - DNA, 483 bp, Glycine max
  Peptide Sequence Number=SeqID_137372
atgggttcctccaagttattgggtactatggccatgcttttcgttgtgctgctacccatggctgccaaaggggataatattactgatttccttgataaggtttgtgaagaagtggaatgtgggaagggaagctgcgtagtaaacacaagttacccattaaacttcgtttgtgaatgcgattctggctggaagcgaacccaagatgacgatgataaatatgccgctagctttcttccatgtgtcattcccgaatgtagcttgaactatggttgtcagccagcaccaccgccagttccagagaagagttttccacataacttctcagcttttgatagtactcttggatctgattgttcgagactcggaataaaagttgcaaattcatccactgatagtggcagtcaagatagctcagcctcaatcttcacaggaaagttccattggatcgttatgttgttgatgtccacgggtatggttatgtag

SEQ ID NO: 20595 - DNA, 533 bp, Glycine max
  Peptide Sequence Number=SeqID_137373
atggtgaatcaacaagcgaagtatttggcaggcatctatgcttcaacttctcatgttgtctgcaagcagctttgttcagatctgccatcccttcaagatcaacacttaggagcctggtgcttcattgggaacttcaacaccattctcagctatcatgagaagcgtggaggaaatgtctcttctcaaaactcttgcaaggacttccacgcttgggtggaggcttattctctaactcacctccactccttagtgcctttcttcacttggtctaatgggagaagaggtcagcaagatattgatattcgtctggacgggtctatttgtaatgaggctttcatctcctattgggaccaaattagttgcaatgttcttcctcggtctagctcagatcatcatctgcttcttctcacgttgaatcataccactatgaggctcacttcatctttcaaatttatgagtatgtggttagagcaaccccaatgttccaaggttatctctgacgcttggaggactccagcggttggctatcccat

SEQ ID NO: 20596 - DNA, 623 bp, Glycine max
  Peptide Sequence Number=SeqID_137374
gaatcagtccagattaaccactctagatctctcagataaccatatccaagggacagtgcccaactggatttggaaactacagattcttgaaagacttgatatttctcataatttgttgactcatttggaaggacctttgcagaatctttcttcccatttgatttaccttgaccttcatcagaataaacttcaggggccaatacctgctttttctggaaagacgttgtatttggatttttcaagcaacaattttagctctattatcccacgagactttggtaattacatgtcttgcacattttttctctctctctcaaacaatactttgagtggcagcatccctgattccctctgcaatgctttatatcttaaagtgcttgatcttttcaataataacatttctggaacaattccctcatgcttaatgatgatgagtggcactcttgaggtattaaatctgaagaacaacaatctctcaagccctattcctaatacagtcacagtttcttgtggtttgtggactttaaatcttcatggaaatcaattagatgggccaattccaaagtctcttacttattgctcaaagttagaggtattggaccttggatcaaatcaaatcacag

SEQ ID NO: 20597 - DNA, 522 bp, Glycine max
  Peptide Sequence Number=SeqID_137375
gataatgagtcacctgttcatggactatctgaagtggttgttggggttctaggaggagggcaacttggtcgtatgatgtgtcaagctgcttctcagatggccattaaagtcatggttttggatccacaggagaattgccctgctagttccctatcttatcatcatatggttggaagctttgatgacagcactacagtggaggaatttgccaagagatgtggagtattgactattgaaattgaacatgttaatgttgatacattggaaaaacttgagaaacaaggagttgactgtcagcccaaagcctctacagataagtatcagcaaaaggttcacttctcccagcatggcattccacttcctgagtttatgaagatagatgatctcgaaggtgctaagaaagtaggggagctctttggctatcctcttatgatcaagagtaggagattagcttatgacgggcgaggaaactttgtcgtcaaaagtgaagaggaacttccttctgctgtggatggtaattaa

SEQ ID NO: 20598 - DNA, 309 bp, Glycine max
  Peptide Sequence Number=SeqID_137376
atggttttcttcatattgagtattcacaggattttaaagaaaatcacttttctaattttgccaggaattagaacagaagaatcggtatctcaatcccctcaaccccaaagagaaccaagtttggaggatggcaatgaggcatggaaaatgaggaattctaggagactaatgattggatccactgcaccaacttgtacgtacaatgaatgtagaggttgtaagtataaatgcagagctgagcaagtgcctgtagagggaaatgacccaattaatagcccataccactacagatgtgtttgtcatagatga

SEQ ID NO: 20599 - DNA, 366 bp, Glycine max
  Peptide Sequence Number=SeqID_137377
atggatgaagatcaatgggtgtatgacagtataatgtctgaaaaaattgatatggataatcaaaatgaacaagaatgtggtgtgaatgcacaacatattgattgttcggatgctcaatacttctcagatgatgttttgcagtgggctcaatccgttgctcatgaaaatggatttgtggcggtcattatgagatctgacacaaacactggtagtagaggaagaagttcatttgtgttaattggttgtgaaagaagtggtcagtataagtctaggaagaaagattttgttagaagagatactgagagtaggaaatgtgagtgtccttttaagcttcgtgggaaaccagtggttgaagggcaaagttag

SEQ ID NO: 20600 - DNA, 285 bp, Glycine max
  Peptide Sequence Number=SeqID_137378
atgggtttgaacggtgttcttcttggaaacagagctgcgttggcggttcgcgtggctagtgaagcagatctggcggtgcggtgtgttccgacagatcttgtggtgggttctgtggtgcggtggttcccgactgatctttgtggtggcttggagagctcgcggggggttacgttgtcggcgccgaagagatcaccggtgacggcagcgcttgtcggagagtggtcgtggaagacaccgggagggagagtacggagaagaaggaaggaagatcgagatttgatgtga

SEQ ID NO: 20601 - DNA, 261 bp, Glycine max
  Peptide Sequence Number=SeqID_137379
atgggtcgctacacgaagatgttgatgttcacaacaattttactattgggtttacaacaaatatgggcatttaggccattgaaagaggatcaatggttgaagcagaggctggtaatacaatcactacaaagaggccacgtgcaacattctgaaagaaacccatgttccaccgttcctgggcgcagtaagggacgctgcacttctgaaatcaacgttgccgatcacgttgctcatgcaccaccactagaagttgccaattag

SEQ ID NO: 20602 - DNA, 300 bp, Glycine max
  Peptide Sequence Number=SeqID_137380
atgcggatcaactacatccgtaagaaattaaaaaccagaaatgcaagtgacagggaagatgaagcgtacttcgacggtggagcaacccctttaatgcacgtccacaatgccgacggaggagaagaaggatcaaagcccaacgaagggaagggaagaagaatagcggcggcgcaaacggagggaagggaagaacagatgcggcagcgcaaatggaagctacaatgctggtgtacacatcacccaaacatgtatgggacaagacccaaaaggttagatttaggacaaaggaagaactattaa

SEQ ID NO: 20603 - DNA, 1692 bp, Glycine max
  Peptide Sequence Number=SeqID_137381
atggcaaagccaggggtgttggagtctgatccaggggtgatggtgaagaaggccaaagagttgaagagggagcttcagaggttggtgaagtctattgtgcatgatgaggattgcagcactgagaccattgatcaggccaaagagactctctgtgttctcaaggagttgaagctcagaaacaggtcttcactgtctctgaagcttcacaacaagagtgtcgcttcttcttgccctgatgaattcaagtgccctctttccaaggaattgatgagagatcctgtcattgtggcttctggtcaggtactatttttaacctgtttgattgttttgcttttacattttgctgttcaatgtgagtgggacttgctggattttattttggaattgttttacatttgctgtcaatggaagttcaatgccaagtactttttgtttgatttgcggaatttctgtgatcttccctctatttatgttgttagctttactgcattcatgtttcaaatgtatgtttcaagaaacaaaaaagaggaaaaagaaaaaggaaaagggcaatttgatgatatgcctatgatagccattgtggatggaaagagaaagagtggggagacatatgacagacctttcattcaaaaatggctaaatgctggaaataggacttgccctcgtacacatcaagtcctttcacacactgtgcttacaccaaatcatctaataagggaaatgattgagcaatggtctaaaaaccaggggattgaattgtcgaatactgttcaatatattgatgaggaaggtttaaacgaagccgaccgtgagcattttctttgtttgcttaagaaaatgtcatcaacactttctgatcagaagacggctgcaaaagaactgcgcttgctgacaaaaaagtatccttgtttccgggtactcttctgtgattctgcagatgccattccccaattgcttaagccaatttgtggcagtgattcttttggtagtgttcaccctgatctccaagaagatgtaatcacaacactcctcaacatctctattcatgataacaacaaaaagctagtggctgaaactcctatggtaattcctctccttatgagagcattgagatccggaacaattgaaacgaggagcaatgccgcagctgcgcttttcactttatcagctctcgactcaaacaaggaactcatagggaaatctggagttttgaagccgttaattgacctcttggaagaagggcatcccttagccatgaaggatgttgcttcagcaatttttaacatatgtgtaatgcatgagaacaaggcaagagccgagaaggacggcgcagtgagggtgattttggcaaagataaataagcagattcatgttgctgagttactagctattcttgcactgctttcaagtcaccagagggctgttcatgacatgggagatcttggagctgttcctagcttgctgaggatcatcagagagagctcatgcgaacgcaacaaggagaattgtgtagcaatccttcaaaccatttgtctgtatgatagatcaaagttgaaggaaataagggaagaggagaacagccacaaaacaatctctgagctagcaaagcatggaacatcaagggctaagaggaaagctagtggaattcttgagagattgaatagggctgttaatatcacacacactgcataa

SEQ ID NO: 20604 - DNA, 678 bp, Glycine max
  Peptide Sequence Number=SeqID_137382
atggcggagaacggtgaaggcggcgaggagtacctgttcaagatagtgctgattggggactccgcggtggggaagtccaacctcctctcgcggttcgcgcggaacgagttcgatagcaactccaaggccaccattggggtcgagttccagacgcagctcgtcgagatcgacggcaaagagatcaaggcgcagatctgggacactgcgggacaagagaggtttcgagctgtcacctctgcttactacagaggcgctgttggtgcgctcgttgtttacgatatcagcaggaggggcaccttcgacagcatcaagcgatggctccaagaactcactaattccctacaaagcttggtcctagtccagttcatacctcaaaaggacgtatgtgagatgtatttagaaagttggtacttggttgaattggtaaggaacggactcatgtttcacaaaaatatggttttgatttcccttgccaatgtcagaaggttgttgagaatcagggatactgtgatcgttgggtatttgtttattcccgtaattgctgtcaagaccttaatattatatcagggtactatatctgataaaagttccatgaccccactttgtgttagtacaaagttgcatggctcccttgaattatcaacacttgcttctcaattctcatcattgttgcggtaa

SEQ ID NO: 20605 - DNA, 573 bp, Glycine max
  Peptide Sequence Number=SeqID_137383
atgaaccgagtgataaagaagaccgtttcaaatatctgtgctctcaaggttccaagaaagtctttttgtagtactgagggtgtgaaagttgctggttgctctattccagaggtttccaatgaccatgagaagaagcaggctattagcaaagttattccacaatatgatattgctattgttggaggaggcatggttggcatggctttatcttgtttcttggcaagtaatccaatgacaaagcagttgagtgttgcaattattgatagcaatccagctcttggaagtagcttgcacatcaagaaggaagatccccctgatccaagagtcagtacagtaactcctgcttctatttcttttctccaaggtatcaagtccttaaggaatagtaaaaaacttcgtaccccattgcccggaggctcttcgctatgcgaaggtatgggggagggatattgtacgcagccttacccttgcatatgcaaagaggctgtttccggattcgaacccatgaccaacaagtcaccaaggcacaactttaccgctgcaccaaggctcgtcctcataaatcaggaatag

SEQ ID NO: 20606 - DNA, 411 bp, Glycine max
  Peptide Sequence Number=SeqID_137384
atggctggtacacaaactataaacaaaaactacttagcctggcactctctcattatcccaaaatctcatttcccttcactggatgccactcctccatcagtggtagctgcaatgtgttcaaaagtgcccttcattagcaatgcaatcatgaaggctactggctgcagttcattcaacctgttggtcaacaatggggcagctgcaggccaagtaatatatcatacgcatatgcacataattcctcgtaaagcatatgattgcttatgggcttctgagagtttgctaaggcgacgccttaatttagaggatgagaaagtttctcagcttgcagctcgtattcagaagcagttattgccatccgacatttgccaggacagcaagaatgaaagtttttgttcaagtaaaagttag

SEQ ID NO: 20607 - DNA, 648 bp, Glycine max
  Peptide Sequence Number=SeqID_137385
atgcacatgctgaggaacaatgtcatgcctaccagttattccttctcatctttgatcaaggcttgcacttggttgatggattcagcttttggcaaaggtgttcatgggcataattggaaacatgggtttgattctcaggtgtttgtgcagactactactttggttgagttttattcaactttgggtgatgtgggtggttcaagagggtgtttgatggtatgcttgaaagagatgttttgcttggaagacgatgatttcggctcatgtttgggatggggatatggcttctgcagcttgtgctcatctatggatgcattatgcatggttgacctattgagcaaggctggtttactcgaggatgctttagagatggaaatagctcagtgcagttcagaatctgatgacagtggactttacagtctccttgttaacataaacatgtattctgtaaataggtggagtgaggtcgcaaagattcgaacaaccatgagggatctgggtgtagagaagacatgtgaagggtctagctgggttgaaatcaataagagaattaatctatttgcggctacttatatatatcactcttcttatagtcaagttcacttatttctagctgaacaagatgaccaactgaggctagcaggttag

SEQ ID NO: 20608 - DNA, 1338 bp, Glycine max
  Peptide Sequence Number=SeqID_137386
atgtacggcggcgacagcgacaacagcgacggcggcagcgatgacctgcgccgcggcgacacgctggacttccggaacctgaaggtggtttccgccgtggggcgcggcgcgaagggagtggtgtttctggcgcggcagtacggcgcagcggcgggtggcggggagtgggtggcgctgaaggtggtgtcgaaggcgcttcttagaaaaaagaacaaaaacggctatggcgggtgcaagagggtgtcgttcgagaggcacatactgcgtcatttggatcaccccctttttccgcggttccgtggggccttcgagacggagcagctcacggggttcgccattgattattgccacggtgggaatctgcattctctcaggaagaagcaaccggagaaaacgttctctgaaaaaagcataaggttttacgcagtggaattggttctagcattggagtatttgcacaactttggagtagtgtatagggatttaaagccagagaacatcatgatccaagaaacaggtcacataatgcttgtggattttgatctctcgaagaagctaaagctaaagtcaaactcatcaagttgcaactcgtcaccgaattctgactcgtcatcagagaaggagaagagaaagcgacaaatatcgcggttcaattgtttttgtcacacaggaatgtccttgtacgacttggatattccaagtcaactcgatacgatcccgacacgtcaaagcttatcagatttgttggagaagtcaaactcatttgtgggaaccgaggattacgtggcacccgaggttattttaggtcaaggacatgactttggagttgattggtggtcattgggaattgttttgtatgagatgctttatggggcgacgccgtttaagggcgctaataggaaagaaacgtttcaacgaattataaccaaagagccatatttgatgggcgaaacgacgccattgaaggacttgatcatcaagttgcttgagaaagatcctaatggtaggattgaggttgatgagatcaagagtcatgatttctttaaaggcgtcaagtgggacacggtgttggaaattgcacgtccaccatatattcctcagaatgatcatgaaatcgaggatttgataggattttcgaaaaaagacgtggaatcttttgttcatgggatatttttccccaagaataaaagggagaaagataaaacaaatgaaggagataaaaaggggaatacaattgaaagtcgaaaagacgaggataataatcacaataataagaatgtgtgggttgataagttgaatcaagattccattaaggatgacaattttttagttttttaa

SEQ ID NO: 20609 - DNA, 1071 bp, Glycine max
  Peptide Sequence Number=SeqID_137387
atggatttgttttccaaaaattgcaacttcaaggaggcactaaggtttttctatgatgcttcaagcaataacgtggcatgttggaatgctattatttcgttggcagttaaaagtggagaacgctgggttgctttgaatctgtttcgtggaatgtgccatgcatctctaatgccggatagttatacatttccaagcaatctaacagcatgttgtgtgcttaaagaattgcatattgggagaggagttcatgggtgggcaatcaaatgtggtgcaacagatgtctttgtggagactgctattgttgatttatatgcaaaatttggatgtatgagtgaagcttttagacaatcttcccagatgcaagtccataatgtggtctcctggactgctataatttctgggtttgtccaagaggatgatattatttttgcactaaagcttttcaaaaatatgagagcaatagggcaggagataaatagctatactatgactagtgtactttctgcatgtgctaaaccagggatgattaaggaggcaggtgaaattcattccttggtattaaaattagggttgaatttagatgctaaggttggtgatgctttagtcaacatgtatgcaaaaataggagaagttggactatctgagttagcctttagtgagatgaaaaatataaaggatcagagcctatgggcagccaagttgtcctctttcacacagaaccaaaattctgaaagggcagttgagttattcctttcaaagtgtggttgtttagaagaatcttgtaaagtttttcagcaacttcctgccaaagacaacgtctcatggacctccatgatttctggtaaggaaattcacggttatgctttccagttgggaataggaacagacacagttgttggtggtgcacttgtaaacatgtatacaaaatgtggaaacttgaatttggcgagtgcagtgtttgatatgctgccccaaaaagatgtgtttgcttgctcttccttggtcttgggatatgcccaaaaggatctaattgaagaatcatttttgttattccatgatatgctcgactaa

SEQ ID NO: 20610 - DNA, 342 bp, Glycine max
  Peptide Sequence Number=SeqID_137388
atggcccatcctgcacgcaatcacggacttcacggcccttacagctggcacgccgcgttggtaaaacttgttttgtactcgtcttcgccacggggcgcgatctgctgcacccggtactacgctaatatactgtaccctctttcttacagtcgtacgcctctcgctccgaagggttttgttccgctacgctcggctatcgtgctcgaatgctgcacccgcatttacacgtggtggagttatcgatgttgtacacgtaggttgcaggatgaggacacgtggcgaattcgtgtcattctccgacaagaattctgggaaacggagacgtatgggttccatcaataa

SEQ ID NO: 20611 - DNA, 630 bp, Glycine max
  Peptide Sequence Number=SeqID_137389
atgaggaacattccttcctactatgaaaggcaggttatggacaagctccaaatgcttagacaagggagtctgagtgttgaagaatatagacaacaaatggaactactccttttaggagttggacttagggaggaggaaaaaacaagcatagctaggttccttagtgggcttaatatgaaagtgagggacaaggttgaactccttccatatagggacctagatgagctagtccaactttgtataagagtggagcaacaacttaaaagaaagtcttcttcaaaatcttatggctttcactcaaggaaggacaaagcccaaggaattttgggggctgcacctttaaaacccaaggaagataagggtaagaccatagagaaatccacccctaagactagttcccaagaaaggactagcaacattaaatgttttaaatgtcttgggacatgtcacattgtctctcaatgccccaccaagaaaaccatgattatgaggggtcaaggaatttatagtagtcaagaggagactacttcttccccttcctctaatggaagtgaagatgaagtaaggggtgaagagtctagtgaggaagtctacccccatgaagcctcaaacaccttcataggtagctaa

SEQ ID NO: 20612 - DNA, 261 bp, Glycine max
  Peptide Sequence Number=SeqID_137390
atggctccgagaaagctttctgcaaagagatccaggaaggacgccgcggctgaagggaccagtgccgctcccgagcacgatgagtacacagatttcctggaagagatagctcgccggcgttggacgtcgctggtcactcccatggccaagtttgacccagatgtagtcctagagttttatgccaatgcttggcccaaggaggagggcgtgcgggacattcgttcatggatgccctcagccagtttctgggagacccgttag

SEQ ID NO: 20613 - DNA, 171 bp, Glycine max
  Peptide Sequence Number=SeqID_137391
atgtgtcagtatcggtgcctcaaactactatgcgaccatcccaacgatcaccacgatgcggccgagctcgtaatcaatgaaatcatggtgattgtctctcagatgccattccggagaggccatgggggagggaggaatgaagatgaagggaaattcttggttccatcataa

SEQ ID NO: 20614 - DNA, 2547 bp, Glycine max
  Peptide Sequence Number=SeqID_137392
atggaagctcctcctggtggagtggacgatatgactaaactgtcctacttgcatgagcctggagtcctgcagaacttaaaagctagatatgaattgaatgaaatatatacttatactggaaatattctgattgcaataaatccattccaaagactacctcatatttatggtgcgcacatgatgcaacaatacaagggagctccatttggggaattaagccctcacgtgtttgcagttgctgatgttgcatatagggcgatgattaacgaaaaaaaaagcaattcaattctagtcagtggggaaagtggagctggtaaaactgaaactacaaaaatgcttatgcaataccttgctttcttaggtggtagggctggtaccgaagggcgaacagttgaacaacaagttcttgaatcaaatccagtactggaagcatttgggaatgctaaaactgtcaggaataacaattctagccgttttggtaaatttgttgagatccaattcgataaaagtggaagaatatcaggagcagccatccgaacatatcttctagagagatctcgggaaattgagaaatacaaattaggaaatcctagatcgtttcactaccttaaccagtcaaaatgctatgaactggctgatgtaagtgatgctcatgaatatcttgccacccgaagagctatggatattgttggaataagccaaaaagatcaggaagccattttcagagttgttgcttcaattcttcatattggtaatattgaatttaccaaaggaaaagaagttgattcatcagttccaaaagatgacaaatccaaattccacctgaaaacaactgctgagcttctcatgtgtgatgctgatgccttggaagacgcattatgtaagcgtgtcatgatcacccctgaagaagttataaaacggagccttgacccccaaagtgcagcaatcagtagagatggattggcaaaaacaatctattctcggctatttgactggttggtggacaagattaataattccattggacaagaccccaattctaaatctttgattggggtccttgatatctatggtttcgaaagctttaaatctaacagtttgtcatgctctgcagttttgagcaattttgcattaatttcacaaatgagaagttgcagcaacatttcaaccaggcaaagtctaagaacaaattatgcacttcaacacgtgtttaaaatggaacaagaagaatatacaaaggagcagatcaattggagctacattgaatttgttgacaaccaagatgttttggaccttattgagaagaaacctggaggaatcattgctctccttgatgaagcttgcatgtttccgaagtcaactcatgaaacatttgcaaacaagctttatcaaacatttaagaataacaagcgctttattaagccaaaattgtctcgaacagatttcacaattgctcattatgctggggaggtattataccagtctgaccaattcttagacaaaaacaaggattatgtggttcctgaacatcaagatttattgagtgcttccaaatgttcttttgtatctggcctttttcctccacttccagaagagacatcaaaatcttccaaattttcttcaattggttctcgttttaagctacaactacaaagcctgatggacacattaaattctacagaaccccattacattagatgtgtgaaaccaaacaaccaactcaagcctgcaatttttgagaatgtcaatattatgcaacaacttcgctgtggtggtgttttggaggcaatcagaatcagttgtgctggctaccctactcgtcgtgctttctttgaatttataaacagatttggcatccttgctacagaggccatggaagcaaactgtgatgaaaagactggttgccaaaagattttggaaaagatggggcttcaaggatatcagattggaaaaacaaaggtattcttgcgagcaggtcagatggctgaactagatgcacggagagctcaagtacttagtaatgcagcaaaagttatccaacggcgtatacgaactcatcaagctcgtaaacattatcttgcattgcgaaagaagagcatatatgtgcagtctcggtggagaggaagacttgcatgtaaactctatgagcacttgagaagggaggctgctgctaggaaaattcaaaagaacgtacgcagatatgaagctaggaaagcctataaagaacttcatgtgtcagcacttacactgcaaacagctataagggccattgctgcccgcaataaattcagatttaggaagcagactaaagcttccattattattcaggcttggtggcggtgccacaaagctgccatatattataagaggcttagtagaggtgcaatagttacacaatgcagatggagggggcgcatagccaggaaagaacttaggaaactgaaaatggctgcaagagaaactggtgcccttcaagaagcaaaggataaactagaaaaacgagtggaggaactcacttggcgtctccaactagaaaaaggtttaagg

SEQ ID NO: 20615 - DNA, 264 bp, Glycine max
  Peptide Sequence Number=SeqID_137393
atgattccatatctcaatctgcaggggactccagtgaatattattgtgggttctcatgtctggattgaagacccagaggtatcttggattgatggacaggtattaaaaatcaatggaacggatgctgaaattgaagataccaatggaaaaaaggaaattatggcactgacgtgtcaaggattttgtgagaatgccaacgagttgaacaaatgtagaaacatgaggcaagatgataactcgatggtcatacacctcctgggttga

SEQ ID NO: 20616 - DNA, 1863 bp, Glycine max
  Peptide Sequence Number=SeqID_137394
gctctgctcatcaaagagcgagagaatgtgaagaaagttgttgaagaagcacctcccgtcattaaagaaacacaagttattgttgaagatacacagaagattgagacactgactgcagaagttgagagcctaaagcaacaatttggcaacaagaaacccatgccgctgtctggtcatagcattggtaaaaatatcagctacttgaattgctgtagatatacttcactcaagtcagagaaacagaaagctgatgactttgaaagaaaatacaacgaagcccaagtttgtagcgaagaaagaggtaaaaaactggaagacacggagaagaagacacgtcagcttcaagaatcactgactaggctagaggagaagatcactaatttagaatcagagaatcaggttctacgtcaacaagctgtgtccatggcacctaataagttcctttcaggacgttcaagatcagttgtccagagaactgaaagtggtcatattgtaccggaagcaaagacaactctgcctagtcaggaaatgcatagcacatcaatgcaccggagggaaccctctgacggcttggatgacaaaccacaaaagtcactaaatgagaaacaacaggagaatcaagagttactcattagatgtattgcacaacatctaggctatgctgggaacagaccaattgctgcctgtatcatatacaaatgcctcttgcactggcgatcatttgaagttgagcgtactagcgtttttgaccgtatcatccaaactattggccatgcaattgagacccaggataacaatgatatcttggcttattggttatccaatgcctctacacttctcttgttactccagcgcacgctcaaggctagtggtgctgctggaatggctccacaacgccgtcgttcttcatcagcaaccctgtttgggaggatgactcaaagtttccgtggagcaccagctggagtcaatctttccctaataaatggtaacacaagcagaggagtagatacattaagacaagttgaagccaagtacccagctctgcttttcaaacaacagcttacagcatatgtggaaaagatatatggaatgattcgtgataatttgaagaaagaaatttctcccttgcttggattatgcatccaggcaccgagaacatccagagcaagccttgttaagggatcatcacgttcagtagcaaacaccgaagcacaacgcgctttgattgctcactggcaggggatagtgaagagcttaggaaactttctaaatactttgaaagcaaatcatgttcctccatttttagttcgtaaggtgttcacacaaattttttctttcatcaatgtacaattattcaatagtcttcttttaagacgggaatgctgctcatttagtaatggagaatatgtcaaagctggtttggctgaattggagcattggtgttataaggcaacagatgagtatgcaggttcagcctgggatgagctcaaacatattagacaagctattggatttctggtcatacatcagaaaccaaagaaaacattggatgaaataagccatgacctgtgcccagtccttagtatacagcagctatatcggataagcaccatgtattgggatgacaaatatggaacgcatagtgtgtcctccgatgtcatatccaatatgagagtgttgatgactgaagattcaaataatgcagttagtaattctttcctgttggatgatgattcaagcattccgttttctgttgatgacatatcgaaatcaatggaacagatagatatcgcagatatagagcccccgcctctaattcgtgaaaactctggctttagctttttgttgccacgtccagattga

SEQ ID NO: 20617 - DNA, 381 bp, Glycine max
  Peptide Sequence Number=SeqID_137395
atggcatttgcgcatggtttggtgaagaacaatctatggaacaatttggccaaaacaatcaactttgggctacaccatgatgttggccgtgcacctagaggagatggctctgaagaagctttccacgaagagcgcttcaagaccatcaagggatggtcattccacagagagaggcaagtcaagcttagggaggatgagtaccctgatttccaggaagaggtaactcgtaggcgttgggcaccacttgtgacccctaaggctaaattcgacccagagatagtcatggaattctatgccaaggcctggcccaccaaggaggggacgccctcaagccaaattcttggaccagctattgatcttggaggaaggccagcagtgtga

SEQ ID NO: 20618 - DNA, 120 bp, Glycine max
  Peptide Sequence Number=SeqID_137396
atggtcaatactgtgccaaatgtaagacaaagagaaaccaagatacttagggatgggtacgagcagatgctaggcttgtggtcagcagatcattatcccacgtccggttcaagacgttaa

SEQ ID NO: 20619 - DNA, 1495 bp, Glycine max
  Peptide Sequence Number=SeqID_137397
gtatgagttggctgaagagtgtgctgatgacgacgatgcgaaacttggaatctgtgagttgaggaaggcagttctagaggagctgaagatgcacaactcgctggtacaggaatgggggttggaccttgccaaagagcacggtattaattctgcaactgttaagtacacagagtttctactggctacagcctctgggaagattgaaggactaaaaggtcctggtaaacttgctacaccatttgagaaaacaaaaattgctgcttatactttaggtgccatgactccttgcatgaggctttatgctgttttgggaaagaagttccaggaacttttggattccaatgaaagtactcacccatataacaagtggatcgacaattattcctctgatggtttccaggctactactctgcaaactgaagatttgctcgacaaactaagtgtttctttgactggtgaagaacttgatgtcattgaaaagctttattaccaagcaatgaagcttgaaatagatttcttctctgctcagccactctttcagccaactatagtacccttgactaaaggacataagcctgcggaagatcatctcatagttttttctgattttgatttaacatgcactgtagttgattcgtccgccatcttggctgaaattgctatagtgacggcaccaaaatctgatcagaatcagcctgaagatcaaattgttcggatgttatcttctgacctcaggaatacatggggttttctatctaaacagtatacggaggagtatgagcaatgtatagaaagcattatgccttccgatagattgaacaatttcgattataaagaattgtctatggctcttgagcaactttcaaaatttgagaacactgcaaataatagggttatcgagtcaggggtactcaagggtataagtcttgaagatataaagcgtgctggggagcgtctgatcctacaagatggttgcactaacttctttcagagcattgttaagaatgaaaatttgaattccaatgtgcatgttctttcatactgctggtgtggtgacctcattagatctgctttctcttcagctgatttgaatgagttgaatgtccatgctaatgagttcacttatgagggatctgtttccacgggtgaaattgttaagaaggtggagtctcccattgacaaggttgaagcttttcgtaacatattgaaaaattgcaatgatgacaagaagaaattaactgtttacattggggattcggtgggtgatttactttgcctacttgaagcagatgttggaattgtgatcggttcaagttcaagtcttagaagtgtagggacgcaatttggtatttcatttgtcccattgtattctggcttggttaagaaacagaaagaatacgttgaaggaagcacttctaattggaagggtttatctggcattctttacacagtctctagttgggctgaagtgcatgcttttattttgggttgctag

SEQ ID NO: 20620 - DNA, 246 bp, Glycine max
  Peptide Sequence Number=SeqID_137398
atgcggagaccaatcatggtcatccgtcactgttgcaacctacccttcgacgggagggcgacgcggggctcacgggtgcgtcttccaaaggaggaaggcgcgcggagtcgccaccaacgtttattcgaggaaaacatcggaaaaagcaaaacgtgtggtctacgaactttaatcgtgaaaggtttgaaagttgtttttacacacggggaaggtattagcaccccacacgtccgtcacaagggatga

SEQ ID NO: 20621 - DNA, 759 bp, Glycine max
  Peptide Sequence Number=SeqID_137399
atggacttgaccctttccccttcttcttcttcttcttctttagtaatctcgagaccttcttactcttcatcctcttccaccttgtccttcttggccaccaactcaattctctctaggaaagctagaatcagcaccagaagaagcaaggctctaacttgcaacgcattgttcggattgggcgttcccgaactcgtcgttattgctggagttgctgtcctcgctttcggacctaagaatttcccccaaacttgcacgtttttgctatgcccatctaatatgtatatagcagctactacacttcaccagatagctgaaaattttttagaagaccccgatgccttgccaatgactatgactcatagcatatatgtgtctactctaaactctaaggcagcaaaggagtttgagtccgagattaaaaaggaacctgattccacagaagagaaccctgctgctgcagagaaatcaattgctgtgagtgaacaggaggagcaagagactaaggtgtctggtactaaagatagtctatcaatcggaaacaaccacgggatagatgcacttttacaaaatgctagtgctcgaaatatcaaggtacaacacgagtcaaacgtgcttatttgcaaacattataaggagtttgaagtgctccacatgaagaaaggagaatggaccaatctaaaggatgaggacgagggtgtggaagtttcagaggtagaggctatggaagaggtagacaaggcttcaataaacaaatggtag

SEQ ID NO: 20622 - DNA, 366 bp, Glycine max
  Peptide Sequence Number=SeqID_137400
atggaggaattagctagtgcacttagaacactgaatcaaaataatcctaggaaggaagagttgcaaatcatgatgaatgaagtggatatgaatggcagtggaaccatagaatttgggcagttcttgaatctcatggccagaaaaatgaagaagcaaagtgaagcagaagaggaattaaaagaagctttcaaactgtttgacaaggatcaagatggttacatatcacccactgagttgttatctgcgatgagaaatattggagtgaagatcacagaagaagagctggagcatatgatcagactggctgatttggacggtgatggacgagttaattatgaagagttcatgaggatgatgacggtttaa

SEQ ID NO: 20623 - DNA, 267 bp, Glycine max
  Peptide Sequence Number=SeqID_137401
atgtccaattcattggctgacttctgcatattgaagcgctttgttgtcgctagtcatcttagtaggaagcttcaaagcatcaaacaagttgattgcaagcttccccctgctccttggatcaaatgcaacacgaacgatgctgctagagctttggaaatcttccagcatttcatagagactttggctactattgttgctattcaaatggcttttgggaaaggacataggctctcactggtgggactttctgtcgaggtagctctctaa

SEQ ID NO: 20624 - DNA, 3099 bp, Glycine max
  Peptide Sequence Number=SeqID_137402
atgaaaaatgcaacaagattaagaggaaccaacgcaaagaaaacaaccaccaaaatgcaaagccacttgctgttcttctattattacattggcctctcacttatttttactaaagcttcagcagatgatgaattgtcaactcttctctcaatcaaatccattctcattgacccgatgaagcatctgaaggattggcaaacaccaagcaatgtgacacagccaggctcacctcattgtaactggactggagttggttgcaactcgaaaggctttgtagagagtcttgacctctccaacatgaacctcagcggtcgtgtttccaaccgcattcaatctctttcaagtctatcttctttcaacataagatgtaacaactttgcttcatcactgcccaaatcactgtccaacctcacctctctcaaaagctttgatgtgagccagaactacttcactggcagcttccccactggtcttggaagagctacaggcttgagattaatcaatgcatcgagcaatgaattttcaggttttcttcccgaggatattggaaatgcaacattgctcgagagccttgattttcgagggagctactttatgagtccaatccccatgagtttcaagaatttgcagaagctcaagtttctaggcctttcaggcaataacttcacagggaggattccagggtatctaggggaacttatttctctggagacattgattataggatacaatttgtttgaaggtgggatccctgcagagtttggcaacctcaccagtcttcagtaccttgacttggctgtaggcagtctcggtggacaaattccagctgaattgggtaagctgacaaaactcaccacaatttatttgtaccataacaacttcacaggaaaaattccacctcaacttggcgacattacttcactagcatttttggacctctctgacaatcagatctcaggaaagattccagaagaacttgctaaactggaaaacctgaagctcttaaatctaatggccaacaaactatctgggcctgtaccagagaagcttggtgaattgaaaaatttacaggtgcttgagctatggaaaaattctttacatggtcctttgccacacaaccttgggcagaactctcctttgcagtggttggatgtatcctctaactcgttatcgggggagatccctccaggtttgtgtactacaggcaatctcactaaactaatcctctttaataattccttcactggtttcattccaagtggacttgcaaactgtttgtctttagtacgtgttcggattcagaacaatcttatttctgggactattccaattggctttggaagcctccttggccttcaacggctggagttggcaacgaacaacctcactgagaaaattcctactgatattaccttatccacgtcactctctttcattgatgtatcttggaaccaccttgagtcctctttaccctcagatattctttctattccatcccttcaaaccttcattgcctctcataacaattttggaggaaatatcccagatgagttccaggactgtccatctctctctgtgctggatctttcaaacacccatatatctggcacaatccctgaaagcattgcttcttgtcaaaaattagtaaaccttaaccttcgaaataactgcttgacaggagaaatcccgaaatcaatcacaaagatgcccaccttatctgttcttgatctgtccaacaattcactgactggtaggatgcctgaaaattttggcaactccccagctctagaaatgctgaatctgtcctataacaaacttgagggtccagtaccctcaaatgggatgttggtgaccataaatcctaatgatcttatcggcaatgagggtctttgtggaggcattctccctccatgttctccaagtttggctgtgacaagccatcgaaggagctcacatatcagacacgtcattattggttttgtgactggcgtctcagtgattttagctcttggtgcagtatattttggaggtagatgtttatacaagagatggcacttgtataacaatttcttccatgattggttccagagcaatgaggattggccctggaggttagtagcattccagaggatcagcatcactagtagtgacatcctcgcatgtataaaggaatcaaatgtcataggcatggggggcaccggtattgtctacaaagctgaaatccatagacctcacgtaaccttagcagtgaagaaactatggaggtcacgaacagatatagaagatggcaatgatgcgttgagagaagtggaactcctagggagacttaggcacaggaatattgtaaggctgttggggtatgtacacaatgaaaggaatgtgatgatggtttacgagtacatgcctaacgggaatcttggaacagcactgcatggtgaacaatctgcaaggttgcttgttgattgggtctcaaggtacaacatagctcttggtgttgcacaagggcttaactacctccaccatgattgccacccactagtaattcacagggatatcaagtctaacaacatactccttgactcaaatttagaggcaagaatagcagatttcgggttggcaaggatgatgattcaaaagaatgagacagtttccatggtggctggatcatatggatacatcgcacccgaatatggatacactctgaaggttgacgagaagattgacatatacagctatggagtggtacttttggagctcctaactggaaaaatgcctttagacccttcatttgaagaatcaattgacatagtcgaatggataaggaagaagaaaagcaacaaagccttgttagaagcattggatcctgctatagctagtcagtgcaagcatgtccaagaagaaatgctgcttgtgctccggattgcacttctatgtactgcaaagcttcccaaggaaagaccacccatgagagacatcgtcacaatgcttggagaggcaaagccaagaaggaaaagtatttgccataatgggggacaagacagcaggagcgtggaaaagccaacgatcttcaccacctccccaataatcagtcttttgtag

SEQ ID NO: 20625 - DNA, 213 bp, Glycine max
  Peptide Sequence Number=SeqID_137403
atgtttcctcaggtcaaatgtcctgatcaggtttatagttcctttcttatagcatcatttggccatggctccaacaacggcgcaaacttggacaaaagtggtgttgttcttgactttaagcgcctcatgatgatcttcttctgcaggactaatttgaaaaaagaggagagcattgagtgggaggggttttatttatctatatggtggacctaa

SEQ ID NO: 20626 - DNA, 1056 bp, Glycine max
  Peptide Sequence Number=SeqID_137404
atgattttggcttggcttctgattgttgtgctatggagatgcctttggcaaggaaacccagtcaagaaagtgactctgaatcagctagagagacaagcagtgatagtagcagtggctattgtcatgaaagaggagctaagagtgttcatggtagtaggaatcatcttaatgttatggatgcaagcaatcatactttggaaagggtctcccaaggaaaacctttcatgggttcatcaagtgatgagactgagagctgcagccctcctgatttctgatcttgcacggcaatttccagagttgaaaacatactggagctgtgatctttcccctgcaagttgggtttcatttgcttggtacccaatatacagaataccaactggtccaacattacaaagcttaagtgcctgcttcctgacctttcattccctgtcaacagctttgcagagtagggacatatccaagctatcactaccgatctttgggcttgcctctcacaaattcaaagtttctctctgggatcccgatggggtttctgaatgtcagaaagccaattctctgttgcgggctgctgaaaactggcttaggctattgcgagttaatcatcctgattacaattactttatgtctcattatgcatataacagcagggttgctgcttcagcaagggggagaatagaatatatattcattttatgtgatccatttcttagctatgttcaatcgtttggtggaagtatgatttggaaaaaagttcttaaggatatttggatcgagactgattctatgccagcagctactttcatgaaccagggcactcactccacgcatccgtacttggtttttcttaattatgagagaactctgttacagcactcttggaatgtcaagattagtcatgctatgcgtgaggctaattgtgtggctgactgtttagcctccatttcacatcatgctcaccaaggtttggtgtttttttatgatcctcctcttgagtgtaaagtttttctttgttttgattctattgggactttgtacccacgtcctgtgaagcattag

SEQ ID NO: 20627 - DNA, 249 bp, Glycine max
  Peptide Sequence Number=SeqID_137405
atgtccccaaaagattttcttgagaaggattatctactaagcgaagaaagtaatgtcacaggaatccaaactcatgcctatgaaaaagactattactccgacaaagcaaagcctaactcaagaccaacttctatgctagatttcatagcacttgacttgtcatactcgttcccagtgatagtggaactcgcacaagagaatctagttgtgattttatttatagaggatctcttttctattatagtgtaa

SEQ ID NO: 20628 - DNA, 732 bp, Glycine max
  Peptide Sequence Number=SeqID_137406
atgacgctacttccagagatggaagataagtcaggggtagacgccacaagggaacccagagagaagctctcacgaaatacagaagtattttatgagaaatgccgaaagtccttttcttcaaaaagagttgaatacatatggaagcaccgaaatagaatcatcttttcacacgacaccttcaatgccaacaaactgttggaggatgcagtctttttactctggacatggcttaggaacttggaaaagaactttgttattcattataatcattggtctagcaacattagcataggggtgcctcaaacagtggtggacaagctaatcaaattacaacgtagattcctatggggagggggacatgacaacaaaaagattgcgtggatttcatgggagacacaccaaggggaactatgggctagagttttggaggctaaatatgggggatggaggggtttagctgaagagggcaggtcaaatttagagtcaatatggtggagggatttaaaaagagctgttcatcattcacaccacggtaaggtcctacaaaatggactgaaatggaaggtagaaggtggggataagataaaattttgggaggatagatggatttgtcaggaggaatcactagctgaaaagtattctagactctatatgatttcatctcagcaacaccagcttattcgacaattgggaaagcacaacgattctggttgggagtggaattttaattag

SEQ ID NO: 20629 - DNA, 144 bp, Glycine max
  Peptide Sequence Number=SeqID_137407
atgccacgttcatccatgacgacagattgctgtatttgtgggaatgaagcgcatgttaatttggaagtgcatccacattcggaatacgtgcaaccaactcaacgctacatgttagagtttcagcttcgacgtgggaagatgtgg

SEQ ID NO: 20630 - DNA, 192 bp, Glycine max
  Peptide Sequence Number=SeqID_137408
atgtttgtagcagagtatgctatgaagtttgagtatatcttaaggtttaatgctcaagatggagatgatgcatgcagatccaagagatttaaggatgggcgactgagacttgaattgcaaagattcatagttcctctatacattacagtgttccacttgcttgtagagaacaatttcatttgctataggtga

SEQ ID NO: 20631 - DNA, 279 bp, Glycine max
  Peptide Sequence Number=SeqID_137409
atgatgggtcaccattgcaggaagagccaccaaaaccatcatgaccacaatcgtaaccacgcccaccagcaacactatgatataaacccttatattcacgagtttcccatcccacgaggaattgagaaaggggtatgtccaacattaagttattactatagattcattaggtatatcacctataaaggtccatccttgctcaaggccttagatggtaaggtgcaactccacagagaaaaggtcataaggtcgaggtcctgccatttgctcccatcatga

SEQ ID NO: 20632 - DNA, 594 bp, Glycine max
  Peptide Sequence Number=SeqID_137410
atggcctttgatgatagagccttgaaggcttatgatgaacttctgaatctttccaagtgtgtaagggatagaggtggacattgttttgttgtattgggtggatgcttgggtagaggagagacaaaagcatcttcagtagattcattgcctgatggagatagaggagtccattctttgtcaccaataacgggaaaagatcaccctttgtcactaatcttgggattagctttggtggctctagtcttgactttgcatggaatagaggaaggaatgacaacttcttttgttgtaggtgttgctttgggtattcttgcctcctttgggggcaataacagcttgggcaatgaccttgattttttgaaagacaaccttgacattgtccttttcatcatcgtcagtttcactaacaaccctagttacatgggagtcataggcctcttcccatcactaatgataagtgttgccttcacgaaggcatccaatagccttactaatggagtcattggacagggttacttggactctaagaaccttggatactattgccttgttgctctgaaactcaaaattgtaaaacattctgatgagttctag

SEQ ID NO: 20633 - DNA, 1479 bp, Glycine max
  Peptide Sequence Number=SeqID_137411
atgcaatccaagagtttgagcctggctccagctctgacactcttcccaggcttgaaaccccctcacaaaaccctactgttccaccaaatctgtgttcttgttatcacattccttgcatatgcttccttccatgcctctaggaagccccccagcattgtcaagagtgttttggggcccacagttccatctaatggaactcaagtttccaacttgagttccattgatgcagggtggccccctttcaatggaacccggggcactcaccggctcggagagctcgatctcgctttccttacttcctactccattggcatgtatttggctggccatgttggagataggattgatttaaggttgttccttgtatttgggatgatgggtagtggtctttttaccgtacttttcgggttagggtattggttggatgttcatgtgttggggttttttgttggtgttcagattgtttgtggagtttttcagtcaattgggtggccttgtgtggttgcagttgtggggaattggctaggggaatcaaagaggggcttgataatgggggtatggaactcacatacctcggtgggaaatatcattggttcagttgtggcttcaggggcattggagtttggctggggttggtcatttgttgtgcctggaatcctgatcattttggtggggattttggtgtttttgtttcttgttgtgaaccctgaggatatgggattcgtgcatcctggaatggatgtcgaaatgagtgttgaaatggatagtgcagagaatcagcagaaagtggaagcagaggaagcaaagcttattgagtccgataattcagaatcttcatctgcaattgggtttttggaggcatggaagttaccaggagtggctccgtttgctttctgtctctttttctcgaagctcgtggcttacactttcctgtactggttgcccttctacataaggcacacagctgttgcaggtgtgcatatgtctcacaaaactgctgggttactttcaaccatatttgacattgggggagtcctaggtggaatcacagctggtttcatttctgacttgattgaagcgcgtgctattacttcaattctattcttgtttctatcaattcctgctcttgctttgtatcgcatttttgggagcctctccatattgatcaacatcattttaatgtttctgtcgggatttttggtgaatggtccatactcactaatcacaactgctgtggctgctgatcttggtacgcaaagcttgaattatcgaaattctcgggctcttgctactgttactgcaatcatagatggcactggttctgttggagctgcccttggtccccttttggcaggatatatttcaactaggggatggaacagtgtcttttttatgctcattctgtctattttctttgccggtttattcttgattcgtatagcaagaactgagataagagagaagctttcaggaaagtga

SEQ ID NO: 20634 - DNA, 192 bp, Glycine max
  Peptide Sequence Number=SeqID_137412
atgtgtactctcaagcagttgaaaatcaaagcgccaatcaacaatatcacaaaggaacacccttcccactatcataggccatcttcaagtggttatccagagacatattaccatgatatttacccagcaactgcagtaacagattctccacaaccaatccctaacaagaatgatctttcctcacactgctag

SEQ ID NO: 20635 - DNA, 311 bp, Glycine max
  Peptide Sequence Number=SeqID_137413
atggatggacaagacttcatagatcatgtgactaagcttcatgttgcccataaagaaagaagaatcaggatcgaagaagagcgagtttccactcaagctgcaaaggagcaagctgttatagcccaagtgtccaaagtagctctagctgatgaggtgattcaacaagaaaaagaacatgcgtccaatgttgttgctgctcttgcacctactgttactatccctgcactgcttgttctcgtccaacaaccaccacccaatgaaccaacaccaccaccacctacgcaacctccaccagatcctcaagttcaaaa

SEQ ID NO: 20636 - DNA, 231 bp, Glycine max
  Peptide Sequence Number=SeqID_137414
atgtgggacaaaggaactaagaccacaaactctaacatgtcattactcgccctctccttcaaaggcaattctcagggaacatcaagctcactttcggataaggttcatcaagttgaatggaaatcttttagcaccctcatcttgttcttggacttaaacctcatgcagagggataaggaatctgttttgagtgaagctttagcagtacttgcagcagatttggtgaagtaa

SEQ ID NO: 20637 - DNA, 382 bp, Glycine max
  Peptide Sequence Number=SeqID_137415
atgtcatcaccaccttacccatgtttcgtcttctcaaaaccaaataaggcttatttgtcacgagaaaatgcaacgaagaggcaaagaggcgcgaggaagagaacaggcgaggaggtgaatagacaagaacgcgaggaaggatttatgctgtgtggtggtgatggtgaatgtgtcgatttcgatgatgttggcattggcattggcattggtagtaatagtaatgtcgacgatagtggtttggttcacagtgccagtggtgtagatgtcgatgatggtagcaatggtgacattgttggtggtaacgatgccaatagcgacaacattgatgatgacaatgacaacgatggtattagttgttctggtggtagaggtggtggtggtg

SEQ ID NO: 20638 - DNA, 483 bp, Glycine max
  Peptide Sequence Number=SeqID_137416
atgatgctcgagttggaaccaaattctgatgaggaaagtgagcagtgggagaacattttggagaagtgcgtgagaagcttatccgcgaggaggtccaacggtcagcgaggagttcccgacagcgatgagttgcatcatcgtcacacagatgttgatgtgcttgctgggcccgggaagggtgagaagcacaccgttgaggatgacaaaggcctcctcgaggttgccaaagatggagaagaccaaggttgcggaggaagagcttgcattgagagacatcatggtccgcaacagcgcgcacaacaacaaggacgtcaaggtggcgcaccaccgcgtcctaaaggatgtcgaggaactggtcagggtgaagcgctcgatgagcttgcgagcttcgaagggggagagcttgagggggttagaagagttgttgttgagaacgagaaagcttcaataaaaggaaaattaaaacacaacattaaaacttaa

SEQ ID NO: 20639 - DNA, 231 bp, Glycine max
  Peptide Sequence Number=SeqID_137417
atgcttagacttaatgagaaagtgaagaagacaatgtttcaggcatggagaagtaaggaagagaaggtatggacaagtgaggaagacaaggttactatgggcgttttgaaaaattgggaggtgcaagaagcaaacatggagacacagtgtgatgtgatcctgactaggagcagatcacttgatacaggctacggagatttgaatgacgccacttccagtgaaggaagataa

SEQ ID NO: 20640 - DNA, 372 bp, Glycine max
  Peptide Sequence Number=SeqID_137418
atggatgaacatcaacaaaaccgaaaggaattgactaacataataatgaaaattaacaaagaatcagatgaaatgtttaacactgttcatgttattgatcagccttttggtgaagtgagtaagtcatttgctataagatggaaagatgaactagagcctacgtggcttctgctacattctaatggcaatatgcactctgtcacatataaccaagattttgtgagtccaactctacttgctggatgtatggaacttagagagttctatgggctcattggaaatcatcaagtcaccttgatccactatggacaaagtgttttcctcctcaccatcttcaaaagcagctctgaaccaaaagctttccctaaatga

SEQ ID NO: 20641 - DNA, 3219 bp, Glycine max
  Peptide Sequence Number=SeqID_137419
atggcatcagagcacgatctagaaaatgaaataccatcaaaaaattcacctcaaaaacaaccaaatagcagtagcaacaattcaaataaaaacagttctaatatggattcctcaaatccatactatatccatccttcagatcaccctggtcatttgcttgtcccaataaaactgaatggcaccaattacccatcatggagtatatcgatgatccatgccctcacagccaaaaacaaaataggctttatcaatggatccatcaaagcaccatcagcagtagatcaatctgcagagcatgccctatggaatcggtgtaacagcatgattttatcatggctcacccattctgtagaacccgatttagccaagggagtcattcatgccaagactgcgcatcaggtttgggaagattttaaagatcagttctcacaaaagaatgctccagcaatatatcggattcaaaagtccttagcctctatatcccaaggcaccatggctgcctcaacgtgctttacaaaaatcaaaggcctttgggatgaattagaaacataccgcactcttcctacttgcaaccagatgaaagcacatgatgaacaaagggaagaagatcgcttgatgcaatttctcatgggtcttaatgatacctaccgcactgttcgcaccaacattctcatgatgtcaccattacccaatgtgcgacaggcctactctctagtcattcaagatgagacacagcgccagatgacttccgaaacaacggagaatttctccattgccgctgcaatccatagtcatccagacaacctctccaacaaatttgtcaaagacaaacactgtgagcactgcaatagagatggccatacaattagcaattgtcggactctaaaattttattgcgatttttgcaataaaaacgggcacacagaggatcgatgcagaattaaaaatgggacttacaacacaggaactcaaagcaacaagcacatccaatcacaacagcgacaacaagggcctcgaagcactgcacctaggactttctctgctgccaatgcagcagattcttccaaaaatgcacttgagctatctgcagaacagcttcagcaacttgcccgcgcattgaatatgatgtctccaaacaatacctctggtaatagcaatgctcatgcaaatgctgcaggtctgtctcttttctctaatgcctcaattaattatgtattcaccaagccttggattttggacagtggagctaccgatcatatcacatctgattctacatttctctctgaaacaaaatttccatccataccttctgtcaatttacctactgggtcttctgctccaatcacatctattggagacatgtcattcaattccaatataaccttaaaaaatgacttggctacggggaagacgattggctcgggtgaacaatgtggtggtctttattacatgtctccattacaaaaaatacctgtctctcatcaagtttctcagccctcaaatatatggcacatgcgtcttggacacccatctacatctcgcctcaaattatgttctcctttattgtctccaaacaacatatcttttgagaataattgtaatgtttgccctatggctaaacagactagatttccttttcctttaagcactatatcaactcatgctccttttgatttattacattgtgatatttggggtcctcataaagtccccacacattcaggggcacgtttttttttaactattgtcgatgattttacaagatgcacatgggtatttcttatgcgatacaaatcagattctcaaaatattttgaaatccttcattaattttgcttatacccaatttcaagctactgttaaagaaattagagttgacaatggttctgaattcatgtccatgagagaattctttcaatctcatgggatagaatatcaacgaacttgcgtttacacaccacaacaaaatggagttgtagaacgcaagcatcgtcatattctagttgtggcacgagcattactatttcattctcatctacctcttgaattttggggagaatgtgtattaactgctgtttaccttataaatcgtttgccatccccattgttatccaacaaatcaccttttgaattattatacaataagccaccatcatttgatcacttgagagtgtttggttgcttatgttatgctactattgtccaacctacacataaatttgatcctcgtgcaaaaaggggtatctttgttggatatcctactggtcaaaaaggttataaaatttatgatcctgagacaaagactttctttgtgagtcgtgatgtcaaattttgcgaaaccaattttccttccattccaaacacatatgaacccaacctaacttcatctcatccttcatatgaggccattgatgattggccttctcctacaccatctcatcatcaatcacaacaaactggtataccttctgcacatgagccaaattatccttcacacctaactaccgaaacatcttccgctgcctcacctatagttgaaccaactctacctacttcccacacttcaaacactccaactccctccattccccaagttcggcagtctctccgtgacaagaaccccccgatatggcataaagactaccacatgtccacacaagtcaataaatctccctcagagccaacttctgggtcagcccacacagaaccacagtcctatgatcaagctgtccatgatccacattggcaagatgcaatgaatgcagaattagaagcattagaacaaaataacacatggagccttgtacctcttccttctggtcataagcccattggttgcaaatgggtatacaaaataaagtacaaatctgatggcacgatagagcgctataaggcacgccttgttgctaagggatatactcaagttgaaggcattgactatcaagaaaccttttcccctactgccaaggtcactactcttcgttgtcttctcactgttgcagctgctcgtaattggttcatacaccaattagatgtgcaaagcgcctttcttcatggcgatttgcatgagttagtgtacatggagcctccacctggtcttcgccgacagggggagaacgttgtatgtcggctcaataagtcactctatggactcaaacaagcatcaagaaactggttctctactttttctgaagccattcaaaaggctggttatcaataa

SEQ ID NO: 20642 - DNA, 201 bp, Glycine max
  Peptide Sequence Number=SeqID_137420
atgggttgttacaacaaaaagagcattcttccttgctactcaagttggcaagtggatgatgcaattctggaatctaggagacaacaagttggtgttgttgtgaaggcaaataggaatgtaggcaaattccttgtcaggagtggattgcttgatacaggctacggagaattggatgatgccacttccggtgaagaaagataa

SEQ ID NO: 20643 - DNA, 197 bp, Glycine max
  Peptide Sequence Number=SeqID_137421
ggatcgcgcccgcaagacacccagtgaacccggagaagtccaacagggtcctagggtttccagctctgattacgagcctctgtcagttttacggagttcctgtcacccccaacaaggtcattaggccccgcattaaccgggctttcatcaagaagtactacgcccccaagcaggcgcagggcgagacaccacagtag

SEQ ID NO: 20644 - DNA, 346 bp, Glycine max
  Peptide Sequence Number=SeqID_137422
atgtcgctgagctattgccacaaacaccagcctatgaaacattgtgcaatagcttccgattttcgacaaatggttgcaaggattaacattgaaatcatcttgatggatgagaaggctaataagatttttgctccaattaaaaatgttgatcctggtaagtggaatgatgttgttaaagtggttgaaaagaatttggacagcccaacaaagcacacctttaaactgaactttgtcaatttcacaaaagtaaaaaagcaggattttccaatgataccagaaatggtgtatgattttatactacttgatgatgttcttactggcaatgtcaatcctgactacttaatgg

SEQ ID NO: 20645 - DNA, 228 bp, Glycine max
  Peptide Sequence Number=SeqID_137423
atgaccctcgcggacgccgaagcgggttatcgcctgactcagcaactgggctgggcgcaccgccgcgaagactggcagcagctcatcgccctgggtgaaggcgtggtggttgaggcgcagggcgactatctcggcggggcgattggctggcgctgggggcctgatgccgccactattggtctggtgattgtgagcgaacaggcgcgcggacgcggtattggccgccag

SEQ ID NO: 20646 - DNA, 1116 bp, Glycine max
  Peptide Sequence Number=SeqID_137424
atgggagagggccggggtgagggcggcaaatcgcacccatccccaacccccacgcttattactattccgcataacacaccgttttttattatttgttgcaatcacaccaacttcataacatggacgaaacaggggcaggaaacaggagaaaagggtgtgaatttccagcaacttaaaattatacgcgaagcggcccgttgcgaattcaacctgacagaagtcgccaatacgttgtttacctcgcaatcgggggtgagccggcatattcgcgatctggaagatgaactgggcgtggaaatcttcattcgtcgtggcaagcggctgttaggcatgaccgaaccgggaaaagcgctgctgaccattgctgaacgcatccttgatgaggccggcaaagtgcgccggctggcggatgtgtttaccaatgaaaccagcggcgtgctgaccatcgccaccacgcacacccaggcgcgctatagcctgccgcgcgtcatcaaagcgtttcgccagctctatcccaacgtgcggctggaactcaatcagggttcaccgcaggaaatagtcgccatgctgctggccggtgaggccgatgtcggcatcgcctcggagcaactggtgaataacaccagcctggcggcattcccgtggttcagctggcaccactcgctgctggtgccgcacgatcacgagctgctggcgaatcagccggtcacgctcgtcagcctcagccgccatccgctgatcacctatcgtcaggggattaccggtcgctcacgcgtggaccgtgctttccaggctgctggcctccgcccggatatcgtgctcagcgcgcaggattctgacgtggtgaaaacctatgtcgaactcgggctgggcgtcggtatcctcgccgatcaggcgtgcgatatttacgacggcgaagacctggtgaagattgatgctcaccatctgtttgatgccaacaccgtgtggctcggactgaagcgcggccagctccagcgcaactacgtctggcagttccttgaactgtgtaacgctaacctgtcactggaagagatcaaacggcaggcgctctcttacgaaaccgacgacgaacccgccatcgatttccaaatctga

SEQ ID NO: 20647 - DNA, 210 bp, Glycine max
  Peptide Sequence Number=SeqID_137425
atggccttccaaaaagaatatgtccggcctccatgggaactgtcgcaacctaccatctggcgggagggcgagataaaagagactgttaaggcattggaccttgaacggagtcaagcgacttttgtggatagaaagctcgattacatgttgattttatcttggtttcacttatttattttcaatctcattaaaaaaggacttgtgaggtaa

SEQ ID NO: 20648 - DNA, 552 bp, Glycine max
  Peptide Sequence Number=SeqID_137426
atgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaagctgataatagcggagcacgcgaactgatgtgtattcgaatcctaggagctagtaatcgacgatatgcttatattggtgacattgttgttgctgtaatcaaacaagcagtaccaaatacgaacttagaaagatcagaagtgatcagagctgtaattgtacgtacttgtaaagaactcaaacgtagcaacggtataataattcagtatgatgataatgctgcagttgtcattgatcaagaaggaaatccaaaaggaactcgaatcttttgtgcaatcgcccgggaattgagacagttaaatttcactaaaatagtttcattagcacccgaggtattataa

SEQ ID NO: 20649 - DNA, 177 bp, Glycine max
  Peptide Sequence Number=SeqID_137427
atggttcagtccttttggtatttgaggactctcacgaaattagtgaaaaaaattgtttccgtgaaaaaaatcaagccgaggcgcttccgtaacgcttccgtgagcgatttcgtgaagatgctttatcgttcttcatcgttcttcgttcgttcttcgtcgttcttcggtcttcaaccg

SEQ ID NO: 20650 - DNA, 426 bp, Glycine max
  Peptide Sequence Number=SeqID_137428
atgttgtctttcagccggatgcaatcccatggattcatacctcctcttgagcttgaggtttctccttctgcttcttatgttagaagaaagggaggttgtgttgatccctcgaggcaaggcccaaacacggctttatcacacaagcgttggttatatcttgatgacaatcctccacgcttggttacctttagcagagtttatgaggggtcaataactgtgcacaatgtccctttgggcaatgatcaagtgaaggtaggtgttgaggaagttcaagatgtttatgttcgtgtccttgtatcccctaaaaaaggaccagagagaccggcgaagcatgttcataagtcaaaacctgatgacaatccaatataccagatgtcattgatgatcccgcaacttttcctcaagcctatgcaggtatatgaatga

SEQ ID NO: 20651 - DNA, 189 bp, Glycine max
  Peptide Sequence Number=SeqID_137429
atgactcgttgtccctggatgacaaaaggtgcagaagacgacgttagtctctgtgcgtcaactggctcgtttgccccctggttgatgaaaggtgcggataaccatacggtcacgatagcaataggtggggcggtcgacaaaagtggggcttttgctcctacgtttcctcaatttgtgatgaggaactaa

SEQ ID NO: 20652 - DNA, 447 bp, Glycine max
  Peptide Sequence Number=SeqID_137430
ggatcgcgcccacaagacacccagtggacctggaggagtccaacagggccctggggtttccagctttggtcacgggcttctctcagtcctaaaggatgcccgtcccctccaacaaggtcatgccatcgtgacatagggatcgcacccgcaagacatctagtggacccggagaagtccaatagggtcctggggtttccagctctgattatgagcctctgtcagttctacggagtgcccgtcgcccccagctgggtcaacaggcccctattaatagggctttcatcgagaagtactgcgaccccaggcaggcacccaaacactggaatgggtacgagcaggcactggttccgtgatcaacaaatcaccatcccgcgtccggctcaagacattaaagaagcgctactaggaggcaacctagtatcttttaaatttctgcttgttatttga

SEQ ID NO: 20653 - DNA, 783 bp, Glycine max
  Peptide Sequence Number=SeqID_137431
atggctcgggagtcacagcattatcttcaagagtggctaatccatcaaatgcaggcacctcgtgtcacacagatacaggtccgagtggactgcaacgggtgcgtgcagaagatcaaaaaagcactaaatggaattcatggtatacatgatcttcgtgttgacttacttcgacaaaagctcacaattattgggtgggcagatccagaacaagttgtcaaagcaattaagaagacaaagaagaatgccatcatttgctctagttttgaactaccgtctccatctaaaccaactgaaccagaaccaaaaggaaatgcaaatgcaccagctcctgatgcaacacaaccaccaccaacgcaagctccaccgcctcaacagccaccacctgaagcaacaacatcacacatacctacatggcacaacacaacccgacagtggcagaacaacacaggaacagaagaattagagcaggttcatgtgacaccccatcatctgcctaactacgttaacagattcagttctggccacaaacatgttgaacactggtacagataccataatggtcctatatttctaaaagagccatcccgacccatgtatgtgacacacagctataacacacacgtgccttcgtcatacgtcactgaatatgaatatgtcagatcaccttccagatacacacattacaattgtatagaacactacagtggagattaccagaacaacaatgtaaacatcgcatccatgttcagcgatgacaatccgaatgcatgttgcattgtctag

SEQ ID NO: 20654 - DNA, 1314 bp, Glycine max
  Peptide Sequence Number=SeqID_137432
atgaaagtgctcaacttaagtagagaatttgagatgcagaggatgaaggagacgaaaacaattaaagcctatgttgaccgattgttaagcatagcaaacaaagtgcaacttcttgggaatgacttttctgatgaaagaatagtgcagaaatttatggttgttgtacttgaaaagtatgaattagagatatcagtgttggaggaagcaaaagatctttcaaccatcaccttgggagaattggagaatgtggaggaacaagaagaagaacaactctttgttgcaacttgcttttctacaagcaacatttccagtgattcatggttgatagacaacggctgcacaaatcacatgaccaacgaccaaaagctcttcaaagagttggacaaaaccattgtttccaaagtaaaaattggaaacggtgatttcatcttagtcatgggaaaatggattgttgctattgaaagcttggtaggtctaaaacatatctctgatgtcttgtatgtgcctgatattgaccaaaatttgctcagtcttgcacagctagtagaaaagggattcaaagtcatatttgaagacaattggtgcttgatcaaagatgtaaaagacaaagatgtatgcagggtgaaaatgaaagctaaaagctatgctctaaatcttatggaggaggagcaaataactttttcaagcacaaccacctatctgatctataacacaaaagacttggacatttccaccttattggactattatacatgtagaaacatgccttggttaaaagagacaaatttgattagaaggcaaaacctggagttttcattggatacaatgacacttcccaagcttacaaaaattttcaaccacaaaaaggaaaaaattcttgtgagtagagatgtcaagttcatggaagatcaacaatggagttgggagaagccaataagcaagcagcttccagaaaccccacaattctttgatgatcatgtagatgacattcctatcagaagtacaagacctttatctaagatctatcaaaggtgtaatgtggctgtcttagaacctccagaatttgaggaagctgagaaggatgacaaaggctatgctcaggtgtttggagttgatttttcagaaacatttgcttcagttgcacacctcaatacaatcaaaatgctacttgccttgattgcacataaagggtggaaagtttaccatttagatgtaaaatctgcttttctaaatggttacttgcaagatgagatttatgtagaccaacctaagggtttcaaatcaaaggagaggaaaagaaagtttacaagttga

SEQ ID NO: 20655 - DNA, 882 bp, Glycine max
  Peptide Sequence Number=SeqID_137433
atgggatttgcttggtgggaattgtttagctctcattccctgaactacagccgtccacatctgattgaattagtggcatctgatcacgtggtagtttcaaatcttacattcttgaacgctcctgcatatagcattcacccagtttattgcagcaatgtacatattcacaatgtttcaatttctgctcctccagaatcccctaataccgttggcatagtaccagattcttctgaccatgtttgtatagaggattgtgtcattgcaacggggtatgatgcaatttccctcaaaagtgggtgggacgaatatggcattgcctatggcaggccaaccgagaatgtacacatcagaagggtacatcttcaggcttcttctggctctacaattgcatttggcagtgacatgtctggtggcatttcaaatattcttgtggagaatgttcatctttacaattcaaagagtggcattgaattcagaaccatgaggggcagaggtggttatatgaaggaaataatcatatcagacatagaaatggagaatatatacactgcaatagctgccacaggttattgtgggtctcatcctgatgacaaatttgatcctaatgctctcccacttttggaccacattattttgcaagatatgattggcacaaacatcactattgctggaagctttgctggactacaggaatctcccttcactaacatatgcctttccaacataactttgtctacaaattcagtttcttccattccttgggaatgctcaaatgtctccggattttcagattatgttcttcccaaaccatgtcctgaccttgaaactctttcgaattgtctctccctgctgattatcaagggaaaaactgcagtcatgtga

SEQ ID NO: 20656 - DNA, 396 bp, Glycine max
  Peptide Sequence Number=SeqID_137434
atggatgatctcacaattaacttcagaggggccaggaaggtaagggctcgaccaacatattttccttcttcttctgcaccaccagttcctcccacttctgccacgcctacaccagctgcccatgactctcaacgctttgaagccatgcttcagaaacagttcattgagaaggtatcctggcctggaaccgtaccttctgctgtgagagagggtgagggccccagtgctcaggtacctcaacaggtacaagatgcgtcttctgaggctaccatccctggagcttttgatttttcaggtgcaggaatagagatgagaccttatgaggctgttcttcctaagccaattgtgccagttatacatgagactgttgaagcaggtgagtcacaatttagatag

SEQ ID NO: 20657 - DNA, 1124 bp, Glycine max
  Peptide Sequence Number=SeqID_137435
gatggacctgacattcttgtttgtgatgaagcccatatgataaaaaatactaaggctgacgtaactcaagccttgaaacaagtaaaatgccagagaagaattgcacttactggatcacctcttcaaaacaatctcatggaatattactgtgttttcttggaagcagccatgaatttcggaaccggcaagactttcttttctctcattgtactgatttttactcacaccaattcaactctgatcgatgtgaaaattatgaaccagaggtctcatatcctctatgaacagttaaaaggctttgttcaaagaatggacatgaatgtggtgaagaaggatctaccacccaaaactgtcttcgtgataactgtcaagctatctcccttacagagaaaattgtacaagagattccttgatgtgcatgggttcactactcaggtgcatcctgaaatgttaaggaagagatgtttttttgctgggtaccaggcattagctcggatatggaaccaccctgggatcttgcagttgacaaaagaagtcaaggactatgtaaaacacgaagatgctgttgagaattttcttgtggatgatagttacagtgatgagaattctgattataatgtacttgctggagagaagatgaggtatggaaatgacttgctgcaaaggaaagatgacaatggctttttcctgaagggttggtggaatgatcttcttcatggaaaaatttataaagagattgatcacagtggcaaaatggttttgctgatggagatactaaccatgagttctgatgtgggtgataaggtgttagtttttagtcagagcataccaaccctagacctcattgaactttatctctcaaggatacctcgacgtggcaaacaagggaagttttggaagaaaggaaaagattggtataggttggatggaaggacagagagttctgagaggcagaagcttgttgagagatttaatgagcctttgaataagagggtaaagtgcactctgatttcaaccagagcaggctctttgggtattaatcttcatgcagctaatcgtgttgttatagttgatggttcttggaatccaacgtatgatctccaggccatctatcgatcatggag

SEQ ID NO: 20658 - DNA, 321 bp, Glycine max
  Peptide Sequence Number=SeqID_137436
atggtggcatttctcttgctgttggcgttgagcaatgaagtcagagttaatggtgatggcagtggtagacaatgtgagattaatccagcactaaagccaagaccacacactgtctccatcttggagtttggtgcggttggggatggtaaaacattgaacactatggcattccagaatgccattttctatctcaagtcgtttgctgacaagggtggtgctcagttatatgtgccaccgggaacatggttgactcaaagtttcaatcttactagccatctcacacttttcttggaaaaaggtgctgtaattcttggatctcag

SEQ ID NO: 20659 - DNA, 765 bp, Glycine max
  Peptide Sequence Number=SeqID_137437
atgtattttcatggtgctcgtttttccaattatgaggcatggttaagtgatcctactcacattaggcctagtgctcaggtggtttggccaatagtgggccaagaaatattgaatggtgatgtagggggagggttccgaggaatacaaataacctccggtttttttcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacggccagggtcataaaggtctatatgagatcctaa

SEQ ID NO: 20660 - DNA, 2718 bp, Glycine max
  Peptide Sequence Number=SeqID_137438
atgatagaggcagatcctctaattacagaggaggaggtggcatgcctagctatgggtatagaggaggcagaaattatggtaacaatgataacagaaactatggaaataatgagaacaagaattatggaaatgctgcaaattatggaaatactgataggtataaaatacagtgtcaagttttctacaagtttggccacagtgcagctgattgctatcacgggtttaatacaaattatgaagctcagcggtataatcagaatcagtcttggaatcagcacagaaactactcttatcaaaggtctaactctcaggctcaggacagtaactcagtcacaacaaaatgcacaaactcctcaggcctacttagccaatactaatcctactcaacaatcacagaattcgtacattgactctggggcaactcatcatgtcactgcatctcctcagaacttgatgaatgaaattccaacctcgggcaatgagcttgttttccttggcaatggtcaaggcttgcctattatttccactagttcaacagtttttaatcctccttttgcctctaatgttaaattatctttgtatcttgtagtaccactggttgatggttccatccttcttagaggttctcttagccaagatggcctctatgtcttctcaaatcttctgtcaagtattcatcataggcttatctgtcctcatactcaccatcaaaaaggtgtagtggaaagaaaacacaggcacattgttgaaatgggtttaacccttatgtcacaggcttccatgcctctttcttattgggatcatgcttttcataccgcagtttatctcattaatagacttccttctgcctatcacgaaaatactattccttatgagatgatttttaacaaatatcctgattattcttttctaaaagtgtttgggtgtccagtccttgtacttttttgtggtattcacctcatcataaaggatataaatgtcttgattcaaagggcaagattttttctgtctcgtgatgttattttcaatgaatccagttttcctttttctgttgctaagcctcatgattcatcccccccttctagtgttccttctcaattacttgctcttggtgtccttcctatacctactgctcatcctaatcctccttctcattctatagggtctatagagtcacttggttcattgtctcaacctgttgagttgaattctcctcagcttgttcccactgaacaagctgcatcctctactccagtgaatgatgagtctagtccctctactgctttatcctctcctcctccttctcaacctccaaatacacatcccatgcaaactagatcaaagtcaggtattgtttgccctcggttacatcctactttacttttaactactgctgaacctacttctgttaaacatgctctctcatctcctgagtggaaggaagctatgcagcaagagtacaatgctcttatggccaataacacttggtctccggtccccttaccctcaggcagaaaagccattggctgcaagtgggttttcagggtaaaacagaatcctgatggctctatcttgaagtataaagctcggttggtggccaaggggtttaatcaaattcctggtcaggattattcagaaactttttcacctgttatgaaacctgtcacaatcagaatcatgctaactgtagctcttactcatcactggtctattcagcaaattgatgtgaacaatgcttttcttaatggcgatttggaagaagaggtctacatgacacagccacatgggtttgctggttctgataaaagtgtggtctgcaaactcaagaaagctatctatggcttaaaacagacacctagggcctggtatgaaaggttaaccaaaacacttctgacttttggctttgttcaaagcaagtgtgatccttcccttctagtgttcaaaactgtttctgactgcctttatctgttgatatatgttgatgatattatcatcacagggtcatcttctgttcttattcaaaaattaattaccaaactacatgctgtctttgctcttaaacaactagctaaatacattcatgatctacttgaaaaggttaagatggttgatgccaaacctatactcactcccctgccctctgatcttaagttaactaaacatggcacaaccaagattgtttcagtccctgttgctgatgctactctctatcagtcagttgttggggcacttcagtacatcactgtaactaggccagaactaagttacagtgtaaacaaggtctgtcagtttatgtcagaacccatggaggagcattggaaggctgtcaagtgtattttaaggtatctgaagggtactatagactatgggttgtctttaaaatctgctcctcaaggtgaaccctatactttggaagctttttgtgatgctgattggggaatggatatggttgacagaagatcaatttcaggcactattgccttgagtcataatcctgttcttcattcaaggacaaaacacatggaactagacatattttttgtgagagaaaaagttttggataaatccctgctggcctgtttgatggaagcttgcttgtggggcttctatggaggctggatctttgagcttcaatggggtcctttaatggtgattttccaccatggagatgcagcggaagacaaaggaaaagaggtgagaggaggcgccatccattaa

SEQ ID NO: 20661 - DNA, 480 bp, Glycine max
  Peptide Sequence Number=SeqID_137439
atgggctcaaaaatctaccctaaggttcatgagaaccctagggccttctttagtagctctagcccaagcctctcggagtcttctatccaatacccttgggaggtaggattgcatcactgttgccaagcaatcttttctggatttgagaaaaagcctgtgtttgcttatcgattgctggctcatggaactatggaggagaagatatataagcgccaggtaacaaaggagggacttgctgctagggtggttgatagacagcaggtgcataggaccatttctaaagaagaaatgctgcatctgtttgagcttggtgatgatgacaaccctgagactttggctgatctaagtcaagaaaatgagcatcaagacaaccctattttggttgggcattcactgaaacacacagcaccacattcaaatggcagtagttattctgataagttaatggaaagcttacttagcaagcatcatccgcggtag

SEQ ID NO: 20662 - DNA, 399 bp, Glycine max
  Peptide Sequence Number=SeqID_137440
atgcagacatggataaagaaaatccagcttatgcagcatgggaatatcaagaccagtcactacttgtttggctttagtcgtccttttctaaggcaattctgtcaaaagttgttggctgtgttcatgcacatcaagtatggggaaagatacataatcactttcatgctaaaacaaaagcaaaatccagatatcttcgcacggaacttaggaatagcagaaaaggaacagatagatgttattcttgaaggtttgccaagtgaatatgaatcactggttactgcaatcagcagcaagattgatcagtttgaatttgagatccaatatcttcttttggctcaagaacagaggcttgaaaagttaagagaaaatgctattgctcctgcactgaatttaacttga

SEQ ID NO: 20663 - DNA, 234 bp, Glycine max
  Peptide Sequence Number=SeqID_137441
atgcctattatcatgtcaatgaaggaaagctggtacctagatcaagaaaggggttatacagatacatctcctatggttcttcaagaaggtgagcaatcagaagattccagtgcaaatgagttttatcagaatgctgaacttgattctgctcaactcaatcttggaatcagtcagagacctaagagaatcatcaagcctcctgagagatatggctttgaagacatggctgcctaa

SEQ ID NO: 20664 - DNA, 1680 bp, Glycine max
  Peptide Sequence Number=SeqID_137442
atgtttgggtgcaagagtttatgctgggattctgtccctgaattcactgaccctgatccacttcccttttctctgccttcaccccttcctcaatggccacaaggtggtagttttgcatgtggaagaatatgccttggagaaatagaagttataaaagtaaacaagtttgagaaggtttggagatgcacaagtttgaatgggaaatcgcttggtttcacattttatagacctttggaaattccagaaggctttttctgccttggtcactattgccagtccaatgaccagccattgagaggatatgttcttgtggcccgtgacactagttctgatgcctccactctagaatctcctgctctggaaaagccacttaactactcgttaatatggagcctggattctcatgatgaatgtgtttacttttggttgccaaaccctccaacgggttataaagccatgggcatagtagttactagcagtcctaatgaacctgaagttgaagaagttagatgtgtgcgagatgatctcacagaaagttgtgagacttctgatctgttactgactgtaaagtcaaaatattcaaaagattcatttcaggtttggaatacacaaccctgtgatagaggtatgttagctagaggtgtagctgttggggcattcttctgtggaagtacatctgttgatcctgaacaagtggtggatattgcgtgcttgaagaatcttgattcttccttgcacgcgatgccaaatcagaaccagattcatgcacttattcagcattatggtcccactgtgtactttcatcctgatgagaagtacttgccatcatcagtgcaatggttttttaagaatggagcagttttgcatgcagcaggcaataagaaaggtatagctatagattatcagggctcaaatttacctagtggtggaacaaatgatggtgccttttggattgatttgcctactgatgctgatgcaagaaacaatctaaagaagggaaacatagagagtgctgaactctatgttcatgtaaaaccagcattgggaggagcctatactgatattgtgatgtgggttttttgccccttcaatggacctgccacccttaaagtggcattgatgaacattgagatgaacaagataggagaacacataggtgactgggagcacttcacccttaggataagcaacttcactggagagctatggtctgtttacttctctcagcatagtggaggtggatgggtaaatgcatttgatctggagtttattaaggggaataagccaattgtttattcatcaaaagatggccatgctagcttccctcatcctgggacttaccttcagggatcatccaaactaggaataggagtacgcaatgatgcagctccaagcaaatttattgtggattcgagcatcaaatatcagattgttgcagccgagtatcttggtgatggagtcattgcagaaccatgctggttgcagtatatgagagagtggggtcctaccattgtgtatgattcacggtctgagatagagaagataataaatctgctcccactatttgttagattttctgtggagaacttatttgaactatttccaacggagctttatggtgaggaggggccaactggtccaaaggagaaggataattggctaggagatgaatattgctag

SEQ ID NO: 20665 - DNA, 1449 bp, Glycine max
  Peptide Sequence Number=SeqID_137443
atgtgggactcagcagcaactgcgaaggaaaggagaaagagttgttccgaccaagatcgttacgtcgacgtaccggatgatttatcagaggggtggatgatggattctacaagcggaatgaagaaaaaatcagctcctggcactgggggtctggaacttaggatgttcgtggggacgtggaatgtcggagggaagtcaccgaacgaaggcttgaatttgaggaattggcttacgtgtccttccccagctgacatctatgttatagggttccaagaaattgtaccgctaaatgcggggaacgtgcttgggccggaggacagtggcccagcagcgaagtggctggcccttattcgtgaagccttgaacaccaacaagtgcgaccatgaaatgtcacactattacaccagcaagaagtgtaggcagaatttttcggaattcctctctttagatgaggagttggataataatggagaaaattatcctaagagtttacgacgctattgcttagcagcaagcaagcaaatggttggtatattcttgtccgtgtgggtacgagcggatctttgcaaccatgttaccaatttaaaagtctcaagtgttggcagaggcatcatgggctatcttggaaataagggttcaacatcaattagcatgacattgtacaacaccaccttctgtttcgtttgcacccacttggcctctggggagaaatttggtgatgagttgcgaaggaacttggacgtctcggaaatcttgaagaaaactaagttttgtcactcatttaaatctcttgttcatccactctctcctgaaagcatactagaacacgataatattatttggcttggcgatttgaattatcggctagctgctggctacgatgacacacatgaactactaaagaagaataattggcaggcattactagaaaaggatcagtttttccttagaatgcttttaaggcctatctctttgctaacacaatgttgtgttgactcggcttggcagctaaggatagagcagaaagctggtagagtattcaatggttggaatgaagggaacatatactttgctcctacttataaatacttgaccaattctgaccactatgttgcccaatcctcccaatccaaggaaaaacgacgaactcctgcttggtgtgatcgaatattgtggaaaggggaaggcctgaatcagatgtggtatgtacgaggagagtccagattctcagatcacaggccagtgtattcactattctctgttcaagttgacatgaaaagcaagaatatagctccctctactgccacattgcctatttgttgtcccttaaaaccgttgacaaattcttcgttgtcatcgacttgttgcgctacgaaagtccaggcagaagagcaactcttgctgctaactagggcacaaagttgcatagacaccatacctaggttttga

SEQ ID NO: 20666 - DNA, 2127 bp, Glycine max
  Peptide Sequence Number=SeqID_137444
atggctcctcatccaagagtcattaaggcttataatgctatgagatccttaggaatttctgatgaagaggtgaaaccggtgttgaaaaatttgttacaattgtatgatagaaactgggaacttattgaagaagacaattatcgtactcttatagatgcatactttgagttaaaggaagctaagagcgtcgaatggtgcaacgtagaactgcatccaccagttaggggagcagtcgtcgctgcctatcatgcggtggaggtgcttgccggcacggagggtctgaccatgccttacgttgtggtcaagtatgatggtgtatgccatcgtgtccggcaaacagaaggtaagagaaaggctccaatcagttatcttaatgggagaaagccaaaacaggaactgcacttggtagatggagatgaccaggtttcatcaactgacaactccagtcaagggttgtctgtagaagactcggaaataactcccaacgcatttaaacagaaaatcattaaatcttctcaaacctccattgtacatatgaagcccacgagcagttcacaagcattgcagagaatgtcgagtgaggtagaaaggatctcaactttaccttgcatgcctgctagagatagaaaattgcatcgtgggaaggcatcagctgcagggcattgtgaagatccaattgatgaaccaagcaatcctcgtgtccagaggaaaaatatatcaaatgatcatcaacagaaggagctgatgataccaagaactgagaaacttaagttacatcttggacctgtttcaacgagttacaatggctcagctaatgcttcaaatggaaattgttgtgccaaatctctatcagctctgtatcagaatgtgcccaagaaagatgctacctcagcatgcaataatagtaaaagaactcagaagggtagtattgacattgcctcttcacctttgggagaaattaaaatttctttaaactgcgaagctgctttgggacaaccaaacttccgtattcctgatttggatgctatcatgaaatccattgaggagaaatacctgaaggctcacaagatagtcgagcctcaatcatctatggttaagctattagatgatttatgtggaatttacttgaagctgggcttgagtttaaatcgaaacgggtcaactcccaagtctgcaaattcacgcaatgtggcatgtctgccactgcaagctgttactgaagatgacaagaattcctttcactttctcgatgacataacaaaaggttccgagaatgttaaaatatcactgttggatgaaactggaagtgaggacgtgcctcagtttaattacataccctataatgtaatatatcaagatgctaacgtcaatatttcacttgctcgtattgcggatgagggttgctgtgctgattgtgctggcgactgtctttccttatcacttccatgtgcatgttctcaagaaacaggtggagagtttgcttacactccacgaggcttgttgaaagaaatatttttaaaagattgcatgtctatgaaattggaacctctagatcatcattttgtgtattgccaagaatgcccagtggagaggtccaggaatgacatcatggccgaaccatgcaaggggcatctggttaggaagtttatcaaggaatgctggaggaaatgtggttgtgacatgcagtgtggaaatcgggtagtgcaacggggtttaagatgtaaattgcaggtgtttttgactcgagaaggaaagggatggggcatcagaactctagaagatttgcccaagggatgttttgtatgtgaatatgcaggggaaatattaaccaatacagaattatatgaaaggattatgcagaaaagcggcaatgacagacatacatatcctgtaacccttgatgcagattggggctcggaaggggtgttaaaggatgaggaggcactatgcttagatgcaacatataatggaaatgttgcaagatgctcggacgcaaatctgatagacattccagttgaagtagagacacctgatcgtcactattatcatcttgctctcttcacaaacagaaatgtgaatgcatacgaggaattgacatgggccgataatccaaatttcgctgattga

SEQ ID NO: 20667 - DNA, 888 bp, Glycine max
  Peptide Sequence Number=SeqID_137445
atgtccattgcacactccaatgtggtttttccaaatgttcccattccacaatcctcctcagtttcactttcttgctcttccaaaacagtttccgattacagcattttagtgtacaaaacctgtgcaagccaaacctttaacgaccaattaactaaaacttattctcaaacactcaactctctgctccaacaactcattgcacaatcctcccaacaaaagttcttcaaaaacacggaagccgttagcgacgacgcagccatctcaggccttttccaatgtagagacgatatcggcataaaagattgttttaactgcgtaaacttgctgcatcagatgtcaaacaccttgtgcagtgattccatgccaacacgggttcaacttgacggttgctacattcactacgagacagaggagcttccagaaacaaatggtgaatctaaaagttatagcaatttcttgcttcacaaggagtgtggggaaccggttgtggactatatcaagttcaaagagtttatggacgaggcgtttgtgaatctggaaagtgggattccgaacagtaatgggttctatacgatgaattataaatcagtgaaattgatggcgcagtgtgaaggggattcaaatatttgtgactgtagcaactgcgtgagcgatgcagtgcaggttgctaaggaagaatgcggaacttcactttcggcacaaatatatcttgacaagtgtttcataagctactatggcattcctggaaactctgtcccaggggcaagaagaaataacaacaccgaaaagttggcagcgataattgttggaggggccgcagctctgtttttgggttttgcttttttatcactgcttaagtcttggtttagaaaagacgattatgaatag

SEQ ID NO: 20668 - DNA, 1809 bp, Glycine max
  Peptide Sequence Number=SeqID_137446
atggtggaggagatgatttcgaagggtatttatgttgatctttatgtgtttagtgttttgattgatgggttgtgtaagaaggggatggtgggggaggcacgggaggtgtttgatgaaatgattaagagaggctgtggggttagtgttgttgcatgctcgtccttgatggtggggtattgtttgaagaacgaagtggacgaggcgaggaggttgtttgacgcggttgtgggacgaccggacgtttggagttataatgttttgattaacgggtattgcaaggttaggagattggatgatgccatgaagttgttctatgaaatgtgggggaagaatgtggttccgaatcttgtgacttacaatttgttggttgattgtgtttgtaaatgcgggagggtggcgattgcttggaaggttgttaagacgatgtgtgagagtggtttggcgccggacgttgttacttatagtatcttattggatggtttgtgtaaagagcaacatcttgacctggcggttgtgttgtttaaccagctgattaagaggggcgtggcacttgatgtttggagttatagtatattgattgatgggtgttgcaagaatcagaggataggtgaggccatgaatttcttgaaagaaatgcatttaaggaatttggttcctcatattgtgacttacacttctcttattgatggcttgtgcaaatctgggaggctgtcgtctgcgtggaggcttctcaatgagatgcacaataatggtccaccccctgatgttgttgcttacagtaccctgttgcatgctttatgcaaaagtgaacatttcgaccaagcaattttattgtttaaccaaatgatcaggaggggtttggcacctgatgtttggagttataccatcttgattaatggactgtgcaagagtgaaaggatagacgaggccgttaatctctttaaagacatgcatctaaaaaatttggttcctgataccataacttacatttctcttgttgatgccttgtgcagatctgggagattctcttacgtgtggcagcttgttaatgagatgcatggcaatgctccacccctggatgttatcaattacattgatgcactttgcagaaaccagcatcttgacagcaagtgccttgcttcagcgtattatgttgtgactgaattcattgaaggtcttgtggagacatatcctggactacaatatttagatggctttcctcaggtgaaggttgtcttacgtgcagatgtttcagctgcaacatatgataaagttgcaatcatatcagggggaggaattggccatgagcctgcccatgctggatttgtgggagaaggaatgcttactgcagcaatttgtggtgatatattttcttctccacctgttgacacaattctagctgggatacgagctgtgactggtcctaagggatgtcttttggttgtaaagaactatactggtgatcgtttgaactttggtttggctgccaagatagcaaaatctgaagggtataaaggtatgtctagctggctaactgttattattggtgacgattgtgcactacctccacctcgagggattgctggaagaagaggtttggcaggaactattctggttcacaaggttgcaggagctgctgctgctgctggtctttctcttgatgatgttgctgcagaagctaaacatgcatctgaaatagtaggaacaatgggtgttgctttgactcatggagaacctggggcagctgtggctaatattcagcccgtaaatgtggtggcttctcatgttcagcagcaaattttgtccacg

SEQ ID NO: 20669 - DNA, 237 bp, Glycine max
  Peptide Sequence Number=SeqID_137447
atgtggcctgtgtggtgttttgctgctaaattgctatcaacacccaccgctcgaaaaacaaccttgtccttaaggttggatagtaaaaaacaagcgaaaacaagggtgagtttaggaaataaaagtgtgtgtgacatgtgttgtggagcagtcaaggaaggtgttaaacacggttgcggagatgatggtggaggcggtggcttcggaggtggtggtggatgtggcgacggtcgttga

SEQ ID NO: 20670 - DNA, 327 bp, Glycine max
  Peptide Sequence Number=SeqID_137448
atgtccaaagaaagtgaatacgaggtatcccttcctgtcgctctctcttcgttcttcaatgcaagaagtgctttggttcttcagcgctctattcccacagccaatcactttcttcttcaactctgttgggtaacatgttcaaaaagggaatcatgccagatgtggaaatttatactgttatatttgacagatattgcaaagaggggttccttttgctcatcaccaccttcttcatattccctctccaaccatggacgtgggatcgtggagttcttctccctcgaagatgaagtcccgattctccttccaagatcgccttatccgtag

SEQ ID NO: 20671 - DNA, 366 bp, Glycine max
  Peptide Sequence Number=SeqID_137449
atgccgttgatgagggtgttgaccgtgacgacgtcgtacgggagaccgcgcttgagaagcttcccgaagacggagaaggcgagagcgaccttgccgacgtggcagaagcagttgatgaggatggtgagggtgacgtggcagggggcgacgctcctggcgcgagactccgtttgggcgcaaaggaaaatcgcggcggggaagcgcttcgccttcgcgagggaggcgaggattctgttgagggcgaggggggcgcgtgggggagggcgcgagtggagaaggcgcgtgaaggaagatagccgccggaacgctctcttcatctttcgctcagacgcggcttcctcgcgtgactccgtcggcgtcggctag

SEQ ID NO: 20672 - DNA, 243 bp, Glycine max
  Peptide Sequence Number=SeqID_137450
atggaaacttgggctatggcgagtttggccatggcggcgttgaggcgagccaggctggtagcgagagaaggggcaggttcggcatctgccattagagagcgaattatcactaccaacaaactagtggaatgctataacaaactcaagaagattctacaagcacttggagccttcgcgcaattggaactcaaacgaagtcctgcaattaggtgggcttcttactcactcttcttggcctgttag

SEQ ID NO: 20673 - DNA, 192 bp, Glycine max
  Peptide Sequence Number=SeqID_137451
atggggtttggaggaagagaagagaaaatgttgagttcttggagaggagttcttaccttaaccttggtgctcttgaccccaatgtgtgaaaacatgtttgataggttggggattccgtttgggttgatttggaagccattgaaagtgaaaactcctttttcaaagctttgcaaggttgtggaactaaagtga

SEQ ID NO: 20674 - DNA, 2139 bp, Glycine max
  Peptide Sequence Number=SeqID_137452
atggctgagctaatgaatttgagagagaagggtaccattagtgagtaccatgagcaatttgatgccatcatgacacgattggatttaccagtagactactccttaagttgtttcttgggagggttgaaaactgaggtgcaaatgatggttcgtatgtttcaaccccagtcaatgatgaaagcatataacctagccaaattgtatgaatttgcgattctgcaaggtactacaaccacattgcctagcaagaacaaacctgtagtcccaatcaaatccttgttgggacccaaaccaccgacagtaactgaaccagagtccatgaaaaccaaaccaagattcaccaagaatttgacaccagcattcatgagtgaaagaagggccaaagggttgtgttatttctgtgatgagacattttctgtggagcatagcttgacacacaagaaactacaaattcacctcatggaggttgatgacatagaggaggacactattgagatagaaaaccatacagggggagctgcaacacagtttgaggaggcacaaatatctgtcaatgccttgacaggtgttccaactttcataaccatgtgtgtcacagggagatacaatggcacaaaagtgcaaatatcttcagttgtacgaaattttacatgggtaattcagcataccactttcactttagatgtcatgctaattcccctaggatgttgtgatatagtgctaggttctaatccaagcagctgtaaatcaatcaagagcccaactcttgataaaatagtgaacaatagtgtgcacctgtctatgatccaagtagggatggaaggtggagtattgcaagcattaacaactcatgccactaaggatatcattgataagataatccatgagatgttggactcaggaatcattcaaactagcaacaacccttatgctagtccagtggtgttggttgggaaaaaagatgtcacttggaggttgtgtgttgactacagggacttgaacaagaataccatcaaggaccggtttccaattcctttggtagaagatctcataaatgagttgcacgactctactatcttttccaagattgatcttagggcagggtaccatcaagttaaaatgcatactgcttatatttacaagacaacattcagaaatcacaatggtcattttgaatacttggtcatgccatttggcctcaccaatgcccatgctacatttcaaaacctaatgaacactgtcttccaagaattcttgaggaagtttttgctagtctttttttatgacatcctcatctattgtcaatccttggatgagcacttaccacacttacataagtacttagggcatgtcatatttgctgaaggggtttcaacagaccctgccaaaatagtggcagtccaaaattggcctatgcctgctactcttaagcaacttagagggtttttggacttggcatgttactatagaagatttgtgaggaattgtggtactatggccagagcattgactgaaatgctaaaaaaagacaagtttcagtggactcctgcagccaaaatagtctttcaacaactcaaagagtccctcacctctgcacctgtcttggctatgcctgatttcacacagatttttgtcattgaagtttatgcttctggtcagggcataggaggtcactcaggcagaattgcaacttgcaaaagaatccaggctattctatattggaagggtttgaccttggatgtcaaacaatttgtgcagcagtgtgccactcagcagtgtaagtatgaccatgctgcttatctagggtttttgcaaccattgcctatactggatcatgtgtggcaacacatatcaatgaactttatagagggtctacccctttcgaatggcaaacaagctatctttgtggtggtggatcgtttgagtaaagctgcacattttatacctttatcaaatccatatactgctagcacagtagctcaagcttttattgatcatgttttcaagctacatggttttccatcctctataacaagtgacaaggattcaatcttcctcaacaaattctggcaggaattaatggcattccagggagatgttgaaggttttaaaatttcatctccaaagagcgcaaaatag

SEQ ID NO: 20675 - DNA, 432 bp, Glycine max
  Peptide Sequence Number=SeqID_137453
atgtcgtcatcacctctatggtccaccctctatatcatctccaacgtcggaatagtccttttcctgatggagattctggaaggtgatgacgtggtggaggctgtcaaagtcgattcggttgcggacacagatgatgaaggggatggagttggtgacattggagttatcgatgatgatggtggagtgtgtgagagtaggaaacagaactggagagagttgatttgcaaatggagtgaggagaaggttagggttcatggaattaagggtgtacagagggggagtcaattcgaaggaaaaatttatcagggatcaaatgcaaaagccagtggtggtggcgatgccaatagtggtggcagtgatgacttgatggtgatagttgtgatgatggtggtggtagtggcggcaatgttggtggcgatgacaatgacggag

SEQ ID NO: 20676 - DNA, 330 bp, Glycine max
  Peptide Sequence Number=SeqID_137454
atgggttgtctaatgctgatgagcgatggtgatgacgctgagctgagcagtaagctcagggccatacttgggaactatcaacaacaagggtttgaggtcatgtatgatgagaacgcagaggaggtcaaggagttgggagggggagaagtccagagggagggggtggataaagtgatgcaagctccattggagcttgtaggcctaggatcttcttcatcaatggattcctttgcttcttggaagataaatggcagcggaatggagaaggaagagagagaggagacgccacttcaaggagaagatgagtctagaagaagcttaccaccatag

SEQ ID NO: 20677 - DNA, 1566 bp, Glycine max
  Peptide Sequence Number=SeqID_137455
atggaaagaagggttgtaattatcggggcaggaatcagcggccttgttgcctgcaaatacgttatagagtttggatttaatccaattgtctttgaagttgatgatggcgttggaggactatggagacataccatggagtccaccaagctccaaaacaataaacaaatgttccagttcatggattttccatggccgccttctgtgaaagaagataatccaagtcacaagcaagtgctagattatgttaactcctatgctgaacatttttccctcattccttacattagattcaactccaaagtaattgatatagattatgttggtggagagtccagtgaagaaatgaagtcatgggaattgtggggtggtaatggcaggccattctgctccaagggaacttggcatattgctgtgcaacataccaagaatttatccatagaggtgcatgaggccgagtttgttgttctttgcattgggaaatatagtggttttccgaacattcctgaattcccacccggaaaaggcccagaagttttcaatggcaaggttatgcactccatggactactccaatttggacaatgacactgctgctgaattggtcaaaggaaaaagagtaacaataataggctcactgaaatctggtcttgatctagcagctgaatgtgcaaatgtaaatggaatgaagcatccttgcacaattatccaaagaaccgcacactggtttcttccagattttaacttttggggtattattgctggattcttgtacttcaatcgctttgcggagcttttagttcacaagccaggggaatccttcctacttggcctcgtggccactttactttcaccattgagatggggaatttctagacttgttgaaactactctaaaatggaagcttccattgaagaagtatggaatggtgccaaatcacagctttcttgaggacctctccacatgtttgtttggggtgtatcctgacaacttctttgacaaactaaaagaaggatccatccttataaaggaatcacaaagctttggcttctgcaaagaaggtgtaataattgatggagaagctaagcccttggaatcagatatagtattttttgccactggatacaaaggtgaccaaaaaatcaaaaacatattcaaatctccggtcttccaaaagtacatcattgggcacgcaacctcaacagtacctctctacagacaaataattcatcctcgaatcccccagttggcaataataggatatgctgaagggccatcaaatatttttgcctcggaaatgaaaagcttgtggctggcgcatttcttggatggaaacattgaactgcctagtataagagagatggaaaaggacgtgaaattgtgggaagacaatttgaagctttatggtggaaggtattattggaaaatatgcattgctcattgtgccatttggtatcacgatcaattatgcaaagacatgaagcataaccctagaaggaagaaaggccttttttcagagttgtttgaaccatatggccacactgattacgcgagtcttactcgtaaatga

SEQ ID NO: 20678 - DNA, 168 bp, Glycine max
  Peptide Sequence Number=SeqID_137456
atggaaattaagggtaacatcagggtactggctatggtactcaggagagatagagagtctatggatttacatataatgcttgatgctcattgttatttacacgcaggaaatttcgaagacatggttgaaagtttcgctggtataaattccagaccggccgatttataa

SEQ ID NO: 20679 - DNA, 942 bp, Glycine max
  Peptide Sequence Number=SeqID_137457
atgtcaatatcggtaaacactgaacccaactcttatgctgaggcttctaaatttgattgttggattaaagcaatgcagatcaaatacaaagctgacgacactgttgaacgatacaaggcatgcctagtagcaaaaggatacactcaattggaagggttagacttcctcgataccttttctcccgtggctaagctcactactgtgagattacttcttgctcttgctgctcttcacaattggcacctcaggcaactcgatgtaaacaatgcctttcttcatggggatcttgacgaagaggtctacatgactcttcctccaggacttgattcttcagctgatcattccctttttctgcacttccataatagtgatatcaccgctgttcttgtttatgttgatgacatcattttggcaggtaataacctcgacactattgcatatatcaccaaactccttgatcaagctttcagtatcaaagatcttggcacgctgaaattttttctcggccttgaggttgctcagactagccatggtatccacttatctcaacgcaagtacgtcctggacatactatctaactcaggcatgcttgcttctcgaccagtttccactcctatgaactattccacacgattaactgcttcgatgggtactcccttatcagagacttctgcctcctcatatcgacgtttgattggaagactcatttacctcacaaatactcgtcccgacattactcatgctgttcaacaacttagccaatatatggctcacccaacctctgcccattcacaagcagcttttcgtatcttgcggtatctcaaaggttcacctggttctggtatattcctcgctactcacggtaccctacagctcaaggctttcagcgactccgattgggcgggttgtcgcgatacacagcgttccatcatcggattctcg

SEQ ID NO: 20680 - DNA, 213 bp, Glycine max
  Peptide Sequence Number=SeqID_137458
atggccaaaacaggtttttccagaagaggaccccctatcctgggagacaacaatttcaaaatattagaagacaatggaagaaaaaggaagatgtgtacaagtaggggtaatatcctcgaaagggtcagtgatcacagtaaagaaagaagcaaacagttggctacaagactgcttggtagggagtattgtctgacttgttggtggagaagctaa

SEQ ID NO: 20681 - DNA, 276 bp, Glycine max
  Peptide Sequence Number=SeqID_137459
atgtctcctccacctctagaaacctctcaatctctcaaaatctcctccaaagctcagcaagcgccagccatactcgctcagcctgaaggtgaagacggtgcgcttagcgagttggctttcactcagcacctctatacaactcattcttcttccagaattgtccatgcgcttagccatcagttggggcgcttagcggatgatgcgcttagccagaagatgagtggcttagcgagttcaggaaatctgcacttcaccaatcttgcctatttaacctga

SEQ ID NO: 20682 - DNA, 1180 bp, Glycine max
  Peptide Sequence Number=SeqID_137460
gctgctgtcccttgggacggacgtgtggggtgctaataccttccctgtgcgtaaatacaactcccgagcctttcacttaaaagttcgtagatcgcgtcttttccggtttttccgacgttttcctcaaataaacgttggtggtgactccgcgcgtattcctttcgtggaacacgcatcccgcgagtcacgcgtcgccctcccgccgaaggagactaaagtcgtcatctgcaccctttgtcaactaggggcaagcgagcctgttgacacgcagagactaacgccatcttctgtacctttgtcatccagagacgacgactccgatgacaggcggagatacctaagtgagactaacatcgtcatctgcaccctttttcaaccatgggaaaccgagcccgttgacacgcagagactaatgtcatcttctgcacctttgtcatccagagacggcgagtccgatgacatgcagagatacctaagtgagactaacgtcgtcatctgcaccctttgtcaaccaggggcaagcgagctcgttgacacacacagactaatgtattcttctacatatttgtcatccagagacggaggaaggcgaagatacccaagtggttatccatacaaaatgatttctgttaatcctgacccgagaagtcaggtggtaggcagagatacccaagtggttatctgtataaacactcttttgctatccgtcaaactcaaagtctgggacggtgagtccgatgatagccggagatacccaagtgattatccgtacaaaatgatttatgttaatcctgaccctagaagtcaggaagcaggcggagatacccaagttgttatccagactaacgtcgtcatcttcaccctttgtcaaccatgggcaagcgagcctgttgacacgcagagactaacgtcgtcttctgcacctttgtcatccagagacggcgactccgatgataggcggagatacctaagtgacttaaagtccggtagcatccagagactaacgtcgtcatctgcaccctttgtcaaccatgggcaagcgagcccgttgacacgggcaagcgagcctgttgactcgcagagactaacgtcgtcttctacacctttttcatccagagacagcggaaatgccccaagtggttatctgtacaaacagacttctgttaatcctgacccgtga

SEQ ID NO: 20683 - DNA, 183 bp, Glycine max
  Peptide Sequence Number=SeqID_137461
atggttctatcactaccaaatgcaataagctcacagaaaatagttgctatgcatcagtatacttctactgatacagcagatctagtgaaccaaatcacccaccttggatacactcagtgtcccaaaacccatctatggcagcagaactccagtgcctactcgactttcaccaatggaatctga

SEQ ID NO: 20684 - DNA, 397 bp, Glycine max
  misc_feature (310)..(310): n is a, c, g, or t
  Peptide Sequence Number=SeqID_137462
atgcgttcatgggtgaggggtcagtggattccctttgacgcagatgccctcagccagttcctgggtgacccgctagttttggaggaaggccatcaatgtgaattcagccagaggaggaacagggccgacgggttcgacgaggaggccattgcccaactgttatgcacaccggggcaggatttcgcccggaccgctgcagggaggcgggtgcggattatgcgcactagcatgaccactttgacccagacgtggatgacactgctgctcaacaatgtcttgcctagcgatcataactccgatctccctctgnctaagtgtcagttggtgtatgccattctgacacggatgagcgtccacgaggcccaggtgattgctgatgccatctatttgtttgcag

SEQ ID NO: 20685 - DNA, 1893 bp, Glycine max
  Peptide Sequence Number=SeqID_137463
atggaattgcctgatacaatcagtacagccatgtataaggggagattctgcacgagtagtggagttaagtctcagcttggttatgttgaaaccgatccatctggtcgatatggccgcttcagggatgttctcggcaaaggagcaatgaagactgtgtatagggcatttgatgagttactagggattgaagtggcttggaaccaagtcaagcttggtgatgcctttcactcaccagagcaactccagcgcctttattcagaggttcatctccttaagcacctcaaccatgactctatgatgatcttctatggttcttggatcgatgtcagcaacagaaccttcaacttcgtcactgaattgttcacctccggcacccttagagagtataggcagaagtataagagagttgatatccgagcagttaagaattgggctcgccagattctaagtggtttggagtatttacacagccataatcctcctgtgatacatagagatctcaagtgtgacaacatctttgtcaatggccatcaggggagggtcaagattggtgacttaggcctggcagctatacttaaaagctcccaacatgcacacagtgtcatcggtaatacctcttgctctattttagcagttaaaataagcacaccagaattcatggcaccagaactgtatgaagagaaatacaacgagctgatagatatatactccttcggtatgtgcatgatagagatgcttacttttgagttcccatatagtgagtgcgccaacccagctcaaatatacaagaaagtcacttcggggaagctacctgaagcattttacaaaatcgaaaatttggaagcccaggagtttgtgggaaaatgtttgacaaatgtctcagagagaccatcagcgaaggagctcttgttggacccttttttagccatggaacaacttgaaattccattgccaccaagcataccagcattatttacaaataagtctttcaagcttaattgccctgcaccaattcccagtgaccatcgtgatcaaacaaagaacgcggatatgacaatcagcgggtcaataaacgaagagaacaacactgttttccttaaagtccggatatctgacataacggggcatacaagacatgtgttcttcccatttgacacattaaaggacacggctattcaggtggcaatggagatggtgcaagaacttgagattagccacttggagccattggagattgctgtaaggatagatcatgaggtatcagctctagttccaacttggagggacagggttaagtgtcaccaccaacgacagtacagctttaactacgaagaagatgaagatgtcaataaccatcaccctttcttcttatcatcttctccatcatcccctcgcggttctggccacatgtctgcttccaactccttcaagactcgtgttcgtggaaaccattacccttttactcaagaatggcctcaagatgatccgttcatggtcaacgacgacgcaagcccacaagcctcactgaactccttcaagtgttcgagtttccagttcttggacccgggccaggaagacgagcacgccccaacagatgcaaccgaacgcaccaagaagtgcacaccattatcgtaccgtaccgaagaaccagaacccaattacacgaaaccgtttaattactgccctcctcgtatggactcttgttcgtgtggttgcagcaggttcgggtcgagccacgcgtacccgaggctcacaaggatccggtcctgcccgcacgagcggaggagccagcagcagctgctgcaacggtcgatgatgttggaggagatgtacaagtacaagagacgcttcttcaacaacgttggcgccgttgagaacctcgtgtctagatga

SEQ ID NO: 20686 - DNA, 317 bp, Glycine max
  Peptide Sequence Number=SeqID_137464
atggagcactgcatattttacgtccaaactgaaagaggtcccctatcatttgacgcaggtccagagaacatagttgtcaccgttggcaaacagctagaggggtggagccatggtgtattcaaatgtgttcctggggaaatgatcttcatgccgagtttccagagtagccctgcctctttctccatagagcttgcaacacttgcgccaacaattgctgacaagcttccttcttttagtgttcaaaatctagagtatacttactcgaattcctcacccctttcatttgtgagtagctccttaggtaccgataggagtgg

SEQ ID NO: 20687 - DNA, 306 bp, Glycine max
  Peptide Sequence Number=SeqID_137465
atggtgatcttcttatatattgcattggtgagagaagagaagttggaatgcttgacacaggaaattaaaggaataatattgtttcaagttggaagggaaaagtttttaatcccgtggcttcttgtggtgaatcggaaaagtacagaggttccaatgatcgaagtagatctgaggtattcaggaaatgatttgcatggtgtcacagctaaagttgtggatatgcctcatcactgtatgttgttcttctctaatcatatttttaaaaacattaagttctatacatataggctggtaactgggttgtga

SEQ ID NO: 20688 - DNA, 186 bp, Glycine max
  Peptide Sequence Number=SeqID_137466
atggcacacaaaccgaggcaggattttagcgtttcaaagccccgacacttttcagatagctctctctctccctcacgttgccattttcttcttcttcattctccattgaagctccaagcaaagcttcaacctttggccatcatttctgctccaaatcgcgaaaggagggcatttccggagtcgtga

SEQ ID NO: 20689 - DNA, 207 bp, Glycine max
  Peptide Sequence Number=SeqID_137467
atgtcaggatttacacgcaattctcctcaaatttcagccagcccgcatcaattagaccttgcaccttacgcttcagagccctacaatgctcaatggaacgccccggggcttctccgtgacaaacacacgttgcgttcgagtcgtattctcggagaaatggaggtggtcttcgtcattggaagtgcggtagacaggctttgtggttga

SEQ ID NO: 20690 - DNA, 1368 bp, Glycine max
  Peptide Sequence Number=SeqID_137468
atgagcgtagcggtagtgaacagcttcaccataacagagttcgtaaatgacaaggctaagtttgatggtttcgtgaatgaatggtttgcgaggatagatgagaatggcgatgggaagctttcgcgtgacaaaatccgagggaggttagggatgctcttgcctttcggttcggagttgcagccacagcaagagaacgaagagatattcaaaaggttcgatgaagatgggaatggtgcacttgatctgaaggagttcaaggccttaatgaccgagattatgaatgccgctgctcgtagcattggtggctctcccgtcattgtgcttcttggaaaagatagcttgctcatgaaggctgttcaacatgaattggcaactcgctcttctcattcttaccaacccaacacaccttcaagctcaagcaccactcaagtgccacaaaacctagtaacatgcatataccaaactcaactttgcaactcctccacgcacctcaccctcacgtggtccagaacccttctctctcactccttaaccatttatgcacctcacaccttctccatcaccattcctctcaacccttcaactttctccttcttccgaactcgaccaggatccaaatccatctacctcactcgccccaacaaacgttctcagaaaatcaaacttcactgggacttctctgaagcaatttttagtactcggaactcagctgagcctgagtcacgcttctaccttgcagtctgctgcaatggcagggttgaattctttctgggtgatcttgttcttgttcttcccatgcagctttcacctcaccaaccaagtgaccaagctcttgtgtcgagaagagaacacgtgtttggaagcacgagttacgagtcaaggggtgagttcgtgggttcaaaacgcgaaatagagattgaattgttcagtggagaagaactgagagtgaaagtggatggtcaagtttgcttggtggtgaaaaggctgacgtggaaattcagaggcaacgagaaaatcttcattgatggcgttgaagtagagttcttctgggacgtgttgaattgggtgtttaatagtgaaaatggcaatggcaacaatggttatggtgtttttgtgtttcaagttggtgatggtggcgccgtgtggcctgaaatggtggggccagagaagaagttgatgaagaagaggttggtgggacccactatggtgccttcggtggtaacaacgtcaccgtcgagctccagtgtgttgcagtggacggaggagagcagtgatggtgggaggagttcgtgctcttcatcaacaaggtcgtgtgggagtagtaatggtggtttctctttgttgctctatgcttggcggagagactag

SEQ ID NO: 20691 - DNA, 480 bp, Glycine max
  Peptide Sequence Number=SeqID_137469
atgaacagagaaagtgaaacacctcagatattgaaaatagcaatgagtggagtgacggagctcttgaggcttttctctccttcttccaatcaaacaagacttgagaaacacagagatgaattcccagcttcaagcgtcgatgatgttctaaggatcatccagtctgatcaccacaacgcttatttcttaacagggaacttcacttcttcaatttatgctgagaactgtatctttgaagacccaactattaaatttcgtggtagggagttatatgcgcgcaacttgaaattgcttgttcccttctttgactgtggatcaattatactacaaaagattgacaagatgatggagatttcacttttcagtggctcttgggaatctggggcaattaataatttaatatccaccaactcattcatgaatggagccacaccaccccaacctaaagagggtttaagcacccaagcagaaggaacatga

SEQ ID NO: 20692 - DNA, 249 bp, Glycine max
  Peptide Sequence Number=SeqID_137470
atgctgaagagctcgctgagcgagccagattcgctaagcgaggcgaacccgcttagcgtggaagagagctcgcccagtgcgaagaagaaccctagagaatacaagtcagaaagcaacacgctcagtgcgcagccagctcgcccagtaaagcttttgtcgcttcttgcgcttagtgcgtccacgttcgctcagcgtccattcactaactctcaatcaacaagacattactcactgagcgtgccttcataa

SEQ ID NO: 20693 - DNA, 486 bp, Glycine max
  Peptide Sequence Number=SeqID_137471
atggaaactacacagaatgttcttacctgggaaaaagacacgtcgaagtttcgaggaacttttatgttccgtgtggttcaacgcggtcgtgaactgaaaagtagaaaaagcaacaagacacaacagaaaagttttggttctgtggaatttgagtgcaagacgtgcaaccgcaagttctcttcttttcaagcactgggagggcacagggcaagccacaagaggcagaagctggagggggaagaactgaaagaacaggccaaaagtcttagcttgtggaacaaacccaaaatgcacgagtgctccatttgtggccttgaattctctctgggccaggctctgggtggccacatgagaaaacacagagcttccctcaacgaagggtttcctattattccttctatcgaccaagttattgcgaaaatcccggttttgaaaaggtcgaatagcaccagggttatgtgcttggacttggagttacacctgtag

SEQ ID NO: 20694 - DNA, 504 bp, Glycine max
  Peptide Sequence Number=SeqID_137472
atgacctgtgataatagatcaaatttcgtcggcaccacccaccgccacgccgacgaccttcattcgctgtcggcaacacatcccttctgctgcgtcttcgtcgtctctgaccactcctccctggtcaagcttcgccgacctcatctagcccctctccccgtcgccatagcgagatccgtcgtgagatccagtccgtttctctctatcatttttctgattttttttccagatctgagattagctcctcccagatctgagattcgttcctcccttggtgtcctccttttccgcctcgtcctcgtcggtaactccattgacgtcgtcactgcgagatctagacccgctcctcgctgccgcctccacacgattgcttcaggaaccgctttccctttatttgttgtggagaatttggctgggaaaatgtctttgttgccaaggagaaagtgttctaatgaaggtagaatccagttgagcagagaagagcctggtggtggtggccggtag

SEQ ID NO: 20695 - DNA, 2334 bp, Glycine max
  Peptide Sequence Number=SeqID_137473
atgggagtgccagcgttttaccggtggctcgccgaccggtacccgctctccatcgccgatgtcgtcgaggaagaccccgccgtcggcgacgacggcgttccgtttccaatcgacgcgtctaaacctaatcccaacggcatggagttcgacaacttgtacttggacatgaacggcatcattcacccttgttttcaccctgacggcaagccggcacctgctacctacgatgatgtgttcaaatcaatatttgattaccttgaccatctctatacgttggttcgtccaaggaagcttctctaccttgcaattgatggtgttgcaccaagagccaaaatgaatcagcagcgttctcggcgcttccgagctgcaaaggatgcagctgaggctgaagctgaagaggaaaggctgaggaaagaatttcagagtgagggaaaagttttgtcttctaaagacaagcctgagacttcagactcaaatgtcattacccctggaactcaatttatggtagcactgtcagtatctctccagtattatatacagactagattgaaccacaaccctagctggcggaataccaaggttatactgtctgattcaaatgcacctggtgaaggagaacataaaataatggaatacatccggttacaacgcaaccttcctggtttcaatccaaatactcgtcattgtttgtatgggttggatgctgatttgattatgctctccttagctacacatgaggttcacttctcaatattgagggaggtagttactttacctggtcaacaggataagtgttttttgtgcggccaagctggccattttgcagctgattgtcaagctgaggattttgatactcctgatgatagcccaattcacaagaagaaatatcagtttcttaacatctgggtgctgcgtgaatatttgcaatttgaattggagatacccaaccctccttttgagattgactttgaacgagtagtggacgattttgtatttctatgcttctttgttggcaatgattttcttccgcacatgccaacattagagatcagggagggggctataaatttattgatgcatatatatagaaaggaatttactgccataggtggttatcttactgatgcgggcgaggttttcttagatagagtgcaacgatttatccagtttgttactgttcacgaagatcaaatctttcagaaacgagttcgcattcagctggctgccgaaaataatgaagagatgagagctagggcaagaggagaaatgcctggagaaccacgagcctcgcttttggataagtttctagagcatgttttggaatccaccataattgcttttctgaactgccaaagtaattcttctggtgttcccaaacacactctaagggttaaattaggggagcctggatacaaggaaagatattatgttgaaaagtttggtgtatcaaatctcgaggagattgataaaattaagaaagatattgtcttgaaatatgtggaaggcctttgttgggtttgccggtattattaccagggtgtttgctcatggaaatggtactacccatatcattatgctccatttgcttctgattttaaagatctacctgatctggaaataaatttcttcccaggagagccatttaaaccatttgatcagctcatgggcaccctacctgcttcaagttcaagtgcactgcctaagaaatatagggatttgatgagtgatccttcatcacctatttttcacttctaccctgctgattttgagattgatatgaatggaaaacgatttgcatggcagggtgttgccaagctgccatttattgatgagaagaaattgcttgctgccacaagaaggattgaagatacattaacggaggaagaacaacttcggaatagtgtgatgcttgatttgctatatgtcaatcgtgcacataatttggctgcacatatcttatcatattaccatgtttgtagtcaattacccccacatgaaagatgtgttcagccaattgacacaaatgctagtggcgggatgaacggatatctttggttatgtgaaagaaatgttttcagctctgttatatcttctcccatcagtggattgcaagacattgaatataaccaagtcttaaatattacatttcttaaccctcgtagacacgatcatatcccaaaacctccagatggtgtagtaatacccaaaaaggtattaaaagccattgatattaaaccttttcctgtgctatggcatgaggacaatattggtcaaagacagcaagcaagagaaagcatgagaactgagcccaacaatggaatagctaccaaatag

SEQ ID NO: 20696 - DNA, 243 bp, Glycine max
  Peptide Sequence Number=SeqID_137474
atgtcgttgagcatttgcggcaaggttcgaggagaaggggcggccgctgacggtggcctcctgggcgtggcggacgcgcacggcgacgacaactcgcgggtgccgcaacaaatcagagagaagtggggttttgagagggaaaacattgaattagggaatgagcttggtcggtgggggcacaatggtagtgattttcatcagagaaggagaagagtggagaaaggaaagaaggtattgagttaa
